United States Patent 8,586,006 (ORGAN-SPECIFIC PROTEINS AND METHODS OF THEIR USE) - sequence listing, part 20

SEQ ID NO: 61300 - DNA, 4165 bp, Homo sapiens
gagacagggaaggtttcctttcctcattagaaggactccagtgatctgtggaatgagcactacagtatccttttaaattttcacccacaagacaaagccagtatgcagtgaaatgaggaaatgcctttaagtgaagagatttttatttctttcataaattgctcaagccatgattggatggaggtcctccaggtagctccatggactttaacaagtctattgaataactgcatttgagttggaagctgagttgcctgaacacaaacgatttaaaccagattagaaagtgtctacatacagagctcaataacacactcggaatcttcttgggaggacccacagactgtacctatattacttttgacctaggtggatgcagtcactctctagaagcctccccgacttcagatgtgtggcacacatccacacaggggtgtaggtaggagaagcccacaggaatggctctgcagatgttcgtgacttacagtccttggaattgtttgctactgctagtggctcttgagtgttctgaagcatcttctgatttgaatgaatctgcaaattccactgctcagtatgcatctaacgcttggtttgctgctgccagctcagagccagaggaagggatatctgtttttgaactggattatgactatgtgcaaattccttatgaggtcactctctggatacttctagcatcccttgcaaaaataggcttccacctctaccacaggctgccaggcctcatgccagaaagctgcctcctcatcctggtgggggcgctggtgggcggcatcatcttcggcaccgaccacaaatcgcctccggtcatggactccagcatctacttcctgtatctcctgccacccatcgttctggagggcggctacttcatgcccacccggcccttctttgagaacatcggctccatcctgtggtgggcagtattgggggccctgatcaacgccttgggcattggcctctccctctacctcatctgccaggtgaaggcctttggcctgggcgacgtcaacctgctgcagaacctgctgttcggcagcctgatctccgccgtggacccagtggccgtgctagccgtgtttgaggaagcgcgcgtgaacgagcagctctacatgatgatctttggggaggccctgctcaatgatggcattactgtggtcttatacaatatgttaattgcctttacaaagatgcataaatttgaagacatagaaactgtcgacattttggctggatgtgcccgattcatcgttgtggggcttggaggggtattgtttggcatcgtttttggatttatttctgcatttatcacacgtttcactcagaatatctctgcaattgagccactcatcgtcttcatgttcagctatttgtcttacttagctgctgaaaccctctatctctccggcatcctggcaatcacagcctgcgcagtaacaatgaaaaagtacgtggaagaaaacgtgtcccagacatcatacacgaccatcaagtacttcatgaagatgctgagcagcgtcagcgagaccttgatcttcatcttcatgggtgtgtccactgtgggcaagaatcacgagtggaactgggccttcatctgcttcaccctggccttctgccaaatctggagagccatcagcgtatttgctctcttctatatcagtaaccagtttcggactttccccttctccatcaaggaccagtgcatcattttctacagtggtgctcgaggagctggaagtttttcacttgcatttttgcttcctctgtctctttttcctaggaagaaaatgtttgtcactgccactctagtagttatatactttactgtatttattcagggaatcacagttggccctctggtcaggtacctggatgttaaaaaaaccaataaaaaagaatccatcaatgaagagcttcatattcgtctgatggatcacttaaaggctggaatcgaagatgtgtgtgggcactggagtcactaccaagtgagagacaagtttaagaagtttgatcatagatacttacggaaaatcctcatcagaaagaacctacccaaatcaagcattgtttctttgtacaagaagctggaaatgaagcaagccatcgagatggtggagactgggatactgagctctacagctttctccataccccatcaggcccagaggatacaaggaatcaaaagactttcccctgaagatgtggagtccataagggacattctgacatccaacatgtaccaagttcggcaaaggaccctgtcctacaacaaatacaacctcaaaccccaaacaagtgagaagcaggctaaagagattctgatccgccgccagaacaccttaagggagagcatgaggaaaggtcacagcctgccctggggaaagccggctggcaccaagaatatccgctacctctcctacccctacgggaatcctcagtctgcaggaagagacacaagggctgctgggttctcagatgatgacagcagtgatccaggatccccatccatcacgttcagcgcatgctctcggatagggtcacttcagaagcaagaggcacaagaaataataccaatgaagagcctacacagaggaaggaaggcattcagctttggttatcaaagaaacacaagccaagaagagtacttgggtggagtaaggagggtggccttaagacccaaacctctgtttcatgcagtggatgaggagggtgagtctggaggggagagtgagggcaaggcctctttggttgaggttcggtcgaggtggacagctgaccatggacacagcagggaccatcacaggtcccatagtcctttgctccaaaaaaaatagtgttattgtccacaggattgttttggtgtttctcgagagtctgtcttcctataactgtgaaaggaggatttctggaattcagaagagagctattgagtttgctgtgttgaagctattaaacatggatctataagcagcaggaagattttttccaaggactgggagcaaacttgcaggctctgccatgtacttattgtggggtacctttagatgaattccctgtgagtgagagaagttgatcaccccaggaattagtcactaagaattcctaagaactttctatcaaaagcattggatccaagccatatattgaaatacaagcgtgattaatcagtaattcacattgccgatatgcatatgcaacttataatcaaatagaactagaagagactttgaagtcacctgactcagccccttgtgtttacagacaaggacatgtagtccaaggttgcatggtgagttcacagtcggattgtcctccctccaaactgaaactaatttgattttgatttcatattcaatatgcaataattatgttctatcagagatacaatttgttatgaatttgctttatttaatcagtagcaatgatagatgtgatgcatactataggattaatctgtgaacaatgggtttacggtctatttcataattgaaatatttattttaaaaatgaatattagaaacaaaacagccataaacagagtttaatagcaatgatgttaacaacaagtatttataaggggtgcatttgtagggtgtgacattttaccctagggtataaaactatttttcttttattattattattattattattatactttaagttttagggtacatgtgcacattgtgcaggttagttacatatgtatacatgtgccatgctggtgtgctgcacccgctaactcgtcatctagcattaggtgtatctcccaatgctatccctcccccctccccccaccccacaacagtccccagagtgtgatgttccccttcctgtgtccatgtgatctcattgttcaattcccacctatgagtgagaatatgcggtgtgtggttttttgttcttgggatagtttactgagaatgatgatttccaatttcatccatgtccctacaaaggacatgaactcatcattttttatggctgcatggcattccatggtgtatatgtgccacattttcttaatccagtctatcattgttggacatttgggttggttccaagtctttgctattgtgaataatgccgcaataaacatacgtgtgcatgtgtcgcaaaaaaaaaaaaaaaaaaaaaaaaaaaa

SEQ ID NO: 61301 - DNA, 508 bp, Homo sapiens
atccctgactcggggtcgcctttggagcagagaggaggcaatggccaccatggagaacaaggtgatctgcgccctggtcctggtgtccatgctggccctcggcaccctggccgaggcccagacagagacgtgtacagtggccccccgtgaaagacagaattgtggttttcctggtgtcacgccctcccagtgtgcaaataagggctgctgtttcgacgacaccgttcgtggggtcccctggtgcttctatcctaataccatcgacgtccctccagaagaggagtgtgaattttagacacttctgcagggatctgcctgcatcctgacgcggtgccgtccccagcacggtgattagtcccagagctcggctgccacctccaccggacacctcagacacgcttctgcagctgtgcctcggctcacaacacagattgactgctctgactttgactactcaaaattggcctaaaaattaaaagagatcgatattaaaaaaaaaaaaaaaaaa

SEQ ID NO: 61302 - DNA, 2047 bp, Homo sapiens
agagcatgatggggcacgcgcggtagcgcgaggcggggcatgtaaccatagcgtgcgggtcatgatgaggcacggacgtggggggttaggtggggcacgtaattggagctcgcggggcaggatggggcatctagctggagcgacagagagcacgatggggcacttacaggggccggaggctggcccgggcagtgagtgtggatggcttggcaggtgagcctgctggagctggaggactggcttcagtgtcccatctgcctggaggtcttcaaggagcccctgatgctgcagtgtggccactcttactgcaagggctgcctggtttccctgtcctgccacctggatgccgagctgcgctgccccgtgtgccggcaggcggtggacggcagcagctccctgcccaacgtctccctggccagggtgatcgaagccctgaggctccctggggacccggagcccaaggtctgcgtgcaccaccggaacccgctcagccttttctgcgagaaggaccaggagctcatctgtggcctctgcggtctgctgggctcccaccaacaccacccggtcacgcccgtctccaccgtctacagccgcatgaaggaggagctcgcagccctcatctctgagctgaagcaggagcagaaaaaggtggatgagctcatcgccaaactggtgaacaaccggacccgaatcgtcaatgagtcggatgtcttcagctgggtgatccgccgcgagttccaggagctgcaccacctggtggatgaggagaaggcccgctgcctggaggggatagggggtcacacccgtggcctggtggcctccctggacatgcagctggagcaggcccagggaacccgggagcggctggcccaagccgagtgtgtgctggaacagttcggcaatgaggaccaccacaagttcatccggaagttccactccatggcctccagagcagagatgccgcaggcccggcccttagaaggcgcattcagccccatctccttcaagccaggcctccaccaggctgacatcaagctgaccgtgtggaaaaggctcttccggaaagttttgccagccccggagcctctcaagttggaccctgccactgcccacccactcctggagctctccaagggcaacacggtggtgcagtgcgggcttctggcccagcggcgagccagccagcctgagcgcttcgactacagcacctgcgtcctggccagccgcggcttctcctgcggccgccactactgggaggtggtggtgggcagcaagagcgactggcgcctgggggtcatcaagggcacagccagccgtaagggcaagctgaacaggtcccccgagcacggcgtgtggctgatcggcctgaaggagggccgggtgtacgaagcctttgcctgcccccgggtacccctgcccgtggccggccacccccaccgcatcgggctctacctgcactatgagcagggcgaactcaccttcttcgatgccgaccgccccgatgacctgcggccgctctacaccttccaggccgacttccagggcaagctctaccccatcctggacacctgctggcacgagaggggcagcaactcgctgcccatggtgctgcccccgcccagcgggcctggccccctcagccccgagcagcccaccaagctgtagggccgcccggagtcctgccggcccacaggcccatcccggcggggcaccggggactcgcgggcttctgctgggtcccgcctgaggtgatatcgtcactgtttaggaaggtcttcaggcctgtgtgtccctggaacatgtaatgatagggaacaggaccccagtccctttcccctcagccaagggtgtatttgtaaacttcggcccccaggccttggcagccagggacacactgaaatccccatggttcctgccacttgctaaccatgctatctgcgcagacgcttccgagggcagaaatagtcccatgtataccttttccatattactgtgaactttcaactactatcaaggataataaatttgacattatttctttctcttt

SEQ ID NO: 61303 - DNA, 1138 bp, Homo sapiens
cccttccctgcccgacacccagaccgaccttgaccgcccacctggcaggagcaggacaggacggccggacgcggccatggccgagctcccggggccctttctctgcggggccctgctaggcttcctgtgcctgagtgggctggccgtggaggtgaaggtacccacagagccgctgagcacgcccctggggaagacagccgagctgacctgcacctacagcacgtcggtgggagacagcttcgccctggagtggagctttgtgcagcctgggaaacccatctctgagtcccatccaatcctgtacttcaccaatggccatctgtatccaactggttctaagtcaaagcgggtcagcctgcttcagaacccccccacagtgggggtggccacactgaaactgactgacgtccacccctcagatactggaacctacctctgccaagtcaacaacccaccagatttctacaccaatgggttggggctaatcaaccttactgtgctggttccccccagtaatcccttatgcagtcagagtggacaaacctctgtgggaggctctactgcactgagatgcagctcttccgagggggctcctaagccagtgtacaactgggtgcgtcttggaacttttcctacaccttctcctggcagcatggttcaagatgaggtgtctggccagctcattctcaccaacctctccctgacctcctcgggcacctaccgctgtgtggccaccaaccagatgggcagtgcatcctgtgagctgaccctctctgtgaccgaaccctcccaaggccgagtggccggagctctgattggggtgctcctgggcgtgctgttgctgtcagttgctgcgttctgcctggtcaggttccagaaagagagggggaagaagcccaaggagacatatgggggtagtgaccttcgggaggatgccatcgctcctgggatctctgagcacacttgtatgagggctgattctagcaaggggttcctggaaagaccctcgtctgccagcaccgtgacgaccaccaagtccaagctccctatggtcgtgtgacttctcccgatccctgagggcggtgagggggaatatcaataattaaagtctgtgggtaccaaaaaaaaaaaaaaaaaa

SEQ ID NO: 61304 - protein, 1035 aa, Homo sapiens
MGKAENYELYSVELGPGPGGDMAAKMSKKKKAGGGGGKRKEKLENMKKEMEINDHQLSVAELEQKYQTSATKGLSASLAAELLLRDGPNALRPPRGTPEYVKFARQLAGGLQCLMWVAAAICLIAFAIQASEGDLTTDDNLYLAIALIAVVVVTGCFGYYQEFKSTNIIASFKNLVPQQATVIRDGDKFQINADQLVVGDLVEMKGGDRVPADIRILAAQGCKVDNSSLTGESEPQTRSPECTHESPLETRNIAFFSTMCLEGTVQGLVVNTGDRTIIGRIASLASGVENEKTPIAIEIEHFVDIIAGLAILFGATFFIVAMCIGYTFLRAMVFFMAIVVAYVPEGLLATVTVCLSLTAKRLASKNCVVKNLEAVETLGSTSVICSDKTGTLTQNRMTVSHLWFDNHIHTADTTEDQSGQTFDQSSETWRALCRVLTLCNRAAFKSGQDAVPVPKRIVIGDASETALLKFSELTLGNAMGYRDRFPKVCEIPFNSTNKFQLSIHTLEDPRDPRHLLVMKGAPERVLERCSSILIKGQELPLDEQWREAFQTAYLSLGGLGERVLGFCQLYLNEKDYPPGYAFDVEAMNFPSSGLCFAGLVSMIDPPRATVPDAVLKCRTAGIRVIMVTGDHPITAKAIAASVGIISEGSETVEDIAARLRVPVDQVNRKDARACVINGMQLKDMDPSELVEALRTHPEMVFARTSPQQKLVIVESCQRLGAIVAVTGDGVNDSPALKKADIGVAMGIAGSDAAKNAADMILLDDNFASIVTGVEQGRLIFDNLKKSIAYTLTKNIPELTPYLIYITVSVPLPLGCITILFIELCTDIFPSVSLAYEKAESDIMHLRPRNPKRDRLVNEPLAAYSYFQIGAIQSFAGFTDYFTAMAQEGWFPLLCVGLRAQWEDHHLQDLQDSYGQEWTFGQRLYQQYTCYTVFFISIEVCQIADVLIRKTRRLSAFQQGFFRNKILVIAIVFQVCIGCFLCYCPGMPNIFNFMPIRFQWWLVPLPYGILIFVYDEIRKLGVRCCPGSWWDQELYY

SEQ ID NO: 61305 - protein, 291 aa, Homo sapiens
MAALQEKKTCGQRMEEFQRYCWNPDTGQMLGRTLSRWVWISLYYVAFYVVMTGLFALCLYVLMQTVDPYTPDYQDQLRSPGVTLRPDVYGEKGLEIVYNVSDNRTWADLTQTLHAFLAGYSPAAQEDSINCTSEQYFFQESFRAPNHTKFSCKFTADMLQNCSGLADPNFGFEEGKPCFIIKMNRIVKFLPSNGSAPRVDCAFLDQPRELGQPLQVKYYPPNGTFSLHYFPYYGKKAQPHYSNPLVAAKLLNIPRNAEVAIVCKVMAEHVTFNNPHDPYEGKVEFKLKIEK

SEQ ID NO: 61306 - protein, 2483 aa, Homo sapiens
MGAEDNFYLRNLPPQPTLLPANHNFPSVARAAPAHPMGSCSRDRDRGEAGSLQKGPKDFDRFLVGKELGREKAGKAAEGKERPAAEEDGGKERHKLVLPVPADGHCREGGPAPRGACEGRPKHLTSCLLNTKVLNGEMGRAALASCAGGMLGRPGTGVVTSGRCAKEAAGPPEPGPAFSECLERRQMLHHTASYAGPPPPLSTAAGSFPCLQLHGGPDGLCPLQDKAPRDLKASGPTFVPSVGHLADKGRPFQAAEACAVAGEGKDRHLEGTMAPDHAAPYGVSYAHLKAEGKGERRPGGFEAALNPRLKGLDYLSSAGPEASFPGLPKSGLDKSGYFELPTSSQDCARPGHQDPLGGKAPQACCTLDKTVGKEAPAGPPGAQKVARIRHQQHLMAAEVEQGGIGAEAKRKSLELASLGYSGPHLPPWGVQAGQGTAMAISEERKAGAYLDPFGSGLQQAALLPQELPAPPDEVSAMKNLLKYSSQALVVGQKAPLVGLGGLKASCIQQEAKFLSSKGPGQSERPDCARSREHDTTHGDGEVRQPPVGIAVALARQKDTVSRSEAAYGTNTARQGRAAPAFKGGGGPRSTHALDLEAEEERTRLCDDRLGLASRELLLQDSKDRVEFARIHPPSSCPGDLAPHLMMQSGQLGGDPAPHTHPHPPWLPRTRSPSLWMGGHSYGLGHPALHQNLPPGFPASVAGPVPSVFPLPQDAPTQLVILPSEPTPHSAPHALADVMDQASLWPPMYGGRGPASHMQHPGQLPVYSRPQLLRQQELYALQQQRAAQFQRKPEDQHLDLEEPAQEKAPKSTHKPVALTPTAPGAPSPAAGPTKLPPCCHPPDPKPPASSPTPPPRPSAPCTLNVCPASSPGPGSRVRSAEEKNGEGQQSTADIITSEPVARAHSVAHAGLEFLASNDPSTSASQSFGITDLPPGYLRPMAGLGFSLPSDVHSSNLEDPETMQTTAPGAQPEPTRTFLPGEPPPCSPRSLEEPGLLSGAREATQDLAATPYPTERGPQGKAADPSPLEGLQELQCAALLEAGGPEATGQAHSTQGGAREERSREEGEQGPSSGASSQVLEQRAGSPGALEDEGEQPAPEEDELEEDELGQQSMEDSEEDCGGAPDNSHPPRALPGLDALVAATINLGDLPSDSPPDPQPPAASGPPSTVPLPHSSGIHGIALLSELADLAIQRQRSERTVPEEEEDVLAFNLQHLATLATAWSLVEAAGLDSSTAPAQPPTANPCSGPRLTPRMQILQRKDTWTPKTKPVCPLKAAIDRLDTQEVGMRVRLAELQRRYKEKQRELARLQRKHDHERDESSRSPARRGPGRPRKRKHSSSLPAPRPTGPLPRSDGKKVKAVRTSLGLLCAELRGGSGGEPAKKRSKLERSVYAGLQTASVEKAQCKKSSCQGGLAPSVAHRVAQLKPKVKSKGLPTGLSSFQQKEATPGGRIREKLSRAKSAKVSGATRHPQPKGHGSRETPRCPAQPSVAASQEAGNGYDSEDCEGLLGTEAPPREAGLLLHTGASVAVLGPSPSSVVKMEANQKAKKKKERQGLLGACRLSSPESEVKIKRRSVKAKVGTTLERAPGQRPPGALGKKKAKGKAKGSLRAEPGATPSRDALFNPSRAFACREEGSQLASERLKRATRKGTVLQPVLRRKNGALSITLATRNAKAILGKGRKLSKVKHKAGKQGKGRAVSRLLESFAVEEDFEFDDNSSFSEEEEDEEEEEEDSGPLSAEQSAALARSCAIHKEDLRDGLPVLIPKEDSLLYAGSVRTLQPPDIYSIVIEGERGNRQRIYSLEQLLQEAVLDVRPQSSRYLPPGTRVCAYWSQKSRCLYPGNVVRGASGDEDEDLDSVVVEFDDGDTGHIAVSNVRLLPPDFKIQCTEPSPALLVSSSCRRTKKVSSEAPPPSEAATPSLSPKAQDGPEALKTPGKKSISKDKAGKAELLTSGAKSPTGASDHFLGRRGSPLLSWSAVAQTKRKAVAAASKGPGVLQNLFQLNGSSKKLRAREALFPVHSVATPIFGNGFRADSFSSLASSYAPFVGGTGPGLPRGAHKLLRAKKAERVEAEKGGRRRAGGEFLVKLDHEGVTSPKNKTCKALLMGDKDFSPKLGRPLPSPSYVHPALVGKDKKGRAPIPPLPMGLALRKYAGQAEFPLPYDSDCHSSFSDEDEDGPGLAAGVPSRFLARLSVSSSSSGSSTSSSSGSVSTSSLCSSDNEDSSYSSDDEDPALLLQTCLTHPVPTLLAQPEALRSKGSGPHAHAQRCFLSRATVAGTGAGSGPSSSSKSKLKRKEALSFSKAKELSRRQRPPSVENRPKISAFLPARQLWKWSGNPTQRRGMKGKARKLFYKAIVRGEETLRVGDCAVFLSAGRPNLPYIGRIESMWESWGSNMVVKVKWFYHPEETKLGKRQCDGKNALYQSCHEDENDVQTISHKCQVVAREQYEQMARSRKCQDRQDLYYLAGTYDPTTGRLVTADGVPILC

SEQ ID NO: 61307 - protein, 2451 aa, Homo sapiens
  VARIANT 884,921,926,938,1056,1065,1140,1154,1163,1281,1371,14661468,1531,1533,1598,1606,1678,1734,1751,1815,1818,1828: Xaa = Any Amino Acid
  VARIANT 1846,1862,1873,1878,1879,1905,1911,2029,2047,2370,2393,2412,2444: Xaa = Any Amino Acid
MGAEDNFYLRNLPPQPTLLPANHNFPSVARAAPAHPMGSCSRDRDRGEAGSLQKGPKDFDRFLVGKELGREKAGKAAEGKERPAAEEDGGKERHKLVLPVLNGEMGRAALASCAGGMLGRPGAGVVTSGRCAKEAAGPPEPGPAFSECLERRQMLHHTASYAGPPPPLSTAAGSFPCLQLHGGPDGLCPLQDKAPRDLKASGPTFVPSVGHLADKGRPFQAAEACAVAGEGKDRHLEGTMAPDHAAPYGVSYAHLKAEGKGERRPGGFEAALNPRLKGLDYLSSAGPEASFPGLPKSGLDKSGYFELPTSSQDCARPGHQDPLGGKAPQACCTLDKTVGKEAPAGPPGAQKVARIRHQQHLMAAEVEQGGIGAEAKRKSLELASLGYSGPHLPPWGVQAGQGTAMAISEERKAGAYLDPFGSGLQQAALLPQELPAPPDEVSAMKNLLKYSSQALVVGQKAPLVGLGGLKASCIQQEAKFLSSKGPGQSERPDCARSREHDTTHGDGEVRQPPVGIAVALARQKDTVSRSEAAYGTNTARQGRAAPAFKGGGGPRSTHALDLEAEEERTRLCDDRLGLASRELLLQDSKDRVECARIHPPSSCPGDLAPHLMMQQRPAGRGPSPPHPPPSPLAAPHPQPLPVDGGALLRPGAPCPAPEPAPRLPRLRGWPCALCLPPPTGRPHTAGHPALRAHTPQRPPRTCGCHGPGVTVAPHVRGPGPRLSHAAPGPAPCVLEAAAPPAAGALCFAAAEGRPVPAEARRPAPGSGGARPGEGPKVHPQASCLNPHGPGRPLTRCRPHQAATLLPSARPKAPRQLPHPTTSAQRPVHFKCLPCQQPRAWLPGAQRRGKEWGGSAVHGRHHHIRTSGTCSLCCPRWSRIPGLKXSIHLSLPKFWDYRPASRIPAPHGWPGLLPTLRRALFXPRGPXNYANHRPGGPAXAHKDIPAWGAASLQPQEPGGARAALRGQGGHPGPCRHPLPCRAGTPGEGSGPQPTRGATRTAMCGPPGGRGPRGHRPGSFYSGRGTRREEQGGGGAGALVRGLLPSPGAASRESGCPXGRGGAAGPXGGRAGGRRAGAAEHGGLRGGLWRSSRQQPPTQGATRPGCLGGRHHQPGGPAQRQPTGPSAPSGLWAPQHSPPASXLRDSWDRSAQRAGXPGNPAAEEXEDCARGGRGRASLQPAAPGHAGHSLVPGGGRWPGQLHCPSAAAHSQPLQRPQAHPPHADPAAQGHLDPQDQACVPPEGRHRPAGHAGGGDARAAGGAAAALQGEAAGAGPPAAQARPXERREFTEPCTAGAWPAEEAQTLKLAACPTSHGAAPQERWQESQGGADKPGSAVCGAARRQWGRACEEAKQAGEERLCGPADCLRGEGAVXEEQLSGRAGALRGPQGGPAETQGQEQRAAHRPQLFPAEGGYPRGAHPGEAVPSQECQGVWGHTAPTAQGPRQPGDTQVPSPALRGCVPGGRQWLXQXGLRGSPGDRGTTQGSRAAAARRGQCGRVGALTLLCGQDGGQPEGQEEEGEAGVARGLPPVQPXEXGQDQEAVGEGQGGHHPGAGPRAEAPRCAGQEESQGQGQGQPAGRAGGHPQQGRPLQPLSGLRLPXGGQPAGQXAPQEGHAQGHSAAASAAAEERGPVHHAGHTQRQGHPGEGPEAEQGEAQGRQAGQGPGREPPAGKLRRGGRLXVRRQQQLLGRGGGRGGRGGGQRPSERRAERRPSALVCHPQGGPAGRAARAHPQGGXPAVRGQRQDPAATRHLXHRHRGREGQPAEDLLTGAAAAGSGSRCAATVQPVPPARHAGLRLLESEVSMSVPGQRGPGGLRXRRXGPGLSSGGIXRWGYRPHRRLQRQAAAPXLQDPVHRALSSPASVXQLPEDQEGIQXGTPAXXSRHPQPVPQSTGRPRSFEDTWEKIHXQRQSWXSRTPNLRCQIPHGGLRPLPGPPWQPLAELVRGGADQAEGGGSGQQGAGGAAEPLPAQRQQQEAAGPRGPVPRAQRGHTHIWQRLPRRLLQQPGQLLRALRRGDRAGPPQGSPQAAAGXEGREGGGREGWAAAGGRXVPGQAGPRGCDLPQEQDLQGVAHGGQGLQPQARAAPAQPQLCAPGPCGQGQEGAGTHPPAAHGAGAAQVRGPGRVPAALRQRLPQLLLGRGRGRAGAGGRRALPLPRPPVRVLFLLWLVHLLLLRLRVHLQPLLLRQRGLVLQLRRRGPGSAAADLPHPPRAHPPGPARGPALQGQRPSRACPALLPVQGHGGWHRCGLRPQQQQQIQAQAQRGPELLQSQRALPEAAAALRGKPAKDLSLPARPAALEVVGESHTAAWHEGEGPEAVLQGHRAGRGDPACRGLCRLPVSWAAQPPLHRPHREHVGVVGQQHGGQGQVVLPPXGDQAGQEAVRRQECAVPVLPRGXERRADHLPQVPGRGARAVXADGPEPQVPGPAGPLLPGGHLRPHHRAPGDGXWRAHPML

SEQ ID NO: 61308 - protein, 225 aa, Homo sapiens
MIEEILTEPPGPKGAAPAAAAAAAGELLKFGVQALLAARPFHSHLAVLKAEQAAVFKFPLAPLGCSGLSSALLAAGPGLPGAAGAPHLPLELQLRGKLEAAGPGEPGTKAKKGRRSRTVFTELQLMGLEKRFEKQKYLSTPDRIDLAESLGLSQLQVKTWYQNRRMKWKKIVLQGGGLESPTKPKGRPKKNSIPTSEQLTEQERAKDAEKPAEVPGEPSDRSRED

SEQ ID NO: 61309 - protein, 459 aa, Homo sapiens
MAPLCPSPWLPLLIPAPAPGLTVQLLLSLLLLMPVHPQRLPRMQEDSPLGGGSSGEDDPLGEEDLPSEEDSPREEDPPGEEDLPGEEDLPGEEDLPEVKPKSEEEGSLKLEDLPTVEAPGDPQEPQNNAHRDKEGDDQSHWRYGGDPPWPRVSPACAGRFQSPVDIRPQLAAFCPALRPLELLGFQLPPLPELRLRNNGHSVQLTLPPGLEMALGPGREYRALQLHLHWGAAGRPGSEHTVEGHRFPAEIHVVHLSTAFARVDEALGRPGGLAVLAAFLEEGPEENSAYEQLLSRLEEIAEEGSETQVPGLDISALLPSDFSRYFQYEGSLTTPPCAQGVIWTVFNQTVMLSAKQLHTLSDTLWGPGDSRLQLNFRATQPLNGRVIEASFPAGVDSSPRAAEPVQLNSCLAAGDILALVFGLLFAVTSVAFLVQMRRQHRRGTKGGVSYRPAEVAETGA

SEQ ID NO: 61310 - protein, 447 aa, Homo sapiens
MELLKLNRSVQGTGPGPGASLCRPGAPLLNSSSVGNLSCEPPRIRGAGTRELELAIRITLYAVIFLMSVGGNMLIIVVLGLSRRLRTVTNAFLLSLAVSDLLLAVACMPFTLLPNLMGTFIFGTVICKAVSYLMGVSVSVSTLSLVAIALERYSAICRPLQARVWQTRSHAARVIVATWLLSGLLMVPYPVYTVVQPVGPRVLQCVHRWPSARVRQTWSVLLLLLLFFIPGVVMAVAYGLISRELYLGLRFDGDSDSDSQSRVRNQGGLPGAVHQNGRCRPETGAVGEDSDGCYVQLPRSRPALELTALTAPGPGSGSRPTQAKLLAKKRVVRMLLVIVVLFFLCWLPVYSANTWRAFDGPGAHRALSGAPISFIHLLSYASACVNPLVYCFMHRRFRQACLETCARCCPRPPRARPRALPDEDPPTPSIASLSRLSYTTISTLGPG

SEQ ID NO: 61311 - protein, 368 aa, Homo sapiens
MVSTPENRQTFITSVIKFLRQYEFDGLDFDWEYPGSRGSPPQDKHLFTVLVQEMREAFEQEAKQINKPRLMVTAAVAAGISNIQSGYEIPQLSQYLDYIHVMTYDLHGSWEGYTGENSPLYKYPTDTGSNAYLNVDYVMNYWKDNGAPAEKLIVGFPTYGHNFILSNPSNTGIGAPTSGAGPAGPYAKESGIWAYYEICTFLKNGATQGWDAPQEVPYAYQGNVWVGYDNIKSFDIKAQWLKHNKFGGAMVWAIDLDDFTGTFCNQGKFPLISTLKKALGLQSASCTAPAQPIEPITAAPSGSGNGSGSSSSGGSSGGSGFCAVRANGLYPVANNRNAFWHCVNGVTYQQNCQAGLVFDTSCDCCNWA

SEQ ID NO: 61312 - protein, 368 aa, Homo sapiens; identical to SEQ ID NO: 61311

SEQ ID NO: 61313 - protein, 534 aa, Homo sapiens
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPRSPFQVTAGYQLPVYNYQAFPAYPNSPFQVATGYQFPVYNYQPFPAYPSSPFQVTAGYQLPVYNYQAFPAYPNSPFQVATGYQFPVYNYQAFPAYPNSPVQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPNSAVQVTTGYQFHVYNYQMPPQCPVGEQRRNLWTEAYKWWYLVCLIQRRD

SEQ ID NO: 61314 - protein, 366 aa, Homo sapiens
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSPFQVTTGYQLPVYNYQPFPAYPSSPFQVTAGYQLPVYNYQAFPAYPSSPFQVTTGYQLPVYNYQAFPAYPSSPFQVTTGYQLPVYNYQAFPAYPSSPFQVTTGYQLPVYNYQAFPAYPNSAVQVTTGYQFHVYNYQMPPQCPVGEQRRNLWTEAYKWWYLVCLIQRRD

SEQ ID NO: 61315 - protein, 558 aa, Homo sapiens
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPRSPFQVTAGYQLPVYNYQAFPAYPNSPFQVATGYQFPVYNYQPFPAYPSSPFQVTAGYQLPVYNYQAFPAYPNSPFQVATGYQFPVYNYQAFPAYPNSPVQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPNSAVQVTTGYQFHVYNYQMPPQCPVGEQRRNLWTEAYKWWYLVCLIQRRD

SEQ ID NO: 61316 - protein, 438 aa, Homo sapiens
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPRSPFQVTAGYQLPVYNYQAFPAYPNSPFQVATGYQFPVYNYQAFPAYPNSPVQVTTGYQLPVYNYQAFPAYPNSPFQVATGYQFPVYNYQAFPAYPNSPVQVTTGYQLPVYNYQAFPAYPNSPFQVATGYQFPVYNYQAFPAYPNSPVQVTTGYQLPVYNYQAFPAYPNSAVQVTTGYQFHVYNYQMPPQCPVGEQRRNLWTEAYKWWYLVCLIQRRD

SEQ ID NO: 61317 - protein, 235 aa, Homo sapiens
MTQVTEKSTEHPEKTTSTTEKTTRTPEKPTLYSEKTICTKGKNTPVPEKPTENLGNTTLTTETIKAPVKSTENPEKTAAVTKTIKPSVKVTGDKSLTTTSSHLNKTEVTHQVPTGSFTLITSRTKLSSITSEATGNESHPYLNKDGSQKGIHAGQMGENDSFPAWAIVIVVLVAVILLLVFLGLIFLVSYMMRTRRTLTQNTQYNDAEDEGGPNSYPVYLMEQQNLGMGQIPSPR

SEQ ID NO: 61318 - protein, 1548 aa, Homo sapiens
MLRARPEALMLLGALLTGSLGPSGSQDALSLPWEVQRYDGWFNNLRHHERGAVGCRLQRRVPANYADGVYQALEEPQLPNPRRLSNAATRGIAGLPSLHNRTVLGVFFGYHVLSDVVSVETPGCPAEFLNIRIPPGDPVFDPDQRGDVVLPFQRSRWDPETGRSPSNPRDLANQVTGWLDGSAIYGSSHSWSDALRSFSGGQLASGPDPAFPRDSQNPLLMWAAPDPATGQNGPRGLYAFGAERGNREPFLQALGLLWFRYHNLWAQRLARQHPDWEDEELFQHARKRVIATYQNIAVYEWLPSFLQKTLPEYTGYRPFLDPSISPEFVVASEQFFSTMVPPGVYMRNASCHFRKVLNKGFQSSQALRVCNNYWIRENPNLNSTQEVNELLLGMASQISELEDNIVVEDLRDYWPGPGKFSRTDYVASSIQRGRDMGLPSYSQALLAFGLDIPRNWSDLNPNVDPQVLEATAALYNQDLSQLELLLGGLLESHGDPGPLFSAIVLDQFVRLRDGDRYWFENTRNGLFSKKEIEDIRNTTLRDVLVAVINIDPSALQPNVFVWHKGAPCPQPKQLTTDGLPQCAPLTVLDFFEGSSPGFAITIIALCCLPLVSLLLSGVVAYFRGREHKKLQKKLKESVKKEAAKDGVPAMEWPGPKERSSPIIIQLLSDRCLQVLNRHLTVLRVVQLQPLQQVNLILSNNRGCRTLLLKIPKEYDLVLLFSSEEERGAFVQQLWDFCVRWALGLHVAEMSEKELFRKAVTKQQRERILEIFFRHLFAQVLDINQADAGTLPLDSSQKVREALTCELSRAEFAESLGLKPQDMFVESMFSLADKDGNGYLSFREFLDILVVFMKGSPEDKSRLMFTMYDLDENGFLSKDEFFTMMRSFIEISNNCLSKAQLAEVVESMFRESGFQDKEELTWEDFHFMLRDHDSELRFTQLCVKGGGGGGNGIRDIFKQNISCRVSFITRTPGERSHPQGLGPPAPEAPELGGPGLKKRFGKKAAVPTPRLYTEALQEKMQRGFLAQKLQQYKRFVENYRRHIVCVAIFSAICVGVFADRAYYYGFASPPSDIAQTTLVGIILSRGTAASVSFMFSYILLTMCRNLITFLRETFLNRYVPFDAAVDFHRWIAMAAVVLAILHSAGHAVNVYIFSVSPLSLLACIFPNVFVNDGSKLPQKFYWWFFQTVPGMTGVLLLLVLAIMYVFASHHFRRRSFRGFWLTHHLYILLYALLIIHGSYALIQLPTFHIYFLVPAIIYGGDKLVSLSRKKVEISVVKAELLPSGVTYLQFQRPQGFEYKSGQWVRIACLALGTTEYHPFTLTSAPHEDTLSLHIRAVGPWTTRLREIYSSPKGNGCAGYPKLYLDGPFGEGHQEWHKFEVSVLVGGGIGVTPFASILKDLVFKSSLGSQMLCKKIYFIWVTRTQRQFEWLADIIQEVEENDHQDLVSVHIYVTQLAEKFDLRTTMLYICERHFQKVLNRSLFTGLRSITHFGRPPFEPFFNSLQEVHPQVRKIGVFSCGPPGMTKNVEKACQLVNRQDRAHFMHHYENF

SEQ ID NO: 61319 - protein, 135 aa, Homo sapiens
MRPRMLPVFFGESIKVSPEPTHEIRCNSEVKYASEKHFQDKVFYAPVPTVTAYSETIVAAPNCTWRNYRSQLTLEPRPRALRFRSTTIIFPKHARSTFRTTLHCSLGRPSRWFTASVQLQLCQDPAPSLLGPATL

SEQ ID NO: 61320 - protein, 2244 aa, Homo sapiens
  VARIANT 1039,1132,1140,1147,1188,1213,1216,1235,1253,1272,1307,1308,1314,1316,1326,1354,1374,1422,1438,1439,1477,1478: Xaa = Any Amino Acid
  VARIANT 1505,1524,1532,1540,1554,1559,1564,1635,1644,1712,1750,1804,1819,1848,1992,2006,2052,2121,2144: Xaa = Any Amino Acid
MGCQALPLWLLFFHAVILPEAVCYRKNVGGSRGRLWNPCSERSTVQGTPATQQEDWIAVQLVEGSGRCSGRVEVYFEGVWGMVCDDLWDEKEVQVVCRQLGCGAAISAPGEAHFGQGSGPILLDDVQCSGIEDYLEECSHAGWSTHNCGHGEDAGVICSEYENERLQSFDAEILTPFPGDWPQLQLVNGSGRCSGHVEVFHHGQWGRVCDDQRDMNEADVVCRQLHCGCALAAPAEAQFGEGRGEFLLDDVDCTGKESFLGQCPHAGWGLHNCGPREDASIICAGASLLQFYLLPSQLNSLLQLLHIRHRQQFCQLPPPRKMLTTQPYHQCYLWLTQHLPAVGPTCLGPALQVSNLPEDTFLLSKPQSEGGLIPMREEPGGAAPFAASLAWGHFGDFTGHNPCVLHTSINSSLDGGEAAEWHREVLRPRGGSCPGHMEDRVLRDDLWNLAKATVVCRQLQCGRAVAAPTGAHFGAGSGKILLDDVQCVGSESHLGQCVHGGRARHNCGHLEDASVICSGQALSLTTTEPTVLPPTPPTGAGLSATIATTEPVSLPSTPMPLAGAWMEVRLLNGTGRCSGRVEVLVQGTWGTVCDDLWDLAEATVVCRQLQCGQAVAAPTGAHFRAGSGKILLDDMQCVGSESHLGQCMRGDQARHNCGHLEDASVICTGDGLSATIATTAMTLPSTPMPPAGSRKILLDDFQHVGSESHLGQCVNRSWTRHNCGHLENASIICTSEGMALSPHLDGNRQPSNLDNLREKAFLYQRHQHLLKFHHQLPAAGACMEVRLLNGTGRCLGRVEVLIQGTWGTVCDHFWNLAEAAVVCRQLQCGQAMAAHFGASSGKVLLDDMQCVGSKSHLGRCVHRGWARHNCGHLEDASVICAAIPTATPRTVTARAGDWPELQLVGGSGRCSGRVEILHQGAWGTVCDDLWDLNEAEVVCRQLGCGRAMSALGKAHFGPGSGDIFLDNLQCAGVERYLGQCTHSGWSEHNWPPRGCQCHLLRGLAGAEADGRLRPVLGARGDSPPGCLGHRVRRPVGPEXSQGCVPAVGVWAGCFWPWRGPLWPRLRRHLPGQPPVHSGRALPGPVYPLGLVRAQLWPPRGCQCHLLRCGRPTSTHTSRFFYSFSGSHKRRKXLLWRGHFXSLWLIFXSTVSRKLPNRYPVCLGDPHGCKISHRTHNSKFEGFANIKFXEVSNLPLPLHVYSPQVGRYPWMSLXLRXNLQWSQDCLALHGEVLCPXNCDILLLLTHHDSGVPKXFYENQHWLLCSFQCHSSGXKGVRRWTRVAAGGWLWPVLRTWGGPTQGLLGHCVXXPVGSEXSXGCVPAARVWXGHCCSWKGPLWPRFWRHPSRQHSVFRKXEPPWPVAQLRLVRPQPWPPXGCQCCLLRCPWYPTNYPTNLECVWVIHICSSSSSWSGTAAGERVQQMXGPSRGLPCQCLGHRVXXQLVYRGCPRGLQAAGLWPGRVCPPRSQLQPWIRQHPPXXRQLHGKGVLPGAVPSQRLVHPQLWAPXRCWRHLLRFCSCWTSRYLXVCVHFICXLVASRHLXLQMRFPWPWCCVQXELCSXEASWXHGGFSWSRCLSKKRAHSATALCSNSSSRLLLLQVLLQGPREPAPVPGDADPESQLHLLWAQGLAHCQVGRXEEPMQRAHXSLPQWHMGDCVRQPLGRQRCPHGVPAAGLWEGCWPPQGMATWLQGWGVAAWDTSSWTMGSVKAWRPHXASVAIWVCPSTTVATMRMLGSSAQILTSSFLLRLPEPXLSVGDLETNFLLQFQPQILPLHLMGTWMVSGFGLLWRLLLCPNLSVDMHIRSSXVNTKWKSWVVQYGFXSERMSSSPSRVKSRPCAWRAGGAAVRAGXSCGTRACGARCATTTGTSGTPVWCAASWVAAVLWAPRAAAALARAPGPSCWTTCAAPATRTRWSAAPTRAGPGTTASTARTRAWCAQVSRPLPTLPFLSSHSWGPNSPSWGYQPSYPACLTSSKPSLTEAISGGWATPPGTSTXMMSYVAPKSWDAAXSSTFPMATVALSSRSTLAPSATLTPSEAGNGATLAESLCGTRCPSXSSPVGRTAHPQLKSFMGMTPQQRVLATPCLYPSSSPLSPSMWEAWCPTMTARGKRSSSKPPSTAPIPTXCSSWIPVWLLLIPMILQPSSMIXSGRGASKTIPTSTSIPARRTWLSSSSMSSAFLTAMMWYICSVRLQCARWGIMPLSAPGAVQDRVGEVQAPWRPRKSRLSISKWWGHWRSTKSLLRGGLLS

SEQ ID NO: 61321 - protein, 2207 aa, Homo sapiens
  VARIANT 1039,1161,1162,1168,1170,1180,1208,1228,1253,1289,1370,1400,1416,1417,1455,1456,1483,1502,1510,1518,1532,1537: Xaa = Any Amino Acid
  VARIANT 1542,1613,1622,1691,1701,1707,1736,1768,1786,1793,1807,1938,1956,1957,1992,2019,2027,2033,2052,2064,2095,2098: Xaa = Any Amino Acid
  VARIANT 2105,2139,2142,2149,2171,2185,2206: Xaa = Any Amino Acid
MGCQALPLWLLFFHAVILPEAVCYRKNVGGSRGRLWNPCSERSTVQGTPATQQEDWIAVQLVEGSGRCSGRVEVYFEGVWGMVCDDLWDEKEVQVVCRQLGCGAAISAPGEAHFGQGSGPILLDDVQCSGIEDYLEECSHAGWSTHNCGHGEDAGVICSEYENERLQSFDAEILTPFPGDWPQLQLVNGSGRCSGHVEVFHHGQWGRVCDDQRDMNEADVVCRQLHCGCALAAPAEAQFGEGRGEFLLDDVDCTGKESFLGQCPHAGWGLHNCGPREDASIICAGASLLQFYLLPSQLNSLLQLLHIRHRQQFCQLPPPRKMLTTQPYHQCYLWLTQHLPAVGPTCLGPALQVSNLPEDTFLLSKPQSEGGLIPMREEPGGAAPFAASLAWGHFGDFTGHNPCVLHTSINSSLDGGEAAEWHREVLRPRGGSCPGHMEDRVLRDDLWNLAKATVVCRQLQCGRAVAAPTGAHFGAGSGKILLDDVQCVGSESHLGQCVHGGRARHNCGHLEDASVICSGQALSLTTTEPTVLPPTPPTGAGLSATIATTEPVSLPSTPMPLAGAWMEVRLLNGTGRCSGRVEVLVQGTWGTVCDDLWDLAEATVVCRQLQCGQAVAAPTGAHFRAGSGKILLDDMQCVGSESHLGQCMRGDQARHNCGHLEDASVICTGDGLSATIATTAMTLPSTPMPPAGSRKILLDDFQHVGSESHLGQCVNRSWTRHNCGHLENASIICTSEGMALSPHLDGNRQPSNLDNLREKAFLYQRHQHLLKFHHQLPAAGACMEVRLLNGTGRCLGRVEVLIQGTWGTVCDHFWNLAEAAVVCRQLQCGQAMAAHFGASSGKVLLDDMQCVGSKSHLGRCVHRGWARHNCGHLEDASVICAAIPTATPRTVTARAGDWLELQLVGGSGRCSGRVEILHQGAWGTVCDDLWDLNEAEVVCRQLGCGRAMSALGKAHFGPGSGDIFLDNLQCAGVERYLGQCTHSGWSEHNWPPRGCQCHLLRGLAGAEADGRLRPVLGARGDSPPGCLGHRVRRPVGPEXSQGCVPAVGVWAGCFWPWRGPLWPRLRRHLPGQPPVHSGRALPGPVYPLGLVRAQLWPPRGCQCHLLRPTSTHTSRKLPNRYPHPTFYSFSKWTRVAAGGWLWPVLRTWGGPTQGLLGHCVXXPVGSEXSXGCVPAARVWXGHCCSWKGPLWPRFWRHPSRQHSVFRKXEPPWPVAQLRLVRPQPWPPXGCQCCLLRCWGLGSRCDSSTPRRKXLLWRSDFKSLRFLLQPLVPYKLPHQLGVRLGDTRGXEIPHRTDDPKPEIRGHLWVSLRLYRSVRWTTGCLTLHGQVLCWDRAHVPFFFKHHDHSVQKQRHDHQHRVLCSVQHRSARXKGERIFSKANRGAHMDRSGTAAGERVQQMXGPSRGLPCQCLGHRVXXQLVYRGCPRRLQAAGLWPGRVCPPRSQLQPWIRQHPPXXRQLHGKGVLPGAVPSQRLVHPQLWAPXRCWRHLLRFCSCWTSRYLXVCVHFICXLVASRHLXLQMRFPWPWCCVQXELCSXEASWXHGGFSWSRCLSKKRAHSATALCSNSSSRLLLLQVLLQGPREPAPVPGDADPESQLHLLWAQGLAHCQVGRXEEPMQRAHXSLPQWHMGDCVRQPLGRQRCPHGVPAAGLGGGWRRGTHPPGRWAVSRHGDHTRPAWLSGSVHPQLWPPXGCWAHLHRYXLPAFSXGCQSHDSQWGTWKPISCFNFSHRFCPYTXWAPGWFLDLGCCGGFCCVQIFLWTCTFVHLEXIPNGRAGLYNMVFRANVXALHHQEXKAAPAPGGRAEPLXGPGRAAAPGRVGHGVRRPLEHQERPCGVPPPGLRPCSGRPGPRPLWPGHRAHPAGRRALHRPRERAGALHPLGLGPAQLPAPRGRGRGVRRYRVLCPPCLSSPHIPGVQIHHPGDISPAILLASPLPSRHXPRLSPEAGLLLLGHPLKXXAMSPQSHGTLPDLQHSLWPLWHYPAGAPWLPQLLXLHQRPETGPPWPSHCAAQGAQAEVHLXGGRPIHSXNHSWGXRPNRGCWLHRVYILPPVPXVPACGRHGALLXQPEERGLPPSHPPQPQSQPDALRGYLCGFSXSPXFYSHQVXFDPAGVHQRQYLHQPPSPPEEHGSVQVQCLQLSXQLXCGISAVXGCSVQGGGLCLSLLLGLYRTEXERCRPHGGQGKADXAFPNGGATGDPQSHCSEEDSXV

SEQ ID NO: 61322 - protein, 184 aa, Homo sapiens
MKILVAFLVVLTIFGIQSHGYEVFNIISPSNNGGNVQETVTIDNEKNTAIINIHAGSCSSTTIFDYKHGYIASRVLSRRACFILKMDHQNIPPLNNLQWYIYEKQALDNMFSSKYTWVKYNPLESLIKDVDWFLLGSPIEKLCKHIPLYKGEVVENTHNVGAGGCAKAGLLGILGISICADIHV

SEQ ID NO: 61323 - protein, 117 aa, Homo sapiens
MPSPGTVCSLLLLGMLWLDLAMAGSSFLSPEHQRVQQRKESKKPPAKLQPRALAGWLRPEDGGQAEGAEDELEVRFNAPFDVGIKLSGVQYQQHSQALGKFLQDILWEEAKEAPADK

SEQ ID NO: 61324 - protein, 417 aa, Homo sapiens
MAWFALYLLSLLWATAGTSTQTQSSCSVPSAQEPLVNGIQVLMENSVTSSAYPNPSILIAMNLAGAYNLKAQKLLTYQLMSSDNNDLTIGQLGLTIMALTSSCRDPGDKVSILQRQMENWAPSSPNAEASAFYGPSLAILALCQKNSEATLPIAVRFAKTLLANSSPFNVDTGAMATLALTCMYNKIPVGSEEGYRSLFGQVLKDIVEKISMKIKDNGIIGDIYSTGLAMQALSVTPEPSKKEWNCKKTTDMILNEIKQGKFHNPMSIAQILPSLKGKTYLDVPQVTCSPDHEVQPTLPSNPGPGPTSASNITVIYTINNQLRGVELLFNETINVSVKSGSVLLVVLEEAQRKNPMFKFETTMTSWGLVVSSINNIAENVNHKTYWQFLSGVTPLNEGVADYIPFNHEHITANFTQY

SEQ ID NO: 61325 - protein, 874 aa, Homo sapiens
MGPAARGRSAPFPAVPRRFAVPAAQELEAGPAPWVCTRAGARPGRPAAKLKPGALAAPLLKSITVKVETEAEDAALDCSVNSRTSEKHSVDSVLTALQDSSKRKQLVSDGLLDSVPGVKRRRLIPEALLAGMRNRENSSPCQGNGEQAGRGRSLGNVWPGEEEPCNDATTPSYKKPLYGISHKIMEKKNPPSGDLLNVYELFEKANASNSPSSLRLLNEPQKRDCGSTGAGTDNDPNIYFLIQKMFYMLNTLTSNMSQLHSKVDLLSLEVSRIKKQVSPTEMVAKFQPPPEYQLTAAELKQIVDQSLSGGDLACRLLVQLFPELFSDVDFSRGCSACGFAAKRKLESLHLQLIRNYVEVYYPSVKDTAVWQAECLPQLNDFFSRFWAQREMEDSQPSGQVASFFEAEQVDPGHFLDNKDQEEALSLDRSSTIASDHVVDTQDLTEFLDEASSPGEFAVFLLHRLFPELFDHRKLGEQYSCYGDGGKQELDPQRLQIIRNYTEIYFPDMQEEEAWLQQCAQRINDELEGLGLDAGSEGDPPRDDCYDSSSLPDDISVVKVEDSFEGERPGRRSKKIWLVPIDFDKLEIPQPDFEVPGADCLLSKEQLRSIYESSLSIGNFASRLLVHLFPELFTHENLRKQYNCSGSLGKKQLDPSRIKLIRHYVQLLYPRAKNDRVWTLEFVGKLDERCRRRDTEQRRSYQQQRKVHVPGPECRDLTSYAINPERFREEFEGPPLPPERSSKDFCKIPLDELVVPSPDFPVPSPYLLSDKEVREIVQQSLSVGNFAARLLVRLFPELFTAENLRLQYNHSGACNKKQLDPTRLRLIRHYVEAVYPVEKMEEVWHYECIPSIDERCRRPNRKKCDILKKAKKVEK

SEQ ID NO: 61326 - protein, 828 aa, Homo sapiens
MNSTEFTEDVEEVLKSITVKVETEAEDAALDCSVNSRTSEKHSVDSVLTALQDSSKRKQLVSDGLLDSVPGVKRRRLIPEALLAGMRNRENSSPCQGNGEQAGRGRSLGNVWPGEEEPCNDATTPSYKKPLYGISHKIMEKKNPPSGDLLNVYELFEKANASNSPSSLRLLNEPQKRDCGSTGAGTDNDPNIYFLIQKMFYMLNTLTSNMSQLHSKVDLLSLEVSRIKKQVSPTEMVAKFQPPPEYQLTAAELKQIVDQSLSGGDLACRLLVQLFPELFSDVDFSRGCSACGFAAKRKLESLHLQLIRNYVEVYYPSVKDTAVWQAECLPQLNDFFSRFWAQREMEDSQPSGQVASFFEAEQVDPGHFLDNKDQEEALSLDRSSTIASDHVVDTQDLTEFLDEASSPGEFAVFLLHRLFPELFDHRKLGEQYSCYGDGGKQELDPQRLQIIRNYTEIYFPDMQEEEAWLQQCAQRINDELEGLGLDAGSEGDPPRDDCYDSSSLPDDISVVKVEDSFEGERPGRRSKKIWLVPIDFDKLEIPQPDFEVPGADCLLSKEQLRSIYESSLSIGNFASRLLVHLFPELFTHENLRKQYNCSGSLGKKQLDPSRIKLIRHYVQLLYPRAKNDRVWTLEFVGKLDERCRRRDTEQRRSYQQQRKVHVPGPECRDLTSYAINPERFREEFEGPPLPPERSSKDFCKIPLDELVVPSPDFPVPSPYLLSDKEVREIVQQSLSVGNFAARLLVRLFPELFTAENLRLQYNHSGACNKKQLDPTRLRLIRHYVEAVYPVEKMEEVWHYECIPSIDERCRRPNRKKCDILKKAKKVEK

SEQ ID NO: 61327 - protein, 398 aa, Homo sapiens
MWLLLTMASLISVLGTTHGLFGKLHPGSPEVTMNISQMITYWGYPNEEYEVVTEDGYILEVNRIPYGKKNSGNTGQRPVVFLQHGLLASATNWISNLPNNSLAFILADAGYDVWLGNSRGNTWARRNLYYSPDSVEFWAFSFDEMAKYDLPATIDFIVKKTGQKQLHYVGHSQGTTIGFIAFSTNPSLAKRIKTFYALAPVATVKYTKSLINKLRFVPQSLFKFIFGDKIFYPHNFFDQFLATEVCSREMLNLLCSNALFIICGFDSKNFNTSRLDVYLSHNPAGTSVQNMFHWTQAVKSGKFQAYDWGSPVQNRMHYDQSQPPYYNVTAMNVPIAVWNGGKDLLADPQDVGLLLPKLPNLIYHKEIPFYNHLDFIWAMDAPQEVYNDIVSMISEDKK

SEQ ID NO: 61328 - protein, 703 aa, Homo sapiens
MAAQAAGVSRQRAATQGLGSNQNALKYLGQDFKTLRQQCLDSGVLFKDPEFPACPSALGYKDLGPGSPQTQGIIWKRPTELCPSPQFIVGGATRTDICQGGLGDCWLLAAIASLTLNEELLYRVVPRDQDFQENYAGIFHFQFWQYGEWVEVVIDDRLPTKNGQLLFLHSEQGNEFWSALLEKAYAKLNGCYEALAGGSTVEGFEDFTGGISEFYDLKKPPANLYQIIRKALCAGSLLGCSIDVSSAAEAEAITSQKLVKSHAYSVTGVEEVNFQGHPEKLIRLRNPWGEVEWSGAWSDDAPEWNHIDPRRKEELDKKVEDGEFWMSLSDFVRQFSRLEICNLSPDSLSSEEVHKWNLVLFNGHWTRGSTAGGCQNYPATYWTNPQFKIRLDEVDEDQEESIGEPCCTVLLGLMQKNRRWRKRIGQGMLSIGYAVYQVPKELESHTDAHLGRDFFLAYQPSARTSTYVNLREVSGRARLPPGEYLVVPSTFEPFKDGEFCLRVFSEKKAQALEIGDVVAGNPYEPHPSEVDQEDDQFRRLFEKLAGKDSEITANALKILLNEAFSKRTDIKFDGFNINTCREMISLLDSNGTGTLGAVEFKTLWLKIQKYLEIYWETDYNHSGTIDAHEMRTALRKAGFTLNSQVQQTIALRYACSKLGINFDSFVACMIRLETLFKLFSLLDEDKDGMVQLSLAEWLCCVLV

SEQ ID NO: 61329 - protein, 74 aa, Homo sapiens [sequence omitted]

SEQ ID NO: 61330 - protein, 121 aa, Homo sapiens
MTLWNGVLPFYPQPRHAAGFSVPLLIVILVFLALAASFLLILPGIRGHSEYLHSHLLPSEIRLGPPSSEGGDPCVPSTSGLTEPHQAVTGPGGRTRTRRQTARGVKVVEECQEVGVEGRCC

SEQ ID NO: 61331 - protein, 295 aa, Homo sapiens
MLPQYWVDEEDSGQRGIEKKHQTQVPLNVATVFAMLTLFCDRTNSSQKMEEFVQSSGENGVVAVLLKSMVSNITEERANVIASALAQIPRKLIDNFFRVLTSYSFGILLMEQDIFFTPTGSVDGKRPNTLASNTQLYKWISQNDLLGHPKTKSFMTHGETSGIYEAIYHGIPMVGIPLFADQPDNIAHMKALNVDIRTMSSTDLLNALKTVINDPVYKENAMKLSIIRHDLPIKPLDQAAFWIEFVMQHKGAKHLRVAAHDLTWFQYHNLHVIRFLLAYVSTVIFIITRCCLFSF

SEQ ID NO: 61332 - protein, 208 aa, Homo sapiens
MGHGSGFPGKRRPRGAGLSGRGGRGRSKLKSGIGAVVLPGVSTADISSNKDDEENSVLDMVVLFSSSDKFTLNQDICVVCGSFGQGAEGRLLACSQCGQCYHPYCVSIKITKVVLSKGWRCLECTVCEACGKATDPGRLLLCDDCDISYHTYCLDPPLQTVPKGGWKCKWCVWCRHCGATSAGLRCEWQNNYTQCAPCASLSSCPVCY

SEQ ID NO: 61333 - protein, 577 aa, Homo sapiens [sequence omitted]

SEQ ID NO: 61334 - protein, 76 aa, Homo sapiens
MANVTVTRCEGACISAASFNIITQQVDARCSCCRPLHSYEQQLELPCPDPSTPGRRLVLTLQVFSHCVCSSVACGD

SEQ ID NO: 61335 - protein, 133 aa, Homo sapiens
MHSTLSADYRSKNTDFLKSNGTGTLGAVEFKTLWLKIQKYLEIYWETDYNHSGTIDAHEMRTALRKAGFTLNSQVQQTIALRYACSKLGINFDSFVACMIRLETLFKLFSLLDEDKDGMVQLSLAEWLCCVLV

SEQ ID NO: 61336 - protein, 670 aa, Homo sapiens [sequence omitted]

SEQ ID NO: 61337 - protein, 347 aa, Homo sapiens
MAVDIGRHRWDQVKKEDQEATGPRLSRELLDEKEPEVLQDSLDRCYSTPSGCLELTDSCQPYRSAFYVLEQQRVGLAIDMDEIEKYQEVEEDQDPSCPRLSRELLDEKEPEVLQDSLDRCYSTPSDYLELPDLGQPYSSAVYSLEEQYLGLALDVDRIKKDQEEEEDQGPPCPRLSRELLEVVEPEVLQDSLDRYYSTPSSCLEQPDSCQPYGSSFYALEEKHVGFSLDVGEIEKKGKGKKRRGRRSKKKRRRGRKEGEDDNPPCPRLNGVLMEVEEPEVLQDSLDRCYSTQSMYFELPDSFQHYRSVFYSFEEEHISFALYVDNRFFTLTVTSLHLVFQMGVIFPQ

SEQ ID NO: 61338 - protein, 480 aa, Homo sapiens
MQKAEEKEVPEDSLEECAITCSNSHGPYDSNQPHKKTKITFEEDKVDSTLIGSSSHVEWEDAVHIIPENESDDEEEEEKGPVSPRNLQESEEEEVPQESWDEGYSTLSIPPEMLASYQSYSSTFHSLEEQQVCMAVDIGRHRWDQVKKEDQEATGPRLSRELLDEKEPEVLQDSLDRCYSTPSGCLELTDSCQPYRSAFYVLEQQRVGLAIDMDEIEKYQEVEEDQDPSCPRLSRELLDEKEPEVLQDSLDRCYSTPSDYLELPDLGQPYSSAVYSLEEQYLGLALDVDRIKKDQEEEEDQGPPCPRLSRELLEVVEPEVLQDSLDRYYSTPSSCLEQPDSCQPYGSSFYALEEKHVGFSLDVGEIEKKGKGKKRRGRRSKKKRRRGRKEGEDDNPPCPRLNGVLMEVEEPEVLQDSLDRCYSTQSMYFELPDSFQHYRSVFYSFEEEHISFALYVDNRFFTLTVTSLHLVFQMGVIFPQ

SEQ ID NO: 61339 - protein, 670 aa, Homo sapiens [sequence omitted]

SEQ ID NO: 61340 - protein, 670 aa, Homo sapiens [sequence omitted]

SEQ ID NO: 61341 - protein, 670 aa, Homo sapiens [sequence omitted]

SEQ ID NO: 61342 - protein, 590 aa, Homo sapiens
MVVSAGPLSSEKAEMNILEINEKLRPQLAEKKQQFRNLKEKCFLTQLAGFLANRQKKYKYEECKDLIKFMLRNERQFKEEKLAEQLKQAEELRQYKVLVHAQERELTQLREKLREGRDASRSLNEHLQALLTPDEPDKSQGQDLQEQLAEGCRLTQHLVQKLSPENDNDDDEDVQVEVAEKVQKSSAPREMQKAEEKEVPEDSLEECAITCSNSHGPYDSNQPHKKTKITFEEDKVDSTLIGSSSHVEWEDAVHIIPENESDDEEEEEKGPVSPRNLQESEEEEVPQESWDEGYSTLSIPPEMLASYQSYSSTFHSLEEQQVCMAVDIGRHRWDQVKKEDQEATGPRLSRELLDEKEPEVLQDSLDRCYSTPSGCLELTDSCQPYRSAFYVLEQQRVGLAIDMDEIEKYQEVEEDQDPSCPRLSRELLDEKEPEVLQDSLDRCYSTPSDYLELPDLGQPYSSAVYSLEEQYLGLALDVDRIKKDQEEEEDQGPPCPRLSRELLEVVEPEVLQDSLDRYYSTPSSCLEQPDSCQPYGSSFYALEEKHVGFSLDVGEIEKKGKGKKRRGRRSKKKRRRGRKEGEDDNPPCPR

SEQ ID NO: 61343 - protein, 595 aa, Homo sapiens
MVVSAGPLSSEKAEMNILEINEKLRPQLAEKKQQFRNLKEKCFLTQLAGFLANRQKKYKYEECKDLIKFMLRNERQFKEEKLAEQLKQAEELRQYKVLVHAQERELTQLREKLREGRDASRSLNEHLQALLTPDEPDKSQGQDLQEQLAEGCRLTQHLVQKLSPENDNDDDEDVQVEVAEKVQKSSAPREMQKAEEKEVPEDSLEECAITCSNSHGPYDSNQPHKKTKITFEEDKVDSTLIGSSSHVEWEDAVHIIPENESDDEEEEEKGPVSPRNLQESEEEEVPQESWDEGYSTLSIPPEMLASYQSYSSTFHSLEEQQVCMAVDIGRHRWDQVKKEDQEATGPRLSRELLDEKEPEVLQDSLDRCYSTPSGCLELTDSCQPYRSAFYVLEQQRVGLAIDMDEIEKYQEVEEDQDPSCPRLSRELLDEKEPEVLQDSLDRCYSTPSDYLELPDLGQPYSSAVYSLEEQYLGLALDVDKIEKKGKGKKRRGRRSKKKRRRGRKEGEDDNPPCPRLNGVLMEVEEPEVLQDSLDRCYSTQSMYFELPDSFQHYRSVFYSFEEEHISFALYVDNRFFTLTVTSLHLVFQMGVIFPQ

SEQ ID NO: 61344 - protein, 268 aa, Homo sapiens
MDEIEKYQEVEEDQDPSCPRLSRELLDEKEPEVLQDSLDRCYSTPSDYLELPDLGQPYSSAVYSLEEQYLGLALDVDRIKKDQEEEEDQGPPCPRLSRELLEVVEPEVLQDSLDRYYSTPSSCLEQPDSCQPYGSSFYALEEKHVGFSLDVGEIEKKGKGKKRRGRRSKKKRRRGRKEGEDDNPPCPRLNGVLMEVEEPEVLQDSLDRCYSTQSMYFELPDSFQHYRSVFYSFEEEHISFALYVDNRFFTLTVTSLHLVFQMGVIFPQ

SEQ ID NO: 61345 - protein, 268 aa, Homo sapiens; identical to SEQ ID NO: 61344

SEQ ID NO: 61346 - protein, 416 aa, Homo sapiens
MVVSAGPLSSEKAEMNILEINEKLRPQLAEKKQQFRNLKEKCFLTQLAGFLANRQKKYKYEECKDLIKFMLRNERQFKEEKLAEQLKQAEELRQYKVLVHAQERELTQLREKLREGRDASRSLNEHLQALLTPDEPDKSQGQDLQEQLAEGCRLTQHLVQKLSPENDNDDDEDVQVEVAEKVQKSSAPREMQKAEEKEVPEDSLEECAITCSNSHGPYDSNQPHKKTKITFEEDKVDSTLIGSSSHVEWEDAVHIIPENESDDEEEEEKGPVSPRNLQESEEEEVPQESWDEGYSTLSIPPEMLASYQSYSSTFHSLEEQQVCMAVDIGRHRWDQVKKEDQEATGPRLSRELLDEKEPEVLQDSLDRCYSTPSGCLELTDSCQPYRSAFYVLEQQRVGLAIDMDGEYLSMKVIRIH

SEQ ID NO: 61347 - protein, 601 aa, Homo sapiens
MLRNERQFKEEKLAEQLKQAEELRQYKVLVHAQERELTQLREKLREGRDASRSLNEHLQALLTPDEPDKSQGQDLQEQLAEGCRLTQHLVQKLSPENDNDDDEDVQVEVAEKVQKSSAPREMQKAEEKEVPEDSLEECAITCSNSHGPYDSNQPHKKTKITFEEDKVDSTLIGSSSHVEWEDAVHIIPENESDDEEEEEKGPVSPRNLQESEEEEVPQESWDEGYSTLSIPPEMLASYQSYSSTFHSLEEQQVCMAVDIGRHRWDQVKKEDQEATGPRLSRELLDEKEPEVLQDSLDRCYSTPSGCLELTDSCQPYRSAFYVLEQQRVGLAIDMDEIEKYQEVEEDQDPSCPRLSRELLDEKEPEVLQDSLDRCYSTPSDYLELPDLGQPYSSAVYSLEEQYLGLALDVDRIKKDQEEEEDQGPPCPRLSRELLEVVEPEVLQDSLDRYYSTPSSCLEQPDSCQPYGSSFYALEEKHVGFSLDVGEIEKKGKGKKRRGRRSKKKRRRGRKEGEDDNPPCPRLNGVLMEVEEPEVLQDSLDRCYSTQSMYFELPDSFQHYRSVFYSFEEEHISFALYVDNRFFTLTVTSLHLVFQMGVIFPQ

SEQ ID NO: 61348 - protein, 181 aa, Homo sapiens
MGVPGHRNPPQTHTKPPAETVQLELDEVLGAAPVVCYEDRKRLPYTMLSSMTCSASAASWPWGTIILPNLASVLYDPECWETPRQFNPGHFSDKDGNFVANEAFLPFSAGHRVYPADQLAQMELFLMFATLLRTFRFQLPEGSPGLKLEYIFGGTWQPQPQEICAVPRLSSPSPGPREDGL

SEQ ID NO: 61349 - protein, 181 aa, Homo sapiens; identical to SEQ ID NO: 61348

SEQ ID NO: 61350 - protein, 1115 aa, Homo sapiens
  VARIANT 555: Xaa = Any Amino Acid
MTSGPGTTPSPHNLCSYNQHNLCLYSQHNLCPVPTTSTTSAPTTSTTSGPGTTPSPVPTTSTTPVSKTSTSHLSVSKTTHSQPVTSDCHPLCAWTKWFDVDFPSPGPHGGDKETYNNIIRSGEKICRRPEEITRLQCRAESHPEVNIEHLGQVVQCSREEGLVCRNQDQQGPFKMCLNYEVRVLCCETPRGCPVTSVTPYGTSPTNALYPSLSTSMVSASVASTSVASSSVASSSVAYSTQTCFCNVADRLYPAGSTIYRHRDLAGHCYYALCSQDCQVVRGVDSDCPSTTLPPAPATSPSISTSEPVTELGCPNAVPPRKKGETWATPNCSEATCEGNNVISLRPRTCPRVEKPTCANGYPAVKVADQDGCCHHYQCQCVCSGWGDPHYITFDGTYYTFLDNCTYVLVQQIVPVYGHFRVLVDNYFCGAEDGLSCPRSIILEYHQDRVVLTRKPVHGVMTNEIIFNNKVVSPGFRKNGIVVSRIGVKMYATIPELGVQVMFSGLIFSVEVPFSKFANNTEGQCGTCTNDRKDECRTPRGTVVASCSEMSGSGTXAYPDQPACHRPHPTPTTVGPTTVGSTTVGPTTVGSTTVGPTTPPAPCLPSPICQLILSKVFEPCHTVIPPLLFYEGCVFDRCHMTDLDVVCSSLELYAALCASHDICIDWRGRTGHMCPFTCPADKVYQPCGPSNPSYCYGNDSASLGALPEAGPITEGCFCPEGMTLFSTSAQVCVPTGCPRCLGPHGEPVKVGHTVGMDCQECTCEAATWTLTCRPKLCPLPPACPLPGFVPVPAAPQAGQCCPQYSCACNTSRCPAPVGCPEGARAIPTYQEGACCPVQNCSWTVCSINGTLYQPGAVVSSSLCETCRCELPGGPPSDAFVVSCETQICNTHCPVGFEYQEQSGQCCGTCVQVACVTNTSKSPAHLFYPGETWSDAGNHCVTHQCEKHQDGLVVVTTKKACPPLSCSLDEARMSKDGCCRFCPPPPPPYQNQSTCAVYHRSLIIQQQGCSSSEPVRLAYCRGNCGDSSSMYSLEGNTVEHRCQCCQELRTSLRNVTLHCTDGSSRAFSYTEVEECGCMGRRCPAPGDTQHSEEAEPEPSQEAESGSWERGVPVSPMH

SEQ ID NO: 61351 - protein, 1673 aa, Homo sapiens
MDGSSRPAGPSASSSPLCTMVQRWLLLSCCGALLSAGLANTSYTSPGLQRLKDSPQTAPDKGQCSTWGAGHFSTFDHHVYDFSGTCNYIFAATCKDAFPTFSVQLRRGPDGSISRIIVELGASVVTVSEAIISVKDIGVISLPYTSNGLQITPFGQSVRLVAKQLELELEVVWGPDSHLMVLVERKYMGQMCGLCGNFDGKVTNEFVSEEGKFLEPHKFAALQKLDDPGEICTFQDIPSTHVRQAQHARICTQLLTLVAPECSVSKEPFVLSCQADVAAAPQPGPQNSSCATLSEYSRQCSMVGQPVRRWRSPGLCSVGQCPANQVYQECGSACVKTCSNPQHSCSSSCTFGCFCPEGTVLNDLSNNHTCVPVTQCPCVLHGAMYAPGEVTIAACQTCRCTLGRWVCTERPCPGHCSLEGGSFVTTFDARPYRFHGTCTYILLQSPQLPEDGALMAVYDKSGVSHSETSLVAVVYLSRQDKIVISQDEVVTNNGEAKWLPYKTRNITVFRQTSTHLQMATSFGLELVVQLRPIFQAYVTVGPQFRGQTRGLCGNFNGDTTDDFTTSMGIAEGTASLFVDSWRAGNCPAALERETDPCSMSQLNKVCAETHCSMLLRTGTVFERCHATVNPAPFYKRCVYQACNYEETFPHICAALGDYVHACSLRGVLLWGWRSSVDNCTIPCTGNTTFSYNSQACERTCLSLSDRATECHHSAVPVDGCNCPDGTYLNQKGECVRKAQCPCILEGYKFILAEQSTVINGITCHCINGRLSCPQRPQMFLASCQAPKTFKSCSQSSENKFGAACAPTCQMLATGVACVPTKCEPGCVCAEGLYENADGQCVPPEECPCEFSGVSYPGGAELHTDCRTCSCSRGRWACQQGTHCPSTCTLYGEGHVITFDGQRFVFDGNCEYILATDVCGVNDSQPTFKILTENVICGNSGVTCSRAIKIFLGGLSVVLADRNYTVTGEEPHVQLGVTPGALSLVVDISIPGRYNLTLIWNRHMTILIRIARASQDPLCGLCGNFNGNMKDDFETRSRYVASSELELVNSWKESPLCGDVSFVTDPCSLNAFRRSWAERKCSVINSQTFATCHSKVYHLPYYEACVRDACGCDSGGDCECLCDAVAAYAQACLDKGVCVDWRTPAFCPIYCGFYNTHTQDGHGEYQYTQEANCTWHYQPCLCPSQPQSVPGSNIEGCYNCSQDEYFDHEEGVCVPCMPPTTPQPPTTPQLPTTGSRPTQVWPMTGTSTTIGLLSSTGPSPSSNHTPASPTQTPLLPATLTSSKPTASSGEPPRPTTAVTPQATSGLPPTATLRSTATKPTVTQATTRATASTASPATTSTAQSTTRTTMTLPTPATSGTSPTLPKSTNQELPGTTATQTTGPRPTPASTTGPTTPQPGQPTRPTATETTQTRTTTEYTTPQTPHTTHSPPTAGSPVPSTGPVTATSFHATTTYPTPSHPETTLPTHVPPFSTSLVTPSTHTVITPTHAQMATSASNHSAPTGTIPPPTTLKATGSTHTAPPITPTTSGTSQAHSSFSTNKTPTSLHSHTSSTHHPEVTPTSTTTITPNPTSTRTRTPVAHTNSATSSRPPPPFTTHSPPTGSSPFSSTDGHFCLHPLNANRHDSSTDNAQGHRVHPHSANNDADHQRDQPSPELIKHSQNLYIPTFTHFLHTPC

SEQ ID NO: 61352 - protein, 577 aa, Homo sapiens [sequence omitted]

SEQ ID NO: 61353 - protein, 76 aa, Homo sapiens; identical to SEQ ID NO: 61334

SEQ ID NO: 61354 - protein, 598 aa, Homo sapiens
MVVSAGPWSSEKAEMNILEINEKLRPQLAENKQQFRNLKERCFLTQLAGFLANRQKKYKYEECKDLIKFMLRNERQFKEEKLAEQLKQAEELRQYKVLVHSQERELTQLREKLREGRDASRSLNEHLQALLTPDEPDKSQGQDLQEQLAEGCRLAQHLVQKLSPENDEDEDEDVQVEEDEKVLESSAPREVQKAEESKVPEDSLEECAITCSNSHGPCDSIQPHKNIKITFEEDKVNSSLVVDRESSHDGCQDALNILPVPGPTSSATNVSMVVSAGPLSSEKAEMNILEINEKLCPQLAEKKQQFRSLKEKCFVTQVACFLAKQQNKYKYEECKDLIKSMLRNERQFKEEKLAEQLKQAEELRQYKVLVHSQERELTQLREKLREGRDASRSLNEHLQALLTPDEPDKSQGQDLQEQLAEGCRLAQHLVQKLSPENDNDDDEDVQVEVAEKVQKSSSPREMQKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEGYSTLSIPPERTSVGSSEKGGPRGNRSQAQQGAAG

SEQ ID NO: 61355 - protein, 346 aa, Homo sapiens
MLAFLLTWEVKGEEDQNPPCPRLSRELLAEKEPEVLQDSLDRWYSTPSVYLGLTDPCQPYRSAFYVLEQQRVGLAVDMDEIEKYQEVEEDQDPSCPRLSRELLAEKEPEVLQDSLDRCYSTPSGYLELPDLGQPYRSAVYSLEEQYLGLALDVDRIKKDQEEEEDQGPPCPRLSRELLEVVEPEVLQDSLDRCYSTPSSCLEQPDSCQPYRSSFYALEEKHVGFSLDVGEIEKKGKGKKRRGRRSKKKRRRGRKEGEEDQNPPCPRLNSVLMEVEEPEVLQDSLDRCYSTPSMYFELPDSFQHYRSVFYSFEEQHITFALDMDNSFFTLTVTSLHLVFQMGVIFPQ

SEQ ID NO: 61356 - protein, 670 aa, Homo sapiens
MVVSAGPLSSEKAEMNILEINEKLRPQLAEKKQQFRNLKEKCFLTQLAGFLANRQKKYKYEECKDLIKFMLRNERQFKEEKLAEQLKQAEELRQYKVLVHAQERELTQLREKLREGRDASRSLNEHLQALLTPDEPDKSQGQDLQEQLAEGCRLTQHLVQKLSPENDNDDDEDVQVEVAEKVQKSSAPREMQKAEEKEVPEDSLEECAITCSNSHGPYDSNQPHKKTKITFEEDKVDSTLIGSSSHVEWEDAVHIIPENESDDEEEEEKGPVSPRNLQESEEEEVPQESWDEGYSTLSIPPEMLASYQSYSSTFHSLEEQQVCMAVDIGRHRWDQVKKEDQEATGPRLSRELLDEKEPEVLQDSLDRCYSTPSGCLELTDSCQPYRSAFYVLEQQRVGLAIDMDEIEKYQEVEEDQDPSCPRLSRELLDEKEPEVLQDSLDRCYSTPSDYLELPDLGQPYSSAVYSLEEQYLGLALAVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKKRRRGRKEGEDDNPPCPRLYGVLMEVEEPEVLQDSLDRCYSTPSMYFEQPDSFQHYRSVFYSFEEEHISFALYVDNRFFTLTVTSLHLVFQMGVIFPQ

SEQ ID NO: 61357 - protein, 584 aa, Homo sapiens
MDLLWMPLLLVAACVSAVHSSPEVNAGVSSIHITKPVHILEERSLLVLTPAGLTQMLNQTRFLMVLFHNPSSKQSRNLAEELGKAVEIMGKGKNGIGFGKVDITIEKELQQEFGITKAPELKLFFEGNRSEPISCKGVVESAALVVWLRRQISQKAFLFNSSEQVAEFVISRPLVIVGFFQDLEEEVAELFYDVIKDFPELTFGVITIGNVIGRFHVTLDSVLVFKKGKIVNRQKLINDSTNKQELNRVIKQHLTDFVIEYNTENKDLISELHIMSHMLLFVSKSSESYGIIIQHYKLASKEFQNKILFILVDADEPRNGRVFKYFRVTEVDIPSVQILNLSSDARYKMPSDDITYESLKKFGRSFLSKNATKHQSSEEIPKYWDQGLVKQLVGKNFNVVVFDKEKDVFVMFYAPWSKKCKMLFPLLEELGRKYQNHSTIIIAKIDVTANDIQLMYLDRYPFFRLFPSGSQQAVLYKGEHTLKGFSDFLESHIKTKIEDEDELLSVEQNEVIEEEVLAEEKEVPMMRKGLPEQQSPELENMTKYVSKLEEPAGKKKTSEEVVVVVAKPKGPPVQKKKPKVKEEL

SEQ ID NO: 61358 - protein, 798 aa, Homo sapiens
MALQMFVTYSPWNCLLLLVALECSEASSDLNESANSTAQYASNAWFAAASSEPEEGISVFELDYDYVQIPYEVTLWILLASLAKIGFHLYHRLPGLMPESCLLILVGALVGGIIFGTDHKSPPVMDSSIYFLYLLPPIVLEGGYFMPTRPFFENIGSILWWAVLGALINALGIGLSLYLICQVKAFGLGDVNLLQNLLFGSLISAVDPVAVLAVFEEARVNEQLYMMIFGEALLNDGITVVLYNMLIAFTKMHKFEDIETVDILAGCARFIVVGLGGVLFGIVFGFISAFITRFTQNISAIEPLIVFMFSYLSYLAAETLYLSGILAITACAVTMKKYVEENVSQTSYTTIKYFMKMLSSVSETLIFIFMGVSTVGKNHEWNWAFICFTLAFCQIWRAISVFALFYISNQFRTFPFSIKDQCIIFYSGARGAGSFSLAFLLPLSLFPRKKMFVTATLVVIYFTVFIQGITVGPLVRYLDVKKTNKKESINEELHIRLMDHLKAGIEDVCGHWSHYQVRDKFKKFDHRYLRKILIRKNLPKSSIVSLYKKLEMKQAIEMVETGILSSTAFSIPHQAQRIQGIKRLSPEDVESIRDILTSNMYQVRQRTLSYNKYNLKPQTSEKQAKEILIRRQNTLRESMRKGHSLPWGKPAGTKNIRYLSYPYGNPQSAGRDTRAAGFSDDDSSDPGSPSITFSACSRIGSLQKQEAQEIIPMKSLHRGRKAFSFGYQRNTSQEEYLGGVRRVALRPKPLFHAVDEEGESGGESEGKASLVEVRSRWTADHGHSRDHHRSHSPLLQKK

SEQ ID NO: 61359 - protein, 84 aa, Homo sapiens
MATMENKVICALVLVSMLALGTLAEAQTETCTVAPRERQNCGFPGVTPSQCANKGCCFDDTVRGVPWCFYPNTIDVPPEEECEF

SEQ ID NO: 61360 - protein, 487 aa, Homo sapiens
MAWQVSLLELEDWLQCPICLEVFKEPLMLQCGHSYCKGCLVSLSCHLDAELRCPVCRQAVDGSSSLPNVSLARVIEALRLPGDPEPKVCVHHRNPLSLFCEKDQELICGLCGLLGSHQHHPVTPVSTVYSRMKEELAALISELKQEQKKVDELIAKLVNNRTRIVNESDVFSWVIRREFQELHHLVDEEKARCLEGIGGHTRGLVASLDMQLEQAQGTRERLAQAECVLEQFGNEDHHKFIRKFHSMASRAEMPQARPLEGAFSPISFKPGLHQADIKLTVWKRLFRKVLPAPEPLKLDPATAHPLLELSKGNTVVQCGLLAQRRASQPERFDYSTCVLASRGFSCGRHYWEVVVGSKSDWRLGVIKGTASRKGKLNRSPEHGVWLIGLKEGRVYEAFACPRVPLPVAGHPHRIGLYLHYEQGELTFFDADRPDDLRPLYTFQADFQGKLYPILDTCWHERGSNSLPMVLPPPSGPGPLSPEQPTKL

SEQ ID NO: 61361 - protein, 327 aa, Homo sapiens
MAELPGPFLCGALLGFLCLSGLAVEVKVPTEPLSTPLGKTAELTCTYSTSVGDSFALEWSFVQPGKPISESHPILYFTNGHLYPTGSKSKRVSLLQNPPTVGVATLKLTDVHPSDTGTYLCQVNNPPDFYTNGLGLINLTVLVPPSNPLCSQSGQTSVGGSTALRCSSSEGAPKPVYNWVRLGTFPTPSPGSMVQDEVSGQLILTNLSLTSSGTYRCVATNQMGSASCELTLSVTEPSQGRVAGALIGVLLGVLLLSVAAFCLVRFQKERGKKPKETYGGSDLREDAIAPGISEHTCMRADSSKGFLERPSSASTVTTTKSKLPMVV

SEQ ID NO: 61362 - DNA, 20 bp, Homo sapiens
gatcacttcaaagatgtgat

SEQ ID NO: 61363 - DNA, 20 bp, Homo sapiens
gatcctgtgcaacaagagct

SEQ ID NO: 61364 - DNA, 20 bp, Homo sapiens
gatcgattgcataaacttgt

SEQ ID NO: 61365 - DNA, 20 bp, Homo sapiens
gatcaccgaagtggagccca

SEQ ID NO: 61366 - DNA, 20 bp, Homo sapiens
gatccggaagcttggagttc

SEQ ID NO: 61367 - DNA, 20 bp, Homo sapiens
gatcgccatcgtgttccagg

SEQ ID NO: 61368 - DNA, 20 bp, Homo sapiens
gatctcatcatagacgaaga

SEQ ID NO: 61369 - DNA, 20 bp, Homo sapiens
gatcttcgacaacctgaaga

SEQ ID NO: 61370 - DNA, 20 bp, Homo sapiens
gatcttgtaggtggtggtcc

SEQ ID NO: 61371 - DNA, 20 bp, Homo sapiens
gatcagcctgtactacgtgg

SEQ ID NO: 61372 - DNA, 20 bp, Homo sapiens
gatcccaacttcggctttga

SEQ ID NO: 61373 - DNA, 20 bp, Homo sapiens
gatccgccaggcctgagcag

SEQ ID NO: 61374 - DNA, 20 bp, Homo sapiens
gatcgtcaagttcctcccca

SEQ ID NO: 61375 - DNA, 20 bp, Homo sapiens
gatcagagggtgccgtcaag

SEQ ID NO: 61376 - DNA, 20 bp, Homo sapiens
gatcataataaaaaggctta

SEQ ID NO: 61377 - DNA, 20 bp, Homo sapiens
gatcttgaatgcggacaatt

SEQ ID NO: 61378 - DNA, 20 bp, Homo sapiens
gatccagcctctaggctcca

SEQ ID NO: 61379 - DNA, 20 bp, Homo sapiens
gatcttggagaatgtgagaa

SEQ ID NO: 61380 - DNA, 20 bp, Homo sapiens
gatctgggaagaatgaaatg

SEQ ID NO: 61381 - DNA, 20 bp, Homo sapiens
gatcagacatcctttataaa

SEQ ID NO: 61382 - DNA, 20 bp, Homo sapiens
gatcgttgtgcttttttttc

SEQ ID NO: 61383 - DNA, 20 bp, Homo sapiens
gatcaatggcccagaccatg

SEQ ID NO: 61384 - DNA, 20 bp, Homo sapiens
gatcccagactccttggcat

SEQ ID NO: 61385 - DNA, 20 bp, Homo sapiens
gatctgcttggcctcctgct

SEQ ID NO: 61386 - DNA, 20 bp, Homo sapiens
gatctggatgacttcactgg

SEQ ID NO: 61387 - DNA, 20 bp, Homo sapiens
gatcatcaatgggtttattg

SEQ ID NO: 61388 - DNA, 20 bp, Homo sapiens
gatcatgttcattgtctcag

SEQ ID NO: 61389 - DNA, 20 bp, Homo sapiens
gatcctgtctaaaaaaataa

SEQ ID NO: 61390 - DNA, 20 bp, Homo sapiens
gatccttatgagtattcacc

SEQ ID NO: 61391 - DNA, 20 bp, Homo sapiens
gatctatttcccagcttatc

SEQ ID NO: 61392 - DNA, 20 bp, Homo sapiens
gatcttaaaagttaccaaac

SEQ ID NO: 61393 - DNA, 20 bp, Homo sapiens
gatcttcaggctgaacagac

SEQ ID NO: 61394 - DNA, 20 bp, Homo sapiens
gatcatggtataataaatcc

SEQ ID NO: 61395 - DNA, 20 bp, Homo sapiens
gatcattctgaagcaaattc

SEQ ID NO: 61396 - DNA, 20 bp, Homo sapiens
gatccaggtacagcatgtgg

SEQ ID NO: 61397 - DNA, 20 bp, Homo sapiens
gatcctgggggatgtcttca

SEQ ID NO: 61398 - DNA, 20 bp, Homo sapiens
gatctaactaccattttata

SEQ ID NO: 61399 - DNA, 20 bp, Homo sapiens
gatctggaggtctgattttg

SEQ ID NO: 61400 - DNA, 20 bp, Homo sapiens
gatcaaatgatactgataca

SEQ ID NO: 61401 - DNA, 20 bp, Homo sapiens
gatcctctcagctatctagt

SEQ ID NO: 61402 - DNA, 20 bp, Homo sapiens
gatctgccatggacatgtgt

SEQ ID NO: 61403 - DNA, 20 bp, Homo sapiens
gatcagtgggtgagactgct

SEQ ID NO: 61404 - DNA, 20 bp, Homo sapiens
gatccaagaagaaaagagaa

SEQ ID NO: 61405 - DNA, 20 bp, Homo sapiens
gatccgttttttttgttttt

SEQ ID NO: 61406 - DNA, 20 bp, Homo sapiens
gatctccaccccagaccttc

SEQ ID NO: 61407 - DNA, 20 bp, Homo sapiens
gatcttggagtaggcgccca

SEQ ID NO: 61408 - DNA, 20 bp, Homo sapiens
gatcctctggctgagaatct

SEQ ID NO: 61409 - DNA, 20 bp, Homo sapiens
gatctcaattcccctcttcc

SEQ ID NO: 61410 - DNA, 20 bp, Homo sapiens
gatccgctgcaactctgagg

SEQ ID NO: 61411 - DNA, 20 bp, Homo sapiens
gatctctgtttttatcctct

SEQ ID NO: 61412 - DNA, 20 bp, Homo sapiens
gatcaaagacgtggattggt

SEQ ID NO: 61413 - DNA, 20 bp, Homo sapiens
gatcagagactccagagggt

SEQ ID NO: 61414 - DNA, 20 bp, Homo sapiens
gatcatgctcttctaccaca

SEQ ID NO: 61415 - DNA, 20 bp, Homo sapiens
gatcctgcatggatgttaat

SEQ ID NO: 61416 - DNA, 20 bp, Homo sapiens
gatcacttgtcggctggggc

SEQ ID NO: 61417 - DNA, 20 bp, Homo sapiens
gatcgcccacaagccttact

SEQ ID NO: 61418 - DNA, 20 bp, Homo sapiens
gatcaaagataatggcatca

SEQ ID NO: 61419 - DNA, 20 bp, Homo sapiens
gatcatgaggtacaaccaac

SEQ ID NO: 61420 - DNA, 20 bp, Homo sapiens
gatcttgtgcgagatgccat

SEQ ID NO: 61421 - DNA, 20 bp, Homo sapiens
gatcaaagaagttgtgtggg

SEQ ID NO: 61422 - DNA, 20 bp, Homo sapiens
gatcaatttcttgctactga

SEQ ID NO: 61423 - DNA, 20 bp, Homo sapiens
gatcagtcccaacctcccta

SEQ ID NO: 61424 - DNA, 20 bp, Homo sapiens
gatcatagtgcatcctattc

SEQ ID NO: 61425 - DNA, 20 bp, Homo sapiens
gatccgcctggagaccctct

SEQ ID NO: 61426 - DNA, 20 bp, Homo sapiens
gatctgtaaataaacctttt

SEQ ID NO: 61427 - DNA, 20 bp, Homo sapiens
gatcttcatcatcacaagat

SEQ ID NO: 61428 - DNA, 20 bp, Homo sapiens
gatcttcacttgtagcacaa

SEQ ID NO: 61429 - DNA, 20 bp, Homo sapiens
gatcaaggccacagggtcca

SEQ ID NO: 61430 - DNA, 20 bp, Homo sapiens
gatcacgttcaaggggtgca

SEQ ID NO: 61431 - DNA, 20 bp, Homo sapiens
gatcccagcacgcctggccg

SEQ ID NO: 61432 - DNA, 20 bp, Homo sapiens
gatccccagagtcagggagg

SEQ ID NO: 61433 - DNA, 20 bp, Homo sapiens
gatcgtggtcggtggaggaa

SEQ ID NO: 61434 - DNA, 20 bp, Homo sapiens
gatctcctcctgctgctccc

SEQ ID NO: 61435 - DNA, 20 bp, Homo sapiens
gatctcctcttctctgtgct

SEQ ID NO: 61436 - DNA, 20 bp, Homo sapiens
gatcaccacgctgccactct

SEQ ID NO: 61437 - DNA, 20 bp, Homo sapiens
gatcaccgtggacagcatca

SEQ ID NO: 61438 - DNA, 20 bp, Homo sapiens
gatccaaagctctccagatt

SEQ ID NO: 61439 - DNA, 20 bp, Homo sapiens
gatcctgggtgatgtcttca

SEQ ID NO: 61440 - DNA, 20 bp, Homo sapiens
gatctgattggtgtcagaga

SEQ ID NO: 61441 - DNA, 20 bp, Homo sapiens
gatctgccagtaaccctcga

SEQ ID NO: 61442 - DNA, 20 bp, Homo sapiens
gatctggcctctgtcctgtg

SEQ ID NO: 61443 - DNA, 20 bp, Homo sapiens
gatcttcctgggaggtggct

SEQ ID NO: 61444 - DNA, 20 bp, Homo sapiens
gatcttcggcctgagcgaga

SEQ ID NO: 61445 - DNA, 20 bp, Homo sapiens
gatctttggtggcattgact

SEQ ID NO: 61446 - DNA, 20 bp, Homo sapiens
gatcacatcagagctaccaa

SEQ ID NO: 61447 - DNA, 20 bp, Homo sapiens
gatcacctcatgtctgccca

SEQ ID NO: 61448 - DNA, 20 bp, Homo sapiens
gatcagaataataatgagaa

SEQ ID NO: 61449 - DNA, 20 bp, Homo sapiens
gatcagtctcacttggttga

SEQ ID NO: 61450 - DNA, 20 bp, Homo sapiens
gatcatcttgcccttctgcc

SEQ ID NO: 61451 - DNA, 20 bp, Homo sapiens
gatcaaagaagaaaagaaga

SEQ ID NO: 61452 - DNA, 20 bp, Homo sapiens
gatctgcgcagtgccccgcc

SEQ ID NO: 61453 - DNA, 20 bp, Homo sapiens
gatcaccatgtccaagcgtc

SEQ ID NO: 61454 - DNA, 20 bp, Homo sapiens
gatcagctgcctggtggctg

SEQ ID NO: 61455 - DNA, 20 bp, Homo sapiens
gatcatccagcagcagggct

SEQ ID NO: 61456 - DNA, 20 bp, Homo sapiens
gatcccctctgcggcttgtg

SEQ ID NO: 61457 - DNA, 20 bp, Homo sapiens
gatcagcgcctgggcggccg

SEQ ID NO: 61458 - DNA, 20 bp, Homo sapiens
gatcttggtgctgagccgcc

SEQ ID NO: 61459 - DNA, 20 bp, Homo sapiens
gatcctggcatcattttctg

SEQ ID NO: 61460 - DNA, 20 bp, Homo sapiens
gatctggaaaataagcatct

SEQ ID NO: 61461 - DNA, 20 bp, Homo sapiens
gatctggcctccgtcctatg

SEQ ID NO: 61462 - DNA, 20 bp, Homo sapiens
gatcagcatcgggactccac

SEQ ID NO: 61463 - DNA, 20 bp, Homo sapiens
gatcatacttgtgggtcctc

SEQ ID NO: 61464 - DNA, 20 bp, Homo sapiens
gatccacaggggctggccgt

SEQ ID NO: 61465 - DNA, 20 bp, Homo sapiens
gatcctcggggatgtcttcc

SEQ ID NO: 61466 - DNA, 20 bp, Homo sapiens
gatcctgcttggaagtaccg

SEQ ID NO: 61467 - DNA, 20 bp, Homo sapiens
gatctactgggcgcctgtca

SEQ ID NO: 61468 - DNA, 20 bp, Homo sapiens
gatctcaccaaagtaggcag

SEQ ID NO: 61469 - DNA, 20 bp, Homo sapiens
gatctgccccgtgtacaggc

SEQ ID NO: 61470 - DNA, 20 bp, Homo sapiens
gatccaagccatatattgaa

SEQ ID NO: 61471 - DNA, 20 bp, Homo sapiens
gatcaccttgttctccatgg

SEQ ID NO: 61472 - DNA, 20 bp, Homo sapiens
gatccctgcagaagtgtcta

SEQ ID NO: 61473 - DNA, 20 bp, Homo sapiens
gatcgatattaaaaaaaaaa

SEQ ID NO: 61474 - DNA, 20 bp, Homo sapiens
gatctcttttaatttttagg

SEQ ID NO: 61475 - DNA, 20 bp, Homo sapiens
gatctgcctgcatcctgacg

SEQ ID NO: 61476 - DNA, 20 bp, Homo sapiens
gatctgcgccctggtcctgg

SEQ ID NO: 61477 - DNA, 20 bp, Homo sapiens
gatcagtgcgtcatggaggt

SEQ ID NO: 61478 - DNA, 20 bp, Homo sapiens
gatccgactcttgctttggg

SEQ ID NO: 61479 - DNA, 20 bp, Homo sapiens
gatcggcctgaaggagggcc

SEQ ID NO: 61480 - DNA, 20 bp, Homo sapiens
gatcagagcctatggcagtg

SEQ ID NO: 61481 - DNA, 20 bp, Homo sapiens
gatctattttagataatttc

SEQ ID NO: 61482 - DNA, 20 bp, Homo sapiens
gatcttaagagttcacttag

SEQ ID NO: 61483 - DNA, 20 bp, Homo sapiens
gatctctgagcacacttgta

SEQ ID NO: 61484 - DNA, 5168 bp, Homo sapiens
gccttggtcattggaccggctcccaaccaaaaccacaccatagggttttctgctcttggccaacccaacatgagaaaagaggaattaaatggtcctactaataagaaagcctcagcgtagcattaagggacgtagcaggtcttctggccacactcccctacaaatgtggaaagctcattggtgaaaacagttctcaggggtcaaagcaaaggaactgatctgggtaaagtagaggctgcctgatcccaatcagacatcctcacctctcaataacctttgccatttctctgccatagagtgaaagtgtccccaggccaaaagcccagggctccaggctgccatcaggatggtgggtgaaggaccctaccttatctcagatctggaccagcgaggccggcggagatcctttgcagaaagatatgaccccagcctgaagaccatgatcccagtgcgaccctgtgcaaggttagcacccaacccggtggatgatgccgggctactctccttcgccacattttcctggctcacgccggtgatggtgaaaggctaccggcaaaggctgaccgtagacaccctgcccccattgtcgacatatgactcatctgacaccaatgccaaaagatttcgagtcctttgggatgaagaggtagcaagggtgggtcctgagaaggcctctctgagccacgtggtgtggaaattccagaggacacgcgtgttgatggacatcgtggccaacatcctgtgcatcatcatggcagccatagggccggtgattctcattcaccaaatcctccagcagactgagaggacctctgggaaagtctgggttggcattggactgtgcatagccctttttgccaccgagtttaccaaagtcttcttttgggcccttgcctgggccatcaactaccgcacggccatccggttgaaggtggcgctctccaccttggtttttgaaaacctagtgtccttcaagacattgacccacatctctgttggcgaggtgctcaatatactgtcaagtgatagctattctttgtttgaagctgccttgttttgtcctttgccagccaccatcccgatcctaatggtcttttgtgcggcgtacgcctttttcattctggggcccacagctctcatcgggatatcagtgtatgtcatattcatacccgtccagatgtttatggccaagctcaattcagctttccgaaggtcagcaattttggtgacagacaagcgagttcagacaatgaatgagtttctgacctgcatcaggctgatcaaaatgtatgcctgggagaaatcttttaccaacactatccaagatataagaaggagggaaagaaaattactggaaaaagctggatttgtccaaagtggaaactctgccctggcccccatcgtgtccaccatagccatcgtgctgacattatcctgccacatcctcctgagacgcaaactcaccgcacccgtggcatttagtgtgattgccatgtttaatgtaatgaagttttccattgcaatcttgcccttctccatcaaagcaatggctgaagcgaatgtctctctaaggagaatgaagaaaattctcatagataaaagccccccatcttacatcacccaaccagaagacccagatactgtcttgcttttagcaaatgccaccttgacatgggagcatgaagccagcaggaaaagtaccccaaagaaattgcagaaccagaaaaggcatttatgcaagaaacagaggtcagaggcatacagtgagaggagtccaccagccaagggagccactggcccagaggagcaaagtgacagcctcaaatcggttctgcacagcataagctttgtggtgagaaaggggaagatcttgggaatatgtgggaatgtgggaagtggaaagagctccctccttgcagctctcctaggacagatgcagctgcagaaaggggtggtggcagtcaatggaactttggcctacgtttcacagcaggcatggatctttcatggaaatgtgagagaaaacatactctttggagaaaagtatgatcaccaaaggtatcagcacacagtccgcgtctgtggcctccagaaggacctgagcaacctcccctatggagacctgactgagattggggagcggggcctcaacctctctggggggcagaggcagaggattagcctggcccgcgctgtctactccgaccgtcagctctacctgctggacgaccccctgtcggccgtggacgcccacgtggggaagcacgtctttgaggagtgcattaagaagacgctcaggggaaagacagtcgtcctggtgacccaccagctacagttcttagagtcttgtgatgaagttattttattagaagatggagagatttgtgaaaagggaacccacaaggagttaatggaggagagagggcgctatgcaaaactgattcacaacctgcgaggattgcagttcaaggatcctgaacacctttacaatgcagcaatggtggaagccttcaaggagagccctgctgagagagaggaagatgctggtataatcgttttggctccaggaaatgagaaagatgaaggaaaagaatctgaaacaggctcagaatttgtagacacaaaagttcctgagcaccagctcatccagactgaatccccccaggaaggaaccgtgacctggaaaacatatcacacgtacattaaggcttctggagggtacctcctttctctcttcactgtgttcctcttcctcctgatgattggcagcgctgccttcagcaactggtggctgggtctctggttggacaagggctcacggatgacctgtgggccccagggcaacaggaccatgtgtgaggtcggcgcggtgctggcagacatcggtcagcatgtgtaccagtgggtgtacactgcaagcatggtgttcatgctggtgtttggcgtcaccaaaggcttcgtcttcaccaagaccacactgatggcatcctcctctctgcatgacacggtgtttgataagatcttaaagagcccaatgagtttctttgacacgactcccactggcaggctaatgaaccgtttttccaaggatatggacgagctggatgtgaggctgccgtttcacgcagagaactttctgcagcagttttttatggtggtgtttattctcgtgatcttggctgctgtgtttcctgctgtccttttagtcgtggccagccttgctgtaggcttcttcattctgttacgcattttccacagaggagtccaggagctcaagaaggtggagaatgtcagccggtcaccctggttcacccacatcacctcctccatgcagggcctgggcatcattcacgcctatggcaagaaggagagctgcatcacctatcacctcctctactttaactgtgctctcaggtggtttgcgctgagaatggatgtcctcatgaacatccttaccttcactgtggccttgttggtgaccctgagtttctcctccatcagtacttcatccaaaggcctgtcattgtcatacatcatccagctgagcggactgctccaagtgtgtgtgcgaacgggaacagagacgcaagccaaattcacctccgtggagctgctcagggaatacatttcgacctgtgttcctgaatgcactcatcccctcaaagtggggacctgtcccaaggactggcccagccgtggggagatcaccttcagagactatcagatgagatacagagacaacaccccccttgttctcgacagcctgaacttgaacatacaaagtgggcagacagtcgggattgttggaagaacaggttccggaaagtcatcgttaggaatggctttgtttcgtctggtggagccagccagtggcacaatctttattgatgaggtggatatctgcattctcagcttggaagacctcagaaccaagctgactgtgatcccacaggatcctgtcctgtttgtaggtacagtaaggtacaacttggatccctttgagagtcacaccgatgagatgctctggcaggttctggagagaacattcatgagagacacaataatgaaactcccagaaaaattacaggcagaagtcacagaaaatggagaaaacttctcagtaggggaacgtcagctgctttgtgtggcccgagctcttctccgtaattcaaagatcattctccttgatgaagccaccgcctctatggactccaagactgacaccctggttcagaacaccatcaaagatgccttcaagggctgcactgtgctgaccatcgcccaccgcctcaacacagttctcaactgcgatcacgtcctggttatggaaaatgggaaggtgattgagtttgacaagcctgaagtccttgcagagaagccagattctgcatttgcgatgttactagcagcagaagtcagattgtagaggtcctggcggctgattctagaggaggaagaggctctgtgagatgaataggaggagtcttcaggaggaggggctgtcctctccgcaggcagccctggtcttcagcccctcccatccacggagtgagctggggctgaagttgtccccactgccatactcagtccatgtcaccccacttggtgggcttggggttggttctgggtggtgaaccggggcagacccagctaatggattaaaaaactgcccttcacctcccaaatccccaagggttcctcatgtgttttcaccaaaaccaccccagtgcctgagattgaaaatattgtaactttcagttagaaatcagccacaataaacaacatgggaaaatgccttaggatggagtttgcaaggtttccttgcccattatcagaaggaaaaagagcagaattttcttctcgtttaaccccactcacttccatcttgactgggtgacaagtggtaatgacacagatttgtagcgtgaaagactgaatacagtgtttggccaaaaatttttttaaaaatcatattatatgtttcaattgatctgttagaataaccaagaaaacaaaatgctggagtttctctataaatgacacttttatatcttctttattcgtcgttaaaacgcggtaggaaattaccctgaaatgtcgccttgcaattatttcactgaagatattccaatttccatactatttcctccaatagacccttgttgcct

SEQ ID NO: 61485 - DNA, 1458 bp, Homo sapiens
ccggggcaccggcggtgggcggggccagcagcgcaaactgcctgcagcggggaccggacctgcacaggccgcctatggcgggcggcgggtgggaccgcgagttacagccggccaactggggccagccaggagcctgagggtcggaagcccccaacacaagatgctgagctccttcctgagcccccagaatggcacctgggcagacaccttctctctgctcttggctcttgccgttgccctctacttgggctactactgggcatgtgtgcttcagaggcctcggctggtggctgggccgcagtttctggccttcctggagccacactgttccatcaccaccgagactttctacccaacgctgtggtgttttgaggggcgactacaaagcatcttccaagtcctcctgcagtctcagcccctagtcctttatcagagtgacatcctccaaacaccagatggaggccagctcctgctagactgggccaagcagcctgacagcagccaagaccctgatcctactacccagcccattgtgctgctgcttcctggcatcactggcagtagccaggatacatacgtcttgcacctagttaaccaagctctgagggatggctaccaggctgtcgtgtttaacaaccggggctgccgtggggaggaactgcggacccacagggctttttgtgccagcaatactgaagatctagagacagtcgtgaaccacataaagcatcgttatccccaagctccactgctggccgtgggcatctcttttggagggatactggtgctgaatcacctggcacaggccaggcaggctgcagggctggtggcagcactgactctgtctgcatgctgggattcctttgagaccactcgctccctggaaaccccactcaactcactgctcttcaatcagcccctcactgctgggctctgccaacttgtggaacgaaacagaaaggtgattgaaaaggtggtggacatagactttgtactacaggcccgtacaatccgccagtttgatgagcgctacacatctgtggcctttggatatcaagactgtgttacctactacaaagcagcaagccctagaaccaagatagatgccatccggatccctgtgctctatctcagtgcagcagatgaccccttctcccccgtctgtgcccttcccatacaggccgcccaacactccccctacgttgcgctgctcatcacagcccggggtggccacatcggcttcctggaagggctgctcccgtggcagcactggtacatgagccgcctcttgcatcagtacgccaaagccatcttccaggacccagaggggctgcctgacctcagggctctcttaccttctgaggacagaaacagctgacaagagtaccatttggggtctcagttcactctttccttgtttattaaatatcaacttttcctgcctaaaaaaaaaaaaaa

SEQ ID NO: 61486 - DNA, 3198 bp, Homo sapiens
gggaggagctggcggcgagcgccgagccgggcgcgcagcgacggagctggggccggcctgggaccatgggcgtgagtgcaatctacggatcagtctctgatggtgggtcgttaacctcagtggggactccaagatttccatgaagaaaatcagttgtcttcattcaagaattggggtctggctcagaattcctgcagctggtgaaaatctgttttctagaagaggtttaattaatgcctgcagtctgacatgttcccgatttgaggtgaaaccatgaagagaaaatagaatacttaataatgcttttccgcaaccgcttcttgctgctgctggccctggctgcgctgctggcctttgtgagcctcagcctgcagttcttccacctgatcccggtgtcgactcctaagaatggaatgagtagcaagagtcgaaagagaatcatgcccgaccctgtgacggagccccctgtgacagaccccgtttatgaagctcttttgtactgcaacatccccagcgtggccgagcgcagcatggaaggtcatgccccgcatcattttaagctggtctcagtgcatgtgttcattcgccacggagacaggtacccactgtatgtcattcccaaaacaaagcgaccagaaattgactgcactctggtggctaacaggaaaccgtatcacccaaaactggaagctttcattagtcacatgtcaaaaggatccggagcctctttcgaaagccccttgaactccttgcctctttacccaaatcacccattgtgtgagatgggagagctcacacagacaggagttgtgcagcatttgcagaacggtcagctgctgagggatatctatctaaagaaacacaaactcctgcccaatgattggtctgcagaccagctctatttagagaccactgggaaaagccggaccctacaaagtgggctggccttgctttatggctttctcccagattttgactggaagaagatttatttcaggcaccagccaagtgcgctgttctgctctggaagctgctattgcccggtaagaaaccagtatctggaaaaggagcagcgtcgtcagtacctcctacgtttgaaaaacagccagctggagaagacctacggggagatggccaagatcgtggatgtccccaccaagcagcttagagctgccaaccccatagactccatgctctgccacttctgccacaatgtcagctttccctgtaccagaaatggctgtgttgacatggagcacttcaaggtaattaagacccatcagatcgaggatgaaagggaaagacgggagaagaaattgtacttcgggtattctctcctgggtgcccaccccatcctgaaccaaaccatcggccggatgcagcgtgccaccgagggcaggaaagaagagctctttgccctctactctgctcatgatgtcactctgtcaccagttctcagtgccttgggcctttcagaagccaggttcccaaggtttgcagccaggttgatctttgagctttggcaagacagagaaaagcccagtgaacattccgtccggattctttacaatggcgtcgatgtcacattccacacctctttctgccaagaccaccacaagcgttctcccaagcccatgtgcccgcttgaaaacttggtccgctttgtgaaaagggacatgtttgtagccctgggtggcagtggtacaaattattatgatgcatgtcacagggaaggattctaaaaggtatgcagtacagcagtatagaatccatgccaatacagagcatagggaaaggtccacttctagttttgtctgttactaagggtagaagattattgctttttaaaggctaaatattgtttgtgggaaccacagatggttggggttgaacagtaagcacattgctgcaatgtggtacgtgaattgcttggtacaaaatggccagttcacagaggaatagaaggtactttatcatagccagacttcgcttagaatgccagaataatatagttcaagacctgaagttgccaatccaagtttgcactcttctggcctgccccatgttactatgtgatggaaccagcacacctcaaccaaaatttttttaatcttagacatttttaccttgtccttgttaagaatttcttgaagtgatttatctaaaataaaggttggcaaactttttctgtaaagggccagattgtaaatatttcagactgtgtggaccaaaaggccacatacagtctctgtcataactactcaactctgtttctgaagcaggaaagccaccacagacagtacataaaggaatatgtgtagctgggttcccaggccggacaaaacagatggtgaccagatttggcccctgggctgtagtttgctgacccctcatctaaaaaataggctatactacaattgcacttccagcactttgagaacgagttgaataccaagaattattcaatggttcctccagtaacttctgctagaaacacagaatttggtctgtatctgacactagaacaaaacttgagggtaaataaacattgaattagaatgaatcatagaaaactgattagaagaatacttgatgtttatgatgattgtggtacaagatagttttaagtatgttctaaatatttgtctgctgtagtctatttgctgtatatgctgaaatttttgtatgccatttagtatttttatagtttaggaaaatattttctaagaccagttttagatgactcttattcctgtagtaatattcaatttgctgtacctgcttggtggttagaaggaggctagaagatgaattcaggcactttcttccaataaaactaattatggctcattccctttgacaagctgtagaactggattcatttttaaaccattttcatcagtttcaaatggtaaattctgattgatttttaaatgcgtttttggaagaactttgctattagatagtttacagatctttataaggtgttttatatattagaagcaattataattacatctgtgatttctgaactaatggtgctaattcagagaaatggaaagtgaaagtgagattctctgttgtcatcggcattccaactttttctctttgtttttgtccagtgttgcatttgaatatgtctgtttctataaataaattttttaagaatacctatactataaaaaaaaaaaaaaaaaa

SEQ ID NO: 61487 - DNA, 1347 bp, Homo sapiens
atggccggcctggggttttggggccaccctgctggacctctcctgctgctgctgctgctggtgctgccaccccgggccctgccagaaggacccctggtgttcgtggctctggtattccgccatggcgaccgggccccgctggcctcctaccccatggacccacacaaggaggtggcctccaccctgtggccacgaggcctgggccagctgaccacggagggggtccgccagcagctggagctgggccgcttcctgaggagccgctacgaggccttcctgagtccggagtaccggcgggaggaggtgtacatccgcagcacggactttgaccgcacgctggagagtgcccaggccaaccttgccgggctgtttcccgaggctgctccagggagccccgaggcccgctggaggccgatcccggtgcacacggtgcccgtggctgaggataagctgctgaggttccccatgcgcagctgtccccgataccacgagctgctgcgggaggccaccgaggccgccgagtaccaggaggccctggagggctggacgggcttcctgagtcgcctggagaacttcacgggactgtcgctggttggagagccactgcgcagggcatggaaggttctggacaccctcatgtgccagcaagcccacggtcttccactaccagcctgggcctccccagatgtcctgcggactcttgcccagatctcggctttggatattggagcccacgtgggcccaccccgggcagcagagaaggcccagctgacaggggggatcctgctgaatgctatccttgcaaacttctcccgggtccagcgcctggggctgcccctcaagatggtcatgtactcagctcatgacagcaccctgctggccctccagggggccctgggcctctatgatggacacaccccgccatatgctgcctgcctcggctttgagttccggaagcacctggggaatcccgccaaagatggagggaatgtcaccgtctccctcttctaccgcaatgactccgcccacctgcccctgcctctcagcctccccgggtgcccggccccctgtccactaggccgcttctaccagctgactgccccggcccggcctcccgcccatggggtctcctgccatggcccctatgaggctgccatccccccagctccagtggtgcccctgctggccggagctgtagctgtgctggtggcactcagcttggggctgggcctgctggcctggagaccagggtgcctgcgggccttggggggccccgtgtgagccagaaaccagggcttccctacccccagctgacactggaccccaacatgtatgctcagtagctgc

SEQ ID NO: 61488 - DNA, 1415 bp, Homo sapiens
atggccggcctggggttttggggccaccctgctggacctctcctgctgctgctgctgctggtgctgccaccccgggccctgccagaaggacccctggtgttcgtggctctggtgaggcgcccccaccccggcctgcccttagctcccccagggctagccctgaccagtcctgtccccaggtattccgccatggcgaccgggccccgctggcctcctaccccatggacccacacaaggaggtggcctccaccctgtggccacgaggcctgggccagctgaccacggagggggtccgccagcagctggagctgggccgcttcctgaggagccgctacgaggccttcctgagtccggagtaccggcgggaggaggtgtacatccgcagcacggactttgaccgcacgctggagagtgcccaggccaaccttgccgggctgtttcccgaggctgctccagggagccccgaggcccgctggaggccgatcccggtgcacacggtgcccgtggctgaggataagctgctgaggttccccatgcgcagctgtccccgataccacgagctgctgcgggaggccaccgaggccgccgagtaccaggaggccctggagggctggacgggcttcctgagtcgcctggagaacttcacgggactgtcgctggttggagagccactgcgcagggcatggaaggttctggacaccctcatgtgccagcaagcccacggtcttccactaccagcctgggcctccccagatgtcctgcggactcttgcccagatctcggctttggatattggagcccacgtgggcccaccccgggcagcagagaaggcccagctgacaggggggatcctgctgaatgctatccttgcaaacttctcccgggtccagcgcctggggctgcccctcaagatggtcatgtactcagctcatgacagcaccctgctggccctccagggggccctgggcctctatgatggacacaccccgccatatgctgcctgcctcggctttgagttccggaagcacctggggaatcccgccaaagatggagggaatgtcaccgtctccctcttctaccgcaatgactccgcccacctgcccctgcctctcagcctccccgggtgcccggccccctgtccactaggccgcttctaccagctgactgccccggcccggcctcccgcccatggggtctcctgccatggcccctatgaggctgccatccccccagctccagtggtgcccctgctggccggagctgtagctgtgctggtggcactcagcttggggctgggcctgctggcctggagaccagggtgcctgcgggccttggggggccccgtgtgagccagaaaccagggcttccctacccccagctgacactggaccccaacatgtatgctcagtagctgc

SEQ ID NO: 61489 - DNA, 1282 bp, Homo sapiens
atggccggcctggggttttggggccaccctgctggacctctcctgctgctgctgctgctggtgctgccaccccgggccctgccagaaggacccctggtgttcgtggctctggtgaggcgcccccaccccggcctgcccttagctcccccagggctagccctgaccagtcctgtccccaggtattccgccatggcgaccgggccccgctggcctcctaccccatggacccacacaaggaggtggcctccaccctgtggccacgaggcctgggccagctgaccacggagggggtccgccagcagctggagctgggccgcttcctgaggagccgctacgaggccttcctgagtccggagtaccggcgggaggaggtgtacatccgcagcacggactttgaccgcacgctggagagtgcccaggccaaccttgccgggctgtttcccgaggctgctccagggagccccgaggcccgctggaggccgatcccggtgcacacggtgcccgtggctgaggataagctgctgaggttccccatgcgcagctgtccccgataccacgagctgctgcgggaggccaccgaggccgccgagtaccaggaggccctggagggctggacgggcttcctgagtcgcctggagaacttcacgggactgtcgctggttggagagccactgcgcagggcatggaaggttctggacaccctcatgtgccagggatcctgctgaatgctatccttgcaaacttctcccgggtccagcgcctggggctgcccctcaagatggtcatgtactcagctcatgacagcaccctgctggccctccagggggccctgggcctctatgatggacacaccccgccatatgctgcctgcctcggctttgagttccggaagcacctggggaatcccgccaaagatggagggaatgtcaccgtctccctcttctaccgcaatgactccgcccacctgcccctgcctctcagcctccccgggtgcccggccccctgtccactaggccgcttctaccagctgactgccccggcccggcctcccgcccatggggtctcctgccatggcccctatgaggctgccatccccccagctccagtggtgcccctgctggccggagctgtagctgtgctggtggcactcagcttggggctgggcctgctggcctggagaccagggtgcctgcgggccttggggggccccgtgtgagccagaaaccagggcttccctacccccagctgacactggaccccaacatgtatgctcagtagctgc

SEQ ID NO: 61490 - DNA, 1068 bp, Homo sapiens
atggccggcctggggttttggggccaccctgctggacctctcctgctgctgctgctgctggtgctgccaccccgggccctgccagaaggacccctggtgttcgtggctctggtattccgccatggcgaccgggccccgctggcctcctaccccatggacccacacaaggaggtggcctccaccctgtggccacgaggcctgggccagctgaccacggagggggtccgccagcagctggagctgggccgcttcctgaggagccgctacgagggcttcctgagtcgcctggagaacttcacgggactgtcgctggttggagagccactgcgcagggcatggaaggttctggacaccctcatgtgccagcaagcccacggtcttccactaccagcctgggcctccccagatgtcctgcggactcttgcccagatctcggctttggatattggagcccacgtgggcccaccccgggcagcagagaaggcccagctgacaggggggatcctgctgaatgctatccttgcaaacttctcccgggtccagcgcctggggctgcccctcaagatggtcatgtactcagctcatgacagcaccctgctggccctccagggggccctgggcctctatgatggacacaccccgccatatgctgcctgcctcggctttgagttccggaagcacctggggaatcccgccaaagatggagggaatgtcaccgtctccctcttctaccgcaatgactccgcccacctgcccctgcctctcagcctccccgggtgcccggccccctgtccactaggccgcttctaccagctgactgccccggcccggcctcccgcccatggggtctcctgccatggcccctatgaggctgccatccccccagctccagtggtgcccctgctggccggagctgtagctgtgctggtggcactcagcttggggctgggcctgctggcctggagaccagggtgcctgcgggccttggggggccccgtgtgagccagaaaccagggcttccctacccccagctgacactggaccccaacatgtatgctcagtagctgc

SEQ ID NO: 61491 - DNA, 1886 bp, Homo sapiens
gttagaggcggcttgtgtccacgggacgcgggcggatcttctccggccatgaggaagccagccgctggcttccttccctcactcctgaaggtgctgctcctgcctctggcacctgccgcagcccaggattcgactcaggcctccactccaggcagccctctctctcctaccgaatacgaacgcttcttcgcactgctgactccaacctggaaggcagagactacctgccgtctccgtgcaacccacggctgccggaatcccacactcgtccagctggaccaatatgaaaaccacggcttagtgcccgatggtgctgtctgctccaacctcccttatgcctcctggtttgagtctttctgccagttcactcactaccgttgctccaaccacgtctactatgccaagagagtcctgtgttcccagccagtctctattctctcacctaacactctcaaggagatagaagcttcagctgaagtctcacccaccacgatgacctcccccatctcaccccacttcacagtgacagaacgccagaccttccagccctggcctgagaggctcagcaacaacgtggaagagctcctacaatcctccttgtccctgggaggccaggagcaagcgccagagcacaagcaggagcaaggagtggagcacaggcaggagccgacacaagaacacaagcaggaagaggggcagaaacaggaagagcaagaagaggaacaggaagaggagggaaagcaggaagaaggacaggggactaaggagggacgggaggctgtgtctcagctgcagacagactcagagcccaagtttcactctgaatctctatcttctaacccttcctcttttgctccccgggtacgagaagtagagtctactcctatgataatggagaacatccaggagctcattcgatcagcccaggaaatagatgaaatgaatgaaatatatgatgagaactcctactggagaaaccaaaaccctggcagcctcctgcagctgccccacacagaggccttgctggtgctgtgctattcgatcgtggagaatacctgcatcataacccccacagccaaggcctggaagtacatggaggaggagatccttggtttcgggaagtcggtctgtgacagccttgggcggcgacacatgtctacctgtgccctctgtgacttctgctccttgaagctggagcagtgccactcagaggccagcctgcagcggcaacaatgcgacacctcccacaagactccctttgtcagccccttgcttgcctcccagagcctgtccatcggcaaccaggtagggtccccagaatcaggccgcttttacgggctggatttgtacggtgggctccacatggacttctggtgtgcccggcttgccacgaaaggctgtgaagatgtccgagtctctgggtggctccagactgagttccttagcttccaggatggggatttccctaccaagatttgtgacacagactatatccagtacccaaactactgttccttcaaaagccagcagtgtctgatgagaaaccgcaatcggaaggtgtcccgcatgagatgtctgcagaatgagacttacagtgcgctgagccctggcaaaagtgaggacgttgtgcttcgatggagccaggagttcagcaccttgactctaggccagttcggatgagctggcgtctattctgcccacaccccagcccaacctgcccacgttctctattgttttgagaccccattgctttcaggctgccccttctgggtctgttactcggcccctactcacatttccttgggttggagcaacagtcccagagagggccacggtgggagctgcgccctccttaaaagatgactttacataaaatgttgatcttc

SEQ ID NO: 61492 - DNA, 1433 bp, Homo sapiens
atgtgggctccaccagcagcaatcatgggggatgggcccaccaagaaggtgggcaaccaggcccccctgcagacacaggccctccagactgcctctttaagggatggcccggcgaagcgggccgtgtgggtccgccatacgagttcagagccacaagaacctactgaatcaaaggcagccaaggagaggcccaagcaggaggtgaccaaagcagtggtcgtggacctgggcactggctactgtaaatgtggctttgccggcctgccaagacccacccacaagatctcaacaacggtgggcaagccctacatggagaccgccaagactggggataatcgcaaggagacattcgtggggcaggaactcaacaacacaaacgttcatctcaagctggttaaccctctgcgacatggcatcatcgtggactgggatacagtgcaggatatctgggaatatctcttccgacaagagatgaagatcgccccggaggagcatgcggtcttggtttcagacccgccactgagcccacacaccaacagagagaaatatgctgaaatgctgtttgaagccttcaacacccctgcaatgcacatcgcctaccagtcgcgcctgtccatgtactcctatggaaggacctccggcctggtggtggaggtgggccatggcgtgtcctacgtggtccccatctacgagggttatcctttgcccagcatcaccggaaggctggactacgcgggctctgacctgacagcctacctgctgggcctgctgaacagtgcggggaacgaattcacccaggaccagatgggcatcgtggaggacatcaagaagaaatgctgctttgtggccctggatcccattgaggagaagaaagtccctctcagtgagcatacgatccgctacgtgctgccggatgggaaggagattcagctgtgccaggaacggttcctctgctcggagatgttcttcaagccatctctcatcaagtccatgcagctgggcctccacacccaaaccgtgtcctgccttaacaagtgtgacatcgccctcaaacgggacctcatggggaacatcctgctctgcgggggcagcacgatgctcagtggcttccctaaccgtctgcagaaggagctaagcagcatgtgtcccaatgacaccccgcaggtaaacgtgctgcctgaaagagacagtgccgtgtggaccggtggctccatcctggcctcacttcagggtttccaaccattgtgggtccaccgctttgagtacgaggaacacgggcctttcttcctctacagaaggtgcttctgaacggcgacgaggatggacactgcactggcagtgcctaccctcgacagggtgagcgcactcctacacacagggggtggagccggcgcttattcctgtagcattaaacacccctcatatgcccctcc

SEQ ID NO: 61493 - DNA, 1339 bp, Homo sapiens
atggcgacaaggaacagccccatgcccctgggcacggctcagggtgaccctggagaggcaggaacacggcccggccctgacgccagcctccgggacacaggtgcggccactcagctcaagatgaagcccaggaaggtgcacaagatcaaggcggtcatcatcgacctgggctcccagtactgcaagtgcggctacgcgggagagccgaggcccacctacttcatctcctccaccgtgggcaaacgctgccccgaggcggccgacgctggcgacacccgcaagtggactttagtgggccatgagctgctcaacacggaggcgcctctcaagctggtgaacccgctgaagcacggcatcgtggtggactgggactgcgtgcaggacatctgggagtacatcttccgcaccgccatgaagatcctccccgaggagcacgctgtgctggtctccgaccctccgctcagccccagcagcaaccgggagaagtacgcggagctcatgtttgagacattcggcatcccagccatgcacgtgacgtcccagtcgttgctgtccatctactcctacggcaagacctcggggctggtggtggagagcgggcacggcgtctcgcacgtggtgcccatatccgagggcgacgtgctgccgggcctgaccagccgcgccgactacgctgggggtgacctcaccaactacctgatgcagctgctcaatgaggcgggccacgcattcacggacgaccacctgcacatcatagagcacatcaagaagaagtgctgctatgcggccttcctgcccgaggaggagctgggcctggtcccggaggagctgcgcgtggactacgagctcccggacggcaaactcatcactattggccaggagcgcttccgttgctctgagatgctcttccagccctccctggcaggcagcacccagccgggcctcccggagctcacagctgcctgcctgggccgctgccaggacacgggcttcaaggaggagatggccgccaacgtgctactgtgtggcggctgcactatgctggatggcttccccgagcgcttccagagggagctgagcctcctctgccccggggacagccctgcagtggctgccgctcctgagaggaagacctccgtgtggaccggcggttccatcctggcctccctgcaggccttccaacagctctgggtcagcaaggaagagtttgaggagcggggcagcgtggccatctacagcaagtgctgagcctcggcatttccacagacaaggcctccagcacagatggcacaggcctctctatacacatttacagaatttcacataaaggtttactctg

SEQ ID NO: 61494 - DNA, 1437 bp, Homo sapiens
tggaagaggcctcagcaggcccaggccacctggagggagagcagacctgcggctgaggatgcagggctcccgggcacggtgctagccctgccttgagacaccccgagagctgtgggaagagctgtgggatcccctattgcatcacaaagcggccctggagggctggtctttattttgatgaggctgagaagggaaggctgcgggcatgtttaatccgcacgctttagactccccggctgtgatttttgacaatggctcggggttctgcaaagcgggcctgtctggggagtttggaccccggcacatggtcagctccatcgtggggcacctgaaattccaggctccctcagcagaggccaaccagaagaagtactttgtgggggaggaggccctgtacaagcaggaggccctgcagctgcactcccctttcgagcgtggcctgatcacagggtgggatgacgtggagagactctggaagcacctctttgagtgggagctaggcgtgaaacccagcgaccagcccctgcttgcaacggagccctccctgaaccccagggagaaccgtgagaagatggcagaagtcatgttcgagaacttcggcgtgcccgctttctacctgtcggaccaggcggtgctggctctctacgcctctgcctgtgtcacgggcctggtggtggacagcggggatgcggtcacctgcactgtccccatctttgagggttactccctgccccacgcagtcaccaagctccacgtggcgggcagggacatcacggagctcctcatgcagctgctcctggccagcggccacaccttcccctgccagctggacaagggtctcgtggacgacatcaaaaagaagctgtgctacgtggccttggagcccgagaaggagctttcccggaggccggaggaggtcctgagggagtacaagctgcccgacgggaacatcatcagcctcggggacccgctgcaccaggcgcccgaggccctgttcgtgccccagcagctgggcagccagagccccgggctctcgaatatggtctccagcagcatcaccaagtgtgataccgacatccagaagatcctctttggggagattgtgctgtcggggggcactaccctgttccacgggctggatgaccggcttctcaaggagctggagcagctggcctccaaggacacccccatcaagatcacggctccccccgaccggtggttctccacctggattggagcctccatcgtcacctctctgagtagcttcaagcagatgtgggtcaccgccgcagacttcaaggagtttgggacctccgtggtgcagagaagatgcttctgaaggccgcttctcgttgggtaccgtggggggtgaaccctagccccagctttgggaggatgttcaataaaggaccaatgccggaaaaaaaaaaaaaaaaa

SEQ ID NO: 61495 - DNA, 2248 bp, Homo sapiens
atgttccttctcctcgccctcctcactgagcttggaagactgcaagcccacgaaggttctgaaggaatatttctgcatgtcacagttccacggaagattaagtcaaatgacagtgaagtttcagagaggaagatgatttacatcattacaattgatggacaaccttacactctacatctcggaaaacaatcattcttaccccagaactttttggtttatacatataatgaaactggatctttgcattctgtgtctccatattttatgatgcattgccattaccaaggatatgctgccgaatttccaaattcatttgtgacactcagtatatgttctggtctcaggggatttctccagtttgaaaatatcagttatggaattgaaccagtagaatcttcagcaagatttgagcatataatttatcaaatgaaaaataatgatccaaatgtatccattttagcagtaaattacagtcatatttggcagaaagaccagccctacaaagttcctttaaactcacagataaaaaatctttcaaaactattaccccaatatctggaaatatacattatagtggaaaaagctttgtatgattatatgggatctgaaatgatggctgtaacacaaaaaattgtccaggttattgggcttgtcaacactatgtttacccagttcaaattgactgttatactgtcttccttggaattgtggtcaaatgaaaaccagatttccaccagtggggatgctgatgatatattacaaagatttttggcatggaaacgggactatctcatcctacggccccatgacatagcatacttacttgtttacaggaaacatcctaaatatgtgggagcaacatttcctggcaccgtatgcaataaaagctatgatgcaggtattgctatgtatccagatgcaataggtttggagggattttcggttattatagctcaactgcttggccttaatgtaggattaacatatgatgacatcactcagtgtttctgtctgagagctacatgcatcatgaatcatgaagcagtgagtgccagtggtagaaagatttttagcaactgcagcatgcacgactatagatattttgtttcaaaatttgagactaaatgccttcagaagctttcaaatttgcaaccattacatcaaaatcaaccagtgtgtggtaatgggattttggaatccaatgaagaatgtgactgtggtaataaaaatgaatgtcaatttaagaagtgctgtgattataacacatgtaaactgaagggctcagtaaaatgtggttctggaccatgttgtacatcaaagtgtgagttgtcaatagcaggcactccatgtagaaagagtattgatccagagtgtgattttacagagtactgcaatggaacctctagtaattgtgttcctgacacttatgcattgaatggccgtttgtgcaagttgggaactgcctattgctataacggacaatgtcaaactactgataaccagtgtgccaagatatttggaaaaggtgctcaaggtgctccatttgcctgttttaaagaagttaattctctgcatgaaagatctgaaaactgtggttttaaaaattcacaaccattaccttgtgaacggaaggatgttctctgtggaaaattagcttgtgttcagccacataaaaatgctaataaaagtgacgctcaatctacagtttattcatatattcaagaccatgtatgtgtatctatagccactggttcctccatgagatcagatggaacagacaatgcctatgtggctgatggcaccatgtgtggtccagaaatgtactgtgtaaataaaacctgcagaaaagttcatttaatgggatataactgtaatgccaccacaaaatgcaaagggaaagggatatgtaataattttggtaattgtcaatgcttccctggacatagacctccagattgtaaattccagtttggttccccagggggtagtattgatgatggaaattttcagaaatctggtgacttttatactgaaaaaggctacaatacacactggaacaactggtttattctgagtttctgcatttttctgccgtttttcatagttttcaccactgtgatctttaaaagaaatgaaataagtaaatcatgtaacagagagaatgcagagtataatcgtaattcatccgttgtatcagaaagcgatgacgtgggacattaatattgcacagaacttccatagcaaataa

SEQ ID NO: 61496 - DNA, 3282 bp, Homo sapiens
aataaaagctctcctgatggcctgttcctgcacatttcctgaggacgccctcgatcacaagcagcttgctggatgaataaaggaaagaaggtttatatacactaataatagaaatgttttgggatggttcatgatttcgaaaagcttcagagaaaataaagatgcttaatgttagagtacaaaacatgttctccctgcagtctcacgaactgtgaacaaaaactgaagtgaaaactcatagtgcataactcgtcaatactcctgtgatcgtataaccatcagcaagaaaacaaatttgattgagcccccatccagtcctctttgcgtggaatcagacctcttttgcagtggaaaggagcagagaatgtgactttcctgaacaacaggagcaagaatcaatgccagattctcttctctaaaaataatcaatttgttactacagtgctgcagctctgatggttcaactctgccaaaagatggatctttaatgattagcactacacactgaccaactcagaagaaggagccacaccacctgtgactccagccctgacttctgctctggaccagtgtttccataacagggacttcaaaatcactgtgatttgaagcctttttgaacatgaagatgttactcctgctgcattgccttggggtgtttctgtcctgttctggacacatccaggatgagcacccccaatatcacagccctccggatgtggtgattcctgtgaggataactggcaccaccagaggcatgacacctccaggctggctctcctatatcctgccctttggaggccagaaacacattatccacataaaggtcaagaagcttttgttttccaaacacctccctgtgttcacctacacagaccagggtgctatccttgaggaccagccatttgtccagaataactgctactatcatggttatgtggaaggggacccagaatccctggtttccctcagtacctgttttgggggttttcaaggaatattacagataaatgactttgcttatgaaatcaagcccctagcattttctaccacgtttgaacatctggtatacaagatggacagtgaggagaaacaattttcaaccatgagatccggatttatgcaaaatgaaataacatgccgaatggaatttgaagaaattgataattccactcagaagcaaagttcttatgtgggctggtggatccattttaggattgttgaaattgtagtcgtcattgataattatctgtacattcgttatgaaaggaacgactcaaagttgctggaggatctatatgttattgttaatatagtggattccattttggatgtcattggtgttaaggtgttattatttggtttggagatctggaccaataaaaacctcattgtagtagatgatgtaaggaaatctgtgcacctgtattgcaagtggaagtcggagaacattacgccccggatgcaacatgacacctcacatcttttcacaactctaggattaagagggttaagtggcataggagcttttagaggaatgtgtacaccacaccgtagttgtgcaattgttactttcatgaacaaaactttgggcactttttcaattgcagtggctcatcatctaggtcataatttgggcatgaaccatgatgaggatacatgtcgttgttcacaacctagatgcataatgcatgaaggcaacccaccaataactaaatttagcaattgtagttatggtgatttttgggaatatactgtagagaggacaaagtgtttgcttgaaacagtacacacaaaggacatctttaatgtgaagcgctgtgggaatggtgttgttgaagaaggagaagagtgtgactgtggacctttaaagcattgtgcaaaagatccctgctgtctgtcaaattgcactctgactgatggttctacttgtgcttttgggctttgttgcaaagactgcaagttcctaccatcagggaaagtgtgtagaaaggaggtcaatgaatgtgatcttccagagtggtgcaatggtacttcccataagtgcccagatgacttttatgtggaagatggaattccctgtaaggagaggggctactgctatgaaaagagctgtcatgaccgcaatgaacagtgtaggaggatttttggtgcaggcgcaaatactgcaagtgagacttgctacaaagaattgaacaccttaggtgaccgtgttggtcactgtggtatcaaaaatgctacatatataaagtgtaatatctcagatgtccagtgtggaagaattcagtgtgagaatgtgacagaaattcccaatatgagtgatcatactactgtgcattgggctcgcttcaatgacataatgtgctggagtactgattaccatttggggatgaagggacctgatattggtgaagtgaaagatggaacagagtgtgggatagatcatatatgcatccacaggcactgtgtccatataaccatcttgaatagtaattgctcacctgcattttgtaacaagaggggcatctgcaacaataaacatcactgccattgcaattatctgtgggaccctcccaactgcctgataaaaggctatggaggtagtgttgacagtggcccaccccctaagagaaagaagaaaaagaagttctgttatctgtgtatattgttgcttattgttttgtttattttattatgttgtctttatcgactttgtaaaaaaagtaaaccaataaaaaagcagcaagatgttcaaactccatctgcaaaagaagaggaaaaaattcagcgtcgacctcatgagttacctccccagagtcaaccttgggtgatgccttcccagagtcaacctcctgtgacgccttcccagagtcatcctcaggtgatgccttcccagagtcaacctcctgtgacaccctcccagagtcaacctcgggtgatgccttctcagagtcaacctcctgtgatgccttcccagagtcatcctcagttgacgccttcccagagtcaacctcctgtgacaccctcccagaggcaacctcagttgatgccttcccagagtcaacctcctgtgacgccctcctagagccaacctcagttgatgccttcccagagtcaacctcctgtgacgccctcccagagccaacctcgggtgacaccctcccagagtcaacctcatgtgacaccttaccggagtaaaagtggtaaacaaaagcaatcagtaccaattccaaaaactgtatccagaaaaggtacattaaaaaaataattcctagtaaaaaa

SEQ ID NO: 61497 - DNA, 2707 bp, Homo sapiens
ccggggcctccggagaacgctgtcccatgaacgtgcggggagcggcccccggcgtccgcgcgtccccgcgtccctggcaattcccgacttcccaacggcttcccgctggcagccccgaagccgcaccatgttccgcctctggttgctgctggccgggctctgcggcctcctggcgtcaagacccggttttcaaaattcacttctacagatcgtaattccagagaaaatccaaacaaatacaaatgacagttcagaaatagaatatgaacaaatatcctatattattccaatagatgagaaactgtacactgtgcaccttaaacaaagatattttttagcagataattttatgatctatttgtacaatcaaggatctatgaatacttattcttcagatattcagactcaatgctactatcaaggaaatattgaaggatatccagattccatggtcacactcagcacgtgctctggactaagaggaatactgcaatttgaaaatgtttcttatggaattgagcctctggaatctgcagttgaatttcagcatgttctttacaaattaaagaatgaagacaatgatattgcaatttttattgacagaagcctgaaagaacaaccaatggatgacaacatttttataagtgaaaaatcagaaccagctgttccagatttatttcctctttatctagaaatgcatattgtggtggacaaaactttggattactggggctctgatagcatgatagtaacaaataaagtcatcgaaattgttggccttgcaaattcaatgttcacccaatttaaagttactattgtgctgtcatcattggagttatggtcagatgaaaataagatttctacagttggtgaggcagatgaattattgcaaaaatttttagaatggaaacaatcttatcttaacctaaggcctcatgatattgcatatctactaatttatatggattatcctcgttatttgggagcagtgtttcctggaacaatgtgtattactcgttattctgcaggagttgcattgtaccccaaggagataactctggaggcatttgcagttattgtcacccagatgctggcactcagtctgggaatatcatatgacgacccaaagaaatgtcaatgttcagaatccacctgtataatgaatccagaagttgtgcaatccaatggtgtgaagacttttagcagttgcagtttgaggagctttcaaaatttcatttcaaatgtgggtgtcaaatgtcttcagaataagccacaaatgcaaaaaaaatctccgaaaccagtctgtggcaatggcagattggagggaaatgaaatctgtgattgtggtactgaggctcaatgtggacctgcaagctgttgtgattttcgaacttgtgtactgaaagacggagcaaaatgttataaaggactgtgctgcaaagactgtcaaattttacaatcaggcgttgaatgtaggccgaaagcacatcctgaatgtgacatcgctgaaaattgtaatggaagctcaccagaatgtggtcctgacataactttaatcaatggactttcatgcaaaaataataagtttatttgttatgacggagactgccatgatctcgatgcacgttgtgagagtgtatttggaaaaggttcaagaaatgctccatttgcctgctatgaagaaatacaatctcaatcagacagatttgggaactgtggtagggatagaaataacaaatatgtgttctgtggatggaggaatcttatatgtggaagattagtttgtacctaccctactcgaaagcctttccatcaagaaaatggtgatgtgatttatgctttcgtacgagattctgtatgcataactgtagactacaaattgcctcgaacagttccagatccactggctgtcaaaaatggctctcagtgtgatattgggagggtttgtgtaaatcgtgaatgtgtagaatcaaggataattaaggcttcagcacatgtttgttcacaacagtgttctggacatggagtgtgtgattccagaaacaagtgccattgttcgccaggctataagcctccaaactgccaaatacgttccaaaggattttccatatttcctgaggaagatatgggttcaatcatggaaagagcatctgggaagactgaaaacacctggcttctaggtttcctcattgctcttcctattctcattgtaacaaccgcaatagttttggcaaggaaacagttgaaaaagtggttcgccaaggaagaggaattcccaagtagcgaatctaaatcggaaggtagcacacagacatatgccagccaatccagctcagaaggcagcactcagacatatgccagccaaaccagatcagaaagcagcagtcaagctgatactagcaaatccaaatcagaagatagtgctgaagcatatactagcagatccaaatcacaggacagtacccaaacacaaagcagtagtaactagtgattccttcagaaggcaacggataacatcgagagtctcgctaagaaatgaaaattctgtctttccttccgtggtcacagctgaaagaaacaataaattgagtgtggatcaatttgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 61498 - DNA, 3799 bp, Homo sapiens
ctgtgttccacccgcctgggctagcacgtgggggagctgcggaagcgcggcgctgcgggccgggccgcggggcacagccgggggccggcggcggcgcgcggactccgcatcccgcaccccgatggtagccgaggagctggtgtaattacttcaagcctccaggatggcaatccagttccgttcgctcttccccttggcattgcctgggatgctggcgctcctcggctggtggtggtttttctctcgtaaaaaaggccatgtcagcagccatgatgagcagcaggtggaggctggtgctgtgcagctgagggctgaccctgccatcaaggaacctctccccgtggaagacgtctgtcccaaagtagtgtccacaccccccagtgtcacagagcctccagaaaaggaactgtccaccgtgagcaagctgcctgcagagcccccagcattgctccagacacacccaccttgccgaagatcagagtcctcgggcattcttcctaacaccacagacatgagattgcgaccaggaacacgcagagatgacagtacaaagctggagctagccctgacaggtggtgaagccaaatcgattcctctagagtgccccctttcatccccaaagggtgtactattctccagcaaatcagctgaggtgtgtaagcaagattcccccttcagcagggtgccaaggaaggtccagccaggctaccccgtagtccccgcagagaagcgtagctctggggagagggcaagagagacaggtggggccgaagggactggtgatgccgtgttgggggaaaaggtgcttgaagaagctctgttgtctcgggagcatgtcttggaattggagaacagcaagggccccagcctggcctctttagagggggaagaagataaggggaagagcagctcatcccaggtggtggggccagtgcaggaggaagagtatgtagcagagaagttgccaagtaggttcatcgagtcggctcacacagagctggcaaaggacgatgcggcgccagcacccccagtcgcagacgccaaagcccaggatagaggtgtcgagggagaactgggcaatgaggagagcttggatagaaatgaggagggcttggatagaaatgaggagggcttggatagaaatgaggagagcttggatagaaatgaggagggcttggatagaaatgaggagattaagcgggctgccttccagataatctcccaagtgatctcagaagcaaccgaacaggtgctggccaccacggttggcaaggttgcaggtcgtgtgtgtcaggccagtcagctccaagggcagaaggaagagagctgtgtcccagttcaccagaaaactgtcttgggcccagacactgcggagcctgccacagcagaggcagctgttgccccgccggatgctggcctccccttgccaggcctaccagcagagggctcaccaccaccaaagacctacgtgagctgcctgaagagccttctgtccagccccaccaaggacagtaagccaaatatctctgcacaccacatctccctggcctcctgcctggcactgaccacccccagtgaagagttgccggaccgggcaggcatcctggtggaagatgccacctgtgtcacctgcatgtcagacagcagccaaagtgtccctttggtggcttctccaggacactgctcagattctttcagcacttcagggcttgaagactcttgcacagagaccagctcgagccccagggacaaggccatcaccccgccactgccagaaagtactgtgcccttcagcaatggggtgctgaagggggagttgtcagacttgggggctgaggatggatggaccatggatgcggaagcagatcattcaggaggttctgacaggaacagcatggattccgtggatagctgttgcagtctcaagaagactgagagcttccaaaatgcccaggcaggctccaaccctaagaaggtcgacctcatcatctgggagatcgaggtgccaaagcacttagtcggtcggctaattggcaagcaggggcgctatgtgagttttctgaagcaaacatctggtgccaagatctacatttcaaccctgccttacacccagagcgtccagatctgccacatagaaggctctcaacatcatgtagacaaagcgctgaacttgattgggaagaagttcaaagagctgaacctcaccaatatctacgctcccccattgccttcactggcactgccttctctgccgatgacatcctggctcatgctgcctgatggcatcaccgtggaggtcattgtggtcaaccaggtcaatgccgggcacctgttcgtgcagcagcacacacaccctaccttccacgcgctgcgcagcctcgaccagcagatgtacctctgttactctcagcctggaatccccaccttgcccaccccagtggaaataacggtcatctgtgccgcccctggtgcggacggggcctggtggcgagcccaagtggttgcctcctacgaggagaccaacgaagtggagattcgatacgtggactacggcggatataagagggtgaaagtagacgtgctccggcaaatcaggtctgactttgtcaccctgccgtttcagggagcagaagtccttctggacagtgtgatgcccctgtcagacgatgaccagttttcaccggaagcagatgccgccatgagcgagatgacggggaatacagcactgcttgctcaggtgacaagttacagtccaactggtcttcctctgattcagctgtggagtgtggttggagatgaagtggtgttgataaaccggtccctggtggagcgaggccttgcccagtgggtagacagctactacacaagcctttgacccccatgctgcttcctgagagtctttttttgcactgttgaaattgggcttggcactcaagtcaaagatgaacatcggaataacaaacattgtcctctccagaaagtcctttctttatccatactgtagtcctattgagaagacatttcgtctctgagaaaaaaggatggaactatgggttctcttcgcaaagccaaaggatagtgtttaacaagccagctggcttatcctggttctcagctgtttaaaaaaaaaaaaaaaaaggaatagaaacagtttcaaccagattgtcctattccccctgttccattcccctcttcttccttctatctccttccccggcaaaaaccaaacaaactggcagacaggccagggatgtatgttgcttgcttgagagggtttcttttacttcaaaatctttcttcagggagcaagacatgaactgactaattggtatccactacttgtacagcttacataaatgagttgatgatatttaaccagtttttataaacttcatttaggtctctaaacacagactttttaaattgcaactgtaaatatgaaatggtcatcacatctgaccttggtcagtggggaggggaactggtatcctgccaagcctggttgtaatttgtaaccattttctatttgtgcaaactctgtaaatatgtgtttaaacaaatgtaatattttgtacaagatacactggagaacaaagggaactcaagattcttccagccacatgtcacctgtaggtagaagtaaactctgcagtgcagcttctgctcttggcccctctggccagggcccctgtggcttcctgcacactggacaggtgactgtatggtagagactgtgatctgggaactttttgctgtacaaatctgtttaaaaaaaaaaaaaagtaactcattgaattaa

SEQ ID NO: 61499 - DNA, 3801 bp, Homo sapiens
cccacccttggtggcagaaccgagcactacccagcaaggtgtaattacttcaagcctccaggatggcaatccagttccgttcgctcttccccttggcattgcctgggatgctggcgctcctcggctggtggtggtttttctctcgtaaaaaaggccatgtcagcagccatgatgagcagcaggtggaggctggtgctgtgcagctgagggctgaccctgccatcaaggaacctctccccgtggaagacgtctgtcccaaagtagtgtccacaccccccagtgtcacagagcctccagaaaaggaactgtccaccgtgagcaagctgcctgcagagcccccagcattgctccagacacacccaccttgccgaagatcagagtcctcgggcattcttcctaacaccacagacatgagattgcgaccaggaacacgcagagatgacagtacaaagctggagctagccctgacaggtggtgaagccaaatcgattcctctagagtgccccctttcatccccaaagggtgtactattctccagcaaatcagctgaggtgtgtaagcaagattcccccttcagcagggtgccaaggaaggtccagccaggctaccccgtagtccccgcagagaagcgtagctctggggagagggcaagagagacaggtggggccgaagggactggtgatgccgtgttgggggaaaaggtgcttgaagaagctctgttgtctcgggagcatgtcttggaattggagaacagcaagggccccagcctggcctctttagagggggaagaagataaggggaagagcagctcatcccaggtggtggggccagtgcaggaggaagagtatgtagcagagaagttgccaagtaggttcatcgagtcggctcacacagagctggcaaaggacgatgcggcgccagcacccccagtcgcagacgccaaagcccaggatagaggtgtcgagggagaactgggcaatgaggagagcttggatagaaatgaggagggcttggatagaaatgaggagggcttggatagaaatgaggagagcttggatagaaatgaggagggcttggatagaaatgaggagattaagcgggctgccttccagataatctcccaagtgatctcagaagcaaccgaacaggtgctggccaccacggttggcaaggttgcaggtcgtgtgtgtcaggccagtcagctccaagggcagaaggaagagagctgtgtcccagttcaccagaaaactgtcttgggcccagacactgcggagcctgccacagcagaggcagctgttgccccgccggatgctggcctccccttgccaggcctaccagcagagggctcaccaccaccaaagacctacgtgagctgcctgaagagccttctgtccagccccaccaaggacagtaagccaaatatctctgcacaccacatctccctggcctcctgcctggcactgaccacccccagtgaagagttgccggaccgggcaggcatcctggtggaagatgccacctgtgtcacctgcatgtcagacagcagccaaagtgtccctttggtggcttctccaggacactgctcagattctttcagcacttcagggcttgaagactcttgcacagagaccagctcgagccccagggacaaggccatcaccccgccactgccagaaagtactgtgcccttcagcaatggggtgctgaagggggagttgtcagacttgggggctgaggatggatggaccatggatgcggaagcagatcattcaggagttgcagctccacccccgggaaagcggggcactttgataacgaggtgtcctgggtttttcgagtgctgaccccagcgtagacagttcagaccgctaacttacaggttctgacaggaacagcatggattccgtggatagctgttgcagtctcaagaagactgagagcttccaaaatgcccaggcaggctccaaccctaagaaggtcgacctcatcatctgggagatcgaggtgccaaagcacttagtcggtcggctaattggcaagcaggggcgctatgtgagttttctgaagcaaacatctggtgccaagatctacatttcaaccctgccttacacccagagcgtccagatctgccacatagaaggctctcaacatcatgtagacaaagcgctgaacttgattgggaagaagttcaaagagctgaacctcaccaatatctacgctcccccattgccttcactggcactgccttctctgccgatgacatcctggctcatgctgcctgatggcatcaccgtggaggtcattgtggtcaaccaggtcaatgccgggcacctgttcgtgcagcagcacacacaccctaccttccacgcgctgcgcagcctcgaccagcagatgtacctctgttactctcagcctggaatccccaccttgcccaccccagtggaaataacggtcatctgtgccgcccctggtgcggacggggcctggtggcgagcccaagtggttgcctcctacgaggagaccaacgaagtggagattcgatacgtggactacggcggatataagagggtgaaagtagacgtgctccggcaaatcaggtctgactttgtcaccctgccgtttcagggagcagaagtccttctggacagtgtgatgcccctgtcagacgatgaccagttttcaccggaagcagatgccgccatgagcgagatgacggggaatacagcactgcttgctcaggtgacaagttacagtccaactggtcttcctctgattcagctgtggagtgtggttggagatgaagtggtgttgataaaccggtccctggtggagcgaggccttgcccagtgggtagacagctactacacaagcctttgacccccatgctgcttcctgagagtctttttttgcactgttgaaattgggcttggcactcaagtcaaagatgaacatcggaataacaaacattgtcctctccagaaagtcctttctttatccatactgtagtcctattgagaagacatttcgtctctgagaaaaaaggatggaactatgggttctcttcgcaaagccaaaggatagtgtttaacaagccagctggcttatcctggttctcagctgtttaaaaaaaaaaaaaaaaaggaatagaaacagtttcaaccagattgtcctattccccctgttccattcccctcttcttccttctatctccttccccggcaaaaaccaaacaaactggcagacaggccagggatgtatgttgcttgcttgagagggtttcttttacttcaaaatctttcttcagggagcaagacatgaactgactaattggtatccactacttgtacagcttacataaatgagttgatgatatttaaccagtttttataaacttcatttaggtctctaaacacagactttttaaattgcaactgtaaatatgaaatggtcatcacatctgaccttggtcagtggggaggggaactggtatcctgccaagcctggttgtaatttgtaaccattttctatttgtgcaaactctgtaaatatgtgtttaaacaaatgtaatattttgtacaagatacactggagaacaaagggaactcaagattcttccagccacatgtcacctgtaggtagaagtaaactctgcagtgcagcttctgctcttggcccctctggccagggcccctgtggcttcctgcacactggacaggtgactgtatggtagagactgtgatctgggaactttttgctgtacaaatctgtttaaaaaaaaaaaaaagtaactcattgaattaa

SEQ ID NO: 61500 - DNA, 675 bp, Homo sapiens
ctgaagagaagctagcacttgcaaacattccatctggcaatctgagagaagctactgagagaatcctgagacatccccagccacctaccactgctcctgttccaagcaaagaagatctgctcactccggaaaaagaaaatgagtgagactcaaaattcaacaagccagaaagcaatggatgaggataacaaagccgcaagccaaacaatgccgaatacacaagacaagaactacgaggatgaattgactcaagtagctctagctctggttgaggatgtcatcaattatgctgttaagattgtggaagaggagcgaaaccctttgaaaaacatcaagtggatgactcacggtgaattcactgtggaaaagggtcttaaacaaattgacgaatatttttcggatgcacccattgttgtttcttatgtaggtgaccaccaagcattagttcacagaccaggaatggttcgctttcgagaaaactggcagaagaatcttactgatgccaaatatagtttcatggagtcattccccttcttattcaatcgtgtctgatacttacaggatgtcttaggattgtttttctcatcaggatacattaaaaatacaatacagcacgtcaaaccacagaatatttattgagtaataaacttgtggcacacaaaaaaaaaaaaaaaa

SEQ ID NO: 61501 - DNA, 481 bp, Homo sapiens
ctgaagagaagctagcacttgcaaacattccatctggcaatctgagagaagctactgagagaatcctgagacatccccagccacctaccactgctcctgttccaagcaaagaagatctgctcactccggaaaaagaaaatgagtgagactcaaaattcaacaagccagaaagcaatggatgaggataacaaagccgcaagccaaacaatgccgaatacacaagacaagaactacgaggatgaattgactcaagtagctctagctctggttgaggatgtcatcaattatgctgttaagattgtggaagaggagcgaaaccctttgaaaaacatcaagtggatgactcacggtgaattcactgtggaaaagggtcttaaacaaattgacgaatatttttcggtaagttaggccgaccactccagcatggtacaccggtgtgaagaacaataaagagactctcagcagatcaaaaaaaaaaaaa

SEQ ID NO: 61502 - DNA, 855 bp, Homo sapiens
ctgaagagaagctagcacttgcaaacattccatctggcaatctgagagaagctactgagagaatcctgagacatccccagccacctaccactgctcctgttccaagcaaagaagatctgctcactccggaaaaagaaaatgagtgagactcaaaattcaacaagccagaaagcaatggatgaggataacaaagccgcaagccaaacaatgccgaatacacaagacaagaactacgaggatgaattgactcaagtagctctagctctggttgaggatgtcatcaattatgctgttaagattgtggaagaggagcgaaaccctttgaaaaacatcaagtggatgactcacggtgaattcactgtggaaaagggtcttaaacaaattgacgaatatttttcgaagtgtgtttctaaaaaatgctgggcacatggcgtagagtttgtagagaggaaagacttaattcacagcttcctctacatctactatgtacactggagtatctcaactgctgacctacccgtagcacgaatctctgctggtacctacttcaccatgaaggtctccaaaaccaaaccaccggatgcacccattgttgtttcttatgtaggtgaccaccaagcattagttcacagaccaggaatggttcgctttcgagaaaactggcagaagaatcttactgatgccaaatatagtttcatggagtcattccccttcttattcaatcgtgtctgatacttacaggatgtcttaggattgtttttctcatcaggatacattaaaaatacaatacagcacgtcaaaccacagaatatttattgagtaataaacttgtggcacacaaaaaaaaaaaaaaaa

SEQ ID NO: 61503 - DNA, 1443 bp, Homo sapiens
caagcaccgtgggaccttggctggcttctggggagcaagagatccatttatgaatacttgatttctgactgctgggaagcatggctgatgctccgaaggagggaagactgacccggtttctggacttcacccagctgatggacatggcatctgaatccgtaggaggaaaaattttatttgcaacagatgacttttttgctcctgcagaaaacctcataaagagtgacagcccgtgcttcaaagagcatgaatatacggagtttgggaaatggatggatggctgggagaccaggaggaaaaggattccaggtcacgactggtgtgtcctcaggctggggatccaaggagtcatccggggcttcgacgtggacgtttcttacttcacgggagattacgctcctcgagtgtccattcaagcagcaaacttggaagaagataaactaccagaaatcccagaaagaggaatcaggacaggagctgcagccactcctgaggagtttgaagccattgctgagctaaaatccgacgactggagttacttggttcccatgactgagcttaagccaggaaaccctgcttccggccacaactattttcttgtcaattcccagcagagatggactcatatcagactcaacattttcccagatggtggaattgcacgacttagagtattcggtactggacaaaaagactggactgcaactgaccccaaagaacctgcagacctagtggccatcgcttttgggggtgtctgtgtaggatttagtaatgctaagtttgggcacccaaacaatataataggagttggcggggcaaagtctatggcggatggttgggaaactgcaagaaggctggaccggccaccaatattagaaaatgatgagaatggcattctcttggttccgggttgtgaatgggcagttttccgattggcacatcctggagtaataactcgaattgaaattgacacaaaatattttgaaggcaatgctcctgacagctgtaaagtggatgggtgcatcctgacaactcaggaagaagccgtgatcaggcaaaagtggattctcccggcccacaagtggaaaccactgcttccagtgaccaagttgtctcccaaccaaagtcatctgttcgatagcctgaccctagagctccaagatgtcatcactcacgccaggctcaccatcgtccccgacgggggagtgagccgccttcggctccggggcttccccagctccatctgcctcctgaggccccgggagaagcccatgttgaagttctcggtgagcttcaaagcaaacccttaacacacacaaagccccggtgtcggacacacagcagtaatttcccagtcatagtcttcttttcaaatgttttgaacacctggtgatttaataaagtggtcgtctcacaaaaaaaaaaaaaaaaaaaaaaaaaaaa

SEQ ID NO: 61504 - DNA, 1932 bp, Homo sapiens
gtgatattactctcataacccggctcctgctgaatgactccctctaggatattttctagggttttatgccaatgaagtttttggttttatttgttgtaaatagcaagacttccattgttttaccaaaaaattttcagatcactcattttcactaaatttgtaaaataaaaacatatagggcatgttttagtacaatattttgattaaattaattttctatattaaaaatgcttggtttccaccttctagcaattaatattcgaagaaacaaaacattcgttctactagaatcagatgctgtgagttgattttggtagctatttgctgctctgcagacctaatttcaggctgctgtggttctcagcagcaatttgattttgtgaatattatcttttgtattctgaatcacattgctaagcagggtggtgttgtaaaaataaaaacataaggttctcttgtctgagtctgtgtgggagtcagcgatgcttatttctagcacgaaacattatctgtatggtgaatttcccgaatgctgtttgaccttggagttgttcatttaatgaaaaaaacttcaatgcctactatgtgcccagacctcttctaggtagagacgatacaagagtggtacagaagtgaacaacacaggtaagtggtctggcctacaaggatttcgcattctgggtattggagactgattttagcaggaacttaaaaagataatttcaggctgtgattagagctctggagtaaataacaaagagatatgataaaatgtaacctggggagtcaggcagtggctgaatggaggagggaggagacaacttcagagcatgagagggaagacttttctgaggccatgcctttaaggtgaggaacataagtaatcttttggagagctgggaaagttgttctggtacagggtaatatcaagtgcaaaggccctggggcagtgggcttgttgtatttgagaaacagcaggtgggtgtggccaaagcctaccaagagatgacactggagaagacaggagggtcctgtagtgtatgatacacaagcagccatttttacaaacaataactaaggcacctttccttttcagatggtggaattgcacgacttagagtattcggtactggacaaaaagactggactgcaactgaccccaaagaacctgcagacctagtggccatcgcttttgggggtgtctgtgtaggatttagtaatgctaagtttgggcacccaaacaatataataggagttggcggggcaaagtctatggcggatggttgggaaactgcaagaaggctggaccggccaccaatattagaaaatgatgagaatggcattctcttggttccgggttgtgaatgggcagttttccgattggcacatcctggagtaataactcgaattgaaattgacacaaaatattttgaaggcaatgctcctgacagctgtaaagtggatgggtgcatcctgacaactcaggaagaagaagccgtgatcaggcaaaagtggattctcccggcccacaagtggaaaccactgcttccagtgaccaagttgtctcccaaccaaagtcatctgttcgatagcctgaccctagagctccaagatgtcatcactcacgccaggctcaccatcgtccccgacgggggagtgagccgccttcggctccggggcttccccagctccatctgcctcctgaggccccgggagaagcccatgttgaagttctcggtgagcttcaaagcaaacccttaacacacacaaagccccggtgtcggacacacagcagtaatttcccagtcatagtcttcttttcaaatgttttgaacacctggtgatttaataaagtggtcgtctcacaaaaaaaaaaaaaaaaaaaaaaaaaaaaaaaaaaaaaaaaaaaaaaaaaaaaaaaaaaaaaaaaaa

SEQ ID NO: 61505 - DNA, 2413 bp, Homo sapiens
atgaaagcaggtaggatcaacaagaggaatgccagaggggaaagccagcttcatttagctgtcagaagaggaaatctgcccctagtgaaagccctgatagaatctggagcagatgtgaatctaaatgataatgcaggttggacaccacttcatgaggcatctaatgaaggatctattgatataattgtagagttattaaaagctggtgctaaggttaattgtgaaaatatagatggaattctgcccttacatgatgctgttgcaaacaatcatttaaaggcagctgagattctactacaaaatggagcaaaccctaatcaaaaagatcaaaaacagaagagtgctttggatgaagcagatgatgaaaaaatgaaagaattactaagatcttatggtgctattgagactgttaatagagatgagagtgatgctatagtcaatgaaaaaattcctgctgtccggtctaaaagacataaacagtgtttttgtgatgatggcaaaactattgactcatcttccctttcacaccaagaaagatcaagagaaagcctttctgtgcatcagaccctcagtgccattctacaagatatagaagaaaaacaagaatatttattagagtttgaaataagaaaccctgaagatgcagaacaatacattgaaaagatgttaaagataaaaaagattatggataatgtgcttgccaagcagaaagcagaaagggatgatctggctaaaaaatacagggtatccatagagtcatttaagcatggagccctgagagaacaattggccaacttggctgcaagacagaagagccttttagttgtggcaaaaaaacagaaaaaaataagcctgaaaattcaaaactgtaggaatgttacatcattgccttgtcttagtttaaggaagctcccacccagatcagaaatctctagtgaaaaagacagccaagagctcactagtctggaaaatttagagcatccccaatcaggttcactttctcctgtttctggaagcatgcaggaaacacaattgtctctggaaacttggaactacagccaaaataccaacatttgtctaaattcagaggcagtgagaaggggagaattttctggaaatgatatgaattctaaacaaaatggcagtgattgtaccttggatggttttccaaaatccagacattcagatggcacagagaagaataaattaccatcccaacctgttgcttttattggtcaaacagaatattcacagaaagagaatgatcttacagaagctacagacaaagaccatgaattctatgtttcttccccagtaatcggcaaattaaatatttcagaaactgcaagtgtccttgccgaaaatgctgcccatccatcaaatattatttgtgatcaggacctttccaattatgatcccaaaagaggaaacagaaaaacaagttcccagcaatcacctacaggggcatcagaatctctggcacatcaagggattgctgtcttaggcagtgatacagtgcatcagatgaaaccatatcttaaaaaatcagtttctgttgttccatgtgcagatgacagtcagatctcctcttcctctggatctgggcaacaagatacaataaaaaaggctttaaactacagtacagctcctaaaaagaaatgtattcagataaaagatttgatattactaggaagaattaacccaggaaataacattctggaattcaaaacacaggagactacccacaaagccagtattttattgaatggtaaacttaaggtagaaagtggtcagatttataaaaacccagtcacctggctcaaggatcttctgggaggcaacagttatgtgacctggaattatgcttggagtaaggtaacgtatcttgggaaggagcttttaaggtatgtttctgaggatgcacccatacttccagaaccaaactcagtacctcagcaatatcaaccttgtcttccagaagttgcttgtttagatgacccagtacaggaaccaaacaaatcaatgtttgagaaaacaaaatttggacaaggaacttccagagagtcaatgcaaagcagcccacgttatctacaaataaatgaaatactattaatcagtgatcaagaatttctcccatgccacataatggatcagcattggaagttttgtgtggaatgtgaggaactaacaccctaaaaccttggtttcttaatattttattggatatttgttcaaattaccaacaaacatttatatttcatcttgtataatctggtgggcctattttaacatacactttatgagttgctatttaggatgtatgtttactgttcttaagatgtatgtaactgttcaacaattatataagattaatgcttttttgccattgaaataaaggcacatttgaactaga

SEQ ID NO: 61506 - DNA, 2670 bp, Homo sapiens
gttgcgccgttgctatggtaaccgaggaggccggggcccgggtgtggtatttttggagttaatggagtcagaaggacctccagagtcagagagttcagaatttttctcacagcaagaagaggaaaatgaagaagaagaagcccaagaaccagaggaaacaggccctaagaacccccttttacaacctgctctcacaggggatgtagagggtttgcagaagatatttgaggatcctgagaatcctcatcatgaacaggccatgcagcttctcttagaagaagacatcgttgggagaaatttgttgtatgcagcttgcatggctgggcaaagtgacgtgattagagctttggcaaaatatggtgtgaatctgaatgaaaaaaccaccagagggtacacactcttacattgtgctgcagcctggggtcgtttggaaactttgaaagcactggtagaactggatgttgatatagaagctttgaacttccgggaagaaagggctcgagatgttgctgctagatattctcagactgagtgtgttgaattcctggactgggcagatgcaaggctgactctgaaaaaatatattgcaaaagtctctttagctgttactgacacagaaaagggatcagggaaactccttaaggaagacaagaataccatcctcagtgcatgccgtgcaaaaaatgagtggttggaaacccatacagaagcttccattaatgagctttttgagcagagacaacaactggaagatattgtgactcctatcttcacaaaaatgactacaccatgtcaagtgaaaagtgccaaatctgtaacaagccatgaccagaagagaagtcaagatgatacctccaactgaacatacgttctgtaaaaggccacattttcttttagtatctgaaaggcaaacctattcatgccatttgaaatcgagaaaacagatgtgggtttctttaagtatttaagtacaacattacatcgcccttgttttgtttgacctgttcagcatgcttatgtccggactctggcctcgcctctgctcctccaagcacagccccatgtgagtttcacgtgctccttcaggaaagcacttgggtataaatcattcgtgaagaccatgtggaggctttaagaactactcagagaatctaataattttctgtgtaattgaggcattccatataaaaggacatatttggctatttccagagaaaaaatttgttctccctgcctaaaaaggaaatcttatggaatgacacttggagcaaggaaatattaagaccagcttggattaggagcctctgggtacaactatcactttttatgtccaaaattaaatttcacctgtgaggtggggtatacctctgagtaaaacccctctttatctttgacctccttctatctgtaaattaataaacacaaatctgtatagttttatacttagaagagttctcctattctgtaaggctggcaatacagatattgtaactggactgaagaccatttcccctcccattctgttttatatttcctaggttttaagtacgatagttggtttcatattggtggtttggaaagccttttttctaatttatttaatcaggcgcctcaaccttctcttacgttgtgactttatggaaaagttttatagaaaagaagatggtttttaaaaagcacttattgttcgttcttatggctttctcttctttgtcctgttctgaaagctagttttcccttatggggagaaggaaaaggaatgggtaattcagtaatactttgtcagttgacatttatttaaccatggttttgagataaccctgttttaaatgtctcccaaagtttttagttttttatccttttaatgtatgagcaattcagtttcaattttttaaagcaaaagaacactgcaataactttcagccacctttttggccgacccagtgggtgtttatggagcagtacaaagaagacctgtgtttgctcctttttttttttaccctccttctcccttctcccttttcccttcccttccccttctccttcctctcccttcctctcccttcccctcccttcccctcccttcccctcccttcctctcccttcctctcccctcccctcccttcctctcccctcccctcccttcctctcccctcccctccccctcctcttctctctcctcctcctcttccctctccaactccttcttctccctctcttatctctctctctctctccacccccgcaaccttcttgacagggtctgcctctcctgcccaggctggaatgcagtggagttatcatgatcatagctcactgtaacctgtaactcctgcactcaagtgatcctcccaccatgcttgggtaattgaaaaaataaacatttgcaggctgggtgctggctcacacctgtaatccaagaactttgggaggccaaggcaggcggatcacctgaggtcagcggtttgagacaagcctggccaacatggtgaaaccctgtctctactaaaaatacaaaaatttagctgtatgtggtggcacgtgcctgtaatcccagtgacttgggaggctgaggcaggagaatcacctgggcccgggaggtggaggttgcagtgagccgagatcgcaccactgcattccagcctgggtgacagagtgagactccatctc

SEQ ID NO: 61507 - DNA, 1067 bp, Homo sapiens
attttaaagaaacttcacagagctgcttcagtcggggatttgaagaagctgaaggaataccttcagatcaagaaatatgatgtaaatatgcaggacaaaaaatacagaacacctttgcacctagcctgtgctaatggacatacagatgttgtacttttcctaattgagcaacaatgcaaaataaatgtccgggatagtgaaaacaaatccccattgattaaggcagtacagtgtcaaaatgaggattgtgcctactattcttctaaactttggtgcagacccagatctgagggatattcgttataatactgttcttcactatgctgtttgtggtcaaagtttgtcattagttgaaaaactgcttgaatacgaagctgatcttgaagcgaaaaataaggatgggtatactccactattagttgccgttattaacaataatccaaaaatggtaaaatttcttctggagaaaggggctgatgtgaatgcttcagataattatcaaagaacagcccttattcttgctgtcagtggtgaaccaccatgtttagtaaagcttcttcttcagcaaggtgtggaattatgttacgaaggtattgtggattcacagctgaggaatatgtttatttccatggttttactgcatagatacccacaattcactgcgagccatggaaagaagaaacatgctaaatagacaccttattcttggcactacatgtgactaaaggaagatatggaacccatttctacaatttctttgccgcttccttgaattggaaaaatgtactttgaaagaaccggttaagtgaactatgataatatttttgctgactacccagttgaagaaaaagtttcgttaattggatgggatttttttttttcacgttagaagaatgaatgaagaaattttaaaagataaacattatattgtgaaccatcagctgaaaagataaatttgtgttcaatatataggagaaaaaatttgtgtcaaaatgttgaatggaataataatgagaaactgtgttaggcatgtattaaaacatttaaataaaataaaaatacatttc

SEQ ID NO: 61508 - DNA, 2741 bp, Homo sapiens
atgggctccgctgcccgcgcccgcttgttctcggtcttggccgacctgagggtgcgtctctcccgggctctccagaggcgcgcagggggggaagtgcagacgcggccgccaccgcccagcccagggcgcggctctgaacttggcgccagcgcccagaggccaccaggccccgccttcctggctgcacccgccttcggggcggggcttgcggttgggcggctccggcggctggctcggaccgggactggcgcctgcgactatgcctgcgggagggcgagggcgtcctttggaggcggttccctctcacgccgccgccctctggctcctgggcctgccgggtctcggcgatgggcgagggctgtgcccggtgcctgcggctccctccgcgccgtggacccccgcggcctcccggccttccttaccccggcggcctggcggccccgcgagcttcacctccccagcatccgaatcgcgcagctcctcccgcgagcgcccgccgccttcgctccccaggccccagctgagaccgccaggaaggcgggctcctcgaccccagatcataagaggacattgggaagagctgcaggtcacaaagtcaccatgtcaaccttcctgtcaaccataacagagaattctgtccccagggtgggggaagggccaggcagagcaggaagccttcggtaccatggacctgactggagaatatttcaccgcctggccctgggctccaggagagcccaccaccaccatggcccaggatggaggcagcactggcgccaggggcaagcaggtcacagatgccagggctcatttgacctctacttcatcttggacaagtctggcagcgtgaacaataactggattgacctttatatgtgggtggaggaaacagtggcgaggttccaaagcccaaatattcggatgtgcttcatcacctactccacagacggccagactgtcttgccactcacctcagacaagaatagaataaaaaacggtcttgaccaacttcagaaaattgtgcctgacggtcacacattcatgcaggcaggatttagaaaggcaattcaacagatcgaaagtttcaactccggaaacaaggttcccagcatgattattgctatgactgatggagaactggtggcacatgcatttcaggacactctcagagaagctcaaaaggctcggaaactgggggccaacgtttacaccctgggtgtggctgattataatctggatcagataacagcaattgcagacagccctggccacgtgtttgcagtggagaatggcttcaaggccctgagaagcaccattgatgccctcacgtcaaaggtctgtcttgatgtgacatcggtggagccttcctctgagtgtgtaggagaaccctaccatgtggttattcatggaaatggctttcagaatctaaagaaacgggatgaagttatttgcagatttatcttcaatgaaagcactatcattgatgaaaagccaaccagtatcgacaataattccatgaattgccctgggccaaaactagaaaaacctggagaggagtactctattgaagtcagcttgaacaaaggcaaaacattcttcaagagcaatgtcagcatcaccagcaccacatgtccttctcttaagtagagctctggacatgaggaaggcctgagcagcctgccttcccacggatgccgcccaagattcctttattgcgaagaacacccagagaactgttcccgttgcttataccccatgtggccctggttctgagccaggacttggagctctctaaacctcacaagtgcccccagggagggcggctcattccctttgcacagggcattttccgcaactggctctattttgtgccactcctgctgcttgtgccactgctgctgtgttgtgtctggcggctgtgccgcaagcagactgtcaaggagccaccacctgtgcagaagccagaaaaggagccagagcaggaaaaaccaccatcaccaccaccaccgcctccgcctccaccacctccactcccgcctccgcccccagctcctgtaaacacctgccccactgtgattatttgttgctgtggatgccaaggagtgggcgggatgagaaggatagagggcaatctggataccttttgtgacctctctcacgcaagctgccaccaggtgccatggatgtgttgtcagagcagggaccaggggaggtacctcagcttagcccttgcacagtcccaatatgcacaggctccctgctgcccaaggatctgctttccacacagccaggagtgcctttccctaccacaggctccctgcagcccaaggatgtgcctgagacacagccgggagtgcctcgccctcaaacaggctcgctgcagcccaaacatctgcctgagacacagcccggagtacttttcccaagcacagactctgtgcaacccaaagagctgccttcaacccagccgggagtgcctccccctcacctgctcctccaggtgccgcctccccccagctaggtgcttgaggcctccctccaggatgctgccgctgctgtccccactgctcaggcacacggcagaaccccctttgtcactccccccgtcagagcccaacttctaaggcaccaaacacccaagattaacaggcttttgttgctgaactggacatatacattgagtcttttcttgcggtcaaaggagttgaattcttgctgatcaactaaagttgattgtgttt

SEQ ID NO: 61509 - DNA, 2114 bp, Homo sapiens
gagaattctgtccccagggtgggggaagggccaggcagagcaggaagccttcggtaccatggacctgactggagaatatttcaccgcctggccctgggctccaggagagcccaccaccaccatggcccaggatggaggcagcactggcgccaggggcaagcaggtcacagatgccagggctcatttgacctctacttcatcttggacaagtctggcagcgtgaacaataactggattgacctttatatgtgggtggaggaaacagtggcgaggttccaaagcccaaatattcggatgtgcttcatcacctactccacagacggccagactgtcttgccactcacctcagacaagaatagaataaaaaacggtcttgaccaacttcagaaaattgtgcctgacggtcacacattcatgcaggcaggatttagaaaggcaattcaacagatcgaaagtttcaactccggaaacaaggttcccagcatgattattgctatgactgatggagaactggtggcacatgcatttcaggacactctcagagaagctcaaaaggctcggaaactgggggccaacgtttacaccctgggtgtggctgattataatctggaccagataacagcaattgcagacagccctggccacgtgtttgcagtggagaatggcttcaaggccctgagaagcaccattgatgccctcacgtcaaaggtctgtcttgatgtgacatcggtggagccttcctctgagtgtgtaggagaaccctaccatgtggttattcatggaaatggctttcagaatctaaagaaacgggatgaagttatttgcagatttatcttcaatgaaagcactatcattgatgaaaagccaaccagtatcgacaataattccatgaattgccctgggccaaaactagaaaaacctggagaggagtactctattgaagtcagcttgaacaaaggcaaaacattcttcaagagcaatgtcagcatcaccagcaccacatgtccttctcttaagtagagctctggacatgaggaaggcctgagcagcctgccttcccacggatgccgcccaagattcctttattgcgaagaacacccagagaactgttcccgttgcttataccccatgtggccctggttctgagccaggacttggagctctctaaacctcacaagtgcccccagggagggcggctcattccctttgcacagggcattttccgcaactggctctattttgtgccactcctgctgcttgtgccactgctgctgtgttgtgtctggcggctgtgccgcaagcagactgtcaaggagccaccacctgtgcagaagccagaaaaggagccagagcaggaaaaaccaccatcaccaccaccaccgcctccgcctccaccacctccactcccacctccgcccccagctcctgtaaacacctgccccactgtgattatttgttgctgtggatgccaaggagtgggcgggatgagaaggatagagggcaatctggataccttttgtgacctctctcacgcaagctgccaccaggtgccatggatgtgttgtcagagcagggaccaggggaggtacctcagcttagcccttgcacagtcccaatatgcacaggctccctgctgcccaaggatctgctttccacacagccaggagtgcctttccctaccacaggctccctgcagcccaaggatgtgcctgagacacagccgggagtgcctcgccctcaaacaggctcgctgcagcccaaacatctgcctgagacacagcccggagtacttttcccaagcacagactctgtgcaacccaaagagctgccttcaacccagccgggagtgcctccccctcacctgctcctccaggtgccgcctccccccagctaggtgcttgaggcctccctccaggatgctgccgctgctgtccccactgctcaggcacacggcagaaccccctttgtcactccccccctcagagcccaacttctaaggcaccaaacacccaagattaacaggcttttgttgctgaactggacatatacattgagtcttttcttgcggtcaaaggagttgaattcttgctgatcaactaaagttgattgtgttt

SEQ ID NO: 61510 - DNA, 3256 bp, Homo sapiens
cggactgctgtcctccagattcaggccggtgggtctggggagcccggattggtcttggaggagcaacggctgcgcaggtgactcggtggcctcaagtgtgtacaaaactcaaaacatgaacaacaatatatattaccaatcttcaaacctggtttgcctagaactggaatacagttgcctgcgacatattttagaagaactagaaaagtcaaagtaatggataacagaaaagagcctccattcttcaatgatgataacatgggaccattttactacagacttcatttctgtgataccatggagctcttcattgaaacattaactggaacatgttttgagctgagagtttcaccttttgaaactgttatttctgtgaaagcaaaaattcgaagattggaaggtattcccatctgtcgacaacacttaatttggaataacatggaacttgaaaatgattattgcttgaatgattacaacatttcagaagggtgtaccttgaagctagttttggctatgcgtggcggacctataaatactagaagagttcctacagacgatccacttaggaagatggcagagtacttggattccagtcgagttgaggtctgggagaagacctcctgcagcaaacaagttacatttttggtataccgagaaggagatcaattgaatttctttcctgcagtagataggggagatggcactttaacaccgttatctgactcttcaaagaaaatagattttcatttgcatgtcctacggagaaaaggagaacatcgtatgagtggtggttctatgtataattcagatacagatgaggatgaagaaactgagccttcttcttctgggcaacagataattgaaaattcaataactatgaataagatgaagctgctgaaggctaagatgaagaacatgaatctcagcaaaaagcctaagaaagctgtcaagataaaacctcacccacctgtagctcctcgaccttctagtggttccactgcaccatctcgccaccgattgttaagggtcctccccaacattggtcaatcttgttcacctgcttttgggaatgcatatccgcccgaaatctccaggaatggaatttcaagtttggcaactcaactctctgctgagagatacatatcttctatcactggtgaatttcttaaggaagataatagctgggagaataacacactgtctcacttcagtagcaacgtcaaactacctcctcagataccccatttggagttgggaaatgaccaggagcttgctgactctgttctccatcttggatcatccctgcctaggcaaacaaaacattttttaggaaacttgccatctagtaatgggaacattgtcttaccttcagaagaatgtgtaaccgaacaatcacttctacctaaagtgggctcaccggcttcatttgcagaaggaaatgctgatgaacagagcagcggcttagaaggtgcgtgcaaagtgaatctggagttgctactcactaatgctgacaaagggttgaaagctccagagcagcatctcaagcatgttgcaggagtgctgaatggggaatcagtagagacttcagttcttaactaccgggaattaagtcctcacaagaatagactcttgtcacctcttcgctgttctgcatcaatgtcgctacataattctctggtgaaaccagagagacagtccaaatgttttgagtttgggaagctacagccttcttcttctcagtcactggatgttcaaaacataactgattcttctttctctaggactacttgctttcaaggtgttaaagttgattcacttgggaaaagatctgatgttatttccaaagttgaggctcgggatatcacagaaatgactaacaaggcttccaaagagcctgttggttgtgtaaataatatcagttttcttgcctcactggccgggagcacaagcagaaatagattacagagcacacgtggggcaggcaggcttcagaactctggaactgggctgtctacaaacctccagcattttcaggaagaaaactttaggaaaagttctccccagttagaacatacaggagtttttttgtctacccatggtgttggaatgaatggaaataatgcagcagcagggaaaagcgtaggagaatgtactactcatcacctcccacctgtgaaagcccctcttcagacaaagaagaaaacaacaaatcattgttttctttgtggaaagaaaacaggactggctagtagctacgaatgcagatgtggaaacaacttctgtgcatctcatcgttatgcagaaactcatggctgtacctatgattacaagagtgcagggaggagatacttgcacgaggcaaatcctgtggttaatgcaccaaagcttccaaaaatctaactcttcctctacatcttactgttctgcccgggattcgtattataatgacagaagaaatgttgtttagactattatttttgttcgactctaaaagatttgccaaataacaaaagcatacaatgcatactgttggagaacaagaatgctactgtattttacatctttatttcttggtgaaacaaaagttttaaaagtagttttaacaactttacactggaatgatttagctttgttattgcatgtcttgtgttaagtgttttgtatatgatattgcagttttactaggcaaatcttcaaaagatgcactttaggaaacgaaatatttcctaaataaccaggcttccacattgtacagaatgagcagtcatgtaatgaatggctctactcagattgaccatatgggttttttctttttctttcttttattcttctccttctttttttttcagaggtgggatgggtggagattttttaaaaatcccacgtgtgaaagtttactggctttattagcaagttcctttttacttcaagctactttttataaaaaagaacatttttccagtgtggtttttaacagataatacatttcttccacattcagattagattcggacatgaatccattctataaaacacatcgtgttcatgatagtgtatattttactactttttgaatgttaattttaaaatagaagatgtcccacttgccattaaatatagaagccaactttttaccttttgaaatatggctacatttaaaacaaaatctcacagctcggtttttcttatttgttgagtgctattaccaggagaaatacaaataaatattcaatttcattaaaaaaaaaaaaaaaaa

SEQ ID NO: 61511 - DNA, 939 bp, Homo sapiens
aacgggcccccgggtcggtttccgcggtggccatgactgcggccgtgttcttcggctgcgccttcattgccttcgggcctgcgctcgccctttatgtcttcaccatcgccaccgagccgttgcgtatcatcttcctcatcgccggagctttcttctggttggtgtctctactgatttcgtcccttgtttggttcatggcaagagtcattattgacaacaaagatggaccaacacagaaatatctgctgatctttggagcgtttgtctctgtctatatccaagaaatgttccgatttgcatattataaactcttaaaaaaagccagtgaaggtttgaagagtataaacccaggtgagacagcaccctctatgcgactgctggcctatgtttctggcttgggctttggaatcatgagtggagtattttcctttgtgaataccctatctgactccttggggccaggcacagtgggcattcatggagattctcctcaattcttcctttattcagctttcatgacgctggtcattatcttgctgcatgtattctggggcattgtattttttgatggctgtgagaagaaaaagtggggcatcctccttatcgttctcctgacccacctgctggtgtcagcccagaccttcataagttcttattatggaataaacctggcgtcagcatttataatcctggtgctcatgggcacctgggcattcttagctgcgggaggcagctgccgaagcctgaaactctgcctgctctgccaagacaagaactttcttctttacaaccagcgctccagataacctcagggaaccagcacttcccaaaccgcagactacatctttagaggaagcacaactgtgcctttttctgaaaatccctttttctggtggaattgagaaagaaataaaactatgcagatatgcgttccattca

SEQ ID NO: 61512 - DNA, 5595 bp, Homo sapiens
cgggggacgcgggggacgcgggggacggcggggaacggcgggggacggcggggaacagcgggggacggcggggaacagcgggggacggcggggaacagcaggggactgcgggtcgcgtcctggccgccgaggagctccttcccttaacagagctgagagaggcatctggagctgcagcatggaccagcgagagcccctgcctcccgctcctgcagaaaatgaaatgaaatatgataccaataataatgaagaggaagagggagaacagttcgattttgacagtggagatgaaatcccagaagcggacagacaggccccatccgcccctgagacaggaggtgctggagccagtgaagcccctgcacccacaggaggtgaggatggagctggagcagaaaccaccccagtggcagagcctactaagctggtgctcccgatgaaagtcaacccatattctgtcatcgacatcacgccattccaggaggaccagccgcccacccccgtgcccagcgctgaggaggagaatgtgggtctccatgtgccctgcgggtacttggtgcctgtaccctgcggctatgcggtgccctccaacctgcccctcctgctgcccgcctactccagcccggtcatcatctgcgccacgtccctggacgaagaagaaacaccagaagtcacagaagatcgccagcccaattctctgagttccgaggagcctccaaccagtgaagatcaagtcggtcgagaggacagcgcacttgcccgctgggccgcagacccggccaacacagcctggatggagaatccagaggaagcaatttacgatgacgttccaagggaaaactcagactctgaaccagatgaaatgatttatgatgatgttgagaatggggatgaaggtggaaacagctccttggaatacggatggagttcgagtgaatttgaaagttacgaagagcagagtgactcggagtgcaagaatgggattcccaggtccttcctgcgcagcaaccacaaaaagcaactttctcatgacctaacccgtttaaaggagcactatgagaaaaagatgagagatttgatggcaagcacggtgggcgtggtggagattcagcagctcaggcagaagcatgaactgaagatgcagaagctcgtgaaggccgcgaaggacggcaccaaggacgggctggagaggaccagggcagccgtgaagaggggccgctccttcatcaggaccaagtctctcatcgcacaggatcacagatcttctcttgaggaagaacagaatttgttcattgatgttgactgcaagcacccggaagccatcttgaccccgatgcccgagggtttatctcagcagcaggttgtaagaagatatatactgggttcagttgtcgacagtgaaaagaactacgtagatgctcttaagaggattttggagcaatatgagaagccgctgtctgagatggagccaaaggttctgagtgagaggaagctgaagacggtgttctaccgagtcaaagagatcctgcagtgccactcgctatttcagatcgcgctggccagccgcgtttccgagtgggactccgtggaaatgataggcgatgtcttcgtggcttcgttttctaagtccatggtgctggatgcatacagtgaatatgtgaacaatttcagcacagccgtggcagtcctcaagaaaacatgtgccacaaagcccgcttttcttgaatttttaaagcaggaacaggaggccagccccgatcgaaccacgctctacagcctgatgatgaagcccatccagaggttcccacagttcatcctcctgctccaggacatgctgaagaacacctccaaaggccaccccgacaggctgcctcttcagatggccctgacagagctcgaaacactagcagagaagttaaatgaaagaaagagagatgctgatcaacgctgtgaagtgaagcaaatagccaaagccataaacgaaagatacctgaacaagcttctcagcagtggaagccgatacctcattcgatcagatgatatgatagaaacagtttacaacgacagaggagagattgttaaaaccaaagaacgccgagtcttcatgttaaatgatgtgttaatgtgtgccaccgtcagctcacgcccctctcatgacagccgtgtgatgagcagccagaggtacttgctgaagtggagcgttccactgggacatgtggacgccatcgagtatggcagcagcgcaggcacgggcgagcacagcaggcaccttgccgttcacccgccggagagcctggccgtggttgctaacgcgaaaccaaacaaagtttacatggggccaggacaactgtatcaagatttacaaaacttgttgcatgacttaaatgtaattggccaaatcactcagctgataggaaaccttaaaggaaactatcagaacttaaaccagtcagtagcccatgactggacatcaggtttacaaaggcttattttgaagaaagaagatgaaatcagagctgcggactgctgcagaattcagttacagcttcccgggaagcaggacaaatctgggcgaccgacgttctttacagctgtgttcaatacgttcacccctgccatcaaggagtcctgggtcaacagcttacagatggccaagctcgccctagaagaggagaaccacatgggctggttctgtgtggaagacgatgggaatcacattaaaaaggagaagcatcctctcctcgtcggacacatgcccgtgatggtggccaagcagcaggagttcaagattgaatgtgctgcttataaccctgaaccttacctaaataatgaaagccagccagattcattttccacggcacatggtttcctgtggatcggaagttgcacccatcaaatgggtcagattgccatcgtctcgtttcaaaattccactcccaaagtcattgagtgcttcaacgtggaatctcgcatcctgtgcatgctgtacgttcccgtcgaggagaagcgcagagagcctggggcacccccggaccccgagaccccggccgtgagagcttctgatgtccccacgatctgtgtagggacggaggagggaagcatttccatttataaaagcagtcaaggctccaagaaagtgagacttcagcactttttcactcctgagaagtccacagtcatgagcctggcttgcacgtctcagagcctgtacgctggcctggtcaacggggcagtcgccagctacgccagagccccagatggatcctgggattcagaacctcaaaaagtgatcaagttaggcgtcctaccagttagaagtctactcatgatggaagacacgttgtgggcggcttccggaggtcaagtcttcatcatcagtgtggagactcatgctgtagagggtcagctggaggcccaccaggaggaaggcatggtgatctcccacatggccgtgtccggcgtcgggatctggattgccttcacctcagggtccacgctccgcctttttcacacggaaactctcaagcacctgcaggacatcaacatcgccacccctgttcacaacatgctgccagggcaccagcggctgtcggtgacgagcctgctcgtctgccacggattgctgatggtcggcaccagcctgggagtcctcgtggccctgccggtcccacgtctgcaagggattcccaaagtgaccggaagaggcatggtctcctaccatgcacacaacagtcctgtcaaattcatcgtcctggccacggctctgcacgagaaagacaaggacaaatccagggacagcctggctcctggccccgagcctcaggacgaagaccagaaggacgcacttccgagtggaggagctggttcatctctgagccagggtgaccctgacgcagccatctggttgggagattcgctgggatcgatgactcagaaaagcgacctgtcctcctcatctgggtccctgagcttgtctcacggctccagctctctagagcacagatcagaggacagcaccatctatgatctcctgaaggatcctgtctcgctgagaagcaaagcacgccgggccaagaaagccaaggccagctcggcgctggtggtctgtggagggcagggccaccgccgggtgcacaggaaggcccggcagccccaccaggaagagctggcgccgaccgtcatggtctggcagatccctctgctgaatatataagcaggacggccgccttctgctgtcagaatttgcaatcaagggtgacttctcagctaatcctacagcctgagtggttaagctgtgtctacactggttgggaataaattaaaaacagtatttgggggagaaacgtgcaatagcgtaatggtggtgtccctgccaattccttccttctcttctgtacagcagaagtaattacaagcacttctcacgaaggcagaagactgatgcaattttcgagtaattgagtgcagttctgggaaaataccacattctttttgactgctgtagtccatatatgaatactaaatgttaaacttcatcagcgtcagacctattgtatcatattagagaatttgcagactaagaatttatgagaaaatatatgtattcagtagtgcaggcatttattaacaattcttaaaagttttacctgattcagattcacgacttttatttatattctatatttttgaatttcagagtaaaatttgttaacaattttaaaagccaggtaacacctaccagtccagttagcatgatttgctttcagaagtgagctgggttttccaaagtggtataatgtgtgtactgtatattttaacaaagtaatatttttgtattgcatttttctattaaaaaattaacagttaatgtttcagtcaatgtattatctgtagcatttcacaaataatgtttgctttgaaccaaaatgctcagtgcctatcaacatttggactcaagcatcaacaccaaattattcctcccttctcgtataaatagagtgactatccacaggagaaaagtgtgtgctttagtattagaggagataggcagagaagtcttgcttagttccttcgtgcagcttcttgcccctgttgacgtggaatgctgtgtctgctttagcacgcacgctccgaatgactcctggtgctaggccatgctggctgctgtcactgagcgggactcaggccaagaggcgtgacctcgggccagcctgtctgttgtgcagacgcctcctctgcagaacgcatcagtttctattctgcagttgcagagccagccccgcgtgagaacgtgcataatgagtgcacaccatcatgtcaaggtgcatacttagtgagcgccatcctgctgaacgtgtatttcagtgtttcacttactggacggataacaagaaaaaaatcctaacacaggcaggcaccagaaataaatgtctcagcactttacagatgactaaaaatgttaattttatgacttagccaaatatgttctaggttgcatatatcccccatgtgaaagtgatttcttcccaagcttctcaaactgttagctgctgtctgacttcatcaataaagtatttttattttaaaatgcaaaaa

SEQ ID NO: 61513 - DNA, 2957 bp, Homo sapiens
ggggcggggactgtcgcgtggagctgccgggcgagcaccgttagggcagcctggcgcgcggcgcccgccaggcgcccagtcctctgccatcgcccacgcctccctggtgccagggaacaggtatcagcgcgcctccccagcggctgggagagacgctgaatgaagaagagggaaggacggttagtcagcagtcttatagctggatcagctaccaagagaagttgtaaaccaagaagagaaaagcatttcaatttgggacatttatttgcacctggaaatggggaatgggctgtcagaccagacttctatcctgtccaacctgccttcatttcagtctttccacattgttattctgggtttggactgtgctggaaagacaactgtcttatacaggctgcagttcaatgaatttgtaaataccgtacctaccaaaggatttaacactgagaaaattaaggtaaccttgggaaattctaaaacagtcacttttcacttctgggatgtaggtggtcaggagaaattaaggccactgtggaagtcatataccagatgcacagatggcattgtatttgttgtggactctgttgatgtcgaaaggatggaagaagccaaaactgaacttcacaaaataactaggatatcagaaaatcagggagtccctgtacttatagttgctaacaaacaagatttgaggaactcattgtcactttcagaaattgagaaattgttagcaatgggtgaactgagctcatcaactccttggcatttgcagcctacctgtgcaatcataggagatggcctaaaggaaggacttgagaaactacatgatatgatcattaaaagaagaaaaatgttgcggcaacagaaaaagaaaagatgaatatcaatacctattatatctgtgtggagtaggttttctctggtctgattttgacaaatagaagagtgtctacagcgtggtttgcctgtctgccctcctggatgctattaaagctttgttttgttgaacaatcagatgcccaactctgttgccttgtggaagatgagtaaatgcagtgcttcttaaagtggtctcttctccctaccccacaaatcttttggtactaccatttggggaagccaagcaaggatagtaaattgaccagaacacagttgtgggaatttggtctgaagttagtgaaataaaactttaaagagtgtctgcctagtgttttgtgcttacatctttcggggggaagcctttgcaagaaaattgcatacaaggctttgtaacgatcaagtgctaatcgatggaaatgttaaggtagattaacatatatgcagttatattgatcacattggtccaaccagtccttttttgaagtaagggacaaggagtaagtattttcttttttaagtttctgccaaatgatttttgacgctttctggaatcaagtaatttaatagtatagcttaattctagacaatgtttaagttggtctacctttattaaaaataagatatttggggtatattcaagtgcatggattagttttcctgacaaagcatgttttggtgtgtagtcttactttttagaaatagctatgcatcgttctacacaggtttaaaacaacttttttggggatttagggctattataggaatagtttgttgtcagaagcactttcacttgaagaacctaaaatgattgactcattcatagtaaatatgggcatgtaaactaataaatatgcactggatacatatatggatttatgaagaaggcgatttagtcaagaggatgtaattaaaatatgtggtctctaaaatattccagttacaagatatttgttttattaatatttgctggctaaaaacaaatgtggtttttatatatttttgtagtgtgttgagaagagcaaaagctttataaatatacctgatgcgctgtagaatgaaaatgtaaaagataacctgtatgtgttccgagctttaattttttgtttacaaattgaacagtgttacatgggctgtccagtcctgattatagagaggaagaaatggtaacagtatggcagataagaattacaattatagaaaatgaggggaaaataacaaacctgttttatgaaaattcactggtgctgtttacattggaataaaaagctctataaggaggaaaggcctttatctaattcttatctacagacacttacttccagtgaccatattttactaaatcagcttattttttatgtctaaagcaacagctgttctgaaaaatcaccaaaagaaatgcactttgctagcaggatttgttttggctttgggttttgtttttttgttttttttttttttcagtggcataacagtttttggaaccttgattcttgtgtcacacaaaatgaatgaagtagcttgatgtggagccttcatatgttaaatattcctgcactagtgatggtcacttagaatgtttatagaaatgtggataataactaccaataaactacttgaggcactaggagaacagtatttgactttgaattttaatgtatttccacttttgctgaagcttttaatcagatgtgtaaaaacaattgaccagctaggctatttagtcccatagtagttcagatctgcttagatgtgacaggcattgaaggctgtttttttttttttctcccttcactgatactgaaatcatggtatctgctgcaaacatgagtagatccatgatggattaataaagcttgctgaaaaaaaaaatctgtgtatcaattagatttaccagtttgcctgtactttctgtctacctactatgtaaaatagtgctgtttttaagtatttcaaaagcttgtgtgttgaccctttgtagcctaagtacgtaaacaaattaatgttatctaagtttttcatatttcatggacaacaaaagagaaaatggtatgaacactgtacaaactttgatttataaa

SEQ ID NO: 61514 - DNA, 3162 bp, Homo sapiens
gcagcctggcggcgacctgaccgcccgaggctccccttcacctgcagcggctgctcggctccctctgggaacgccgccttttctaacttaagggcaacaggtggtgccggtggaccgagagagagctcagctccgccgcgctgggagcggcagttaccctcaccaattagggagcgggggcgggagttgcatggcttccctgatgcgggtgaccaatgggatttgggatcatgagtggaccgggaggagtgggcgtggtcggagtctgagtccaaggtttctcgtgcggcaactgccagagctgcttggagagctaagctggaagggtgcttatccctgcgtagaaacgcctgccaatgctttctcatttggacccagactccagatcgggagcagtcttatagctggatcagctaccaagagaagttgtaaaccaagaagagaaaagcatttcaatttgggacatttatttgcacctggaaatggggaatgggctgtcagaccagacttctatcctgtccaacctgccttcatttcagtctttccacattgttattctgggtttggactgtgctggaaagacaactgtcttatacaggctgcagttcaatgaatttgtaaataccgtacctaccaaaggatttaacactgagaaaattaaggtaaccttgggaaattctaaaacagtcacttttcacttctgggatgtaggtggtcaggagaaattaaggccactgtggaagtcatataccagatgcacagatggcattgtatttgttgtggactctgttgatgtcgaaaggatggaagaagccaaaactgaacttcacaaaataactaggatatcagaaaatcagggagtccctgtacttatagttgctaacaaacaagatttgaggaactcattgtcactttcagaaattgagaaattgttagcaatgggtgaactgagctcatcaactccttggcatttgcagcctacctgtgcaatcataggagatggcctaaaggaaggacttgagaaactacatgatatgatcattaaaagaagaaaaatgttgcggcaacagaaaaagaaaagatgaatatcaatacctattatatctgtgtggagtaggttttctctggtctgattttgacaaatagaagagtgtctacagcgtggtttgcctgtctgccctcctggatgctattaaagctttgttttgttgaacaatcagatgcccaactctgttgccttgtggaagatgagtaaatgcagtgcttcttaaagtggtctcttctccctaccccacaaatcttttggtactaccatttggggaagccaagcaaggatagtaaattgaccagaacacagttgtgggaatttggtctgaagttagtgaaataaaactttaaagagtgtctgcctagtgttttgtgcttacatctttcggggggaagcctttgcaagaaaattgcatacaaggctttgtaacgatcaagtgctaatcgatggaaatgttaaggtagattaacatatatgcagttatattgatcacattggtccaaccagtccttttttgaagtaagggacaaggagtaagtattttcttttttaagtttctgccaaatgatttttgacgctttctggaatcaagtaatttaatagtatagcttaattctagacaatgtttaagttggtctacctttattaaaaataagatatttggggtatattcaagtgcatggattagttttcctgacaaagcatgttttggtgtgtagtcttactttttagaaatagctatgcatcgttctacacaggtttaaaacaacttttttggggatttagggctattataggaatagtttgttgtcagaagcactttcacttgaagaacctaaaatgattgactcattcatagtaaatatgggcatgtaaactaataaatatgcactggatacatatatggatttatgaagaaggcgatttagtcaagaggatgtaattaaaatatgtggtctctaaaatattccagttacaagatatttgttttattaatatttgctggctaaaaacaaatgtggtttttatatatttttgtagtgtgttgagaagagcaaaagctttataaatatacctgatgcgctgtagaatgaaaatgtaaaagataacctgtatgtgttccgagctttaattttttgtttacaaattgaacagtgttacatgggctgtccagtcctgattatagagaggaagaaatggtaacagtatggcagataagaattacaattatagaaaatgaggggaaaataacaaacctgttttatgaaaattcactggtgctgtttacattggaataaaaagctctataaggaggaaaggcctttatctaattcttatctacagacacttacttccagtgaccatattttactaaatcagcttattttttatgtctaaagcaacagctgttctgaaaaatcaccaaaagaaatgcactttgctagcaggatttgttttggctttgggttttgtttttttgttttttttttttttcagtggcataacagtttttggaaccttgattcttgtgtcacacaaaatgaatgaagtagcttgatgtggagccttcatatgttaaatattcctgcactagtgatggtcacttagaatgtttatagaaatgtggataataactaccaataaactacttgaggcactaggagaacagtatttgactttgaattttaatgtatttccacttttgctgaagcttttaatcagatgtgtaaaaacaattgaccagctaggctatttagtcccatagtagttcagatctgcttagatgtgacaggcattgaaggctgtttttttttttttctcccttcactgatactgaaatcatggtatctgctgcaaacatgagtagatccatgatggattaataaagcttgctgaaaaaaaaaatctgtgtatcaattagatttaccagtttgcctgtactttctgtctacctactatgtaaaatagtgctgtttttaagtatttcaaaagcttgtgtgttgaccctttgtagcctaagtacgtaaacaaattaatgttatctaagtttttcatatttcatggacaacaaaagagaaaatggtatgaacactgtacaaactttgatttataaa

SEQ ID NO: 61515 - DNA, 2954 bp, Homo sapiens
ggggcggggactgtcgcgtggagctgccgggcgagcaccgttagggcagcctggcgcgcggcgcccgccaggcgcccagtcctctgccatcgcccacgcctccctggtgccagggaacaggtatcagcgcgcctccccagcggctgggagagacgctgaatgaagaagagggaaggacggttagtcagtcttatagctggatcagctaccaagagaagttgtaaaccaagaagagaaaagcatttcaatttgggacatttatttgcacctggaaatggggaatgggctgtcagaccagacttctatcctgtccaacctgccttcatttcagtctttccacattgttattctgggtttggactgtgctggaaagacaactgtcttatacaggctgcagttcaatgaatttgtaaataccgtacctaccaaaggatttaacactgagaaaattaaggtaaccttgggaaattctaaaacagtcacttttcacttctgggatgtaggtggtcaggagaaattaaggccactgtggaagtcatataccagatgcacagatggcattgtatttgttgtggactctgttgatgtcgaaaggatggaagaagccaaaactgaacttcacaaaataactaggatatcagaaaatcagggagtccctgtacttatagttgctaacaaacaagatttgaggaactcattgtcactttcagaaattgagaaattgttagcaatgggtgaactgagctcatcaactccttggcatttgcagcctacctgtgcaatcataggagatggcctaaaggaaggacttgagaaactacatgatatgatcattaaaagaagaaaaatgttgcggcaacagaaaaagaaaagatgaatatcaatacctattatatctgtgtggagtaggttttctctggtctgattttgacaaatagaagagtgtctacagcgtggtttgcctgtctgccctcctggatgctattaaagctttgttttgttgaacaatcagatgcccaactctgttgccttgtggaagatgagtaaatgcagtgcttcttaaagtggtctcttctccctaccccacaaatcttttggtactaccatttggggaagccaagcaaggatagtaaattgaccagaacacagttgtgggaatttggtctgaagttagtgaaataaaactttaaagagtgtctgcctagtgttttgtgcttacatctttcggggggaagcctttgcaagaaaattgcatacaaggctttgtaacgatcaagtgctaatcgatggaaatgttaaggtagattaacatatatgcagttatattgatcacattggtccaaccagtccttttttgaagtaagggacaaggagtaagtattttcttttttaagtttctgccaaatgatttttgacgctttctggaatcaagtaatttaatagtatagcttaattctagacaatgtttaagttggtctacctttattaaaaataagatatttggggtatattcaagtgcatggattagttttcctgacaaagcatgttttggtgtgtagtcttactttttagaaatagctatgcatcgttctacacaggtttaaaacaacttttttggggatttagggctattataggaatagtttgttgtcagaagcactttcacttgaagaacctaaaatgattgactcattcatagtaaatatgggcatgtaaactaataaatatgcactggatacatatatggatttatgaagaaggcgatttagtcaagaggatgtaattaaaatatgtggtctctaaaatattccagttacaagatatttgttttattaatatttgctggctaaaaacaaatgtggtttttatatatttttgtagtgtgttgagaagagcaaaagctttataaatatacctgatgcgctgtagaatgaaaatgtaaaagataacctgtatgtgttccgagctttaattttttgtttacaaattgaacagtgttacatgggctgtccagtcctgattatagagaggaagaaatggtaacagtatggcagataagaattacaattatagaaaatgaggggaaaataacaaacctgttttatgaaaattcactggtgctgtttacattggaataaaaagctctataaggaggaaaggcctttatctaattcttatctacagacacttacttccagtgaccatattttactaaatcagcttattttttatgtctaaagcaacagctgttctgaaaaatcaccaaaagaaatgcactttgctagcaggatttgttttggctttgggttttgtttttttgttttttttttttttcagtggcataacagtttttggaaccttgattcttgtgtcacacaaaatgaatgaagtagcttgatgtggagccttcatatgttaaatattcctgcactagtgatggtcacttagaatgtttatagaaatgtggataataactaccaataaactacttgaggcactaggagaacagtatttgactttgaattttaatgtatttccacttttgctgaagcttttaatcagatgtgtaaaaacaattgaccagctaggctatttagtcccatagtagttcagatctgcttagatgtgacaggcattgaaggctgtttttttttttttctcccttcactgatactgaaatcatggtatctgctgcaaacatgagtagatccatgatggattaataaagcttgctgaaaaaaaaaatctgtgtatcaattagatttaccagtttgcctgtactttctgtctacctactatgtaaaatagtgctgtttttaagtatttcaaaagcttgtgtgttgaccctttgtagcctaagtacgtaaacaaattaatgttatctaagtttttcatatttcatggacaacaaaagagaaaatggtatgaacactgtacaaactttgatttataaa

SEQ ID NO: 61516 - DNA, 3572 bp, Homo sapiens
atacggtgcaacgggtccgcgggaatcttggatgcgcggaggtcccgagaccaggtgcgtgtgctaagctcaggtctgagcacggtggatcccatgggtgtggctctgaggaaattgacgcagtggactgctgccggacatggaactggaatcctcgaaatcacccctctaaatgaagcgatattgaaagaaattattgtgtttgtggagagttttatctataaacatcctcaagaggcaaaatttgtttttgtggaaccacttgaatggaacacaagtttggcgccctcagcatttgaatcaggttatgttgtcagtgaaacaacagtcaaatcagaagaagttgataaaaatggacagcctttgctatttctctctgtaccacaaattaaaattaggagctttgggcagctgtcacgcttgttacttattgccaaaactgggaagttgaaggaagcccaagcatgtgttgaagctaacagagaccccatagtaaaaatcctgggctctgattataatacaatgaaagaaaactcaattgcattaaatattcttggcaaaattaccagagatgatgatcctgaaagtgaaattaagatgaagattgctatgctgcttaagcaattggatctgcacctcctcaatcattctctaaaacatatttcattagaaataagtttaagtcccatgacggtgaagaaggatatagaactgctcaaacgtttctcaggaaaaggaaaccaaacagtcttggaatctattgaatatacctcagattatgaattttcaaatggatgtcgagccccaccgtggagacaaattcgtggggaaatttgttatgtgctggtgaaacctcacgatggtgagactctgtgcattacttgcagtgcaggaggagtatttttaaatggtggcaaaacagatgatgaaggggacgttaattatgagagaaaaggttcaatttataaaaaccttgtcacatttttaagagaaaaatcaccaaaattttcagaaaatatgtctaaattgggaattagcttcagtgaagaccagcaaaaggaaaaggatcagcttggcaaagcccccaagaaggaagaagcagctgccctccgcaaagacatttctggttcagacaaaaggtcactggagaagaaccaaattaatttttggaggaatcaaatgaccaagagatgggaaccaagcttaaactggaagaccactgttaattacaaaggcaaaggctcagcaaaagaaatccaagaggacaaacacacaggaaaacttgaaaaaccaagaccatctgtttcacacggaagagcacaattacttcggaagagtgctgaaaagattgaggaaactgttagcgatagctcctcagaaagtgaggaagatgaagaaccacctgaccatcgtcaggaagcaagtgcagatttgccatcagaatattggcaaattcagaagctggtgaaatatttaaagggaggaaatcaaacagctacagtgattgcgttgtgttcaatgagggatttcagcttagctcaagaaacctgccagttggccatcagagatgttggaggcctggaagtgctgataaatttgcttgaaaccgatgaagtcaaatgtaagattggttcattaaaaatactgaaggaaatcagtcataatcctcaaatcagacagaatattgttgaccttgggggcttaccaattatggtgaatatacttgattctccacacaagagtctaaaatgtttggcagccgagactatcgcgaatgttgccaagtttaaaagagcacggcgggtggtgaggcagcacgggggtatcaccaaactggttgctctactagactgtgcacatgattccacaaaacctgcccaatcgagtctgtatgaggccagagacgtggaagtggctcgctgtggggcactggccctgtggagctgcagtaagagtcatacgaataaagaagccatccgcaaagctgggggcattcctctgttggctcggctgctgaagacttctcatgaaaacatgctaattccagtggtggggacattgcaagagtgtgcatcagaggaaaactaccgggctgcaatcaaagcagaaaggatcattgaaaaccttgtcaagaacctaaatagtgagaatgagcagctgcaggagcactgcgccatggccatttaccagtgtgctgaagataaggaaacccgggacctcgttaggctgcacggaggacttaagcccttggccagtctactcaataacactgacaataaagagcggttagctgctgtcacaggggctatatggaaatgttccatcagcaaagagaatgttaccaagtttcgggaatacaaagccattgaaaccttggtgggacttctaacagatcagcctgaagaagtacttgtgaatgtggttggggccttgggagaatgctgccaagaacgtgaaaaccgagtcattgtccggaaatgtggtggcattcaaccacttgtgaacctccttgttggaataaaccaagctcttcttgtgaatgttacaaaagcagttggtgcttgtgcagtagaacctgaaagtatgatgataattgatcgcttagatggagttcgtttgttgtggtccctgctgaaaaatcctcacccagacgtgaaggccagcgcagcatgggcactctgtccatgcatcaaaaatgcaaaggatgctggggaaatggttcgttcctttgttggtggtttggaacttattgtcaatttactgaaatcagataacaaagaagttctggcaagtgtatgtgctgccattaccaacatagcaaaagatcaagaaaatttagctgttatcacagatcatggagttgttcctttattgtccaaactggcaaatacaaataacaataaattgagacatcatctagcagaagctatttcacgttgctgtatgtggggcaggaatagagtggccttcggtgagcacaaagcagtggctccactagtgcgttatctgaaatcaaatgacaccaacgtgcatcgggcgacagctcaggccttgtaccaactctcagaagacgccgataactgcatcaccatgcatgagaatggtgcagtaaagcttctactggatatggttgggtcccctgaccaggatctccaggaagctgcagctggttgtatatccaatatccgcaggctggctcttgctacagagaaggcaagatacacttgaaatttaaatggacattacaagctatcaaattctacatgacacaggacatgtcactcccatggccagaaagcctaaattgggaaacagttgttagcaaaccctttcaaccatctaaatgaaaacacacaaattgaaaatgcacagaatgtttttcatctgaaaattgcatggagacttttgtttctatttaatgttttcgagatatgacatgtgataagatggaaagccaataaacctgtgataagtttctaagaatatgagaatatacgtatatgatgtatttttagttcagtgatgcttttgtatttgtggcgattttaataaaaaggatatggccttcccaa

SEQ ID NO: 61517 - DNA, 7231 bp, Homo sapiens
acatgaccgtagcggcagcctgtacagtaagaacccaatatggcagcggcggtagcagtggcaacggcagcaagaggaccggccgccccatagacccccccgcgcaccacccccgccgcttcctctgcttgggtgcccccccggtctgacttcccttttctcccacctttcccggcaccgcgggaaaagcagcgcagggcagagcaggcagggagggcggccggagcccggacacgggagcctcccagtcagttcaagacccgacatgagggaaaagggacgtaggaagaagggcaggacctgggcggaggccgccaagacggtcttagaaaaataccccaatacacccatgagtcataaagaaattcttcaagttatccagagagaaggactaaaagaaatcagaagtgggacttctcctcttgcatgcctgaatgcaatgcttcacacaaactccagaggtgaagagggcatcttctataaggttccaggtagaatgggagtatatactttgaagaaagatgtgccggatggggtgaaagagctgtcagaaggttcagaagaaagcagtgatggtcagtcagattcccagagttctgagaacagcagcagcagcagtgatggtggcagcaacaaggagggaaaaaagagcaggtggaaaaggaaagtatcgtcgtcctccccgcagtcaggctgcccatcacccaccattccagcaggtaaagtcatttctccatcacagaagcacagcaagaaggcactaaagcaggcgctaaagcagcaacagcagaagaagcagcagcagcaatgcaggccaagcatatccatctcctccaaccagcatctctcactaaagactgtcaaagcagccagtgactctgtacctgccaaacctgcaacatgggaaggaaagcaatctgatggacagacaggcagccctcaaaactcaaactccagcttttcttcctcagttaaagtggaaaatactttactaggcttggggaagaagtcattccagagatctgagagactccataccagacaaatgaaaagaactaaatgtgctgacattgacgttgagacaccggactccattctggttaatacaaatctgcgagcactgatcaacaagcacacattttcagtccttcctggagattgccagcaacgactgcttttactactcccagaggtagatcgacaggttggtccagatggtttaatgaagttaaatggctcagcccttaacaatgaattcttcacttcagcagcccaaggctggaaggaaagactctcagaaggtgagtttacacctgagatgcaggtgagaattcgacaagagattgagaaggagaaaaaagtggagccatggaaagaacaattctttgaaagctactatgggcagagttctggcctgagccttgaagattctaagaaattgacagcttctcccagtgatcccaaagtaaagaaaaccccagctgaacaaccaaaatccatgcctgtgtcagaggcctctcttatcagaatagttccagtagtctcccagtcagagtgtaaagaagaagcattgcaaatgtcatcaccaggcagaaaagaagagtgtgaaagccaaggtgaagtgcagccgaacttctccacatcttcagagcccctgctttcctcagctctcaatacacatgggcttagcagcattcttcccatcaagtgcccaaaggatgaggatctcttggagcagaagccagtcacctctgctgaacaggaatctgagaagaaccatctcaccacagcttctaattataacaaaagtgaaagccaagaatctttagttacatcgccaagcaaacccaagagtcctggggttgaaaaaccaatagtgaagcccacagcaggagcgggtccacaggagactaatatgaaagaacctctagcaactcttgttgatcagagcccagaaagcctcaagaggaagtcttccctcacccaagaagaggcccctgtgagctgggagaagaggccacgtgtcactgagaatcgccagcaccagcagccatttcaggtctcaccacagccctttctcaatagaggggacagaatccaggtgcgaaaagtaccacctctcaagatcccggtctccagaatctcccccatgccgtttcatccatcgcaggtctctcccagggctcgttttccagtctccatcactagtcctaacaaaacaggagccagaactcttgcagacatcaaagcaaaagcccaactggtcaaagcacagagggcagcagctgccgctgccgccgcagctgctgcagccgcctcagttggagggaccattccaggacctggcccagggggtggacaaggtccaggagagggtggtgaagggcagactgctagaggaggcagtccaggctcagacagagtcagtgaaactggaaagggccccacactggaactggcaggaactggaagcaggggaggtacgagagagcttttaccctgtggtccagagactcagccccagtctgagaccaagaccaccccaagccaggcacagcctcatagtgtctctggagcacaactacagcaaacccccccagtgcctccaacacctgccgtcagtggagcatgcacaagtgtcccatcaccagcccacatagagaaattggataatgaaaaactgaaccccaccagagcaacagccacagtggcctctgtcagccatccacaagggcccagtagttgcagacaggagaaagcaccttctccaacaggtcctgctctaatctcaggtgcctcacctgttcattgtgcagctgatggcacagttgagctcaaagcaggtcctagtaagaatatacctaacccttcagcctcatcaaagacagatgctagtgtgccagtggctgtaactccctcccctttaacatctttattgaccacagccactttagaaaagcttcctgtaccccaggtcagtgcaactacagcacctgctggatcagctccaccctcgagcactttgccagcagcttctagccttaaaaccccaggaacttctttaaacatgaatggacccactttaagaccaacctctagtatccctgctaataatcctttagtgactcagctgcttcaaggcaaagatgttcccatggagcaaattctgcctaaacctctcaccaaagttgaaatgaaaacggttccactgactgcaaaagaggaaagggggatgggagcgctcatagctaccaacacaacagaaaatagcaccagagaggaagttaatgagagacagtcccatccagctacgcagcagcagctgggcaaaaccttgcaaagtaagcagctcccccaggttccaaggccccttcagctcttttcagctaaggagctgagggactccagcattgacacacaccaataccacgaaggactaagtaaagcaacccaagatcagatccttcagactctcattcagagggttcggaggcagaatcttctctcagttgtgccgccctcacagttcaacttcgctcactcaggtttccagctggaagacatctccacaagccagaggttcatgctgggttttgctggcagaaggacatccaaacctgcaatggcagggcactacttactgaatatttctacctacggccggggctcagagagctttaggaggacccattctgtaaaccctgaagatcgtttttgtctaagcagccccactgaagccttgaaaatgggatatacagactgtaaaaatgcaacaggagagagtagcagcagcaaagaagatgacactgatgaggaaagtactggtgatgagcaggaatctgtcacagtgaaagaggagccccaggtttcccagagtgctggcaagggtgacacaagttcaggacctcacagcagggaaactctatctaccagtgattgcttagctagcaagaatgtgaaggctgagataccattgaatgagcaaaccactttaagtaaggagaattacctgttcactagaggccaaacatttgatgaaaagaccctagccagagatttaattcaggcagcacagaagcagatggctcatgcagtgagaggtaaggcaatccgtagcagccccgagcttttcagttctactgttcttcctctgcctgcagacagccccacccaccagcccctactccttccacccctgcaaaccccgaagttgtatggaagccccacccagatagggccaagctatagaggcatgatcaatgtctccacctcatctgacatggaccataactctgctgtaccaggtagccaggtatctagcaatgtaggtgatgtcatgtcattttcagtgactgtcactaccatccctgctagccaagctatgaatcccagcagccatggccagaccattcctgttcaggcgttctccgaagagaacagcatagagggcacgccttcgaaatgttactgccgcttgaaagccatgatcatgtgcaaaggctgtggcgctttctgccatgatgattgcatcggcccctccaaactgtgcgtctcctgccttgtcgttcggtaatgagactagaaagagatacactgtaaaggagggggaagggaagggttgaccagttgggttttttgcgtccttttggaatcacagaaataaacaagtaggtttcagttgtcttcagagacaaatgttacttaatcaggaatacaaagtacagattttttacattttagaggaagagcaccttgtatagtaagtctaagtcaagcaagactttgtgaatttgtgacaagtttgcacttacaaaatcatgtaaatatgtcacattttgtttaacattatttttccaagtgtttaggtaataatgtattactttgaattcagattaatgttctactacttgtgactgagaaaagtttaatgccggcatggtaaaaggaagctgtctcccttctgacatttcctaggaagctaggaaaaggaaagtgaaggaatggtctaaagaaatgaccattcacactgattttgtctggacagcctggccgcaggttattcatagattattcagcctttgcaggacttggattcagggttttactcagtccctttaccttaggtggaatcttcttaaattgaaatttttggtaaggaattcatttcacaggtagtgtttcagactctgaaagccctgacttggttcttggcttctactgtactagttactagttactggtactgttgccaagcaatctgcttggaatttgtggatccctgctgttccctaatcccaccccctgccctgagacagtgaatgtagtccgtgaagggagtgcctctctgggaccccctgtgttgttacaggctgtgcagtgcaacaattccagcaaaaataccctatccccgcacttagtcattcgtggtaactaacaattttgaaatactcatataaaatgaacaggaaagtgttagtgattgggtgatttgagctacatcttgttgagcaaggggagtgaaaccacagaaactgttaaattgaacgtaaataactttggaaaacagttttgacactagaacaaggtcgcttctcttttcctcttctctcccaacctgttaacctagtgctagatagtcagctgctgttgcaggtagaaaagctcaccaatgccacatttgttcattctgttcaacctgttttgacctcccaggcatctgaacaggatgacatcatcttattatatcttactttacacatacgtgtatgtacacacacacacacaatacaagacatttttcctgttttagaaaatatagcccttgtttggattactgctgtctgagcactagaaatttctaatggaaagaggcctctgaatggctaagggaacatctggaaaggaaggaaaatgagccctaaaggttttttggttgcttgtttttgtttctttttctttcttgtttcctttttttgtttttaaatccttctctagtgactgaagaaattgtgagtacataatatttaggtcatggttaaggaacattaaaataaacctgcagtttaacagaattttgtattaaatgggggagtgtcaatttgcatcatttgcatattgatttcaagtctcctaatttggaatgggtaaagtacaaatgttaatgcaacatagtacagttgtatttgtccttcatattcaggatgtgatatttacaaaatgcagaacagtttaaacttgttaagtcacattccagattaggagaaaatgggcaataatcatctctgttttgcccccattctactacccaccactgcccaccccacccccacatcacacactcttcgatgctttcccacagcccctgctccgctcctctccgtaagaaactcacttcactgtttttcacttttcacttctggcttttttgtggcccaaggccaatataggattaatatctgtgttccagcttcagccagaacgatatgtctgtccatctttctcctttcttccagcacacacagctaagagataagaaggctgcaaggattggggataaggagtatattttcaagccaagaaccagtagaaaacagaaataatggtgctcccaaatattcagtaccttgggcaatccaggaagggtttaaagagacctgttgctgcatagaactctccctgccctaccccttaactccaccttagtgccagggccgagggctggtctgcatgctggaagaggttgagagttttggaattgattccatgctaaatgtcagttaccagtttggattgatgaaagtgatttttctgctttacctttttcctgtcagaaaggttttcctctgtgctacccttaacttagggatgaacagactataactaggaaaggaggaaaggtatcagggatttttaagtccgtttagagagcaaaccatattgtgcctcttcatcttgacccaggctcttatagataggtcctaaacattgctgttcactagattatcttaacaaataatactcagctaaatatttgcatttaggaatactcctaaaacagatattgccaactagatacactgcctcaatcttgaccagacaagagaacagttaagttctctcagttgggtagtaacttgaataccagtctatttatcagttggtttcaacacagaggtttcaagtggaaagccattcatcttaaaagctgaacagaaaaaaaaaaaaaaaaaaa

SEQ ID NO: 61518 - DNA, 1548 bp, Homo sapiens
tcatctatgggataactccaaaatcccatattcactttaggtttaccatcagcttttgactggatactggcaaaaccaccttggtcacaatagtgctttgtgacataccatctcttacctgaatacctgcaaaaacccatggtcttcataaggtttgaaaacctaacatctgttacatggctatccacaaactgcccaggtaactgccatagctgggcatacaacatcttccggcatacctacagaaactcacggatacaattaacatggatttcatctttcatgagaaacaggaaggtttcctgtgtgctcagcactgtctgaacaatctattgcaaggagaatattttagccctgtggaattagcctcaattgcacatcagctagatgaagaagagaggatgagaatggcagaaggaggagtcaccagtgaagagtatcttgcatttttacagcagccttcagaaaacatggatgataccggtttcttctccattcaggtaataagcaatgccttgaagttctggggtttagagatcatccatttcaataatcctgaatatcagaagctcggcattgatcctataaatgaaagatcttttatatgtaattataaacaacactggtttactattagaaaatttggaaaacactggtttaacttgaattctctcttggcgggtccagaattaatatcagatacatgccttgcaaatttcttggctcgattacaacaacaagcatattctgtatttgttgtcaagggtgatctgccagactgtgaagctgaccaactcctgcagatcatcagtgtcgaagagatggatacaccaaaacttaatggaaaaaaattagtaaaacaaaaagagcatagagtctataaaacagtccttgaaaaagtatcagaagaaagtgatgagtctggaacatcagaccaagatgaggaggattttcagagggcccttgaactaagccgccaagaaaccaatagagaagatgaacatctccgcagtactattgagttaagcatgcaaggtagttccggaaacacatcgcaagatcttccaaagacatcatgtgtaactcctgcttcagaacagccgaagaaaataaaagaagactattttgaaaagcatcagcaggaacagaagcagcagcaacaacagtcagatctgccgggccacagttcatacctacacgaaaggccaacaacaagttcgagagcaattgagagtgatctcagtgatgacatcagtgaaggcacagtacaggccgctgtcgacaccattttagaaattatgagaaagaatttgaaaatcaaaggggaaaaataatgcctttaaaaataatttagatagtcatactttccaacattatcctgtgtgattatactgtaggatccattttggtcatctgtcaaagagatgaggaaataaggcttttagacagtttgcaaacaaaatgacgagagagatgtgggactaaataatgatcgttcaactactagccaaggagacattcagcaattaattaaatttaaattagctt

SEQ ID NO: 61519 - DNA, 1548 bp, Homo sapiens
tcatctatgggataactccaaaatcccatattcactttaggtttaccatcagcttttgactggatactggcaaaaccaccttggtcacaatagtgctttgtgacataccatctcttacctgaatacctgcaaaaacccatggtcttcataaggtttgaaaacctaacatctgttacatggctatccacaaactgcccaggtaactgccatagctgggcatacaacatcttccggcatacctacagaaactcacggatacaattaacatggatttcatctttcatgagaaacaggaaggtttcctgtgtgctcagcactgtctgaacaatctattgcaaggagaatattttagccctgtggaattagcctcaattgcacatcagctagatgaagaagagaggatgagaatggcagaaggaggagtcaccagtgaagagtatcttgcatttttacagcagccttcagaaaacatggatgataccggtttcttctccattcaggtaataagcaatgccttgaagttctggggtttagagatcatccatttcaataatcctgaatatcagaagctcggcattgatcctataaatgaaagatcttttatatgtaattataaacaacactggtttactattagaaaatttggaaaacactggtttaacttgaattctctcttggcgggtccagaattaatatcagatacatgccttgcaaatttcttggctcgattacaacaacaagcatattctgtatttgttgtcaagggtgatctgccagactgtgaagctgaccaactcctgcagatcatcagtgtcgaagagatggatacaccaaaacttaatggaaaaaaattagtaaaacaaaaagagcatagagtctataaaacagtccttgaaaaagtatcagaagaaagtgatgagtctggaacatcagaccaagatgaggaggattttcagagggcccttgaactaagccgccaagaaaccaatagagaagatgaacatctccgcagtactattgagttaagcatgcaaggtagttccggaaacacatcgcaagatcttccaaagacatcatgtgtaactcctgcttcagaacagccgaagaaaataaaagaagactattttgaaaagcatcagcaggaacagaagcagcagcaacaacagtcagatctgccgggccacagttcatacctacacgaaaggccaacaacaagttcgagagcaattgagagtgatctcagtgatgacatcagtgaagacacagtacaggccgctgtcgacaccattttagaaattatgagaaagaatttgaaaatcaaaggggaaaaataatgcctttaaaaataatttagatagtcatactttccaacattatcctgtgtgattatactgtaggatccattttggtcatctgtcaaagagatgaggaaataaggcttttagacagtttgcaaacaaaatgacgagagagatgtgggactaaataatgatcgttcaactactagccaaggagacattcagcaattaattaaatttaaattagctt

SEQ ID NO: 61520 - DNA, 2047 bp, Homo sapiens
ctacacacgtgtgtgtgcgcgtgtgtataaaacacagtgcactaatactcagcctttaaaaaaaatgccacttgcaacaacgtagatggagctggacgatatcatgctaaaattatgcaaagtgaaacaagcacaaaaaagaacgagacacgggcgtggggcacgaggtgctcactgcgcaagcgcccactccaccgcgtggtttccagctggaggctgggagcgttcgtggcttcctcttttcttgctgacccttcggagctctgggaagtggctgcaccttggcggctccccagagcgcgcggtgctaatcgtgggtcgtcagcctgggtggctgggcccggcttagggcagggtttggcatttccaatggtagggggctcggaccgtccctccgcgggaccctcccgttgggacaaggccgatcgcctgggcggttggagccgctatcctggcgcgagacggtggacaagtcctatattcaagagaagataactttgaacagtttcgaaggatctaaaacgtatgtgtctgcagacatcaatgaggatgaagaattagtagaagagattaatagatcaaaaacgtttgctggctttgcaggtggtgggcctgcctgggcatcggcgcgttggaggagacgccctggggggccttagctgccctgaagcggtagacaggtggcaacgtgggggctcaggagttgacaaacacaagaaagcagcgccgaattgcaggtttatccgcagcttttattttgaagacagtgccacgaaacctgcaaatcctggtgtcccaaatagtcaataccaagttgaaaaccatctgggagaggaaaagcgttgtgctttagacaggccgtctgagactcgtgcagaccggcttttgagagctggacaggtggtggatagatcagactccatacacccgaggagccccgccatgcatagtgaagaagctagataacagtcgtttcacaactggccagcctctgcccacttgaccccgagagagctggccagtgctgggctgtactacacaggcactgatgaccaagtgcagtgcttctgttgtggcggaaaactgaaaaactgggaacctggtgatcgtgcctggtcagaacacaggagacattttcctaattgcttctttattttgggccacaacgttaatattcgaggtgaatctgatgttgcgagttctgataggaatttctcaaattcaacaagttctccaaggaatccatccatgacgggttatgaagcccggctcattacttttgggacatggatgtactccgttaacaaagagcagcttgcaagagctggattttatgctataggtcaagaggataaagtacagtgctttcactgtggaggagggctagccaactggaagcccaaggaagatccttgggaacagcatgctaaatggtatccaggttgcaaatatctgctagaagagaagggacatgaatatataaacaacattcatttaacccgttcacttgagggagctctggtacaaactaccaagaaaacaccatcactaactaaaagaatcagtgataccatcttccctaatcctatgctacaagaagctatacgaatgggatttgatttcaaggacgttaagaaaataatggaggaaagaattcaaacatctgggagcaactataaaacgcttgaggttcttgttgcagatctagtgagcgctcagaaagacactacagaaaatgaattgaatcagacttcattgcagagagaaatcagccctgaagagccgctaaggcgtctgcaagaggagaagctttgtaaaatctgcatggacagacatatcgctgttgtttttattccttgtggacatctggtcacttgtaaacaatgtgctgaagcagttgacagatgtcccatgtgcagcgcggttattgatttcaagcaaagagtttttatgtcttaatgtaactctacagtgggtgtgctatgttcttattaccctgattaaatgtgtgatgtgactcaaaaaaaaaaaaaaaaaaaaaaaaaaa

SEQ ID NO: 61521 - DNA, 1212 bp, Homo sapiens
aatatctcaggacccaggaccatgtgatatgggcccaacacctggatgatgttactcttctgcctaggtcatgcgtaaagagggaattagggcatattgcttggcccagtcccgtaatgatatgactctcctgcttgtgccagagccacagaagtgtgcttggtgacataatctttgaggctgtcacatcaccaagattatattgtatcactggaccagcataaagctgacacttctgactatgcccagccttcaaataatactacactgtataattggctcaacacccaggtgatattgttccatttacctgagaccagataaaaagcctaatgatgacgcttgtccccagagccaggacacgtgcaggacaggatcattactctcatccctgccccagattttcacaggtgctgcttacagagggcatcatgacatattgcttgacaaagaacctaagtgatgttaatattctgcataggttgctaaaaaatgggaatgtgagaaataccttgcttcagtccaaagtgggcttgctgacatattatgtgaaactgtacccgggtgaagtgactcttctgactaggcccagcatacaaatgagattatgctgtatcactggctcagtgtcgaagcccagatcacagaagtaattgtgccatatgtggaacaagcagctaagcaatagataacatccatcgtggctctgccttcaaagggaaattttacatatgtcactgggaccatcacccagatgatgtcctgcccactaaaagaattgtgacataacgctgactgcaaaaactgggtaatgcaactctcctctttattctggagtctgccaaaacaagggattatcacatattgcggagtccagcacccaggtaaaattttgtcatatacccagcttcagataccatgcaatgatacaactatcatacctggacccaaagaggagagatattttgattctcattgccattcttatggccacaagcaaagtaatggttctcatagtggtataaagttcacacagtattatgacactcccagcgtatcatagaaaatgtgagtagtacaatgagtgttataacagggaacagcaaaccaatgctattgtgattattggattcacacccagctgacgcgactatcattctctcacaagaacagaacctgcaaataaagtactaaatctcaccaaaaaaaaaa

SEQ ID NO: 61522 - DNA, 1206 bp, Homo sapiens
aatatctcaggacccaggaccatgtgatatgggcccaacacctggatgatgttactcttctgcctaggtcatgcgtaaagagggaattagggcatattgcttggcccagtcccgtaatgatatgactctcctgcttgtgccagagccacagaagtgtgcttggtgacataatctttgaggctgtcacatcaccaagattatattgtatcactggaccagcataaagctgacacttctgactatgcccagccttcaaataatactacactgtataattggctcaacacccaggtgatattgttccatttacctgagaccagataaaaagcctaatgatgacgcttgtccccagagccaggacacgtgcaggacaggatcattactctcatccctgccccagattttcacaggtgctgcttacagagggcatcatgacatattgcttgacaaagaacctaagtgatgttaatattctgcataggttgctaaaaaatgggaatgtgagaaataccttgcttcagtccaaagtgggcttgctgacatattatgtgaaactgtacccgggtgaagtgactcttctgactaggcccagcatacaaatgagattatgctgtatcactggctcagtgtcgaggcccagatcacagaagtaattgtgccatatgtggaacaagcagctaagcaatagataacatccatcgtggctctgccttcaaagggaaattttacatatgtcactgggaccatcacccagatgatgtcctgcccactaaaagaattgtgacataacgctgactgcaaaaactgggtaatgcaactctcctctttattctggagtctgccaaaacaagggattatcacatattgcggagtccagcacccaggtaaaattttgtcatatacccagcttcagataccatgcaataatacaactatcatacctggacccaaagaggagagatattttgattctcattgccattcttatggccacaagcaaagtaatggttctcatagtggtataaagttcacacagtattatgacactcccagcgtatcatagaaaatgtgagtagtacaatgagtgttataacagggaacagcaaaccaatgctattgtgattattggattcacacccagctgacgcgactatcattctctcacaagaacagaacctgcaaataaagtactaaatctcaccaaaa

SEQ ID NO: 61523 - DNA, 1206 bp, Homo sapiens; identical to SEQ ID NO: 61522

SEQ ID NO: 61524 - DNA, 3299 bp, Homo sapiens
gacccaacaccaggccatgggggctactaagtctggcggagtcaaaggaacgagaaaagacaagttaaaagagaaagtgggaccatgcagccaatgctagtgtggaggctgcaaaggccctgagctctgggatcccacactatttattgatgatcaaacaaagaaacaggcagtgaagatgtgggggttgaaaggaagcggtgtatcaagtgaatgagctacagctgtgacggtttagcattttctttgaaacatacggctacttgagataaagggagtgctagaagcaaggagccagcaagtctagacacattccaaagaccacgaggggttttaatcctagaccctggacgtgttccaagccctgcctcagcttctctcccaacactcagcttttctcccaacactcaacattggccattgagagccccttcagctggttgcagtgtttgataagcaagatctacatcatggaggtgatgacatcagtgccagctccatgcatacccagagcccggagagatttactagtgctagtgagcttggcaccaacaatgtctcagcctttcagtctgatcaagcagcaagtgaaattgaggtcacatcttcagtacttcatgcaaatatacctttggagcccaacccttctgaccatccaaaggcaagcacaatattcctgagaaaatctcaaacagatggtatctactgagcattttactcaacaatacagttcatgttcgacaatattccttgatgacagcatagccagccagcctcatcttacaatgacactaaaatctgtgaccttggcactatattatcatatcaagcaaagcgaaaagaggttttggaggaatattttaagtatgatcctgaacacaaattgatcttcagatttgttcgtactctgtttaaagccatgaggctaacagctgagtttgcaatcgtaagtttgatttacatagaaagacttgtaagttatgctgatatcgacatttgtccaactaactggaagaggattgtcttgggagccattcttcttgcctccaaggtttggagtgatatggctgtgtggaatgaggactactgcaagctctttaagaacattacagttgaagaaatgaatgagttggaaaggcaattcttgaagctaattaattataataacagcattactaacagtgtttatagcagattctacttcgatcttcgcaccttggcacacaacaacggcctgtattcaccagtttatcttcttgacagagaaagagcttggaagctggaggctttttcaaggatggaacaagacaaagttttctacagtgctgccaagaatgggtctctgagtgcagatgatttaattcatcttcagcgtgctaaggccatcctcttctgaaggaagaaatgaggagtaatttaacatctgaacccctcatcaaaaaagacaggaaaatatcacctctcctgctaaagaactagaaaagttggtattttctaaagaagaaacacctcaattcaagttaactcaaggacaactaagattgcacttcgtagtaaagaatgggaccttgtcagggcaacaacacactcttacactcttctgtcctgtttaatgtaaacagagttataaaaaccacttcaaagtgaagactcctgcccacgtacagatatttgcttaatgtgtgggctgatagctgtgaactatgtaaggcttttaaaacaatagtttaactttttagattttaaagataacttttctgtttcttttatgtttttttcttttccccaatattcctgcatatgcatttggaatcagtgcagtatcactgttaaaacatgggagtctaacaactcctaaagccactaggagcagtcccagcattgtcaggtatggaagggctctttcttcctacttttaccatggaagctacagttactggcgatcatcaagcaaaagctgccaattaacatttgccattcgtatcctttgtaagcccttcttattagcagtttagcatgtttgggggtcataaaaagagaaagtattggttattgattatctacttttatgaagctctatggtgtatttcttatgaactataatggttctcatttgctgataaattttcttattaagtaaatgtattcaaagatgttttcatagtgccaagcagcatggtggtccagtggttatataaaaataataaaatacaaggtgtcctgaaagtttcagggcagtttttagctttaatatagtgtgcctgggccctccagaggactgcagcatatgtatacatgctgtaaatctttacaaaatatcatttgaaagtgtaattgtatttcttctttttatttttaatagatgatgcctcactatattgcccaagctacagtgcaatgattaatcagagacacaatcatagcacaccacagcctgaaaatcctggcctcaagcaatgttcccatgtcagcctaccaagtagctgggaccatgggtgtgtaccactgcctctggctttattttgcagaatttgaatgttaaacttttaaccttttgtttcagtcaatatctgctatcttcaagaaggactgaaacaataaattaaaagcttaatactcaggagctaggcatgcttgtagtcccagctactcatgaggcttaaatggaggatcacttgaggcctagccttggaggctgcagtgcactgtgattgtgcctgtaaatagctattgcactccagccttggcaacataatgagacactgtcactttaaaaaatggcaaaactaaataaacgtaaaagaaatacaacaagcttttcaatgatttgtaaatgtttgtagcattgttacttctacaagtatcaaagcttaaaatttcactaagacttttggaattcttgtgtttttataaagtgcccttttctcttgtaaagtagctctttgcaaggcttttatctgcattgatcacctcagattattttccctagatgtgataaagaggaggatccatgttaattcatatgtaacaaattagaaggaattggaccctaatagtagtaggtgatgcaatacattttattatcccacatgttagcctggatgcaggtatcatatttcatgtcctgctatttaaaaagaacttccataaaccttaggaatcctacctcctgaaaaagtatcatttatggaatgcagagcttagagattggagtattgattgcagttttattttcaaaataaatgctacaattgatgtggttttcatttctcatgtttatattaaaagaaaacctagta

SEQ ID NO: 61525 - DNA, 3299 bp, Homo sapiens
gacccaacaccaggccatgggggctactaagtctggcggagtcaaaggaacgagaaaagacaagttaaaagagaaagtgggaccatgcagccaatgctagtgtggaggctgcaaaggccctgagctctgggatcccacactatttattgatgatcaaacaaagaaacaggcagtgaagatgtgggggttgaaaggaagcggtgtatcaagtgaatgagctacagctgtgacggtttagcattttctttgaaacatacggctacttgagataaagggagtgctagaagcaaggagccagcaagtctagacacattccaaagaccacgaggggttttaatcctagaccctggacgtgttccaagccctgcctcagcttctctcccaacactcagcttttctcccaacactcaacattggccattgagagccccttcagctggttgcagtgtttgataagcaagatctacatcatggaggtgatgacatcagtgccagctccatgcatacccagagcccggagagatttactagtgctagtgagcttggcaccaacaatgtctcagcctttcagtctgatcaagcagcaagtgaaattgaggtcacatcttcagtacttcatgcaaatatacctttggagcccaacccttctgaccatccaaaggcaagcacaatattcctgagaaaatctcaaacagatggtatctactgagcattttactcaacaatacagttcatgttcgacaatattccttgatgacagcatagccagccagcctcatcttacaatgacactaaaatctgtgaccttggcactatattatcatatcaagcaaagcgaaaagaggttttggaggaatattttaagtatgatcctgaacacaaattgatcttcagatttgttcgtactctgtttaaagccatgaggctaacagctgagtttgcaatcgtaagtttgatttacatagaaagacttgtaagttatgctgatatcgacatttgtccaactaactggaagaggattgtcttgggagccattcttcttgcctccaaggtttggagtgatatggctgtgtggaatgaggactactgcaagctctttaagaacattacagttgaagaaatgaatgagttggaaaggcaattcttgaagctaattaattataataacagcattactaacagtgtttatagcagattctacttcgatcttcgcaccttggcacacaacaacggcctgtattcaccagtttatcttcttgacagagaaagagcttggaagctggaggctttttcaaggatggaacaagacaaagttttctacagtgctgccaagaatgggtctctgagtgcagatgatttaattcatcttcagcgtgctaaggccatcctcttctgaaggaagaaatgaggagtaatgtaacatctgaacccctcatcaaaaaagacaggaaaatatcacctctcctgctaaagaactagaaaagttggtattttcaaaagaagaaacacctcaattcaagttaactcaaggacaactaagattgcacttcgtagtaaagaatgggaccttgtcagggcaacaacacactcttacactcttctgtcctgtttaatgtaaacagagttataaaaaccacttcaaagtgaagactcctgcccacgtacagatatttgcttaatgtgtgggctgatagctgtgaactatgtaaggcttttaaaacaatagtttaactttttagattttaaagataacttttctgtttcttttatgtttttttcttttccccaatattcctgcatatgcatttggaatcagtgcagtatcactgttaaaacatgggagtctaacaactcctaaagccactaggaacagtcccagcattgtcaggtatggaagggctctttcttcctacttttaccacggaagctacagttactggcgatcatcaagcaaaagctgccaattaacatttgccattcgtatcctttgtaagcccttcttattagcagtttagcatgtttgggggtcataaaaagagaaagtattggttattgattatctacttttatgaagctctatggtgtatttcttatgaactataatggttctcatttgctgataaattttcttattaagtaaatgtattcaaagatgttttcatagtgccaagcagcatggtggtccagtggttatataaaaataataaaatacaaggtgtcctgaaagtttcagggcagtttttagctttaatatagtgtgcctgggccctccagaggactgcagcatatgtatacatgctgtaaatctttacaaaatatcatttgaaagtgtaattgtatttcttctttttatttttaatagatgatgcctcactatattgcccaagctacagtgcaatgattaatcagagacacaatcatagcacaccacagcctgaaaatcctggcctcaagcaatgttcccatgtcagcctaccaagtagctgggaccatgggtgtgtaccactgcctctggctttattttgcagaatttgaatgttaaacttttaaccttttgtttcagtcaatatctgctatcttcaagaaggactgaaacaataaattaaaagcttaatactcaggagctaggcatgcttgtagtcccagctactcatgaggcttaaatggaggatcacttgaggcctagccttggaggctgcagtgcactgtgattgtgcctgtaaatagctattgcactccagccttggcaacataatgagacactgtcactttaaaaaatggcaaaactaaataaacgtaaaagaaatacaacaagcttttcaatgatttgtaaatgtttgtagcattgttacttctacaagtatcaaagcttaaaatttcactaagacttttggaattcttgtgtttttataaagtgcccttttctcttgtaaagtagctctttgcaaggcttttatctgcattgatcacctcagattattttccctagatgtgataaagaggaggatccatgttaattcatatgtaacaaattagaaggaattggaccctaatagtagtaggtgatgcaatacattttattatcccacatgttagcctggatgcaggtatcatatttcatgtcctgctatttaaaaagaacttccataaaccttaggaatcctacctcctgaaaaagtatcatttatggaatgcagagcttagagattggagtattgattgcagttttattttcaaaataaatgctacaattgatgtggttttcatttctcatgtttatattaaaagaaaacctagta

SEQ ID NO: 61526 - DNA, 5974 bp, Homo sapiens
tggacgaggaagattatctttctctcattttttagaccattaatttttagaccaagtttgtaaaattggggatactcatatttcttagacaatcaaataaatgatcagaaagactaaataaatcaccatagtcacaaagcagttcacaatacatttactgggtaatttctagttaacagtagcagtgatgatcacattgaaaatctcgtgttttgtggtggttttctcttacgtaagcttcttgctttgttgaaagcatagattctaagctgctctatcaaaatgattattagaaaaatgtgatgtactttctgtgtaaattttctaaactttcttctgttaatcttgttaatttgattgaacatgtgtgtcattttcaaaaatgtaaatcgaatatatgtggatgggatatatatgtgtacatatgaaatataacttcatattacagagtaggcttagctcatggcaatgttgttttgtgaaagcacctgcagaaatctctctcatttctagtttgttaatgtttcagagattgcgtgaggcagatttggtttcagtcattttagcatcattcattgtaaggtgatgatccctaggaactgcttcacaatgagaaacctgaaaggtcccagcagtgagcaatgaatgaaaggtggggcggggctgctggcagggtggggccttgtcagccatatgcctgtgctctcaagtgccaagtttgtggggatgcatgcaggggattctggacctgattgtttcctctgaaccaggatgtggtctggttggcagggcaactggtcttcacttggtggccttcagtgggtgtcctcattggttgccttcagatagtgccctcagttggtaccatcagttggcgctcttcaggtggtggtcctcagttggtggtcttcagttgtagggcaatggtggaaggaggatgaaactgtgctttctcctcccccagtcacagctctcaggcttgctgcctccgggcccttctaaaataaaccagacaggttggcaggtttttcttaacagacaagtcagctcagggtacaggggtgacacagggtgcaggctgctagtgcagtgccaccccatggcccaggggtgcccgtgccagccatgcctttgccaggaagaggcgataggtgttgagctctgcagacttggggacaagcgaacacccaagctgcctgagaagtgcaggggtgccccatggggaccacactgaactgtcgcatgtgcaccaaagccagccccagtcagggccggcacaaggtttctgcagagccagcctgtggctctgacgtctacaagtgtgcatacaacgaaggcgcaggctgcgatatacaggagcagaggcacccagaacacgctgcccctgctgccagttgcaagtggggtctgctcagaatgcggagggtgaagctgtcctgcagctttgagatccacgaggtggtggtggccctagcgccagactccactgctatggaacctgcccagttgaatttgggagccagtgagggacctgacagcagcaccaggagacgcccaaaggtagggaggtgacagatactgctgaagtttaggaactcctctagccattgctggcccaagaatcctgcagaggcatccagagtctcagttttctcatctgtaaacgatgtgcttgttatgaggcttcggtaaggtaagtgtgtaaaaaccatggcaaaatgcttgtaacttaaaagagaggatttctatgaggcttctataaagtaagtgtataaaaatctggacacaatacctatgattttttcagtgttcagtatatggagaaggagattatattctctcatctaattttcagagccagtttataaaaatggtgatactcatatttcttagacgatgaaatcaatgatcagaaagaataaatagatcatcaaagtcacacagcagttcacaatgcgttccttgtgtaatttctagttaaaagtagcaatgatgatcacattgaaaattttgtattatgtggtagttttcacttacataatccttttggtgttttgaaaccatatattctaagttgctctaccaaagcgatcattagaaaaatgtgatgtagttagtgtgtaaattttagaaaatttcttccgttagtcttgttaatttgattgcaaatatgtgttattttcaaaaacgtaaatggaatatatattgattggacttgtatgtgtatatatgaaatatgactggacattatagagtaggcttagttcatggcaatgtttttttctgaaagcacctgaagaaatcactcttatttccagtttgttagtgtttcagagattatgggggaaagggggttctatgaatgtcagacactgcgtgaggcacatttggtttcagtaattttagcatcattcattgtaaagtgatgatccctcggaacttcttcacaatgagaaacctgaaaggtcccagcagccagcaatgaatgaaaggtggggtggggccgctggcagggcgaggccttgtgagccatgtgcctgtgctctcaagtccgaagtttgtggggatgtatgcaggagattctggccctgattgtttccccagaaccaggatgcgttctggttggcaggacaactggccttcacttggtggccttcagtgggtgttctcattggttgccttcgtttagtgccctcagttgtttctcttcagttggcggtcctcagttggtggtcttcggttgttgggcagtggtgggaggaggatgaatccatttgtgctctctcctcccccagtcacagctctcaggcttgttgcctccaggcccttctaaaataaactagacaggtggcaggatttttttagcagacaagtcagctcagggtacaggggtgaagcgggttgcgggatgctagtgcagtgtcgcctcatggcccagggctgcccgtgccagccatgcctttgtcaggaagaggcgataggtgttgagctctgcagtcgtgggggccagggaaggcccaagctgcctgagaagagcaggggtgccccatggggcccacactgaactgtcgcatgtgcaccaaagccagccccagtcagggctggcaaaggggttctgcagagccagcctgtggctctgacatctacgagtgtgcagacagcgaaggcgcaagctgcgatatacaggaccagaagcacccggaacacgctttcccccactgcgagccgcaattgggctagctcagggtgcggtgggtgaagctttcctgcagctctgagatccacgaagtggaggtggtagtagcgcaggaccccactgctttggaggctgcccaatcgaatttgggagccagtgagtgtcctgacagcggcaccagaagaccccgaaaggtagggaggcgacggatactgtttagattcaggagcacctctggctgctgatggcccacgtttcccccagaggcatccaaagcctcagttttctcatctataaaagatgtgattgttatgaggcttccataaggtgtgtaaaaaccaaggcaaaaatgtttgtaatttaaaagagagagtttctgtgaggcttctataaggtaagtgtgtaaaatctggacacaatacctataatttaggtcactataacctctgcctcctgggttcaaacgattctcctgccttagcctcccgtgtagctgggattagaggcatgcgccatcaggcctgaccaatgttgttctttttaggagagatggggtttcaccatgttggtcaggccggtctcgaactcctgacctcaggtgatctgctcaccttagcttccctaagtactgggattataggcgtgagtcaccatcctaggccaaaaatttcattccttgatcaacaaacctgtttccaaggagatgcttgtggtctacatatgcagattcccagcatttccaagaagaagggaatgactgcaaggcaacctgggcgggagtttaggattgttctgaggctgtgaaagccattgaaattcacacataagaggatagagaaagggaattcacatgtttgatccctccatgtactgggtataacttggtcttcattaagtttgcaccacctttggcatcagagagaactggagttgaatccaagttccaacactcattaggatgtgatcatgaatgtgtttttaactcctcagaacctcactttgcttatctataaaagaggggattcttatgaggcttccgtaagttaaatgagtaaaaatttgggtggacaaaatgcctgtaatttaaaagatagggttgttatgaggcttcgataaggtaagtgtgcaaaaatctggacacaatgcctataattttgttagtgttcaatatatagagaaggattatttttctatcatttaatttttagagcaagtttataaaatggtgttactcatctttttgagaaaatcagaccaaggatcacaaagattaaatgagtcgccatagtcacaaaggagtttacaatacatttcctgggtaattgccagttaaaagtagcaatgatgatcacatttcaaatcttgaattatgtggtgcttttctcttacgtaagcctctttgtgtgttgaagccatagattctaagttgctgtatcaaaatgatcactagaaaactgtgatatacttagtgtatatattttagaaaatgtcttctattactcttgttaatttgattgaatacatgtgttattttcaaaaatgtaaatggaatatgtgtggattgaatatatatgtacatatatatgaaatatgatttgtcattatagtgtaggcatagctcatggcaatgtgtttttctgaaagcagctgcagaaatttgtctttttttagtttgcaaaaatttcagaggttatgggggaaagtggggttctatgaatcccagatagtacatgaagcagatttggtttcagtaattttagcataattcattgtaaggtgatgatccctaggaacttcatcacagtgagcaacctgaaagctcccagcagccagcaataaatgaggtgggacgagtccactggcagggcggggccttaagagcctgatgcttgagctctgaattccaagttggggggacacatgcaaaggattctgggcctgattgtttcctgtaaccaggatacagtctggttggcagggcaactggctttcacttggtggccttcagtgggtgtcctcattggttgcctttggttagtgccctcagttggtaccctcagttgtttctcttcagttggtggtcctcagttggtggttttcagttgttgggcagcggtggaaggaggatgaatctgtgctctctcctccccaggccacagcaattcacttgaaggagaaacagccccggtgtggagaggcggccatccttggcgggatcctttctaaggagccgagaaatcaacgtagagcttcctctgtctgattctctaacaactgcagaccttccatgagtcaagctttgtgtcaaaaggacaaataaaaaggacctataaaaggcatcaccaagcccaatggacagatgccccaggctgcacattctgtcagtgctgttctggaaaaggcccaaacacatgctgaaacatcgaaggataagaagccagccctcgggaaccggcaggagcactctgggccccgcacggccccaagtccagcctgccccgcctcctctggtgcagaggtccagggataccagcagcagccccgccacgcccctccaaggccaagaacacaggcggcaggggcttcccctccctgccagactacttcctgccgccacagccaccacccttggacgacccagagctcccgccgcccctggacttcgtgctccctccccccgcggtcgccaagaggcctcctaatgccccacccccgcaagagacacgaagcatcaatgttcagaagcagcaaataaataaaataaatgaataaaagtta

SEQ ID NO: 61527 - DNA, 3608 bp, Homo sapiens
catatgcctgtgctctcaagtgccaagtttgtggggatgcatgcaggggattctggacctgattgtttcctctgaaccaggatgtggtctggttggcagggcaactggtcttcacttggtggccttcagtgggtgtcctcattggttgccttcagatagtgccctcagttggtaccatcagttggcgctcttcaggtggtggtcctcagttggtggtcttcagttgtagggcaatggtggaaggaggatgaaactgtgctttctcctcccccagtcacagctctcaggcttgctgcctccgggcccttctaaaataaaccagacaggttggcaggtttttcttaacagacaagtcagctcagggtacaggggtgacacagggtgcaggctgctagtgcagtgccaccccatggcccaggggtgcccgtgccagccatgcctttgccaggaagaggcgataggtgttgagctctgcagacttggggacaagcgaacacccaagctgcctgagaagtgcaggggtgccccatggggaccacactgaactgtcgcatgtgcaccaaagccagccccagtcagggccggcacaaggtttctgcagagccagcctgtggctctgacgtctacaagtgtgcatacaacgaaggcgcaggctgcgatatacaggagcagaggcacccagaacacgctgcccctgctgccagttgcaagtggggtctgctcagaatgcggagggtgaagctgtcctgcagctttgagatccacgaggtggtggtggccctagcgccagactccactgctatggaacctgcccagttgaatttgggagccagtgagggacctgacagcagcaccaggagacgcccaaaggtagggaggtgacagatactgctgaagtttaggaactcctctagccattgctggcccaagaatcctgcagaggcatccagagtctcagttttctcatctgtaaacgatgtgcttgttatgaggcttcggtaaggtaagtgtgtaaaaaccatggcaaaatgcttgtaacttaaaagagaggatttctatgaggcttctataaagtaagtgtataaaaatctggacacaatacctatgattttttcagtgttcagtatatggagaaggagattatattctctcatctaattttcagagccagtttataaaaatggtgatactcatatttcttagacgatgaaatcaatgatcagaaagaataaatagatcatcaaagtcacacagcagttcacaatgcgttccttgtgtaatttctagttaaaagtagcaatgatgatcacattgaaaattttgtattatgtggtagttttcacttacataatccttttggtgttttgaaaccatatattctaagttgctctaccaaagcgatcattagaaaaatgtgatgtagttagtgtgtaaattttagaaaatttcttccgttagtcttgttaatttgattgcaaatatgtgttattttcaaaaacgtaaatggaatatatattgattggacttgtatgtgtatatatgaaatatgactggacattatagagtaggcttagttcatggcaatgtttttttctgaaagcacctgaagaaatcactcttatttccagtttgttagtgtttcagagattatgggggaaagggggttctatgaatgtcagacactgcgtgaggcacatttggtttcagtaattttagcatcattcattgtaaagtgatgatccctcggaacttcttcacaatgagaaacctgaaaggtcccagcagccagcaatgaatgaaaggtggggtggggccgctggcagggcgaggccttgtgagccatgtgcctgtgctctcaagtccgaagtttgtggggatgtatgcaggagattctggccctgattgtttccccagaaccaggatgcgttctggttggcaggacaactggccttcacttggtggccttcagtgggtgttctcattggttgccttcgtttagtgccctcagttgtttctcttcagttggcggtcctcagttggtggtcttcggttgttgggcagtggtgggaggaggatgaatccatttgtgctctctcctcccccagtcacagctctcaggcttgttgcctccaggcccttctaaaataaactagacaggtggcaggatttttttagcagacaagtcagctcagggtacaggggtgaagcgggttgcgggatgctagtgcagtgtcgcctcatggcccagggctgcccgtgccagccatgcctttgtcaggaagaggcgataggtgttgagctctgcagtcgtgggggccagggaaggcccaagctgcctgagaagagcaggggtgccccatggggcccacactgaactgtcgcatgtgcaccaaagccagccccagtcagggctggcaaaggggttctgcagagccagcctgtggctctgacatctacgagtgtgcagacagcgaaggcgcaagctgcgatatacaggaccagaagcacccggaacacgctttcccccactgcgagccgcaattgggctagctcagggtgcggtgggtgaagctttcctgcagctctgagatccacgaagtggaggtggtagtagcgcaggaccccactgctttggaggctgcccaatcgaatttgggagccagtgagtgtcctgacagcggcaccagaagaccccgaaagcatgcagactgtgaagatgcaggccgcgatatacgggagcagaggtgcccagaacatgctgtcccccaatgccagccacaagtggggctatctgagggtgtgatgggtgaagctgtcctgcagctctgagatccacgaggcagaggcagcagtagcgctggactccactgctttggaggctgcccagtcgaatttgggagccagcaagagtcctgacagcagcacattggccaccagaagacacccaaagggagaggagcggaagaccttctggtgtgggctgggcagcaattcacttgaaggagaaacagccccggtgtggagaggcggccatccttggcgggatcctttctaaggagccgagaaatcaacgtagagcttcctctgtctgattctctaacaactgcagaccttccatgagtcaagctttgtgtcaaaaggacaaataaaaaggacctataaaaggcatcaccaagcccaatggacagatgccccaggctgcacattctgtcagtgctgttctggaaaaggcccaaacacatgctgaaacatcgaaggataagaagccagccctcgggaaccggcaggagcactctgggccccgcacggccccaagtccagcctgccccgcctcctctggtgcagaggtccagggataccagcagcagccccgccacgcccctccaaggccaagaacacaggcggcaggggcttcccctccctgccagactacttcctgccgccacagccaccacccttggacgacccagagctcccgccgcccctggacttcgtgctccctccccccgcggtcgccaagaggcctcctaatgccccacccccgcaagagacacgaagcatcaatgttcagaagcagcaaataaataaaataaatgaataaaagttaa

SEQ ID NO: 61528 - DNA, 1933 bp, Homo sapiens
ttttagaaaatgtcttctattactcttgttaatttgattgaatacatgtgttattttcaaaaatgtaaatggaatatgtgtggattgaatatatatgtacatatatatgaaatatgatttgtcattatagtgtaggcatagctcatggcaatgtgtttttctgaaagcagctgcagaaatttgtctttttttagtttgcaaaaatttcagaggttatgggggaaagtggggttctatgaatcccagatagtacatgaagcagatttggtttcagtaattttagcataattcattgtaaggtgatgatccctaggaacttcatcacagtgagcaacctgaaagctcccagcagccagcaataaatgaggtgggacgagtccactggcagggcggggccttaagagcctgatgcttgagctctgaattccaagttggggggacacatgcaaaggattctgggcctgattgtttcctgtaaccaggatacagtctggttggcagggcaactggctttcacttggtggccttcagtgggtgtcctcattggttgcctttggttagtgccctcagttggtaccctcagttgtttctcttcagttggtggtcctcagttggtggttttcagttgttgggcagcggtggaaggaggatgaatctgtgctctctcctccccaggccacagctctcaggcttgttgcatccaggcccttctaaaataaaccagacaggttggcaggtttttttttagcagacaagtcagctcagagtacgggggtgacacggggtgcaggctgctagcgcagtgccaccccatggcccagggctgcccgtgccagccatgcttttgccaggaagaggcgataggtgttgagccctgcagacttgggtgcaagcgaagacccaagctgcctgagaagagtaggggtgccccatggggcccacactgaactattgcatatgcaccaaagccagccccaattggcacaagggttcacagagccagcctgtggctctgacgtctaccagcatgcagactgtgaagatgcaggccgcgatatacgggagcagaggtgcccagaacatgctgtcccccaatgccagccacaagtggggctatctgagggtgtgatgggtgaagctgtcctgcagctctgagatccacgaggcagaggcagcagtagcgctggactccactgctttggaggctgcccagtcgaatttgggagccagcaagagtcctgacagcagcacattggccaccagaagacacccaaagggagaggagcggaagaccttctggtgtgggctgggcagcaattcacttgaaggagaaacagccccggtgtggagaggcggccatccttggcgggatcctttctaaggagccgagaaatcaacgtagagcttcctctgtctgattctctaacaactgcagaccttccatgagtcaagctttgtgtcaaaaggacaaataaaaaggacctataaaaggcatcaccaagcccaatggacagatgccccaggctgcacattctgtcagtgctgttctggaaaaggcccaaacacatgctgaaacatcgaaggataagaagccagccctcgggaaccggcaggagcactctgggccccgcacggccccaagtccagcctgccccgcctcctctggtgcagaggtccagggataccagcagcagccccgccacgcccctccaaggccaagaacacaggcggcaggggcttcccctccctgccagactacttcctgccgccacagccaccacccttggacgacccagagctcccgccgcccctggacttcgtgctccctccccccgcggtcgccaagaggcctcctaatgccccacccccgcaagagacacgaagcatcaatgttcagaagcagcaaataaataaaataaatgaataaaagtta

SEQ ID NO: 61529 - DNA, 5960 bp, Homo sapiens
tggacgaggaagattatctttctctcattttttagaccattaatttttagaccaagtttgtaaaattggggatactcatatttcttagacaatcaaataaatgatcagaaagactaaataaatcaccatagtcacaaagcagttcacaatacatttactgggtaatttctagttaacagtagcagtgatgatcacattgaaaatctcgtgttttgtggtggttttctcttacgtaagcttcttgctttgttgaaagcatagattctaagctgctctatcaaaatgattattagaaaaatgtgatgtactttctgtgtaaattttctaaactttcttctgttaatcttgttaatttgattgaacatgtgtgtcattttcaaaaatgtaaatcgaatatatgtggatgggatatatatgtgtacatatgaaatataacttcatattacagagtaggcttagctcatggcaatgttgttttgtgaaagcacctgcagaaatctctctcatttctagtttgttaatgtttcagagattgcgtgaggcagatttggtttcagtcattttagcatcattcattgtaaggtgatgatccctaggaactgcttcacaatgagaaacctgaaaggtcccagcagtgagcaatgaatgaaaggtggggcggggctgctggcagggcggggccttgtcagccatatgcctgtgctctcaagtgccaagtttgtggggatgcatgcaggggattctggacctgattgtttcctctgaaccaggatgtggtctggttggcagggcaactggtcttcacttggtggccttcagtgggtgtcctcattggttgccttcagatagtgccctcagttggtaccatcagttggcgctcttcaggtggtggtcctcagttggtggtcttcagttgtagggcaatggtggaaggaggatgaaactgtgctttctcctcccccagtcacagctctcaggcttgctgcctccgggcccttctaaaataaaccagacaggttggcaggtttttcttaacagacaagtcagctcagggtacaggggtgacacagggtgcaggctgctagcgcagtgccaccccatggcccaggggtgcccgtgccagccatgcctttgccaggaagaggcgataggtgttgagctctgcagacttggggacaagcgaacacccaagctgcctgagaagtgcaggggtgccccatggggaccacactgaactgtcgcatgtgcaccaaagccagccccagtcagggccggcacaaggtttctgcagagccagcctgtggctctgacgtctacaagtgtgcatacaacgaaggcgcaggctgcgatatacaggagcagaggcacccagaacacgctgcccctgctgccagttgcaagtggggtctgctcagaatgcggagggtgaagctgtcctgcagctttgagatccacgaggtggtggtggccctagcgccagactccactgctatggaacctgcccagttgaatttgggagccagtgagggacctgacagcagcaccaggagacgcccaaaggtagggaggtgacagatactgctgaagtttaggaactcctctagccattgctggcccaagaatcctgcagaggcatccagagtctcagttttctcatctgtaaacgatgtgcttgttatgaggcttccgtaaggtaagtgtgtaaaaaccatggcaaaatgcttgtaacttaaaagagaggatttctatgaggcttctataaagtaagtgtataaaaatctggacacaatacctatgattttttcagtgttcagtatatggagaaggagattatattctctcatctaattttcagagccagtttataaaattggtgatactcatatttcttagacgatgaaatcaatgatcagaaagaataaatagatcatcaaagtcacacagcagttcacaatgcgttccttgtgtaatttctagttaaaagtagcaatgatgatcacattgaaaattttgtattatgtggtagttttcacttacataatccttttggtgttttgaaaccatatattctaagttgctctaccaaagcgatcattagaaaaatgtgatgtagttagtgtgtaaattttagaaaatttcttccgttagtcttgttaatttgattgcaaatatgtgttattttcaaaaacgtaaatggaatatatattgattggacttgtatgtgtatatatgaaatatgactggacattatagagtaggcttagttcatggcaatgtttttttctgaaagcacctgaagaaatcactcttatttccagtttgttagtgtttcagagattatgggggaaagggggttctatgaatgtcagacactgcgtgaggcacatttggtttcagtaattttagcatcattcattgtaaagtgatgatccctgggaacttcttcacaatgagaaacctgaaaggtcccagcagccagcaatgaatgaaaggtggggtggggccgctggcagggcgaggccttgtgagccgtgtacctgtgctctcaagtccgaagtttgtggggatgcatgcaggagattctggccctgattgtttccccagaaccaggatgcgttctggttggcaggacaactggccttcacttggtggccttcagtgggtgttctcattggttgccttcgtttagtgccctcagttgtttctcttcagttggtggtcttcagttgttgggcagtggtgggaggaggatgaatccatttgtgctctctcctcccccagtcacagctctcaggcttgttgcctccaggcccttctaaaataaactagacaggtggcaggatttttttagcagacaagtcagctcagggtacaggggtgaagcgggttgcgggatgctagtgcagtgtcgcctcatggcccagggctgcccgtgccagccatgcctttgtcaggaagaggcgataggtgttgagctctgcagtcgtgggggcaagggaaggcccaagctgcctgagaagagcaggggtgccccatggggcccacactgaactgtcgcatgtgcaccaaagccagccccagtcagggctggcaaaggggttctgcagagccagcctgtggctctgacatctacgagtgtgcagacagcgaaggcgcaagctgcgatatacaggaccagaggcacccggaacacgctttcccccactgcgagccgcaattgggctagctcagggtgcggtgggtgaagctttcctgcagctctgagatccacgaagtggaggtggtagtagcgcaggaccccactgctttggaggctgcccaatcgaatttgggagccagtgagtgtcctgacagcggcaccagaagaccccgaaaggtagggaggcgacggatactgtttagattcaggagctcctctggctgctgatggcccacgtttcccccagaggcatccaaagcctcagttttctcatctataaaagatgtgattgttatgaggcttccataaggtgtgtaaaaaccaaggcaaaaatgtttgtaatttaaaagagagagtttctgtgaggcttctataaggtaagtgtgtaaaatctggacacaatacctataatttaggtcactataacctctgcctcctgggttcaaacgattctcctgccttagcctcccgtgtagctgggattagaggcatgcgccatcaggcctgaccaatgttgttctttttaggagagatggggtttcaccatgttggtcaggccggtctcgaactcctgacctcaggtgatctgctcaccttagcttccctaagtactgggattataggcgtgagtcaccatcctaggccaaaaatttcattccttgatcaacaaacctgtttccaaggagatgcttgtggtctaaatatgcagattcccagcatatccaagaagaagggaatgactgcaaggcaacctgggcgggagtttaggattgttctgaggctgtgaaagccattgaaattcacacataagaggatagagaaagggaattcacatgtttgatccctccatgtactgggtataacttggtcttcattaagtttgcaccacctttggcatcagagagaactggagttgaatccaagttccaacactcattaggatgtgatcatgaatgtgtttttaactcctcagaacctcactttgcttatctataaaagaggggattcttatgaggcttccgtaagttaaatgagtaaaaatttgggtggacaaaatgcctgtaatttaaaagatagggttgttatgaggcttcgataaggtaagtgtgcaaaaatctggacacaatgcctataattttgttagtgttcaatatatagagaaggattatttttctatcatttaatttttagagcaagtttataaaatggtgttactcatctttttgagaaaatcagaccaaggatcacaaagattaaatgagtcgccatagtcacaaaggagtttacaatacatttcctgggtaattgccagttaaaagtagcaatgatgatcacatttcaaatcttgaattatgtggtgcttttctcttacgtaagcctctttgtgtgttgaagccatagattctaagttgctgtatcaaaatgatcactagaaaactgtgatatacttagtgtatatattttagaaaatgtcttctattactcttgttaatttgattgaatacatgtgttattttcaaaaatgtaaatggaatatgtgtggattgaatatatatgtacatatatatgaaatatgatttgtcattatagtgtaggcatagctcatggcaatgtgtttttctgaaagcagctgcagaaatttgtctttttttagtttgcaaaaatttcagaggttatgggggaaagtggggttctatgaatcccagatagtacatgaagcagatttggtttcagtaattttagcataattcattgtaaggtgatgatccctaggaacttcatcacagtgagcaacctgaaagctcccagcagccagcaataaatgaggtgggacgagtccactggcagggcggggccttaagagcctgatgcttgagctctgaattccaagttggggggacacatgcaaaggattctgggcctgattgtttcctgtaaccaggatacagtctggttggcagggcaactggctttcacttggtggccttcagtgggtgtcctcattggttgcctttggttagtgccctcagttggtaccctcagttgtttctcttcagttggtggtcctcagttggtggttttcagttgttgggcagcggtggaaggaggatgaatctgtgctctctcctccccaggccacagcaattcacttgaaggagaaacagccccggtgtggagaggcggccatccttggcgggatcctttctaaggagccgagaaatcaacgtagagcttcctctgtctgattctctaacaactgcagaccttccatgagtcaagctttgtgtcaaaaggacaaataaaaaggacctataaaaggcatcaccaagcccaatggacagatgccccaggctgcacattctgtcagtgctgttctggaaaaggcccaaacacatgctgaaacatcgaaggataagaagccagccctcgggaaccggcaggagcactctgggccccgcacggccccaagtccagcctgccccgcctcctctggtgcagaggtccagggataccagcagcagccccgccacgcccctccaaggccaagaacacaggcggcaggggcttcccctccctgccagactacttcctgccgccacagccaccacccttggacgacccagagctcccgccgcccctggacttcgtgctccctccccccgcggtcgccaagaggcctcctaatgccccacccccgcaagagacacgaagcatcaatgttcagaagcagcaaataaataaaataaatgaataaaagtta

SEQ ID NO: 61530 - DNA, 3594 bp, Homo sapiens
catatgcctgtgctctcaagtgccaagtttgtggggatgcatgcaggggattctggacctgattgtttcctctgaaccaggatgtggtctggttggcagggcaactggtcttcacttggtggccttcagtgggtgtcctcattggttgccttcagatagtgccctcagttggtaccatcagttggcgctcttcaggtggtggtcctcagttggtggtcttcagttgtagggcaatggtggaaggaggatgaaactgtgctttctcctcccccagtcacagctctcaggcttgctgcctccgggcccttctaaaataaaccagacaggttggcaggtttttcttaacagacaagtcagctcagggtacaggggtgacacagggtgcaggctgctagcgcagtgccaccccatggcccaggggtgcccgtgccagccatgcctttgccaggaagaggcgataggtgttgagctctgcagacttggggacaagcgaacacccaagctgcctgagaagtgcaggggtgccccatggggaccacactgaactgtcgcatgtgcaccaaagccagccccagtcagggccggcacaaggtttctgcagagccagcctgtggctctgacgtctacaagtgtgcatacaacgaaggcgcaggctgcgatatacaggagcagaggcacccagaacacgctgcccctgctgccagttgcaagtggggtctgctcagaatgcggagggtgaagctgtcctgcagctttgagatccacgaggtggtggtggccctagcgccagactccactgctatggaacctgcccagttgaatttgggagccagtgagggacctgacagcagcaccaggagacgcccaaaggtagggaggtgacagatactgctgaagtttaggaactcctctagccattgctggcccaagaatcctgcagaggcatccagagtctcagttttctcatctgtaaacgatgtgcttgttatgaggcttccgtaaggtaagtgtgtaaaaaccatggcaaaatgcttgtaacttaaaagagaggatttctatgaggcttctataaagtaagtgtataaaaatctggacacaatacctatgattttttcagtgttcagtatatggagaaggagattatattctctcatctaattttcagagccagtttataaaattggtgatactcatatttcttagacgatgaaatcaatgatcagaaagaataaatagatcatcaaagtcacacagcagttcacaatgcgttccttgtgtaatttctagttaaaagtagcaatgatgatcacattgaaaattttgtattatgtggtagttttcacttacataatccttttggtgttttgaaaccatatattctaagttgctctaccaaagcgatcattagaaaaatgtgatgtagttagtgtgtaaattttagaaaatttcttccgttagtcttgttaatttgattgcaaatatgtgttattttcaaaaacgtaaatggaatatatattgattggacttgtatgtgtatatatgaaatatgactggacattatagagtaggcttagttcatggcaatgtttttttctgaaagcacctgaagaaatcactcttatttccagtttgttagtgtttcagagattatgggggaaagggggttctatgaatgtcagacactgcgtgaggcacatttggtttcagtaattttagcatcattcattgtaaagtgatgatccctgggaacttcttcacaatgagaaacctgaaaggtcccagcagccagcaatgaatgaaaggtggggtggggccgctggcagggcgaggccttgtgagccgtgtacctgtgctctcaagtccgaagtttgtggggatgcatgcaggagattctggccctgattgtttccccagaaccaggatgcgttctggttggcaggacaactggccttcacttggtggccttcagtgggtgttctcattggttgccttcgtttagtgccctcagttgtttctcttcagttggtggtcttcagttgttgggcagtggtgggaggaggatgaatccatttgtgctctctcctcccccagtcacagctctcaggcttgttgcctccaggcccttctaaaataaactagacaggtggcaggatttttttagcagacaagtcagctcagggtacaggggtgaagcgggttgcgggatgctagtgcagtgtcgcctcatggcccagggctgcccgtgccagccatgcctttgtcaggaagaggcgataggtgttgagctctgcagtcgtgggggcaagggaaggcccaagctgcctgagaagagcaggggtgccccatggggcccacactgaactgtcgcatgtgcaccaaagccagccccagtcagggctggcaaaggggttctgcagagccagcctgtggctctgacatctacgagtgtgcagacagcgaaggcgcaagctgcgatatacaggaccagaggcacccggaacacgctttcccccactgcgagccgcaattgggctagctcagggtgcggtgggtgaagctttcctgcagctctgagatccacgaagtggaggtggtagtagcgcaggaccccactgctttggaggctgcccaatcgaatttgggagccagtgagtgtcctgacagcggcaccagaagaccccgaaagcatgcagactgtgaagatgcaggccgcgatatacgggagcagaggtgcccagaacatgctgtcccccaatgccagccacaagtggggctatctgagggtgtgatgggtgaagctgtcctgcagctctgagatccacgaggcagaggcagcagtagcgctggactccactgctttggaggctgcccagtcgaatttgggagccagcaagagtcctgacagcagcacattggccaccagaagacacccaaagggagaggagcggaagaccttctggtgtgggctgggcagcaattcacttgaaggagaaacagccccggtgtggagaggcggccatccttggcgggatcctttctaaggagccgagaaatcaacgtagagcttcctctgtctgattctctaacaactgcagaccttccatgagtcaagctttgtgtcaaaaggacaaataaaaaggacctataaaaggcatcaccaagcccaatggacagatgccccaggctgcacattctgtcagtgctgttctggaaaaggcccaaacacatgctgaaacatcgaaggataagaagccagccctcgggaaccggcaggagcactctgggccccgcacggccccaagtccagcctgccccgcctcctctggtgcagaggtccagggataccagcagcagccccgccacgcccctccaaggccaagaacacaggcggcaggggcttcccctccctgccagactacttcctgccgccacagccaccacccttggacgacccagagctcccgccgcccctggacttcgtgctccctccccccgcggtcgccaagaggcctcctaatgccccacccccgcaagagacacgaagcatcaatgttcagaagcagcaaataaataaaataaatgaataaaagttaa

SEQ ID NO: 61531 - DNA, 1933 bp, Homo sapiens
ttttagaaaatgtcttctattactcttgttaatttgattgaatacatgtgttattttcaaaaatgtaaatggaatatgtgtggattgaatatatatgtacatatatatgaaatatgatttgtcattatagtgtaggcatagctcatggcaatgtgtttttctgaaagcagctgcagaaatttgtctttttttagtttgcaaaaatttcagaggttatgggggaaagtggggttctatgaatcccagatagtacatgaagcagatttggtttcagtaattttagcataattcattgtaaggtgatgatccctaggaacttcatcacagtgagcaacctgaaagctcccagcagccagcaataaatgaggtgggacgagtccactggcagggcggggccttaagagcctgatgcttgagctctgaattccaagttggggggacacatgcaaaggattctgggcctgattgtttcctgtaaccaggatacagtctggttggcagggcaactggctttcacttggtggccttcagtgggtgtcctcattggttgcctttggttagtgccctcagttggtaccctcagttgtttctcttcagttggtggtcctcagttggtggttttcagttgttgggcagcggtggaaggaggatgaatctgtgctctctcctccccaggccacagctctcaggcttgttgcatccaggcccttctaaaataaaccagacaggttggcaggtttttttttagcagacaagtcagctcagagtacgggggtgacacggggtgcaggctgctagcgcagtgccaccccatggcccagggctgcccgtgccagccatgcttttgccaggaagaggcgataggtgttgagccctgcagacttgggtgcaagcgaagacccaagctgcctgagaagagtaggggtgccccatggggcccacactgaactgttgcatatgcaccaaagccagccccaattggcacaagggttcacagagccagcctgtggctctgacgtctaccagcatgcagactgtgaagatgcaggccgcgatatacgggagcagaggtgcccagaacatgctgtcccccaatgccagccacaagtggggctatctgagggtgtgatgggtgaagctgtcctgcagctctgagatccacgaggcagaggcagcagtagcgctggactccactgctttggaggctgcccagtcgaatttgggagccagcaagagtcctgacagcagcacattggccaccagaagacacccaaagggagaggagcggaagaccttctggtgtgggctgggcagcaattcacttgaaggagaaacagccccggtgtggagaggcggccatccttggcgggatcctttctaaggagccgagaaatcaacgtagagcttcctctgtctgattctctaacaactgcagaccttccatgagtcaagctttgtgtcaaaaggacaaataaaaaggacctataaaaggcatcaccaagcccaatggacagatgccccaggctgcacattctgtcagtgctgttctggaaaaggcccaaacacatgctgaaacatcgaaggataagaagccagccctcgggaaccggcaggagcactctgggccccgcacggccccaagtccagcctgccccgcctcctctggtgcagaggtccagggataccagcagcagccccgccacgcccctccaaggccaagaacacaggcggcaggggcttcccctccctgccagactacttcctgccgccacagccaccacccttggacgacccagagctcccgccgcccctggacttcgtgctccctccccccgcggtcgccaagaggcctcctaatgccccacccccgcaagagacacgaagcatcaatgttcagaagcagcaaataaataaaataaatgaataaaagtta

SEQ ID NO: 61532 - DNA, 1419 bp, Homo sapiens
atggggagctcagtgtccactctggctggggccagctggaggccttcagtacagccccagccaactctcactgaacagctggagcaccgacaccctgggcactcatttcaaatcatgaaatgctacttcacagatcacaggggagaacagtcacccaccgatgggaccaccctcagcttgaccagccctgagtccactgaggagagtgtggaagtgttctggccagggactatacagagagaagggtcgtccccacggccggggcctgccattccccgggaggagggcctctacttcgctgccagggaccgggggatgcgggactggagcagctccccatcctcagagtcctccgagtaccagtcctactcccagtaccagtcgtgctgctcctgcatgtgcgatgaggacaatgctgctccgcagagtgtgtgtgccttctacacgcacgtgcagactgtgcggggtgtggctgtggcctgggagacggaggccggcttcgagccggtcaccaggaagccccgcatccatgaagcccagttcatcaagaggcagaggtggaacggctcctccttcgaaatggcttccaacaccgatatgcgctgggacctggaagcctgcaagagcaactgcagccccgagcccgaggacatagacctgctggagtgctgcctgcaggagctgcgggagccgccggactggctggtcaccaccaactacggggtgcgctgcgtggcctgctgcagggtcttgccctccctggacgctctgctggagcacgcccagcatggcatccgggagggcttcagctgtcagatcttttttgaggagatgctggagagaaggcgggctcagggccaagcacatgaccaacagctggaggaggagcagagtccttcagacaacagcgaatgttcccggccccagggtgaggtgctctcagcacagcagcaggagaagcagtgagccagaggggagatacccaaccctgccctcacctccagggcctgggactgctccttccccagccagcagtatcagagccactagggcagggagagaggaccagggtcagggggaaggaaaggcatggagtgtagagcaaggagggccaggagactggaaggaacccccttcctgccctaggcacagcatctccaccagagtccatttcaaaacccaaacgagagggctttgagtgtttctgatggcaggcacaacatctgaaacccacaaacgcatggccagagggatttctatttttgccggtggatcaggcaggtccacacttgctaagtatatgtgggtcacaggacagccaactgcaaattactctccagccctatttttttcactattacaaatctgtcatatgccctagttctatgtcttatgttattgggattaaacttgaataac

SEQ ID NO: 61533 - DNA, 1419 bp, Homo sapiens; identical to SEQ ID NO: 61532

SEQ ID NO: 61534 - DNA, 5281 bp, Homo sapiens
acgggtgtacacagcagcggcgtcgcggcccgcagccccgcggcggcggaaaggtaaccgacccgccctggggtgctgcgtgcgctgcctgctcccgcctgaggaaaacactgcccatggcgcaaggccgggagcgcgacgaaggcccccactccgccggcggcgcgtccttgtccgtgagatgggtgcaaggattccctaagcagaatgttcattttgtcaacgacaacaccatttgctacccttgtgggaattatgtaatatttattaatattgaaaccaagaaaaagactgtactgcagtgtagtaatggaattgtgggcgtcatggcaactaacatcccctgtgaagttgtggctttttctgaccggaagctaaaacctctcatctacgtatacagctttccaggattgaccagaaggaccaaattgaaaggcaacattctcctggactacactttactttcattcagttactgtggcacctacctggctagttactcctctctcccagaatttgaactggccctttggaactgggaatcgagtatcattttgtgtaagaaatcacagcctggaatggatgtgaaccaaatgtcttttaaccccatgaactggcgccagctgtgcttatcaagtccaagtacagtgagcgtgtggaccattgaaagaagtaaccaggagcattgtttcagagcaaggtcggtgaaattacctctagaagatgggtcattttttaatgaaacggatgtcgttttcccccagtcgttgccgaaagatctcatctatggtcccgtgctgccactgtcagccattgccgggctggtaggcaaagaggcagagactttccggccgaaagatgatctatatcctttgcttcacccgactatgcattgctggactccaacaagtgacttgtacattggctgtgaagagggtcatcttttaatgattaatggagacaccttgcaagtgactgtacttaataagatagaagaggaatcgccattggaagacagaagaaattttatcagtccagtaaccttggtatatcagaaggagggcgtgctggcttctggaattgatggctttgtgtattcttttattattaaagatagaagttacatgatcgaggattttcttgagattgaaagacctgtagaacatatgacattttctcccaattatacagtgttgctgattcaaacagacaagggatctgtttatatctacacttttggtaaggagccaaccttaaataaagtcctagatgcttgtgatgggaaatttcaggcaattgactttatcacacctggaacccaatacttcatgacacttacatattcaggggaaatttgtgtttggtggctggaggattgtgcttgtgtaagcaagatttatctgaataccctagcaacggttctggcttgctgtccatcctccctctctgcagccgtgggcacggaggatggctcggtctacttcatcagcgtatatgataaggaatcccctcaggtcgtgcacaaggcctttctctcggaatcgtccgtgcagcacgtcgtttatgatcagcaaggaatatttctgttagttggaacagcagaaggaaaagtctttattatcaatgccaactcctcaagctcatttcagattattggattcacagaggtggccaaagacattttacagatatccacagtgtctcttttagaaacagacatagtggaagtgatggtgctttcctcgcttccagaagcagggagaagcaggttggagatgttcacactgcctacattactgccacaagtttccacaacctttgctgatgaaagaggaaggctgaaagatgaaatcattcataagtacctgtatgagttggagcacgctctgtcctctgcagtcttgggctttcaaagtaaccaaatatatggcttctgtagtcaagtgccatacatctgtagctaccttcttcctgaagaagaacataccggtatctacattcttaaaccatacaaaaaagtacaaagcagacagtatggacctggactgctctatctgtcttcacatggattgtggctcataacaatagctaaatgtggaattctgtgtatccgagacgtttatactttggaaacatttgcttggtgtcggagtcattctcaccagggtcatgggattcagtcaatgagaatttcaatggatggacaaaacattctggtgaatgggagagatgatggcacccttgtctacctaaagtggaagcgatttggaggacacctagccagtgaaattctggactattaccagaaactattaatttccctgagcagcgccatggacaaggagaatcattatttaagcacaacaccaaaagtttccgtagatttgggatccgattctgaacacacaaaacagaaggcaagcactgacttatcacaagatgaattagttctaaccgatgttaagaaggaaattccttggatacaacaaaaaagccaagaggccatcaaaaaggaggttaatctgttttccaagaaaaggaaagagataaaacaaggaatcaaatcactttccaaaactattctgaatatgatggaagaaaatgacaaactagaaaatattgcaaaattagaccaacaggaatttggtctggatcttgaggaactagaaaggcttcatgatgaaagtcaggaagaagtggcaaagatgataaaggatgtagagatgcataacttagccaagagctatttggctgaacttatcaaagaagaatgttggaattcgatggctgtgaaaggtcgagctcttaagtgttttcatatcccctgtgtggttgaaaacttcccgatgaaagcgcgcacggttgaagagctgaaagaattggaaagagttttacagcaaaagaagattgaagcagagtgtcttaaactacggaaggaaattgtagaggctcagtctggagttaagttgattaaacagcgtcatgaagaggatgatgaagaagaggaagaggaagacaagacagtaaaatatagcaatttgcccaattacctgcttggtagtctgagtactgattttggggtagatacctctttattgtcaagccaattggagcttcattccagagaagagaaaatcaaccaaattatattattgaaagatatcatttacaaggtaaaaactgttttcaataatgagtttgacgctgcatataaacaaaaagagtttgaaattgcacgcgtgaaggaaagaaatgttcgaattcgagaaattattttagatctggaattggaagaagcagtctggcaaccagaatttgaagactgtgagaagccagagagaacgcttgttgtgcaagatgaggagattacagcccacaaacacattaagccgtggcacaaagccaaagaattgatcgtgaatcatgaaaaggagcactggcttctgatacaggatgccagtacaagactccgagctctgatggacatgatgggaggagttctggaagtcaagaaggaagatattttgagaatggtgattcctcaacctgctttcatggcaaaacctgatgctgtgtggactgaagaagaaagaaaacaattcaaagattatgagaaaaaagtaaaggagttaaatgaagaaagagataagtatagaaagtcattagaagcagaactgaagaaacttcaaaactctattcaagaaagcacacaggcctttgatgaacatttgaaaagactttttgaaaggagagtgaaggcagagatggttaccaaccaggaggaactgaaaataagtaaccttgcattttctttattgttggatgaagaattaagctctagagaaaaattcctgaacaactaccttacaaggaaacagcacgagaaagttatggatcgcagctttaaaaaggaattttctgaaattcctggtcatcaagtggatatactctacaaactttttaaacgccgaccaaggatttccaaacagaaaacgcactcagaaacaaccagcgttgtccctttcggagaactaccaggatctggcaagttgaataaggatgcctttgcccagttaatgaaagctatggatgagttggacaatattagtaacatgccagaaggcttggaccctttggtctggaatcatttctgcatgacaagacgagcaaaagtggaaaatgaacagaaagtaaagcagaaagcagctgacttattggaaatggcaactttcctccagaagagagttgaggaggaagagaaggtgcaacaggagattgagagagtgttccatgaactcatcctattacaggaagagaaagtgagattccagttgaatttgacaatccaaattcttcttaaacaaggacaagtagaactggaaaatttccagctagtactggagtattctgatgcaattctcatcaacaagaacataattgaagacttgaattctgtgattcggactcaaggacaaaagaaagttgctagcatgatggaaagtaaagatgtacacaaaagaatacttcagattgagtgggaacataagaaaatggagatggaaagggaagatctaaatcagaaggcttgggatattcagatgctatttttttcaagagatcgtcaaaagtacctaaatgaaccaaactatgaggctctgattagtattcagattggaataatggaacaaaccattgctgttttagataagatgcacaaaaagaatgtggaaaactgcaagaaactactcaaaaaacttggaaagttcagcaatcaaaaagatatagcaaattatgccctaagctgcaatctacgagaagagttggtagctgtctcagagagaaaagacatctgtaatgcaatggggtctaaactgacttgtgaaaagattgtcaaagaacggtatgaaaacatgatgcaacagcagaagttaacaaatatttcaaaacaacaagctgaacagatttcaatactacagactgaagttgaaagattaagaatgaaaacatttcctgctcttgttcaaatgtaaaaacgctggcaggaaaacacaaggccaaatcaatcatttaaaaaatcatttcatttgggtaaaatgatttccttttctttcttactgggaaattgaagtagcatgtcctctgagttgcatgttttagataaaaaattgtttaattttagccttaattgtatacaaatttttgtcctgcatgaataaatgtgtaaaataccatgaattgctgtttttattcaagaataaacaagacttgaagtcagaaagta

SEQ ID NO: 61535 - DNA, 1009 bp, Homo sapiens
gggcagaggccaagtgggcaccggatagcgccagccccgcccagagagcgaaatcatggagccttccaagaccttcatgagaaacctgccaatcacaccaggctatagcggctttgtgccattcctcagctgccaaggaatgtccaaggaggatgacatgaaccactgtgtgaaaaccttccaggagaaaacacagcgctataaagaacagctgcgggaattgtgctgcgcagtggccactgccccgaaactgaaacctgtcaactccgaggagacggtcctgcaggccctgcaccagtacaatctgcagtaccaccccctgatcctggaatgcaaatatgtaaagaaacctctccaggagcccccgatccctggctgggcaggctacctgccgagagccaaggtcactgaatttggctgtggcacgagatacactgtcatggccaaaaactgctacaaggacttcctggagatcacggagagggccaagaaggcacatctgaaaccatatgaagagtgaggagaaatgtctctttccttcctactaccgttttaaaaaggggatgaaatgtttgcagtggcctttctgcttagctgggccagctccctgcaactcacacggacggttcctctcctagatggaagctgccctgcccttggaaggcccctgagagaggaccccaaaactccgctgacatgtggctgtgctcagaggccaagtataccatgcagtgggaagatgtatctagagccactgtcctccgcaaagtatgcagaaggctagaagcgcagagtctcccaaggaggtgaactttaagtggggcttccaaaacctgccattctcatgttggaatcacgcccagtgagcaataaagaaatttagtaacaagaattttttaactgccgcctgcatcctgagtggttgacggttgcatgtcattaatgataaagaccgttttttgtcatgtgggaataaagaggctgcttctccgcaaaaaaaaaaaaaaaa

SEQ ID NO: 61536 - DNA, 3097 bp, Homo sapiens
attctgagcctagccacagaggtaaactccggacatttttttctttcatgtcgccaaatacatccttgtcattaaaagacctttgaaactgagtaaaatggctttgaaacctcagtagaatatgctcaaactgtctggagaaggattacgggacagctaccacagtagaagagatcaaattgcccttaaaaatctccagtctgatgtcacagaggcaaaatctgacttcaccaaggagaccctggcatcacaaaacacaaaaatgatttcatccatagtcatctcccagatgattgatgagaataagtcaagagaaaacagggcctccttgcccctaccgtgtgccattgctcagtctcgtgcacatcacgccaagcaatctctggctaaccgcagcggagtcaacattcacagagcatttgcgttacttccgggcagattaggaatcccggcaccgtcagatgagcgaggacctgaggcagagctgccgcccaaagaggagagaccctgtgggggcccccgcagagggtttgcatccatcaccatcacggccagacgcgtgggccccccagcccgcgccctggtgtgggggactgctggggactctctgtgccccaagtgcagggctgaggacacactgttccaggcgcccccggctctggccaatggcgcccatccaggtcggcatcagagatcttttgcctgcacagagttctccagaaacagctccgtggtgcggctgaaggttcccgaggcccacactgggttgtgtgagagacgcaagtactgggtcacccatgcagacgacaaagagaccagtttttctccagacaccccactgtcaggaaagagcccgctggtgttcagttcctgtgtccacctcagggtgtctcagcagtgtccagattcaatctattacgtagacaagtctctctccgtccccattgagccacctcaaattgccagccccaaaatgcacagatccgtcctgtcgctcaacctcaattgtagttcccacagattaacagcagatggagtagatggcctagtgaacagagagccaataagcgaagccctgaagcaggagctcctggagggagaccaggacctcgtaggccagcgctggaacccaggtttacaagaaagtcacttgaaggaaaccccatcgttgaggcgggtgcatttggggaccggcgcttgtccttggagtggttcttttccattggaaaacacagaattggcaaatgtgggagctaaccaagtcactgtaagaaaaggggaaaaggaccatacaactcattgtcacgccagcgatcatgccaaccaactgtccattcacattcctggctggagttacagggcagtacacacaaaagtattttctggaagcagcaagaggcaacaaggagaagtatgtatgactgtgtctgctcctccagtggaacagaagcccactagacatttccttcccattggggatagctctccaagcgatgactgtctgtctagagacctttctgagcccacagagagacgacatcaaagcttcctgaaacccagaatcctttttcctgggtttctttgccccttacaagatgtatgtgcatctctgcaggaagacaatggtgttcagatagaaagcaagttccccaaaggagattacacatgctgtgacttggttgtaaaaataaaggaatgtaagaagagtgaggaccccaccacacctgagccctccccagcagcaccctcgccagcaccccgcgatggagcagggagccctggcctgtccgaagactgttctgagtctcagcaaacgcctgcaagatctttgaccttgcaagaagcactggaagttcgtaagcctcagttcatttctcgctcacaagaacggctgaagaagcttgaacacatggtccagcagaggaaagcccagcggaaggaggacctgaggcagaagcagagcctccttcccatccgcaccagcaagaagcagttcacgattccccatcctctgagtgataacttgttcaaacccaaagaacggtgcatttcagagaaggagatgcatatgcgatctaagagaatctatgataacttgccggaagttaaaaagaaaaaagaagaacaaaggaaaagggtgatcttacaaagtaacagactccgtgccgaagtcttcaaaaagcaattactggaccagctccttcaaaggaatgcggtctaaccacaggctgccctgctgaccacactacctggacctgggaggacttcgaatgctggataagccattaaacttagcattatcttcatcatgggaaaacacttattttactttcgattttttttttccataaaggaaaacatcacttcctgaattactgacccaagccaaacagaaacaataaccctcgagaaaataggtcaacaatctgttgtggggaaaccacctccatgtaacccactggatacagtccccttaatgtttttgcttctaaattgtaccttttgcttctgatttcttctcccctgctgtttcctgcccatcagagaggcctgatacaagcaagtttgtttacatccctggggaatcttttacatcaaacttttgggatccaaatccatctccttttaaatttcaatctcagcacctgccagttatgcaaatgccaaaatgtgggtcatcatatagtatatttgaaacctttctgaacatgtacaccacccaatgctagaggctgacttggaaaccggtgggtgcaatgcccgaggctgtggaacaatcagcccatctctttgtgacctggagcagtcagagggccctcagtcaccccgccccattcctcaccagagaaaagaatccatttctatggaagctctgacgtaacttcagtgttttctacaatactcctcctgccccgccccattaaaacagttcttttgttaagaaatagcctaatggtccaactttgctgtctgttcttccaaatgtttataatacacattatttataaatatgtctgtttgggaagctaagaacaagctagtttttacaacacaaatggaaataaatgcaattattataaaaaaaaaaaaaaaaaaa

SEQ ID NO: 61537 - DNA, 2761 bp, Homo sapiens
cgtatggcctggcccagggtgccgtagctgaggaagaagggaggcttcacagcatccagggcttatatggcctggcccagggcgccatggctgaggaagaagggaggcttcacagcgtccagggcctattgtcacttcaagacttgcagaacgtcaacacgcccctgatgaggaagctggcgcgcctcaagctcggcctcgtggaaatggctctggacatgctccagttcatctgggaggaggcccacgggcagcagagtgagcaggggtccctggagaagctgctggcggactatctgcagaacaccagtgactacacttccgtcggcctgcaatggttcacgctgaagcggactctagcacacggggcactggcacagctggggagcctgcagccgctgagcgtgggctgtgtggagatccgcgcccggctcctgggcctggccgggagggccctgcacctgctggccatgcaagctgaccctgtgcaccctacctgctactgggaggcgggcccctcggtgggcgccaagctgagcggcctcaagtctctggagctggaggtagaggaagagggtgccacaaagtccagcagggacccgccggcctccagggcagccccggaggagcactgcaggagaggcgaggacctgaagaggaggatggttctggcccagcagtacctggctcaggcgtcagaggtgctgctgcagtgcctacaggtggcccttggcagtggcctcctggatgtcgcagcagccgccagcctggagatggtggagtgtgtcggcaccctggaccctgcaactacctgccagttcctggctctgtctcagagctgctcggcctcagagacgatgagggatgtcctgcttgcagccacagccaacaccagcagctcacagctggcggccctgctgcagctacagcaccagctccggtgccaagacaggaccaccaccagcctgggcgcccgtgtggagcagaggctggccgccgtgtccaaggcttggcaaaatctctgcgtcactgagcagcattttaacctcttgaatgagatgcctccgaccttttggatcctctttctgcacctctcaggggacaggtcccgtctgtacggcgctgcctacgagaaacccaagttcattactgcagccaaaggaaaggtgcaggcggtgggaggctcctgcaaggtgatgcgtctggccataagtcccactgccttctcccacctgctggcctgtgcccagcagttccggaagcagacccaggcccaggtgtacagtgaggacatggccctgaacataggctcggaaccagaaggcctgcaggtggaagagaaggagcgccctgtgcagaggctcagtagcgtcctggggcccctggaggagcttctgcagccgctattccccctgctcagcctctccaaggccagagtgcagacacctgcggttgttgccgattcagggaagtcgaagggcaaagacaaggagaggaaaacgtccacaggacaacacagcacagtccagcctgaggttgccgataagatagtcctggtcacagacagacatctcctggagctgccactggaaggtctctctgtgttcgatgaagggacaatttcctctgtgtcacgagaattttctcttcaaatgctgtggaatcgcctccataaagaagagacagaaggtggcgtgaaaaaggagggaagaagcagagaccccaaaaagagaagcctagcgaagaagggcaggaagggcagcatcccccggaccatcccccctgactgcatcatagtcgactcagacaacttcaagttcgtcgtggacccatacgaggaggcccagggcccagaaatgctaactcctgtctccatcacccaagacattttggaaagattccaagacacattcacgtcgcgatgggcgggacatctgggaagcaagcactttcccagccaggcccagtgggagcaggccctgggcagctgcagcggtttcttcttctatggaatggagagcttcctgtcccatatattagtggagagattggtcgccatgaacttgcaagagtgccaggtggcagtcctgctggacctggcgcggtcctaccagagcttgaagaggcacatggagagcgtggagcacaggagatctgttggccgttgggaagccaattggagaaacggtgcgtctccttcagaagatgagtggcgacgaggcggtgaaccaaggcgaggcttctcagaccttgaaggacaagctgctgctgctccaaagctccgagctccttcccaccacgctcaacttggtcctgtatgggctgccgcaccaagccatcgggtagtgcaggcctggacctgcctcccatcagctgctggggccccagcacttgcctctgcccttggctctgcccctctgccaacccatccccacctcccggctcccatccccagctcccagctcgctctccccttcctgggcctctccccagcccttggtgcagcctcagccagggaccctcccccagcgacttcccgcaaggcagccgcctggacctcgagctctgcctgcctgtgtgcgccatggggtctgcgtcggggctggagctgcgtctcttcccggggccaggacaagggcggcctccccttggcggcgctggtgctgagttgcttagaccagaagactattcagaccgtgagcctgtttttgatttgagtgttccactaaacaaacaacaaaagccaaaaaaaaaaaaaaaa

SEQ ID NO: 61538 - DNA, 1744 bp, Homo sapiens
ggcaaggcccgacctgaagcactggctccagccttagggaaggttttggccgtgggttttgttggcacgtaccattttgctgaaagacagagcaccttgaggacgttatccctaaaatgagagaggactgggattgaaaggctgactacagaaatggctgctgcccagacgccctcaaaagccaaggatcctcagggttggttataaaatatttaagggcgagaaaaggatcgcaggagccaggccctgagatgagcttggagtccctgtttcagcacatcatcttcaccgagcatcaggcggaggagagtcgccgtttgatgcgagaagtaaggtcggaaataaccagatgtcgtgaaaaaattaagaaagcaacggaggagctgaatgaagagaaaatcaagctggaatctaaggttcaacagttttttgaaaaatccttcttcttacagcttttgaaagctcatgaaaatgctttagaaaaacagtacagtgaaattacaaaccataggaatatgcttcttcaaacctttgaggctataaagaaacaaatgatagaggaggaagacaaatttattaaggaaattacagactttaataatgattatgaaataacaaagaaaagagagcttttgatgaaagaaaatgtcaagattgaaatatctgacttagaaaaccaagcaaacatgttgaaaagtgaaatgaagtcaatggaacatgatagtagccagttaaatgaacttcaaaaacaaaagagtgaattgatacaagaattatttactctccaaagaaaacttaaagtttttgaagatgaagagaatgaatccatttgtactaccaaatatctagaggcagaaaaaataaaaatcagtgaaaagcctcaaaatgatacagaatgcttaagacttaaaaaagaattagaactttataaggaagatgacatggaaagtgtttatgaagctctccaaacagaaatagaatttttggagttgacattggcacagaaagatcttcaggaaagcaaataacttacagagaattgatcagccatctgagatttgatcagaatatctgagaatcaaatctttgtgatagatatatgaatggtacccgttacaacggatccttgtgggaaatatggggtttaaaatattcaaattgttattatctagaattgatgtgttagccctttaagataatttttgtcttgttactcaaactttaagagttcttctgtggtttgattttgtttctaaaagaaggaaaaggagaagaagtagataccgtgttcccaggcttcttatatgcccctgaacctcaagctgtcctattctttctaatctatataatatggtttggatctgtgtccatgcccaaatctcatgttgaattgtgatccccactgttggaggtgggtcctgataggaggtgattgggtcatgggggtgggtttctcatgaatagcttagcaccattcttcttggtactgtccttgagttctcctgagagctagttgtttactagtgtatagcacttctccactttgctcctgctgccaccgtatgagatgtctcactccccctttgccttcagtcatgattggaaacttcctgaggcctccctagaagcagaagtcactatgcttcctgtacagcctgcagaaccgtgggacaattaaacttgtgttctttataaattaaaaaaaaaaaaaaaaaaaaaaaaaaaaaaaaaaaaaaaaaaaaaa

SEQ ID NO: 61539 - DNA, 1106 bp, Homo sapiens
gtcccaggagactacagcaaacgagtgtatcaaggagtgagagtgaagcatacagtcaaagatctcctggcagaaaaacgatccgggcagacaagtaactcaagacttaatggcagcgtcagttcctctcagtctccatttgtgcagatgccaggttcgccggtcacgtcaggttactacggtgtcagaagatctttcttatctgactcagacttccacaacagtaaacagttttcaaatgacgtctacacctccagcgtggggaagccgtttccctgtgagtcctccgcagggcagagccatgcggctctcctggagccctacttcccccaggagccctacggagactaccggcctccggcgctgacgcccaacgcgggctctctgttcagcgcctcgcccctaccgccgctcctgccaccgcccttccccggagacccagctcacttcctatttagggactcatgggagcagacgttgcctgacggtctcagccagcctgaccctgtgtctgccgatgccctgctgaccttgccacccagcacgagttgcctctcccagcttgagtccgggagcatcgcccagcacaggggctcaagctgggggtcatccctggctggggctcagtcatactcgctgcatgctctggaagatctgcaccacactccggggtaccctaccccgcctccttaccccttcacccctttcatgacggtgtcaaatgacctaccgcccaaggtggggccactctccccagatgaggaagcagacaccggttccctccatgacccttccccttgggtgaaagaagatgggagtattgcctgggggtcatatgaatgccgcagagcttattgaggggagggccaaatgacttctgggtttttctttaacttgaggtgtattccaaagatcgttttaggtgtgtcagcccattcaggactggattttcagaataagcctcaatgctgctctttgttagtggacgagggcatttatttgtaatcctctccactgtaaccccactgaaataaaacagaatgttaattaaaaaaaaaaaaaaaaaaaaaaaaaaaaaaaaaaaaaaaaaaaaaaaaaaaaaaaaa

SEQ ID NO: 61540 - DNA, 2977 bp, Homo sapiens
acagtcctgccaggacggcgacagtgaagcacctgggttgagagggagcagcaggtaactgcgcaacccctgcctcccccggccccagcccgtgcctcagcagagccgggtgtggtggggacccgggagtgggtctcactgcgtgtcgcctgccaacaccttcctccaccaccatccttacccagccccagtcccacccagcacacctgggcgagacaacccaggtgcgaaggacaagcgattactaccgaagagcgtgcaaaccaggaagagagcagcctcctggagaggaaaacgtgatcccaggggtagacacgtggcgctgcgtggagagacaggttgacgagacgaggctcttctgaccgtcctacctggcaaaacttgacgacagcttcaggtcgctaccatctggacctctcggagctccctgaaccatgactcagaccctcgacacaagggaagaccctctgaacctgggcggcggtggcggcggcggctgtggctgtggctgggcacactcggcctccttgagctcctggtcgtcctgccatcgaaggcgcccgggtgctccagcgtacaatagaccgcaccgatatagccccaagaccgagtatgggcccccaaggaagcagccgaagcaacagcacggcccgggcttttggttccaaccacccgtgtgctctaactgggggtgctggggagggccctggcgcccaccccctccaggattctggaaattcccctgcccggtgcaagtgtttcgggtgtatggcctgcaccctctctgcttttgctgctgctcctgctggagcgggtcctggaaccctggctgggtgaagcccccaggcaggaagaagcgctggggccgcagaggccgcggcctgcgccaccaccctcgccactcctacccgcggagcccgccagcggatgtgagcacgctgccgcggccggtcaagctgtatgagtggagagagcctggcatgcgagcgccgcccaacaccacccaattcatcatgaaccagatctacgaggacatgaggcagcaggagaaggtggagcgtcagcaggaggcgctgcgggcgcagaaggccacggtgagcggcgaggcctccccagccagatcctccggaaacgacgcgccccctggcggcagcaaggaaacctggggactgcaggaaactctgtatggctttgtgcagaatccctctctagcattcagtcccaacccagaggaaaaccagtctcttgccccgctgctggtggaagaagaggaggagaagaaaaatgatgatgaggaggagtatgaccaggaggtgtgtgatgcaaaggaggcgagcgaggaggaagaagaggtcgaagatgaggaggaagaggtcgaagatgaggaggaagaagaggtcgaagaggctgaatatgtggaggagggagaggaggagctggaagaggaggagctggaagaggaagaggaggtcctggaggagaacgagcagagaggggaagaatttcacttgcctctggaaatgcctttatcaatcttcgtagaggctgaagaaaagagagagaactttataagctgcacttttttaaacccagagcagataattcccaaagtgccacaggaatccctgttcatggcacaggactttaactgttagacatcagaaaagggattgagaaaagggatggaactgatttgaggctaaactggattagcaatttattaaaaactgattaaaaagtgagttccattaataaacagatctatgtaaacaccttctttggccattataaaatgtttaaaatttgatgcgtatgtgtatgactatgggtgggtggtggggaagctttcaaatataattttactggaactgattaaaggccaagtattttattactaccatttgaatattttcatttggtgttttcccctctagaaaacagagttgctgttgtttttttaaatctggcaatgctgaaaaagcgtttgtttttgaaacaaatttatacaacttggccacttaatgagcttggaatcaagagatagtttattacatgcgtaagaagcacattctaacgctactaaatgttcaccagtgctcttaacataactgaagccattttcaatccctgtattttttcaacaatatttttcctcatagatttttccaccatcagagttcatttttgagggttatattttgttaacctcatttgcaggctcttgtgtcatcgcttattgatattccttgttccacagtgctatggatcttcctcagaagaacatgaagttgcttctgtggaactggttatctgccatggcctcaacaatccataatccagtcatggagaggattccccatggtcagaagtcaacttgcacatctagttaaagtccaaggtaactgcaaacagtggaacatggcttaggttttgaagcctcgttattggatatagtctttatcctaagttctgaggagccataaaaatagttttccagaatggatttttttttttagataaaaagattatctaccttttgggggtggaatatcttattttgtttttgaatttgtctttgttataaagaagagtaaaacaaagatgtgtaagtgtgagtctgtgtgagctagtttctgatgtctaaacagcaattacctatggagaatacatcattcaaagtaatagcttttgttcaaacatttttaggaagtaataatacatttcttcctggacagttgataaaagttccatccatagcatatttccagaatatccctagatgatgaatttaaacatgccttctcagaaattaaatcttttgactttgaaccacaagttagcatttatttgttgaagagaagaatgtgtggtgatgtcttacctgaatgttggttgttactgatatattacaattttcaaggtgataagcttgagctattaaataataaaaagtattaaagtaaaaaaaaaaaaaaaa

SEQ ID NO: 61541 - DNA, 2932 bp, Homo sapiens
ctggtgcccttaacctccaaagcaggcaacattgtgtgtccaggcctgtggaccagaaacacaggatgttttgtgactgacagagtgatccaaaatggagaaggatgaccccccacagttggtgactcccacatcagtgaaagccatcatcctgaggattgaggctgcccagctaactcgggctcaagaggatatttctacccagctctcagacattttggacaatgtcaattgtgtcatcaaccgcttccaggaagaattaggatatgatttaaaagaaaatgccaaatctcagcagagagatccaaagggcaagaagagattcatcttgctggaaaaaattgcctccttctccaaagatgctatgatgaaggagaagcacctgtatgacattctccgctggctgggtgactggggtgacactctgacctatgagattgggcccaggaagagtgaagaggaagcagcagctctggacgaatggattgaagtgacggagaaagtgttaccgctgtccctcattgccaccaaaagaggcatcgagtcactcactgccctttgctccactctcattgaaggacaaaagaaaaggtcacaagtgtccaaacgcaccttctggcagggctggcagggaagaagcccacagacatctccatcccatcctcagccactaagcccagaacagatgctccaggaccagcataccatgaacacgaaggcctcggaggtgacgtccatgctgcaggagctcctggactctaccatgttcagcaagggggaggtcagggccatcaggtacatggccactgtggtggagaacctcaacaaggccttgatcctccaacacaaggagaacaggagcctggagaccaaatacaggcacctgcaaatgcaggcgaccaaagagctcagcagccagaggctgcacttccagcagttcatggaggtccttgagagcaggagggatgctctgctgaagcaggtagagatcttagggggaaggtaccatgaccttctcctgatgaagcaggccttggagttccagctgaagaaggctcagaatgctacaggtcaggcagaagacctggctgaggtttctgttgactccccaggtccctctgagagagagaccctcccaaggaaagaaacagtcatggaggaaagccaacaggaaccgatgaaggaggagcagttgttctcgccacttcccccaagtcccatggccatgatacgggacagtggtgctatagctgcagggcaccagccactttccaccatgactgtgcgctcgagggtcgcagatgtgttcggcagcaaggacactgagagccttgagcctgtgcttttacccttagtagatcgcaggtttcctaagaaatgggaaagaccggtggcagaaagcttaggccacaaagacaaagaccaggaggactacttccagaagggaggactccaaattaagttccactgtagcaagcagctgtctctagagagctccaggcaggtgacctctgagagccaagaggagccctgggaggaggaattcggccgggagatgcggaggcagctgtggctggaggaggaggagatgtggcagcagcggcagaagaagtgggccctgctggagcaggagcatcaggagaagctgcggcagtggaatctggaagacctggccagggagcaacagcggagatgggtccagctagaaaaggagcaggagagcccacggagagagccagagcagctaggggaggatgtggagaggaggatcttcacacccaccagtcgatggagggacttggagaaggcagagctatcattagtgcctgccccaagccggacccaatctgctcaccaaagcaggaggccacacttgcccatgtctcctagtacccagcagcctgccctgggaaagcagagacctatgagttcagtggagtttacctacagaccacggacccgccgagttcccacaaagcccaagaaatctgcctcctttcctgtcactgggacatccatccgaaggctgacctggccctctttgcagatatcccctgcaaatattaagaagaaggtgtaccacatggacatggaggcccagaggaagaacctgcagctcctgagtgaggagtctgagttgaggctgccccactacctgcgcagcaaagcactggagctcaccaccaccaccatggagctgggcgcgctcaggctgcagtacctgtgccataagtacatcttctatagacgcctccagagcctccggcaagaagcgatcaaccatgtacaaatcatgaaagaaacggaggcttcctacaaggcccagaacctctacatcttcctggaaaacattgaccgcctgcagagtctcaggctgcaggcctggacggacaagcagaaggggctggaggagaagcaccgagagtgcctgagcagcatggtgaccatgttccccaagctccagctggagtggaacgttcacctgaacatccctgaggtcacctcgccaaagccaaagaaatgcaagttgcctgcagcctcaccccggcacatccgccccagtggccccacctacaagcagccctttctgtctaggcaccgggcatgtgtgcccctgcagatggcccgccaacaggggaagcagatggaggctgtctggaagaccgaggtggcctcctccagttacgcaatagaaaaaaagacccctgccagccttccccgggaccagctgaggggacacccagatattccccggctgttgacactggacgtgtagtcctcctgccacaaaagcctgaacttcctgaaggcccagtaaggtgcgaggctgatggtcaatgtggattctccccaataaatctctctccaggctttaaaaaaaaaaaaaaaaaaaaaaaaaaaaaaaaaaaaaaaaaaaaaaaaaaaaaaaaaa

SEQ ID NO: 61542 - DNA, 2797 bp, Homo sapiens
agaggctgttgggaggttgggcctcaggcggtggaccagaaggagcttactcgggccctgacgttgtcaggaggccctgggggatcctgctgaagctgcgatttggcgcagagctgagatgtctgagctctagacacagggacctcagtgtcaaaagatttgggaagatgaattgggtcggggggtcccggtccagggttctgatcaagcaggaaagaagaaagcaaaaggaatattttgaaaaacacaggttaaaatcaaaaatgaaatcactgggagttttatctcctgtcaaaaattctgctgtcagcttagacattcttaacctatatatggtaaatcagatatcttgcaagaagaaaattcctgaaactgtgagaaaaccaacccatgtgaacatgaatagagacataaaaatgcccctaagaaagcataatttagaacttacaatgtcgcctcactgtgtaccttctaaactctgccttgatgatacagaaaccaatgtaaactgtcaaagactaagtagcaaggaagatcttggcccagtccagtcacaaggcatggactcatatagtatgcttcaccctcagttcagcaaaatagagaactgcagtttcactccatcatctttttcagtggagttaccttctaacagacatatttcaaaactaaatttcacatctggaatagcacctactcctcagaaacttgcatatgaaaaaaagcagaatgaccagcgcagtactgttaactgttctgattccttgctttccaaattaaataaaagtcaagatgttttcagtccatcacataaaactacacgatttgggacattatttgaaagattaaacagtctaggaaataggaatttacttactaaaagccctgctgtaattatggatgaagattgtagaagcacggatgaaataagacagtcagactacattactgaaaaacactcaatacagcatatttgggggaaaaatggaaaggaagtttcaaattttcttgaagatgtgaaccagtctactcctaaccttctatcagagaattgtgactcttttgttagtcaaaatatgatcaatgtattaaacatagatgagcaaaggataaagaaaacatttaacaagtgtgattatgatagtatgggagatacttgtgtagtcactagttctgataaaaaccatgtcactgacagatgcattagaaacatttttacagttccagagttgacttttagtaattcgactttgaataaaacaagttatccagaaaaatgtcagccaaacaagaagtatcagagagagtataacaaaaatgaaagaaatgatcttagtacatcttttgagaacgattactacccaagcagctctgaaagaaaagaaaaatttgaaaatgattaccaagagaagacaccacagaaaagtattcagaaatatccagcaaactctatgggaaatataccttcggaagaattgcactctaagcagtcatgggactttggacttgatgagattctgatggaagaaggaggaatatattctttaaaaagcaagcgaatatctactaagaaaatctctcttgattctgcacagagtagtcggtctactagttactctccaagaccaacagacagctgtttcagttctagttcagatttgccatctgaagatgaagatcaaatatcacagcaaattgaagattcaaataggatgaccatcaaaaccaaggaaaaaatgaataatttttatgtagaaaggatggcaaaactttcaggtgacaggattgttaaaaacgatgacaaaattcacaaacagaatgagaatttctaccagttctcagtgaaaaataatacagatcagtttccacagttgcagtgcaattcagcccacattttgcaaaacaaaaccaatgataactgcgttctgcaggctgcaaggtgtgatgcagggatacaaacagagagtgaatctgtaatggaggaaaaattagatgttgccatacagtgtgatctaatttcaaaatgtacatgtagaagtgatgtttctctttgcaaccttgaaaggtgcagtggaaatattaaggcagataccactggagggcaggaaatccataagaacaactaatattctaaaatctctacctaggatgtagaatttcacttgcccttagaaaacaacagtaaatgttgaaaatttcattaacatgataagaaatgagaaaaagtagctaagcataagctgacagtgttcagggtgtatattcacggttcatgttaaaacattttaatattattaatgtatgtatttaatttgtatatagccatttccttaatagctttggtatatggtagagtttttagaaaataatatatttgtaaatgtactagcgtttttatgtgattattcagtatattacaatgatgcgctgttatttatgggttaaaatatgcttaattgcttccttccttgtagcatttattttaatattctttgcagttgcattttctggcaaaaatgttccctttcaagatatttaagatagaaaataatacctaatatattttatgtcctcattataataattttgttagctacttctctttaatattacagtcctatttaaaaattctagcattaatttgtagataacacatatcttctatttgcataacatagtttttttgttggtgctattaattcaaaggaaaatgttctgtaggattaaaagatgttttaatgtttttataaaataattgtttgaaattaaaaaatgatttatgttactaaaaaaaaaa

SEQ ID NO: 61543 - DNA, 714 bp, Homo sapiens
ggcctggagctatctccatcttcagctccagagtccttggtttctgtctgagaacaaatggcacagcatccctgccaggatcaggaacaaaaggtagaaatgacctccaagcagcagagaagcacatccatagaagagacaatgagaccacaggaaaaacaggtaaccatcactgaaaccctgtgggaccaggtgctgacagtttttaaggatatacaaaaggagctgcaggaagatgctcggattcgagggatgagcaactgctccatgacacccatgacatcagcacccaggactggaagcataaggcctccagattccttgatgaccccaaagttgagaagattgcagttcagctctggagagcagccatcaggaggccgtatccacaacctgaagacacagctcttcagtcaatcagcttactaccctggaccctaactctacaatcaaggaagaaggacatctctgcttccgccagcacagcttcagttggggaagatattagcagacatcatcactgaacccagaagagagggtggtgcccatgagtggagatgccagggtctatggctgaaactgggaacttggaaatcaagtgagacccaagcaaggaaaccaactgccaaagcaaggaaaccagcttggtttggcaaacagctgatgaaataaatgtgacgtagaaaaaaaaaaaaaaaaaaaaaaaaaaaaaaa

SEQ ID NO: 61544 - DNA, 1583 bp, Homo sapiens
atggccagccccttgccgtccggcttccccgcgcgcaggaacagccgcctggatgtgttcctgcggcggcatctgccgcccgaggtctacgacgcggtccgcgcctacgagccatgcatcgtggtgtccaactctgagaaccacatcctcaagtatgtggtgctaagcgaccggctcgtctacctaaccgagaacccgcccaagtccatccggcgggtagtggctctgcgggacgtcgtggccattgacctgattgatgattacccggaatttttgagttcgccagatagagaaatcagccaacacattcgtatcatctattcttcaaccgttttgaaaaaagagtgtaaaaagtcaaacagtgtcaggaaattcctatttccatttcatcatactaaagctaacaacaagaaagtcaaggaagaaaagaacggccttgccttttggagaagcaaagagtccagaagtctgaaagaatctcctctcaggtctgaggagaaaattaagcacttcagtcaacttaaatctgaactttttcttaaagacaattctttgaggaggatactttctttacttatggaacttaaagtagcagcccagaaaaacttcattctgaaaaggcttttctggaagaccagtgaccttttctatttcatagtaaacaaacttcatgagtacttgccggagtctagggataagaatgcactacaaaatcaaagccaaagggttgatgagctggtggcatgcattgaaattatacagaccctagtattgatgttcagagaaacagaaaccgagtcatcacgcctgaacacattggcagctaagaagggagcactatttaatctcttggtaattttaattagtgagcctcagattccaaaatcttgtcctgtgtttgatatccagttggtggctgattcagctttagtcagaatgtcttttgacgctgagttacagaagcttattctggagtatacaaatactgctacagcacttttatatgagatacttctggtctttcagcagggaaatctcggattgggatccacaaagtttgctattagctggataatgtcctttctacaaagctgtcctcccatcattacttttgtggccagtattgtgaaacaagtggtgaggggtctttcagcttcatttcagctgctaagtccctgccaagcagttctgttgtaccagcaattttacatcctcaagagctgtctgcggcacagcaggactctagctgagtatattaggaataactacagagaagaattcaggtactttattcacatgccagccttgcagaaaaggctcccattgtgttaccccatcactcaacctaccattcaactttttcatgaagttctgaaattggttgaatagaaacaaacaatgtacgcaatgttaataagagtataaaatgttaatcaagagtcaacttgatattcacgagaaacatttttttatttgtttaatatctggctatctctgagtcctataaacaaagattttaattgaatgttccatcaatacctctctatgagaagtttaaaattttaaaaaataaatttgattta

SEQ ID NO: 61545 - DNA, 1583 bp, Homo sapiens
atggccagccccttgccgtccggcttccccgcgcgcaggaacagccgcctggatgtgttcctgcggcggcatctgccgcccgaggtctacgacgcggtccgcgcctacgagccatgcatcgtggtgtccaactctgagaaccacatcctcaagtatgtggtgctaagcgaccggctcgtctacctaaccgagaacccgcccaagtccatccggcgggtagtggctctgcgggacgtcgtggccattgacctgattgatgattacccggaatttttgagttcgccagatagagaaatcagccaacacattcgtatcatctattcttcaaccgttttgaaaaaagagtgtaaaaagtcaaacagtgtcaggaaattcctatttccatttcatcatactaaagctaacaacaagaaagtcaaggaagaaaagaacggccttgccttttggagaagcaaagagtccagaagtctgaaagaatctcctctcaggtctgaggagaaaattaagcacttcagtcaacttaaatctgaactttttcttaaagacaattctttgaggaggatactttctttacttatggaacttaaagtagcagcccagaaaaacttcattctgaaaaggcttttctggaagaccagtgaccttttctatttcatagtaaacaaacttcatgagtacttgccggagtctagggataagaatgcactacaaaatcaaagccaaagggttgatgagctggtggcatgcattgaaattatacagaccctagtattgatgttcagagaaacagaaaccgagtcatcacgcctgaacacattggcagctaagaagggagcactatttaatctcttggtaattttaattagtgagcctcagattccaaaatcttgtcctgtgtttgatatccagttggtggctgattcagctttagtcagaatgtcttttgacgctgagttacagaagcttattctggagtatacaaatactgctacagcacttttatatgagatacttcttgtctttcagcagggaaatctcggattgggatccacaaagtttgctattagctggataatgtcctttctacaaagctgtcctcccatcattacttttgtggccagtattgtgaaacaagtggtgaggggtctttcagcttcatttcagctgctaagtccctgccaagcagttctgttgtaccagcaattttacatcctcaagagctgtctgcggcacagcaggactctagctgagtatattaggaataactacagagaagaattcaggtactttattcacatgccagccttgcagaaaaggctcccattgtgttaccccatcactcaacctaccattcaactttttcatgaagttctgaaattggttgaatagaaacaaacaatgtacgcaatgttaataagagtataaaatgttaatcaagagtcaacttgatattcacgagaaacatttttttatttgtttaatatctggctatctctgagtcctataaacaaagattttaattgaatgttccatcaatacctctctatgagaagtttaaaattttaaaaaataaatttgattta

SEQ ID NO: 61546 - DNA, 753 bp, Homo sapiens
atggacatgctccaggaccttgagtccctgcagtttgagtatggggttccagaggaagatcgtatctggctgtatttgcagggccgttctcggggactgatgatcgaggcttgtgcccatgcaaccttcttctgcaaactattatataatttgagagcatcattaaataagaatcaaagttccagacatctctcaattggctcccttaattcagccactcctgaagagtttaaggtgggcatcattggaggtggccaccttgggaagcagctggctggcacactgctgcagcttggccccatccctgctgaaagcctgcggatctccactcggaggccagagactctgggtgagctccagaagctgggaatcaaatgcttttaccataacgctgatctggtgagttgggccgatgtgatattcctctgctgcttgccgtctcagctgcctaatatctgcgtagaaatttacaccagccttgagaaggccagcattgtgtacagctttgtagctgccatcccactacccaggctgaaactactgttgaaccacaccaatatcttgcggcctcagtatcagtatgatgaagattctgtcagcgtctggggggccaataagggagtcatagctgctctccaagatcctacgattcttcaagctacctgtccctacagtcctgctggtcacggctcaacatatttctggcattcttttgaaaattactttcctgttggcccattgctatcttattaa

SEQ ID NO: 61547 - DNA, 3006 bp, Homo sapiens
cgcttactgaataaggtgggatccaacaagagtgtagtatggaatgcaatagcttatgaattactttttttctgagggagctcaacagaatgacacctaagaaagggaaagtctttgacacttggtacgtttgtgatttttggtcattacttgaaaattaataagtttgaaatcactactcttagaaatggaagaaagtgatgactctaatcagcctatctcagcgtgtaggcaagaaattcgaaagagaagatgacccagcaaaccaatggtaggcaaatcccagcaaactgatgtaatagagaaaaagaaacacatggccataccaaaatcatctagccccaaagctacccatcgtattggtaatacttctggaagcaaaggcagctactctgccaaagcctatgagtctattagagtatcttctgagcttcagcaaacttggacaaagagaaagcatggacaggaaatgactagtaagtctctccagacagacaccattgtagaagagaaaaaagaagtcaagttagttgaggaaaccgtggtacctgaagaaaagtcagctgatgttagagaagctgctattgaattgccagagagtgttcaggatgtagaaattccaccaaacataccttcagttcaactaaaaatggacagatctcagcagaccagccgtacaggatactggaccatgatgaacatcccccctgtagaaaaagtggacaaggaacaacagacatactttagtgaatcagaaatagtggttatttccaggccagatagttcttctacaaagtcaaaggaagatgccctgaaacataaatcgtcgggaaagatttttgctagtgaacaacctgaatttcaaccagcaacaaacagcaatgaagaaattgggcagaaaaatatcagcagaacttcatttactcaggagactaaaaaaggtcccccggtacttttagaagatgagcttagggaagaagtaactgtacctgttgtacaagaaggttctgctgttaaaaaagtggcttctgctgaaatagagcctccatcaacagaaaaattcccagctaaaatacagcctccattagttgaagaggccactgctaaagcggagcccagacctgctgaagagacccatgtccaagtacagccatcaactgaagagactcctgatgctgaggcagccactgcagttgcggagaattctgttaaagttcagcctccacctgctgaagaggcccctttagtggagtttcctgctgaaattcagcctccatcagctgaagagtctccttctgtagagcttctggctgaaattctgcctccatcagctgaagagtccctttcagaagagcctcctgctgaaattctgcctccaccagctgaaaagtctccttcagtagagcctcttggtgaaattcggtctccctcagcacaaaaggctcccattgaagtacagcctttaccagctgagggcgcccttgaagaggcctcagctaaagtagagcctcccactgttgaagagacccttgctgatgttcagcctctattacctgaagaggctcctagagaagaggctcgagaacttcagctttcaacagctatggagacccctgcagaagaggctcctactgaatttcagtctccattacctaaagagaccactgcagaagaggcctctgctgaaattcagcttctagcagctacggagcctcctgcagatgaaactcctgccgaagctcggtctccactatctgaggagacttctgcagaagaggctcatgctgaagttcaatctccattagctgaagagaccactgcagaagaggcctctgctgaaattcagcttctagcagctatagaggctcctgcagatgaaactcctgctgaagctcagtctccactatctgaggagacttctgcagaagaggctcctgctgaagttcagtctccatcagctaagggagtttctatagaagaggcccctcttgagcttcagcctccatcaggtgaagagaccactgcagaagaggcctctgctgcaattcagcttctagcagctacagaggcttctgcagaagaggctcctgctgaagttcagcctccaccagctgaggaggcccccgctgaagttcagcctccaccagctgaggaggcccccgctgaagttcagcctccaccagctgaggagacccccgctgaagttcagcctccaccagctgaggaggcccccgctgaagttcagcctccaccagctgaggaggcccccgctgaagttcagcctccaccagctgaggaggcccctgctgaagttcagtctctaccagctgaggagactcctatagaagagacccttgctgcagtacactctcccccagctgatgatgtccctgcagaagaggcctccgttgacaaacattccccaccagctgatttgcttctgactgaggagtttcctataggagaggcctctgctgaagtttcacctccaccatctgaacaaacccctgaagatgaggctctggtagagaatgtgtctacagaatttcagtcaccgcaggtggcaggaattccagcagtaaaattaggatcggttgttttggaaggtgaagcaaaatttgaagaggtttcaaaaatcaattctgtccttaaagatttgtctaataccaatgatggacaggctcccactcttgaaatagaaagtgtttttcatatagaattaaaacaacgtcctcctgaactgtagtcaggttgtacctaagctagcaatcagaagctacatggttttggaagaacatactttagaaaagggtgggcagcgggaagtagctttgtcaataaggcaaattaaaggggaccccaagacttggaatacaggttggaaaatgaacaataaaaactgtagcagcataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 61548 - DNA, 1191 bp, Homo sapiens
gggccctagcaaccagagcagtgacagtagcaaccgccggaatggcgaaagcaacaacaatcaaagaagccttagcgagatgggaagagaaaactggccagaggccatctgaagccaaagagataaaactttatgcccagattccccctatagagaagatggatgcatccttgtccatgcttgctaattgcgagaagctttcactgtctacaaactgcattgaaaaaattgccaacctgaatggcttaaaaaacttgaggatattatctttaggaagaaacaacataaagaacttaaatggactggaggcagtaggggacacattagaagaactgtggatctcctacaattttattgagaagttgaaagggatccacataatgaagaaattgaagattctctacatgtctaataacctggtaaaagactgggctgagtttgtgaagctggcagaactgccatgcctcgaagacctggtgtttgtaggcaatcccttggaagagaaacattctgctgagaataactggattgaagaagcaaccaagagagtgcccaaactgaaaaagctggatggtactccagtaattaaaggggatgaggaagaagacaactaatgccacgctttccactgtgtgttaacttatttaaatgtcataagaacaatagataaattttatataattgtctattttaaagattctgtatgggacaaaagtttcttaagataaaacagatcactcattctcatctttttttttcctttaacttattcagtgtttctccccaaaactggtaatgccaaccttatatatcgtatttctctttttagaaaccacaaattttcgatttttgtcttcagtctcagttacgtactgtgtagccccatctactaaaacaaaacctttgtagaccagtcatttttaataacaaaggaacaaatgtttttttcagtttgttcatttttttttaggttagacattttaaaagatgtacatttgaaaattcagaacatttttcctgaaggtctgtctctgtacaattcagaagcacatgcctttagctcagaaggcagcatggtgatgggaagagttcctcttagaaatacagcaggtccggaaccaagactccaaagttccattggaaaagatatggtgaaaaaaggaaaaaaaaaaaaaaaaaaaaaaaaaaaaa

SEQ ID NO: 61549 - DNA, 2746 bp, Homo sapiens
agttaggatccgctgtggcgtcctgagtggagtttgggaccccagggagggagggtgtgggcgttcgggtccagaggagctgtttagtatccaagatgaatgacagcctgtttgtcagtttggacagacttttgctagaatttgtcttccagtatgagcaagacataagtactaaagaagagatgattcaaagaattaataaatgctgtgaagatattaaggaaaacaaagtaactatttgtaggatacacgaaactataaatgcaacagatgaggaaattgatcattactgtaaacatagtgaggagattaaagacaactgtagaaactggaagccaacatgtgatgtttttcgtaaacatgaagattatatgcaggaccaatttactgtttatcaaggaactgttgaaaaagacaaagaaatgtatcatgattatatatgtcagtataaagaagttttgaagcagtaccaactaaaatactcagaaacacccttttcacgtgaatattatgagaagaaaagagaacatgaagaaattcaaagcagagtgttggcatgtactgaacaattaaaaatgaatgaaacaatttttatgaaatttcgagtgcctgctccctttccatcacttactaaatggactttaaacattgttaatttgagatgtgaaacacaagatattcttaaacatgccagcaatcttaccaaaagttcatccgaattgaagaaagaagtagatgaaatggaaatagaaattaattatttaaaccagcagatatctaggcataatgaaactaaggctctttcagaaactctggaagaaaagaacaaaaatacagaaaacagaaaagaactgaaagaaagaatttttggaaaagatgagcatgtacttacattgaataaaactcaaagcagtcaattatttcttccttatgaatctcagaaattagtaagaccaataaagatgcattcttcagaaccaagagttgcagatataaaagaagaaagttctgtgaagcagtcaaagcttgccaatattgactttagacaaaaagaaaatgatacacagatatttaatgactctgctgtggataaccattcaaaatgttcacatattacgactatcacaagttcacaaaagtttatgcaagtcagattgttaaccccacagaaacaatcaaattccaatcagtggtcggaaaaaggggataaagatgctgagtatggagataaagggacagtaagacaagtaagagaatcaaaatgtacttcacaagctatatatactgaacattttgggaagtcaatagaaaatgatagtgatgaagtagaagagagagctgagaattttccacgaacgtctgaaattcctatatttttaggaactcccaaagctgtgaaagcacctgagtcattggagaaaataaaattccctaaaacccccccgttcgaaattaacagaaatagaaatgcagtacctgaagttcaaacagaaaaggaatcccctggactttcttttcttatgagttatacttctagatcacctggattgaatttatttgattcttctgtatttgatacagaaatctcatcagatcagtttaatgaacattattctgcaagaaatctaaatcctctgtcatcagagcaagagattggaaacttatttgagaagccagaaggagaagatggctttacattttcttttccatcagacacttcaactcatacatttggagctggaaaagatgattttagttttccattttcatttggacagggtcaaaattcaataccttcttcttctttaaaaggtttttcatcttcctcacaaaatacaacacagtttacttttttttgagctagtcattaattccttaaattattttactgttctgtgttcatgagggcataaatttacattattgcttaaaacatgaagactgctttcttttattgataaagcagtaatgtttacattatttgattatatttattgaaatattgaaatactgaatattttgggttttgtgtgtgctattaactaatcattatttattttggttttgattttgcgagccgtggtcaggtagaacttttattaatcttaatagaatttgatgcttttttcattactctttatttaaatattaagcctgcttctccttggaacctaaggtttttttctggaagtattgttggtactttgataagaacaagaactgcagtagtaactccagagttagtgctgaagcgtactttagctactaaaaatttctattaaaattattgggtttcacttctgcttcactatgtagtatacagagtggtactgtaataataatttcaaataatttatgttaataacaaaatctgtgttattttcttctaatataacacatggtacaattctaattttatgagttatgctaatgctttcaatggctaaaaattaaatgtaaagggcaagagtaatttctgaaaattggattgttgtatcagtggtgatcctgttaatattcttttttgcttaaatattttttgaagaacatttacaattttgtctccttcaataacaaaaatttcttctttatgttttgtgttcagtatttgtcaattaattatatagcttaagtgaagatatttaagatttgatgaacttctgtaaacattttgctcaatatcattgtattttgtgctttgtaaattagctgtactgagttaccaagtaataaagggtttgactcc

SEQ ID NO: 61550 - DNA, 1290 bp, Homo sapiens
gagtcagctaggccccttcctcctccagtgcctgtctacctatgtttgatgcttggggctagaaagactgaccttgtagcccctcaccttctctccccaatgcactgggctgttcagcagctgaccaatgagggtcatgcttgcatactggccttgggtgagtggctcaggaacagtttgcaagaccgtgttgaagctacttgtaactagaccattttcccagcttgaccatgagcttcttcaaggcatctcttctcagtctccactgtagctctgtggggatgctaaccctggcttccaaggatctgaagaggaagctgcggctgtgactgtcccttttcggtctgtcttcatcctgcctggctcacgggtctcctgtcctcctgcatagcttgcggtggtgaggtgatggcagccatggacacaggccagagagctgacccaagcaatcctggtgacaaggaaggggaccttcaagggctgtggcaggaactctaccagctccaggctaagcagaagaagctcaagagagaagtcgagaagcacaagctttttgaagactatctgattaaggtccttgagaaaatccccgagggctgcacgggatgggaggagccggaggaggtgctggtggaggccacggtgaagcactacgggaagctcttcacagccagccaggacacgcagaagcgcctcgaggccttctgccagatgatccaggctgtccaccggagcctggagtctctggaggaggaccacagggctctcatagcctcaagatccggctgtgtcagctgcagaagaagtgctaccgcaagcaggagcagtggtggcagctgaagcacagcatcacttaccagaaggacattgactttgacacacacaccagcagcagctataatgatcagctgctcggctacatgcaaatgaccatcaccaacatggcccggcagtgctgcccctctgcccacggcgtgcccaagagcatggatctcttctccaagctcgatctgattaaggagttcatgttggacaaaatggagactgtaagactgatcgcactgctcacggaacccaaagtgtgctggtcatgggacagcttcggggaccagtggctcagaagacaccccaaacccttcaggaaatgtccaaggaggcgggtttccacccccaggaccccctttcccagcccccatgcttcagagtgctccggcctgtactgaccagcctgcgccttgcaggccccatggcatcacgacctctccttacctgccaaaaaaaaaaaaaaaa

SEQ ID NO: 61551 - DNA, 1405 bp, Homo sapiens
agcgacgccccgccccgctccgcgccccgggcagccgtgtgcaggcgcctgcgggcggtatcctcggcgacgccgtatggctgccagggcgaggccatgtaccgggtgcccgagttttatgcgaggaggaagcggttaggtgggcagaccccttacttgatggatcagttgggattacgattagggatgtggtactggaaagatgaaaccagaactcttgaattcagaaggtttgccgcagaagattctgtccagtggctcctgaaacatcaccctcattttacacctgcagcagaagtcaaggaaaaaggaaagaaaggcaaagcagttcactttgcagaaactgatggtccagcttcagacaggttgacagataaaagacttgctgcaaaagatgataagtcagctaaagctgtagagaaacgaggtcaacagggcaccattacactggatgatgttaaatttgttactttgcttttgctacaagatactgagatgcagcggatctgttcttttacaacatttatgaggaataagaatcttgataatttcctcatggcattattgtactacttatcccattacttggaaaaaaactcactggaaaagaaacccaaaagctatatggtaggccttgtagagaaaaaagaaatggaattggttttaagtgaattagaagcagcacagaggtacttggcgcagaagtactgtatccttgtgctgggcttggccgtgccggataagcatcacatgtgctgtggaaaggagaaaatatcagatacacagaaagactggaagttctttgagtccttttatactttctgtacatatgtggcttggattgtcttccgacgtcaacacttgacagagattgaagaagaagtagggagactctttcgtaccaatatgttcaacattcctcgcaggaggcgtgaagatgaggaatcaggaggggaaaagaaacgcatgacttttgttcagttcaggagaatgatggcaaaacgcccagcaattaaaaaagctatcaacatgcgttctccagtcatgtctactctgctgccatctctcagagaaaaagctcaaaacgtctttgagaaaaagtatcatcaagtagacgtcagattcccagccgagatgcaaaagcatgtgggaactctggactctgtgcccatgccggtagttggcatcttgggggagcctcgatgtctattcaacccacatacgcttcacccccttgatccagaagaaaacacaaaatcatttgggagatatccttccttgatggaaaacaataacatgaggattcaggatacactggacttggtcatgaaaacactgtcctctcatacatcatgccctaagtaacctggtacattccatatctcaagtaaactactttgacttt

SEQ ID NO: 61552 - DNA, 1337 bp, Homo sapiens
actggcttggcgacgccatgtttcaagggcagcgcggttggttttgcggcagcgttagccaggatctgaggcaattctgggtggctgaagggggaacgatcagtgacccgcgagccgccgacttcttgttcagctgtgatgcctcgcacccagacacgctgagaatatatcagagccttgattacatagaagataatgctacagtttttcatgcctactatctctctgcggtagctaatgccaaaataaaaaactcggtggctttgggtcatttcattcttcctcctgcgtgcctgcaaaaagaaataagaagaaaaattggtagttttatttgggaacaagaccaacattttctgatagaaaagcatgatgaagtaacaccaaatgaaataaagacccttagggaaaacagtgaactagcaacagagcacaaaaaagaattatccaaaagcccagaaaagcattttataagaactccagttgtagaaaagcagatgtacttccctctacagaattacccagttaacaacatggtaacaggttatatatcaattgatgccatgaagaaattccttggggagctacatgacttcattcctggaacctcaggatatttggcatatcatgttcaaaatgaaattaatatgtctgctataaaaaacaaattgaagaggaaatagtaaattaaattgtaaataccttggcatttattttctataaaatattatacagatgtgcatatcataaaatgctcccttttggtactgggggatagtgaaatgggaaataatttttctgtttctcaaagtatatctttaggaaatacagaatcattttggttctgtgttttgacatttttcccctagcttataacaacatgttcaaatattctcaatgcacagttgttaatgagtaattgccgttaaaatatatttcataagaagtctcaatctcaaactctccatctctcaatcctcctcctcctcctctttcttgctttctcttttccctctctctttctctcctccccttctctctttctgtctttcaaatgttcttttggctttaacattctattaattatattttttctagattgaatactgtgaatgctaagttttattaatctggtcatcttattttgattttaaaaattaggatgctagttgcattctgaattactgtttctggtttgaaacatggagaaaaacattttaataattcatatttcatgttggatggtttctaataataaatatctcaaaagtgacttaaaaaaaaaaaaaaaaaaaaaaaaaaaaaaaaaaaaaaaaaaaaaaggaaaaaaaaaaaaaaaa

SEQ ID NO: 61553 - DNA, 2916 bp, Homo sapiens
agcggagatggctaacagctagagcaggctgtcctcggagggagacattccatctccagacacccagagacgctccagaatggaggtcctgagggagaaggtggaggaggaggaggaggccgagcgggaggaggcggccgagtgggctgaatgggcgaggatggagaaaatgatgaggccagttgaggtgcggaaggaggaaatcaccttaaagcaggagacgctcagagacctggagaagaagctgtcagagatccagatcactgtctcagcggagctcccggcctttaccaaggacactattgacatctccaagctgcccatttcctacaaaaccaacacacccaaggaggaacacctgctgcaggtggcagacaacttctcccgccagtacagccatctgtgcccggaccgcgtgcccctcttcctgcaccccctgaacgagtgtgaagtgcccaagttcgtgagcacaaccctccggcccacactgatgccctaccccgagctctacaactgggacagctgtgcccagtttgtctccgacttcctcaccatggtgcccctgcctgaccctctcaagccgccctcgcacctgtactcctcgaccactgtgctcaagtaccagaaggggaactcctttgacttcagtacgctgctctgctccatgcttatcggctctggctatgatgcttactgcgtcaacggctacggctcgctggacctgtgccacatggacctgacgcgggaggtgtgcccactcactgtgaagcccaaggagaccatcaagaaggaggaaaaggtgctgcctaagaagtataccatcaaaccccccagggacctgtgcagcaggtttgagcaggagcaagaggtgaagaagcagcaggagatcagagcccaggagaagaagcggctgagggaggaggaggagcgcctcatggaagcggagaaggcaaagccggatgccctgcacggcctgcgggtgcactcctgggtccttgtgctatcggggaagcgcgaggtgcctgagaacttcttcatcgacccattcacaggacatagctacagcacccaggatgagcacttcctgggcatcgaaagcctgtggaaccacaagaactactggatcaacatgcaggattgctggaactgctgcaaggacttgatctttgacctgggtgaccctgtgagatgggagtacatgctcctggggactgataagtctcagctgtccttgactgaagaagacgacagtgggataaacgatgaggatgatgtggaaaatctgggcaaggaggatgaggataagagcttcgacatgccccactcgtgggtggagcagattgagatctccccggaagcatttgagacccgctgcctgaacgggaagaaggtgattcagtacaagagggcaaagctggagaagtgggccccgtacctcaatagcaatggccttgtgagccgcctcaccacctatgaggacttgcagtgtaccaatattttggagataaaggagtggtaccagaaccgggaagacatgctggagctgaaacacataaacaagaccacagacctgaagacagactacttcaagcctggccacccccaggctctgcgcgtgcactcgtacaagtccatgcaacatgagatggaccgtgtcattgagttttatgaaacggcccgtgtggatggcctgatgaagcgggaggagacacccaggacaatgacagagtactatcaaggacgcccagacttcctctcctaccgccatgccagcttcggaccccgagtcaagaagctcactctgagcagtgcagagtcaaacccccggcccattgtgaaaatcacagagcggttcttccgcaacccagcgaagcccgcggaggaggacgtggcagagcgcgtgtttctggtcgcggaggagcgcatccagctgcgctaccactgccgtgaggaccacatcacggcctccaagcgcgagttcctgcggcgcaccgaggtggacagcaaaggcaacaagatcatcatgacgcccgacatgtgcatcagcttcgaggtggagcccatggagcacaccaagaagctgctctaccagtacgaggccatgatgcacctgaagagggaggagaagctgtccagacatcaggtctgggagtcagagctggaggtgctggagattctgaagcttcgagaggaagaggaggcggcgcacacactgaccatctccatctatgacaccaagcggaatgagaagagcaaggaatatcgggaggccatggagcgcatgatgcacgaagagcacctgcggcaggtggagacccagctggactacctggccccattcctggcccagctcccgccaggagagaaactaacatgctggcaggcggtgcgcctcaaggatgagtgcctcagcgacttcaagcagcggctcatcaacaaggccaacctcatccaggcccgctttgagaaggagacccaggagctgcaaaagaagcagcagtggtaccaggagaaccaggtgacgctgacacccgaggatgaagacctgtacctgagttactgctctcaggccatgttccgcatccgcatcctggagcagcgcctcaatcgacacaaggaactggccccactgaagtacctggctctggaggaaaagctctacaaggacccacgcctgggggagctccagaaaatattcgcttgatgtccctcctggggcctccgccagagctgccagagaaaggaaacctcttcccgcagcctggctcctgtgttccctctatccagccaatgcctgtttacacagacacctggcctcactgccagcccacctcccctacagccctgtttgttcctgcttctcatgattttcctgtaaataaacacactcttaatttgccaaaaaaaaaaaaaaaa

SEQ ID NO: 61554 - DNA, 1284 bp, Homo sapiens
agcgcccaccagtccctcagccaaagagcacactggaggcggagaggcagcatccatcagcccgctccccgcctccaggacagagcctcggtctgcatgggggtgacaggtgcccatggatttccatgctgcggcaaagggtcagtggaggttgcagagatgcgagatgacttaagtcaacaccagatacaagaggaacaggagctggaggcagacatgctagagcagaagccccaactccaagtggacctggacctggacccagacccagacccagacccagaactggagatcggacaggtgccggctttactggagtcagagctatacccagccctcaagcttgaagctgagctggacacggaagccaactcgaacgaggagtctgactttgaagaacccatgcagctggtatgcaagatagagtccgcccactccaacatggggctgcccacgccacagaccttcagaccgtggagtctgaattcaaactgccggagtttcacggaggagaaccacgtgtctgcctgccatcactccatcagtgcgcagacctccaagcacctcttctgggcaaacaagctcatccaggcctcagagcacagcctgcagcgggccatcaacatgcagctcaacaatggcagcgcaggccagcccatcagatccccgctccgggaggccatccccaccaacgccctgtgctccgaggagcagctccagatccctgatgcccactcagctcctccaaccacaagctcccaggcaccaagccccctcctgtcctcagatctcccgccacccattgacctgacagagctaatcacctttgcatcttccctggccatggcctcctccagcaggatggacctgcccagtttggaacacatgatgaaagctccaccccaggaggctctggagccttccacagagcccctcctgaccactgtggaggagcgagagccagaaaatcacgcagagaccctgccagagaaaccacgcgaagccagagcaccactgaaatcttggagtcaggaagacaagaacttcgctcaatcttactttgacttcagcaagccggggatcaagagggccaccatcaaagggcaaatccagcttctccagtcaccagccacgtcccctctgctgcagggaagcaaggaagactcagtgccgccaggaaaagagaaagagaatccattattggtgaaaatccattttaagctgtcagcccccacaatcccagagaaatgactagacagaaccaataaagcctccagtgctggc

SEQ ID NO: 61555 - DNA, 1031 bp, Homo sapiens
ggggaaagcagggcacagccttgggaagaatggataagcatggtgtgaagacccccttgtggaagaaggaaacggaagagctccgggccgaggacgcggagcaagaggaagggaaggaggggtcggaggacgaggacgaggacaaccagaggccgctggaggacagcgcgacggagggcgaggagccgccgcgggtagcggaggagggcgaaggccgcgagcggcgctcagtgtcctactgcccgctgcgccaggagtccagcacccagcaggtggcgctgctgcggcgcgcggacagcggcttctggggctggctcggccccttagcgctgctgggcggcctaacagctcccaccgacaggaagcggagcctcccggaggagccgtgcgtgctggagatccggcgacgaccgccgcgccgcgggggctgtgcttgctgcgagctcctcttctgcaagaaatgcaggagtctgcacagccacccagcctatgtggcgcactgcgttctggatcacccggatctgggtaaggcggggggccgctgggaactcctgagcgcccccgctcccagcctttgtgccctccatcatttcctggccccagaccccctaccgaccttctctcttggagcgcggagccctcttcgacgcattccgcaggaccgccccttctcagctgctgcccagagcgcccccatccatcaagaaggcccactgttggtgcttggttcccatctgtcacctagcgcccccagtgcagagcccagcataacctagagcccgctgtcaacagcgcccaccgagggctccccgcccccacgcagcaccagcgccaccgcacacctgactctgtccgctcacacagcctcaccttcacctcttgggtatttcagatccgctctggcccagtgggcagaggcatcgcctagagaaaataacctcagggttccctcatccctctgacaaacctgcctctttccctgaaaccattcaataaaacctctgatcaaagtgccaaaaaaaaaaaaaaaa

SEQ ID NO: 61556 - DNA, 1969 bp, Homo sapiens
acttggaagcttctacctccagaagtccagacacctcccctgtacctctcgtaccacagaggacaggtctcctccagctgtgcccccactcccctaaaagccttgtattcccccctgcaggttccctctggccccaccaggagaagaagatggcctatgaaaaatcaactgatatctctgatgtctccaggtcaatgttcctgtacccatggctggaatatccagacaagaccaaagaactcagaaaagccatggctcctgttcatctgcccttgtcctgctaccagatgccaaaggaagagtttcccccaagtccagagtgctggaggcagcatccgagcaagccaaactcagtcccgtactgctacttcaagaaacctgagatctacacgcactggcacgacctgtatgatcagcgagaggaaagggaggctgagaagatgttgaggaaaatgagagatgactgtaggtacatcaaagaggtacatcaaacccacatcaaaatgttccatctcccaatgagcaagctgactataaaatctgagatgcgatccaggcccttagagcctacccaggaccccctgaagtggcaaagattaagggaactcacaaaaagcctggaatctcccagagaggatgagcagttctatgcagcacaggctctgggatgcttacgcatcagtgacaagtttgtcatggaggcactacagcaggtggcccaaactggtccagagaaagtgaagtacgaggcctaccgaaccctggccatcctgggttgcctgaataagcatgtgatccgggctctcatcaaacagctgaaggagaaaaatgagggtcaaaggatggagactttgacggggctacgaatggctcttaactcctgggctgctgtctctaaagacaagaggactcaagtcggggatgagggcaagctggtgcctgtactacagacactgatcaagaagtcgtccagtgaagcatctctggaggcagccctgtgcctgggtttcctgaggccttgcagcaacatggtccaagagttcttgttgcagtgcctgtgccaaggactcaagacccagcggatgaaggcacttaggatgctggtcaaggtgatgcacgtgcactcagccccagtcatcaaggccatcctagaccagctgtgttcttccagtgtccttgaggaccgctttgaagccacccaaatgctcaagaccattgggctggaacagatccaggcacaggggctagaggaactcacatttaacctgctcaggaggaagacgcataatgaacccttccttgctgtgaggcaggctgtggctcaaactgtggaagagctcaagttgaagcctacgatgatgaacttggtggaggcacaactgatgaacccagatgccactgcacgccaggaagcagtcatctctttgggtgtcctggggatccgcagtccacaagtgttccacttgctcctggacttactagatgcagaaaaccaccaggctgtgaagaagagtctacaagaaacattaatcctttgtgcctcaattgatccctggatccaaaacaagctgaaaaacaaggttctctctgtatatgaggcacctaagaccaatgtgaaggcagagcccacaaggttccagaaagagcctgagaacccagaagagttaactattcaagactttcgacttgcaaagctgaaccccttgtttattgcaaagtccatcaccaaagtaggccaaaagaaaacgcctgctttcccaccgtgctgctcgaaaccacgaaaacataggccacaggtcatagggccctggcagccaaggatcaagaaacagctccgggtccttgctgaaattgccaaataagtcaattctttgggcctactccccgactccctccctgaagatgcttctcaggctcccatgagaaaacaatctatacttatcttccgtgaataaacaagtgtcactct

SEQ ID NO: 61557 - DNA, 1662 bp, Homo sapiens
agtgcagtgtgggttggggccgggggtggggggcagaggggggtggcccaggtggccctaggaccccccctccatggaaaaccagctatggcataacaccgtgagatgttgcaatcaataccaagaaagcccccacgatgccgaggacatcttactcctgctgctgggcctcatcgttcttgtcaacattggcatcaacgtggcaactatgatgtggcatggactccagaacgccttagacaagatgattgattgggctactcagaaaaatgaaattcaggccagtgaaagtcccccaagtggtcccccagacaaggctcaggatgtccacatccactgcatcctggaccctgtgcaggtgaagatgtcccgacccacgcagtactcctctttctcctgccaccatttctccaaccatcacagtagcagtcttcttcgctgtgttcgtcgccgccgccgccgccaccgccgttgtcgccgtcgctgctgcaaccaccagcagcggccgcagaactacagacaaatcccccatagccactcagtcttccgtaacccacatcgcagccaaaagatgtcacaactacaccgagtgcctttctttgatcaggaggacccggattcctacctggaggaggaggacaacctgcccttcccgtatcccaagtacccacgtcgcggctggggcgggttttatcagagagcgggcctgccctccaatgtggggctgtggggccaccagggtggtatcctggccagtctgccaccaccctctctctacctgtcacctgagctgcgctgcatgcccaagcgtgtagaggccaggtctgagctgaggctgcagtcctatgggcgccacggttcccaatcccgactgtggggcaatgtggaggctgagcagtgggcctcgtctccaccacctccccaccggctgccccctaacccctcttgggtccccgtggggcacagcccttacccctcagtgggctggatgctgtatgactcctgggatcagcggcgtcgtggcacggagggctttgagcgcccccctgcctcggtgtcccggaacgcccggcctgaggcccagggctgccgggagcaccactccccacagtcccaccagcagagcctgcttggtcacgcctatggccagtcccaccgcagtccccacccatccacggaacccttgggctacagctcccaggacccccgtgaggtgcggcgtcgggcagctgactgggctgaggctctgcccgcctggcgtcctctgactacctctgcctccctcacggtgttggactaggcctcccatcaacggaccccagctccaagctcagtgctggtcccccattcctcccagccctggcccaaagtccaggctgcggaccctgcccctcccccgaccatgtttgtcccactcagccggaatccagggggcaatgccaactaccaggtgtacgacagcctggagctgaagcggcaggtgcagaagagcagagccaggtccagctcactgccaccggcttccacctccaccttgaggccctctctgcacaggagccagaccgagaaactcaactgaccagcaggcggatgtggggtgtggggcagggcatggagggagaggaataaagagaaacagagtccaggaaaaaaaaaaaaaaa

SEQ ID NO: 61558 - DNA, 889 bp, Homo sapiens
agggaatgatggactctgatttccacacccctttcctgtgaacttgtctccaatttagtctgtcaaggtccctttcttgtgagttaatttctccctagtgctacttctcagattggccagtgactcacagagtggcacaagtacaaatccagcctgccttgcatccaacacagattccaggaccactgaaaccagctgaggcatcctgaaagcctaagattgaccacaccagaggaaccagactgcccttcacaaggatggaaattatctggttccacccctggatatgatcaaccttcatagactgtgcattatacatgccatctctgcgacctgcaaagatgaaaagggaaagcaggagatggaaactggtcagcagccttctggtttatcagccacacttacaaaggtcaaatgtgcaaagcgtcagaagacagtggttagagtgagattctacatgctctcaatgaagaataaagcatgcaggaagaacctttcaaaaggttacaaccagagacctgaaggaagcaaggaagaaagccacatggttgtcaaagagaagaggaaaggagatcactaagctggatgacgttttctgtttctttgaaaacagagaagatgacaagttagggagagatcagaggtcatactgtgaagcacctttggataaacggcagggactttggattttctttttgaatataagcataatccattgaaaggtctcatgcagggaagtggcaaaacacttttaaaatttttcatcttttctttctgaagcagagttcactctccatttatttgtcttctttgatatctctcaatagaatgttgcagttttagtattctcctattaaacatttgtttaactttaaaaaaaaaaaaaaaa

SEQ ID NO: 61559 - DNA, 2257 bp, Homo sapiens
ggccatggcggaggcccgagtctcccagcctggggcatctccacgctctgtaacgctgagctccaggcacccgtgaagccccacgggtcaaggctggtgggccggggctgggaggcctgcacgcctgggttctgggtccctaaaccagtacccatccaccacagccaccatgatctggcttcgaaacaggaggtgccttgagccgctccagggcaccccgaagtgggtccctgttctgggggagctgcaaaagaccctccagaagggcgagtacctgcccctccgtccgctgcccatgttcgagagtaactttgttcaggtgacccatcaagggggcccagtgttcgtgaatcacagaaccaaccggctggccatgggcgtggccgcctccctgccaggcctggtgttgcctgacatcttgctgatcggccagcccgccgaggacagggactgctccggcctcgtgctgaccaggatgatccccctggacctcgtccacctctgcgtccatgacctctctgcctggcgcctgaagctgcgcctggtctcgggccgccagtactacctggccctggacgcccctgacaacgaggtgggcttcctgttccactgctgggtccgcctcatcaacctgcttcaggagccggctcccacctggacccccaggaccacgcgcacggcccccctggatatgccgctggccgaagcgcctgcctccacctggcacctgcaggaccagcccatcagcagacatgcagtcagggttgctgagcgcaactttccgcataagacggtggctgctcagagacagaggaaggccaaggcgctcaagcgcagtttcaagtctcaggccgtgggcgactctgtgcccctcatctggtcgcagctggagcatgctgacgtcaggaagaaacctgcagaaaagaactccctggacccgtgcctgtggcatcaggacacggaagacctcatggactctgggggcagcactttgtcgtctgctgcctccgtcccagaagctcccagctgtacctgcttcatcgtggaaacccccacctggattggctcctccccagaaggccccagctgcgtcagctcctccccggaaggccccagctgtacctgctccatcccagaaggccccagccgtacctgctccatcccagaaggccccagccatacctgctccatcccggaaggcctcagctgcgtcagcttctccccgaaaggcctcagccgaattcctggaagagccgtgctggagagaagccagtctggagggaaaccggagccggtggtgacggtgcgcacccaggagacagacgtggtggagatgacgactcaggccaagtccccggagtcgcccttcaccgtgaccaagaaggagtccaaggacatcctgattagccaaaccaaggaggtgaccctggaggccttcaggggccaggggaagttggaggactgggcccactgggcgaagcttgaagagaggtccccggacctgcctggcgtgagatccaaggagttggagcagcggaagagatgggtcaaggccaaggaactggccgtcgagggcccctcccaggagcacagcaggcccttctctgtggaagcgctcaccctcaccaagctcatgatcacggccaactccaaagagcagccctcgaaatccgctttggtctcacttccctcctggctcttggcgactccgcaggcgtcggccacgtcaatgatggcttcagtgccctcccgccccggccagctgtccttactggaggggaagccagtggtggtcagagagcagccagagtcgcacacctgggtgaaggagggcaagcggccatggggcgagatgaaggagcagccatggggcgagatgaaggagccaccctgggaccccaaggggccacccaaggtgccctttcgctccaagcccacctctgccagtctgaagagggaaggaatctcccaggcgcctatccccctgaccgcctcaccgtgggaggacttacggccatcgcccctctcggagaccctcatctcaaagatggaggccacagccagggcgtcccagcagcccaagagggtgtcgcaggagcccatgaggatgccagcccagcaccccctggccactgtggggtcgtcttcagaaattcttttgcccatgctcttagaacttgaaactgtgaggaacacggccaccaaggcagaggagatacaggaggaatcgggcgtcttgaaccttctgcccaggtag

SEQ ID NO: 61560 - DNA, 2897 bp, Homo sapiens
ggccatggcggaggcccgagtctcccagcctggggcatctccacgctctgtaacgctgagctccaggcacccgtgaagccccacgggtcaaggctggtgggccggggctgggaggcctgcacgcctgggttctgggtccctaaaccagtacccatccaccacagccaccatgatctggcttcgaaacaggaggtgccttgagccgctccagggcaccccgaagtgggtccctgttctgggggagctgcaaaagaccctccagaagggcgagtacctgcccctccgtccgctgcccatgttcgagagtaactttgttcaggtgacccatcaagggggcccagtgttcgtgaatcacagaaccaaccggctggccatgggcgtggccgcctccctgccaggcctggtgttgcctgacatcttgctgatcggccagcccgccgaggacagggactgctccggcctcgtgctgaccaggatgatccccctggacctcgtccacctctgcgtccatgacctctctgcctggcgcctgaagctgcgcctggtctcgggccgccagtactacctggccctggacgcccctgacaacgaggtgggcttcctgttccactgctgggtccgcctcatcaacctgcttcaggagccggctcccacctggacccccaggaccacgcgcacggcccccctggatatgccgctggccaaagcgcctgcctccacctggcacctgcaggaccagcccatcagcagacatgcagtcagggttgctgagcgcaactttccgcataagacggtggccgctcagagacagaggaaggccaaggcgctcaagcgcagtttcaagtctcaggccgtgggcgactctgtgcccctcatctggtcgcagctggagcatgccgacgtcaggaagaaacctgcagaaaagaactccctggacccgtgcctgtggcatcaggacacggaagacctcatggactctgggggcagcactttgtcgtctgctgcctccggtctggctccctatcccccggctgcctgcctctccacaccctactcttccatccccaggggcagggaaaaggccgggcctatgggctcccaccaggggccggggccaccaccctgccagaaggccccatctggccctgtcacatcttgtaaggcaccgttccttgttgaccagtcccagaagctcccagctgtacctgcttcatcgtggaaacccccacctggattggctcctccccagaaggccccagctgcgtcagctcctccccggaaggccccagctgtacctgctccatcccagaaggccccagccgtacctgctccatcccagaaggccccagccatacctgctccatcccggaaggcctcagctgcgtcagcttctccccgaaaggcctcagccgtacctgccccaccccagaagaccccacccccatctcagaaggccccatctgtacctaccattccccagaaggctgtgtcccccactgctccaaagaagaaatctctactcctccctgccccatcccagaaggctctgccaacctcacctacccaataccagatggcgctgagcccgcctgcctcacgggggaagctccctggcgattttgacgtgttgccaacaggaattcctggaagagccgtgctggagagaagccagtctggagggaaaccggagccggtggtgacggtgcgcacccaggagacagacgtggtggagatgacgactcaggccaagtccccggagtcgcccttcaccgtgaccaagaaggagtccaaggacatcctgattagccaaaccgaggaggtgaccctggaggccttcaggggccaggggaagttggaggactgggcccactgggcaaagcttgaagagaggtccccggacctgcctggcgtgagatccaaggagttggagcagcggaagagatgggtcaaggccaaggaactggccgtcgagggcccctcccaggagcacagcaggcccttctctgtggaagcgctcaccctcaccaagctcatgatcacggccaactccaaagagcagcgctcgaaatccgctttggtctcacttccctcctggctcttggcgactccgcaggcgtcggccacgtcaatgatggcttcagtgccctcccgccccggccagctgtccttactggaggggaagccagtggtggtcagagagcagccagagtcgcacacctgggtgaaggagggcaagcggccatggggcgagatgaaggagccaccctgggaccccaaggggccacccaaggtgccctttcgctccaagcccacctctgccagtctgaagagggaaggaatctcccaggcgcctatccccctgaccgcctcaccgtgggaggacttacggccatcgcccctctcggagaccctcatctcaaagatggaggccacagccagggcgtcccagcagcccaagagggtgtcgcaggagcccatgaggatgccagcccagcaccccctggccactgtggggtcgtcttcagaaattcttttgcccatgctcttagaacttgaaactgtgaggaacacggccaccaaggcagaggagatacaggaggaatcgggcgtcttgaaccttctgcccagcctgcagcactcccagcactccgagtggccggatgcgggggcttaacctcagttggaaactgtccagaggagcccagcgctgccaggccccgagggttctgtgcgcaccgactgtaggaagcggaatgttgaaagccgcttggggggatttgccccctctggtagataccagaactatggatatgcctttatatattggggggcgggggggggcggggggcgagcccgtggagccgcccaacttcgcagagattaaagcttgagcctga

SEQ ID NO: 61561 - DNA, 1589 bp, Homo sapiens
actcgatcccggccccacttccaggccagtgtccggccgaccagcctgccttgggccagggccccacgactccctgctgcgggacaagaggccgtctgtgcggctgtggtcgtgggagggtgtggtgaggccgtgaaggtggggacggtgcctgggcctgtggccgccagagctgctgcggctcagaaggtagcaccaggccccgtgggtgctgtgggggccatcgcctgcccaccatggggaccctcagctgcgactccaccccacggctggccacagccccccttggccggcgagtgacggagggccagattccggagaccggcctgaggaagtcctgtgggacggccaccctggagaacggctcggggccaggcttgtatgtcctgccgtccaccgtgggcttcatcaaccacgactgcaccagggtggccagtcccgcctactcgctcgtccggaggcccagtgaggcaccacctcaggacaccagcccgggccccatctacttcttggaccccaaagtcacacgctttggccgcagctgcacccctgcctactccatgcagggccgggccaagtctcggggtccggaggtgacgccaggccctggggcctacagcccagagaaggtgccccctgtgcgccatcggacaccgccggctttcaccctgggctgccgcctccccctgaagcccctggacacctcagcccctgcccctaatgcctacaccatgccccctctgtggggctcacagatcttcaccaagcccagcagccccagctacacggtggtgggccgcaccccccccgcccgccccccgcaggatcctgctgagataccaggcccgggccagtacgacagcccggacgcaaacacctaccgccagcgcctgcctgccttcaccatgctggggcggccccgggccccgcgacccctggaggagacccccggccctggcgcccactgcccagagcaggtcaccgtgaacaaagccagggctccagcgttctctatgggcatccgccactcgaaacgggccagcaccatggccgccaccacgccctcccggcctgcggggcacaggctgcccggccgctgctgctaggccaggcctgtttcccacacagtgaacgggggctggcgggcctctcctggggcctggctttggctggaggggctagaaggcgagaggggctgggaaaggagtcttccctcccctttcctgaactgtccaggtccttctaggacacctgatccttccagtccctgggggctgtgacccatggccctgtgcagggtacagggtgagtctccttccagtgccccagtttcttccaggtcacgccaggccaggccaggccaggtggggaaagggacaccttccggccctccccagtagctggctggagatggagcttctggtgtcccagaactcggcgtccagctccactagggcctagatccccatcacagcttgggttagccccggtcccagcccaagctcaggctggaggcagccccgaggcctgtgcctttcccactccaccttctacagttgcttagccaataaacctttcctgggctggag

SEQ ID NO: 61562 - DNA, 928 bp, Homo sapiens
gttggttggccggcggcgggccgggacgggcatgaccctgctgctgtgcctggtgtgcctgacggcggcgctggcccacggctgtctgcactgccacagcaacttctccaagaagttctccttctaccgccaccatgtgaacttcaagtcctggtgggtgggcgacatccccgtgtcaggggcgctgctcaccgactggagcgacgacacgatgaaggagctgcacctggccatccccgccaagatcacccgggagaagctggaccaagtggcgacagcagtgtaccagatgatggatcagctgtaccaggggaagatgtacttccccgggtatttccccaacgagctgcgaaacatcttccgggagcaggtgcacctcatccagaacgccatcatcgaaagccgcatcgactgtcagcaccgctgtggcatcttccagtacgagaccatctcctgcaacaactgcacagactcgcacgtcgcctgctttggctataactgcgagtcctcggcgcagtggaagtcagctgtccagggcctcctgaactacataaataactggcacaaacaggacacgagcatgagcctggtatcgccagccttaaggtgtctggagcccccacacttggccaacctgaccttggaagatgctgctgagtgtctcaagcagcactgacagcagctgggcctgcctcagggcaacgtgggggcggagactcagctggacagcccctgcctgtcactctggagctgggctgctgctgcctcaggaccccctctccgaccccggacagagctgagctggccagggccaggagggcgggagggagggaatgggggtgggctgtgcgcagcatcagcgcctgggcaggtccgcagagctgcgggatgtgattaaagtccctgatgttccaaaaaaaaaaaaaaa

SEQ ID NO: 61563 - DNA, 2065 bp, Homo sapiens
ataccacccgcgcccgggagggaggggaggaaggttagggaggcggagagggaccgcgcccgcaggagagaggcgcgggccagggctctagcagggactggggccgcggcaggggtagcaaggtgagtcggtgcttgccaagaggcagagcgcaaaacctactaggagatcgcgcccggtgagcagcacccgcagctcagagcccgggacgtccggagcgcggggagcagtcccctctccatcagggagtggtctatctgggcagtctgggacccaggcaccgcgccatccctgagagagcagcagtctggagagcaggcatctcagatccctaagaaaccagccgtccgagaagccgcggatctcaggtgcccaggatcgttaggactgaacgggagggtactagaggaccactggctctggaccgtcgggagctgcccctgacgtaacccacgaggggcctccccttgacggacggcttggggagcggcaccgccgcggctggagcccgcagaggcagggtaaggggagcggggggcagccgtcgggggagtgcagacccaggcccaaggcgggtcaccgcctcctggcccgcggagagccccggccccggcagccattgcgcccaagagtgaggaagatttgctggccctggcagcgtcgcggctgagccgccgcaagagggtggcgggcgcggccgtcggagtggccatggtgctgctgctgctggtggccatcccgctgctggtgcacagctcccgcgggccagcgcactacgagatgctgggtcgctgccgcatggtgtgcgacccgcatgggccccgtggccctggtcccgacggcgcgcctgcttccgtgccccccttcccgccaggcgccaagggagaggtgggccggcgcgggaaagcaggcctgcgggggccccctggaccaccaggtccaagagggcccccaggagaacccggcaggccaggccccccgggccctcccggtccaggtccgggcggggtggcgcccgctgccggctacgtgcctcgcattgctttctacgcgggcctgcggcggccccacgagggttacgaggtgctgcgcttcgacgacgtggtgaccaacgtgggcaacgcctacgaggcagccagcggcaagtttacttgccccatgccaggcgtctacttcttcgcttaccacgtgctcatgcgcggcggcgacggcaccagcatgtgggccgacctcatgaagaacggacaggtccgggccagcgccattgctcaggacgcggaccagaactacgactacgccagcaacagcgtcattctgcacctggacgtgggcgacgaggtcttcatcaagctggacggcgggaaagtgcacggcggcaacaccaacaagtacagcaccttctccggcttcatcatctaccccgactgagccggccccgccccgtgcccccgctcgccccttctctcccgtcctcacccacctcctgcccgccccacccgaggcgccaccccaccctttgagagcctggcggtggggtggacccttccgttcccggaggcggcctaaatgggcgaactcttggtgctcaagggtataagtggccgggaagaggaggagacccggccagaggagcagagcgacttccggagggatcacccgcacccaagtgcgcgctggaccccataggggcagaggtcgtggctttctcttttgtacagagatggggagcagttttaatagcgggactcagaggcccagaaagccggagggaagcccccgcagcttgcgagggaaataacagaaacaggaggagcccatttaggcaagagaagacattaaaacagggtagtgcaggttctccgtcacaactttctctcgccaccctctcgtcccctcgtctccactttcaggctcaggctccagccttggcagccttcctgtgaactggaggaaccagtgaattctttcctggcatttaaaacgcattctgtacagtccccattcccccctatccggactaggccctggggctacagctgctgctgcctcttctaataaagtgagg

SEQ ID NO: 61564 - DNA, 3570 bp, Homo sapiens
gctccagtcctggcatctgcccgaggagaccacgctcctggagctctgctgtcttctcagggagactctgaggctctgttgagaatcatgctttggaggcagctcatctattggcaactgctggctttgtttttcctccctttttgcctgtgtcaagatgaatacatggagtctccacaaaccggaggactacccccagactgcagtaagtgttgtcatggagactacagctttcgaggctaccaaggcccccctgggccaccgggccctcctggcattccaggaaaccatggaaacaatggcaacaatggagccactggtcatgaaggagccaaaggtgagaagggcgacaaaggtgacctggggcctcgaggggagcgggggcagcatggccccaaaggagagaagggctacccggggattccaccagaacttcagattgcattcatggcttctctggcaacccacttcagcaatcagaacagtgggattatcttcagcagtgttgagaccaacattggaaacttctttgatgtcatgactggtagatttggggccccagtatcaggtgtgtatttcttcaccttcagcatgatgaagcatgaggatgttgaggaagtgtatgtgtaccttatgcacaatggcaacacagtcttcagcatgtacagctatgaaatgaagggcaaatcagatacatccagcaatcatgctgtgctgaagctagccaaaggggatgaggtttggctgcgaatgggcaatggcgctctccatggggaccaccaacgcttctccacctttgcaggattcctgctctttgaaactaagtaaatatatgactagaatagctccactttggggaagacttgtagctgagctgatttgttacgatctgaggaacattaaagttgagggttttacattgctgtattcaaaaaattattggttgcaatgttgttcacgctacaggtacaccaataatgttggacaattcaggggctcagaagaatcaaccacaaaatagtcttctcagatgaccttgactaatatactcagcatctttatcactctttccttggcacctaaaagataattctcctctgacgcaggttggaaatatttttttctatcacagaagtcatttgcaaagaattttgactactctgcttttaatttaataccagttttcaggaacccctgaagttttaagttcattattctttataacatttgagagaatcggatgtagtgatatgacagggctggggcaagaacaggggcactagctgccttattagctaatttagtgccctccgtgttcagcttagcctttgaccctttccttttgatccacaaaatacattaaaactctgaattcacatacaatgctattttaaagtcaatagattttagctataaagtgcttgaccagtaatgtggttgtaattttgtgtatgttcccccacatcgcccccaacttcggatgtggggtcaggaggttgaggttcactattaacaaatgtcataaatatctcatagaggtacagtgccaatagatattcaaatgttgcatgttgaccagagggattttatatctgaagaacatacactattaataaataccttagagaaagattttgacctggctttagataaaactgtggcaagaaaaatgtaatgagcaatatatggaaataaacacacctttgttaaagatactttctaaacttgtgtttaataaactttaatagtcatagaattgtaaatcactatggttaacagaaagtgaaaatattttcatgcagatgatgtgaacagccatgtgaataggtgacttgggcacacagcagggtcatatgacttcagaaaacttcgcttttcagttattccattgttataatgtcaaccctttaagacattgatgtttagagggctcacaaataaaatctgaatacctgtaaggaaagaggttttttatcacataccttaagtctttgtaatgttcatgcttaaattctaagttttcaccttagtgacacacaaggtttggttgtaggcaacaagtcccaggtgtgtgggaaattgattcacaacagagatgggaaaaggtgcagataatttccaatgccttcacaatttacccatgaccagaaatatacttggaagactgatttcacaagtgtcccaaaactgagatgctaaaaaggaaacagtaggtaggtgtcataggaaatttacatgtaccatctaataaacaaacttgcaaattctaaatcttttttttttttgagacagtttcacgctgctgcccaggctggagtgcagtggcatgatctcagctcaccgcagcctccgcctcctgggttcaagtgactctcctacctcagcctcctgagtagctgggactacaggcgcccaccaccaggaccagctaatttttaatgtttctaatagagatggggtttcaccatgttgaccaggccggtctggaactcctgacctcaggtgatctgcctgcctcggtcttccaaagtgctgggattacaggcgtgagcccccgcacccagccgcaaattctaaatcttaaaacaactctgcaaacgaagcacttgagtttctgcttgcttcagggatgtaatatggtgtagaactgtttcacataatgatcagccttggtaattttccagtgtagaaaacattatatttgacccttggacaacaaagagattatattgaaggaattttattgattgtatcatgaataaaagctgaagtcaaaattaaaatgtaaaaaaataattcagaggatggaatatgcaaatgtaaactccaaatgatgtggctggaattcataaacatttactttatgcaagatactgtgctattccaggcactcctatggcatttaaagtacaattcttaccttccctaatttttcaacctagtagaggacaataggctaaagggaataagtacatggataacaaaacataaagtagaatgtttttacagccatagaaggcaaagggctaggaattcacaggagagagaaacagtatctagctgagagcataagaaaagcttgtggaaaagataatatctgatggccagagacaatttcttgctttggtatgtttgaagtgttatatttaaatatatatatttttatttaaaaaactcactatagaaaatttataaaattccccaaaatatttagtataaaattaatcatcccatcaaatattaaataatattactattttaaagtgtttatttcagtcttttcctgcatgtatttatggcttttatttttaaatatagtaataaaataatttgaaattagctttttatatatttttgtatcttgctctaatgggttggactaaacatattaagaacactctcaaatgctactaaggacaatttgaaaacataattttaatgactgcataatttatttaactttcctgttttggaaaatattattttttttttattacaaataatatgtcatgagcattctctttttaaaaaaataaactatgtgtgcatataaaaaaaaaaaaaaaaaaa

SEQ ID NO: 61565 - DNA, 3789 bp, Homo sapiens
gctccagtcctggcatctgcccgaggagaccacgctcctggagctctgctgtcttctcagggagactctgaggctctgttgagaatcatgctttggaggcagctcatctattggcaactgctggctttgtttttcctccctttttgcctgtgtcaagatgaatacatggaggtgagcggaagaactaataaagtggtggcaagaatagtgcaaagccaccagcagactggccgtagcggctccaggagggagaaagtgagagagcggagccatcctaaaactgggactgtggataataacacttctacagacctaaaatccctgagaccagatgagctaccgcaccccgaggtagatgacctagcccagatcaccacattctggggccagtctccacaaaccggaggactacccccagactgcagtaagtgttgtcatggagactacagctttcgaggctaccaaggcccccctgggccaccgggccctcctggcattccaggaaaccatggaaacaatggcaacaatggagccactggtcatgaaggagccaaaggtgagaagggcgacaaaggtgacctggggcctcgaggggagcgggggcagcatggccccaaaggagagaagggctacccggggattccaccagaacttcagattgcattcatggcttctctggcaacccacttcagcaatcagaacagtgggattatcttcagcagtgttgagaccaacattggaaacttctttgatgtcatgactggtagatttggggccccagtatcaggtgtgtatttcttcaccttcagcatgatgaagcatgaggatgttgaggaagtgtatgtgtaccttatgcacaatggcaacacagtcttcagcatgtacagctatgaaatgaagggcaaatcagatacatccagcaatcatgctgtgctgaagctagccaaaggggatgaggtttggctgcgaatgggcaatggcgctctccatggggaccaccaacgcttctccacctttgcaggattcctgctctttgaaactaagtaaatatatgactagaatagctccactttggggaagacttgtagctgagctgatttgttacgatctgaggaacattaaagttgagggttttacattgctgtattcaaaaaattattggttgcaatgttgttcacgctacaggtacaccaataatgttggacaattcaggggctcagaagaatcaaccacaaaatagtcttctcagatgaccttgactaatatactcagcatctttatcactctttccttggcacctaaaagataattctcctctgacgcaggttggaaatatttttttctatcacagaagtcatttgcaaagaattttgactactctgcttttaatttaataccagttttcaggaacccctgaagttttaagttcattattctttataacatttgagagaatcggatgtagtgatatgacagggctggggcaagaacaggggcactagctgccttattagctaatttagtgccctccgtgttcagcttagcctttgaccctttccttttgatccacaaaatacattaaaactctgaattcacatacaatgctattttaaagtcaatagattttagctataaagtgcttgaccagtaatgtggttgtaattttgtgtatgttcccccacatcgcccccaacttcggatgtggggtcaggaggttgaggttcactattaacaaatgtcataaatatctcatagaggtacagtgccaatagatattcaaatgttgcatgttgaccagagggattttatatctgaagaacatacactattaataaataccttagagaaagattttgacctggctttagataaaactgtggcaagaaaaatgtaatgagcaatatatggaaataaacacacctttgttaaagatactttctaaacttgtgtttaataaactttaatagtcatagaattgtaaatcactatggttaacagaaagtgaaaatattttcatgcagatgatgtgaacagccatgtgaataggtgacttgggcacacagcagggtcatatgacttcagaaaacttcgcttttcagttattccattgttataatgtcaaccctttaagacattgatgtttagagggctcacaaataaaatctgaatacctgtaaggaaagaggttttttatcacataccttaagtctttgtaatgttcatgcttaaattctaagttttcaccttagtgacacacaaggtttggttgtaggcaacaagtcccaggtgtgtgggaaattgattcacaacagagatgggaaaaggtgcagataatttccaatgccttcacaatttacccatgaccagaaatatacttggaagactgatttcacaagtgtcccaaaactgagatgctaaaaaggaaacagtaggtaggtgtcataggaaatttacatgtaccatctaataaacaaacttgcaaattctaaatcttttttttttttgagacagtttcacgctgctgcccaggctggagtgcagtggcatgatctcagctcaccgcagcctccgcctcctgggttcaagtgactctcctacctcagcctcctgagtagctgggactacaggcgcccaccaccaggaccagctaatttttaatgtttctaatagagatggggtttcaccatgttgaccaggccggtctggaactcctgacctcaggtgatctgcctgcctcggtcttccaaagtgctgggattacaggcgtgagcccccgcacccagccgcaaattctaaatcttaaaacaactctgcaaacgaagcacttgagtttctgcttgcttcagggatgtaatatggtgtagaactgtttcacataatgatcagccttggtaattttccagtgtagaaaacattatatttgacccttggacaacaaagagattatattgaaggaattttattgattgtatcatgaataaaagctgaagtcaaaattaaaatgtaaaaaaataattcagaggatggaatatgcaaatgtaaactccaaatgatgtggctggaattcataaacatttactttatgcaagatactgtgctattccaggcactcctatggcatttaaagtacaattcttaccttccctaatttttcaacctagtagaggacaataggctaaagggaataagtacatggataacaaaacataaagtagaatgtttttacagccatagaaggcaaagggctaggaattcacaggagagagaaacagtatctagctgagagcataagaaaagcttgtggaaaagataatatctgatggccagagacaatttcttgctttggtatgtttgaagtgttatatttaaatatatatatttttatttaaaaaactcactatagaaaatttataaaattccccaaaatatttagtataaaattaatcatcccatcaaatattaaataatattactattttaaagtgtttatttcagtcttttcctgcatgtatttatggcttttatttttaaatatagtaataaaataatttgaaattagctttttatatatttttgtatcttgctctaatgggttggactaaacatattaagaacactctcaaatgctactaaggacaatttgaaaacataattttaatgactgcataatttatttaactttcctgttttggaaaatattattttttttttattacaaataatatgtcatgagcattctctttttaaaaaaataaactatgtgtgcatataaaaaaaaaaaaaaaaaaa

SEQ ID NO: 61566 - DNA, 579 bp, Homo sapiens
actctgcagttgatccagcagcaggaggcagctgtacccatcactgtcctcagagtacttttaagaacaaggaggtctctgcccacggcagcccaagcagattcccatccatcatgactgccatccgactacgagaatttattgagcgtcgcccagtgatcccgccaagtatattcatcgctcaccaaggaagagacgttcaaggctattaccctgggcagctggcaagactccattttgatcatagtgcaaagagagctcccagaccgctcatagacttgacaattccacccaagacaaaatatcactatcagcctcaattagaccaacaaacactcattcgatatatttgtcttcgaagacattcaaagcctgccgagccatggtataaagaaaccacttaccgacgagactattctctgccattttatgagattgattggaaccagaaattagccacagtttcgctgaatcctcgaccgcttaattcactgccagagctctactgttgtgaagagagaagcagctttgaaagaaatgcttttaaactaaaataaccacggcattcgaacaaaataa

SEQ ID NO: 61567 - DNA, 1051 bp, Homo sapiens
gtaaatcacacagatgttggtagagaaaaaggcatactggtattgaaactgtaaactggcctgtttacttcgtctcctaacaaaaaacactttggattcaggttctccacagcagtcttccactggccacagtgaggggagctaggtttccccagtctccagctagaaaaactcagaacatctaaagatctgaaagatggaaaaaagagaactaaaggcttctgttccaaaatttgacaagattccttggcttagtgaggccagccttgtaaacaagccattagtgctcagccttcccagaagatatcctcatacctctgcgacttttctgacttcatccaagaagaatatgaatttgccaattttgtttcaagttccagatgttttatctaaggccaggaggaaccagtgtgactccatgctgctcagaaaccaacagctgtgctccacatgtcaagaaatgaaaatggtacaaccaagaacaatgaaaatcccagatgatccaaaagcatcctttgagaattgtatgagttatagaatgagtcttcatcaacccaaattccagactacacctgagcctttccatgatgacatcccaacagaaaacattcactacagactgcccattctgggccccaggacagctgtcttccacggattactgacagaggcctacaaaactctaaaagagagacaacgttcttccttgcccagaaaggaaccaataggcaagacaacgaggcagtgagcggtaggagctcatcacctcccagactcccagagagaaaataacctcgccaagccaatctttgacactggcaccttctcctcacaattttctctcttctcccaaaagatgatttaattttgccttcctaagattgctggtattctagctcttacctctatgttctttctcacgtctcctaaagacaaaattgtttaatttacatgattataaagatctgtttatgaaaatgaaaaaaaaaaaaaaaaaaaaaaaaaaaaaaaaaaaaaaaaaaaaaaaaaaaaaaaaaaaaaaaaaaaaaaa

SEQ ID NO: 61568 - DNA, 907 bp, Homo sapiens
agcgtcgggacaaaccagccagcctctccagagcaggcgtgtgatctctgtacccccgcagtggtcagaatatggagaacttctcactcctcagcatctctggacctccaatctcttcctccgccctgagtgcttttcccgacattatgttctctcgtgccaccagcctgccagacattgcaaagacagcagtacccactgaggcatccagcccagctcaggccctgccaccccagtaccaaagcatcattgtcaggcaagggatacagaacacagtgctctcaccagactgcagcttgggggacacccagcacggagagaagctgaggcggaactgcactatctaccggccctggttctccccctacagctacttcgtgtgtgcagacaaagagagccagctggaggcctatgacttcccagaggtgcagcaggatgagggcaagtgggacaactgcctttctgaggacatggctgagaacatctgttcgtcctcttcctccccagagaacacttgccctcgagaagccaccaagaaatccaggcatggcctggactccatcacatcccaggacatcctaatggcttccagatggcacccagcacagcagaatggctacaagtgcgtggcctgctgccgcatgtaccccaccctggacttcctcaagagccacatcaagaggggcttcagggagggcttcagctgcaaggtgtactaccacaagctcaaagccctctggagcaaggagcagaaggcccggctgggagacaggctctcctccggcagctgccaggccttcaatagtcctgctgaacaccttaggcaaattggcggtgaagcctacttatgtctctagagagatgccaataaagttagtcacagccttcaagaaaaaaaaaaaaaaaa

SEQ ID NO: 61569 - DNA, 1866 bp, Homo sapiens
cgctgttgccatggcagtgtggtcctggctgccgcggaggcaggtgccggggtctcctttgcctcaatgtgaagagcttagaaagaggaggagaggagaactcccccggccatctctgtgatcccagccgccgcattttacacagcatatttccttcacaaacagaaaatgaatgaaaataaagatactgattcaaagaaaagtgaagaatacgaagatgactttgaaaaggacctggagtggttaattaatgaaaatgaaaaaagtgatgccagcataatagagatggcttgtgagaaggaagagaatattaaccaagacttaaaagagaatgagacagtaatggagcacaccaaacggcattctgatcctgacaaatctttgcaggatgaggtctcaccaagaagaaatgacatcatttctgtaccaggtattcaacctttggatcccatatcagattcagatagtgaaaactctttccaggaatccaaactagaaagccagaaagacttggaggaggaagaggatgaggaagtaaggagatatattatggagaaaattgtacaagctaacaagcttctacagaatcaagaaccggtgaatgataaaagggagcgaaaacttaagttcaaggaccagttagttgatttggaagttcctccactagaagacactactacttttaaaaattattttgaaaacgaaaggaatatgtttgggaaactgtcacaattatgtatttccaatgattttggacaagaagatgtgctcctgtcacttactaatggaagctgtgaagaaaacaaggataggacaatactggtagagagagatggaaaatttgaacttctgaatttacaagacattgccagtcaggggtttttgcctcccattaataatgcaaatagtacagaaaatgaccctcagcagttgttacccagatcttccaactcctctgtcagtggcaccaagaaagaagattctacagcaaagattcatgctgtcactcactcatcaacaggagagccgctggcttatatcgctcagccaccactcaaccgcaagacttgtccaagctctgctgtcaactcagatcgaagtaaagggaatgggaaatctaatcacaggacacagtctgcacatatctcaccagtgacttcaacatactgtctttcccctcgacagaaagaactacaaaaacaactagaagaaaagagagaaaaactgaaaagagaggaagagcgacgaaaaatagaagaagagaaagaaaaaaagagagagaatgacatagtatttaaagcgtggttgcaaaagaaaagagagcaggtcttagaaatgaggagaattcagcgagcaaaggaaattgaagacatgaacagtagagaaaacagagatccacaacaagcttttcgattatggcttaaaaaaaagcacgaagagcagatgaaagaaagacagacagaagaactaagaaagcaagaggaatgtttattcttccttaaaggaacagaaggccgggaaagggcctttaaacaatggttaagaaggaaacggatggaaaaaatggcagagcaacaagctgtcagagagagaactagacagctccgactagaagctaagcgttctaaacagttacagcaccacctatatatgtcagaagccaaaccttttcgttttactgatcattataactgaaagtttctattaaatatttcagtgggcagctgctatcaaaattttggatatgatttcttagggtctgtgtactttggttgtattctaaattatggaaatggtatttatcttttattgacagtgaatttgtttttttaatactagaacaaaataaatttttttctcacagtg

SEQ ID NO: 61570 - DNA, 751 bp, Homo sapiens
accctgagcggtctctgaggacctggtgagcagattgttgcaccattagaagctaggttgatccacagacagatggctgaaagtggaaaagaaaaaataaaatggacaaccaccattattattagctcatctcttaagagttatgaagttgcaactgccctagaaaatcgaagccacaaagttcgatattcagattcagtggaaaatggatcaattatattttctctttctggagttgcatttttattaatggatactaaggaatgtcttctgtcaactgaagaaatatttctagccaaaattgagaaatttattaacattcaccaaaatagttttttggttttgtctgctgccctccatgggcctgaagaatggaaactgatgttcaggattcagcagagattcctgggttgtaacttacgaatacttccagtacacaacacagtaaatgctattaatcttatgtgcactatagcaaagactacctccaaaccatacatagatagcatttgctacagaatgataacagctaaagcttacatcattgagcaaagtcctgtttggaaaacacttcagaagataaaactgaatagtgattcagttaacccaaattagagtaccaacttaatgtttttctcgaagaatgtgaaaataattagacctgttaaattataatattcaaatatctatttaaagacatttatattaatttgaaataataacatatacaattaaaagtgattttatttta

SEQ ID NO: 61571 - DNA, 1077 bp, Homo sapiens
atccaagatagatcaactctccctaaaggctgacagtgaactcttggggccgttttattctctgaggttagcaaggagtcatctactagccattcaggaggccagctgggaagacaaaataggcaccccaaactcagcaacttcataacaccttcctctccccgcctgaagccttaaactgcatcaagtcaaagaaacctggggcaaatccttaacatgtttttgactgcagtaaatccacagccactctctactccgagctggcagattgagaccaagtattcaacgaaagtgctcactggaaattggatggaagagaggagaaagttcaccagagacactgacaagacaccccaatccatttacagaaaagaatacatccccttcccagaccacagaccagaccagatctccaggtggtatgggaagaggaaagttgaggggctaccttacaaacacctgatcacccaccaccaggagcccccacatcgctacctgatcagcacctatgacgaccattacaaccggcatggttacaacccggggctgcctccactccgcacttggaatggacagaagttgctgtggctgccagagaagtctgactttccccttcttgctccccctacaaactatggactctatgagcagctcaagcagagacagctcacacccaaggctggcctgaagcagagcacttatacttcatcctaccccagaccaccgttgtgcgctatgtcctggagggagcatgcggtcccggtccctccccatcgcctgcatcctctcccacacttctgagagctgccaccccaggagcagctcagatagaatcagctggagaccacagcatcactggacttgccagacaacaagtggcgcagataaactcagagtacgagatctggcccgtcaaaggtgctctcagaatcatcatctgcatttggcggtacctgtcccccctcaaaacccacaggttcctttcttttccatccaacaattaaagatctttgacactaaaaaaaaaaaaaaaaaaaaaaaaaaaaaaaaaaaaaaaaaaaaaaaaaaaaaaaaaaa

SEQ ID NO: 61572 - DNA, 1777 bp, Homo sapiens
acaaggcccgggttgccgtggcagcagcggaggcgggcggcgcgcaggcctgccatgagggaaagccaggatgccgccggagctcatggctggaaccgcgtcggctccacggccaccaagtggttcaccggggcgcccttcggggtgcagagccacaggtttgacatctctgctgtttatcccaactggaagaagttcagcaccttcactgaggccccatactccacgcgttattctacccaagtgtcccacataggccctgggacttacagctccaaagagacctgcttcagcaagaagaagctgatgaaggaggtggacacaggctgggccaaggcccaggaagccacgcggctgacccagctaccccacttccagtaccaggccatcatgaaagagaagcggctgaaggagcaaaagctgggcccctgctcctacaacctcaaagacttcttagaacagctgcgggagaaaccatgtagcacccgggggctgctcagctctggggaggttcgcttccgaggactcactgggaactactatccaggccctggaaattatggggagaagggtaacccatacaccaagctggaggagaatgcctggaaccggtctcattccgagggcctcatgtgcaggatgagcaacaagccacacccccggcctcatcaggggagtggtctgggacccggcacctacttcttcaaaagcgaccttgagacatatgtggcacgatccgtcggcacccgcggcccctatgacactttctctggtgatcggagcaagccactgccttatgggcactactccatgcagaaaaaaaagcccagggaactgatgaatttcaagagctttgtagaagaacttaactcacatcacaataagaagcatggggttttttctaaacttccccgaaacccgaaaacccctacagagaggatttactgggccaacctcagccagtgcccccgcacactggccacatctggccccagtttctggcttccacaagagaagaaatgcaaacccgtcaaccagcccccattcctgttgacctccaaggggtcaggtgcaaaggcctgccagatgattatgggaagctggaacccagtaggtgtgggccgctacctcaacacctggctgatggagacaaaggacaggcggcagcgatatcgatccctattcctgagtggatccaaacgctacctctcagacctggcccgggacatgctcatgcaaatcaggctgttttgttggaaaggcctagaagtcatcaattttggcctctcaccaatgtaggatctcctgtgaagcagaaccaacagggaaaggatcacaccatttactaagggaaagtgccctccaactgtggattacaattcagatcctactccttaaagccacatgcgaaggacagcctgcagtgaccagagagcccaaaggcctgaagacaaatctgggggtgacagcatgggcatgggagtggggtgtcttagagaaaggacacatgggcttgggagaggggagagatgtatggggatcacctttgccagagctgcatacctgaaggtcacagtgtcttccgggacagctggggacaggtatcttttgttgcaggagatcaattatcctgagaactcaactcagccagtgacatgaacatgggggccagagagcagatggactgaagggatgggacgtagttgacacttgtgggaccctttctattctaaagccagagtgcttggctccttgtttattaaagttcagaaagtag

SEQ ID NO: 61573 - DNA, 905 bp, Homo sapiens
atggcttcacctaaaggtttttttaattacttgacctattttcttgctgctggtgctgtcactttgggaattggtttctttgctttggcatcagctttgtggttcctgatttgcaaacgaagagaaatatttcaaaattccaaatttaaagcaattgatgagagatgcaggcaaagaccatcaatggcgaagattaaatctcattctcagtgtgtttttatttctcgaaattttcatactgggagattccaattacaggaggagcaaagaaaaaaggaagcagcacatataaaagcaattaaagatcattctaaagatgaaccccaacttgcaacaaaaaatatcatttgtgatccctcagagaccagctccacaacaaatcgcagcagtgttacattaagcttatcaacattaccatctgattcttattacagccaaagtatagaagcagctgatgactggttttctgatgattctctagtgaaaaggaactctccaatgccttctctcggggaacctctaatggaaaaagtattttcatacctgtcaaccatttcattagaagagggtactgaaagtgtactgaatgacactttatgaccatcaaaaagatgactacattaagggaaaatgttcatgaagaaacacagaggttgaaatataaaaccttcaacataatactgaatgacttttttcttttgaaaccttgtatacaatcagcttctgagtctcttaacatgtccatgctaatattgctttttttgttctttaccatagagcggctctacttcccttgctggttcttatttctagaaacaaaattaggaagaactagagtgatgtcatgaacattaagcttaacttattgtatctcatccaaagacatattaaataaaatgagtgta

SEQ ID NO: 61574 - DNA, 905 bp, Homo sapiens; identical to SEQ ID NO: 61573

SEQ ID NO: 61575 - DNA, 2055 bp, Homo sapiens
ggagcgaaggtaggaggcagggcttgcctcactggccaccctcccaaccccaagagcccagccccatggtccccgccgccggcgcgctgctgtgggtcctgctgctgaatctgggtccccgggcggcgggggcccaaggcctgacccagactccgaccgaaatgcagcgggtcagtttacgctttgggggccccatgacccgcagctaccggagcaccgcccggactggtcttccccggaagacaaggataatcctagaggacgagaatgatgccatggccgacgccgaccgcctggctggaccagcggctgccgagctcttggccgccacggtgtccaccggctttagccggtcgtccgccattaacgaggaggatgggtcttcagaagagggggttgtgattaatgccggaaaggatagcaccagcagagagcttcccagtgcgactcccaatacagcggggagttccagcacgaggtttatagccaatagtcaggagcctgaaatcaggctgacttcaagcctgccgcgctcccccgggaggtctactgaggacctgccaggctcgcaggccaccctgagccagtggtccacacctgggtctaccccgagccggtggccgtcaccctcacccacagccatgccatctcctgaggatctgcggctggtgctgatgccctggggcccgtggcactgccactgcaagtcgggcaccatgagccggagccggtctgggaagctgcacggcctttccgggcgccttcgagttggggcgctgagccagctccgcacggagcacaagccttgcacctatcaacaatgtccctgcaaccgacttcgggaagagtgccccctggacacaagtctctgtactgacaccaactgtgcctctcagagcaccaccagtaccaggaccaccactacccccttccccaccatccacctcagaagcagtcccagcctgccacccgccagcccctgcccagccctggctttttggaaacgggtcaggattggcctggaggatatttggaatagcctctcttcagtgttcacagagatgcaaccaatagacagaaaccagaggtaatggccacttcatccacatgaggagatgtcagtatctcaacctctcttgccctttcaatcctagcacccactagatatttttagtacagaaaaacaaaactggaaaacacattgtttggtcttgtgtttctttacagaggtacctgagggaggagagacataaatcccttcatccctaagactgaactatgtaactagcagcctctggcttgttttctactccctgtccctcaggataaaatgttgatattgctcattttcctcatttccaacattgttttaaaacaagtacttcttttacaggcttgaaaaatctcaaataaacgctaagaaaagggagtaggaagaacaaggagttgagcccttgaaagatgacagtggtcttcttgccttcatgcttggccctctctcctcaaaagggcaatgttggtacaaaattccatctcagccactttcgaggagttatcttcattagctatatccatcctttaatccaacacacacctgcaatgattactgtgcaactattttgcttaattttttatttgaaaaaatgtatttaaaagtccaacaactttttaatataaattacgactctcaaacccattcccatcactttattagtgatggtagcatacatattagagaaggtagctaaaggcaagagagcaccaaaggaaaaagactgtccaaagaacaggtattagaatgaggccgaagatcacggtgaccagagatttctaggagtctctaacctttccaccctatcctgttaaccctttagatctctagtataacactcaggctactgaggtattttagagcaacaagctgggttactttcagagcaaccagcttgactggaactgagagtaaattgggaatgtatgaccaatcttagaccctgaaaaatggcagaaaatacatggaaatttgaaaaaaaaaaaaaaaaaaaaaaaaaaaaa

SEQ ID NO: 61576 - DNA, 1907 bp, Homo sapiens
aaaaaagccagcgaccgttctgcctcccgtgggggaggaggagcccaaaagccctgtgctggtggatggggagaaggaattataggagctggagaaacaacatcttctggaagggaagacaagacagtatacaatcccctacagaggagtaccagtgctccggggtcctcgagaccgacttcgccgagctctgcacgcggtggggctacacggacttccccaaagttgtcaaccggccccgcccccacccgcccttcgtcccctccgcctctttgtcggaaaaggccaccttagacgatccgcggctgtcggggtcctgcagcctcaatagcctggagagcaaatacgtgttcttccggcccaccatccaggtggagctggagcaggaggacagcaagtcagtgaaggaaatctacatccgcggttggaaggttgaggaacggattctgggtgtcttctctaaatgtctgcccccgcttacccagctacaggccatcaacttgtggaaggtggggctgaccgataagaccctgaccaccttcatcgagctcctgcctctctgttcatccacgctcagatctcccctgccctcaggaaggtgtctctggaggggaacccactgccggagcagtcctatcacaagctcatggccttggacagcacgattgcgcacttgtctctgcggaacaataacatcgacgaccgcggggcgcaactcctgggccaggcgctgtccacgctgcacagctgcaaccggaccctcgtctcgctcaacctgggtttcaaccacatcggtgacgagggcgcaggctacatcgcggacggcctccggctgaaccgttccctgctctggctgtccctggcccacaaccgcatccaggacaagggcgccctgaagctggctgaggtcctgcgcgccttcgagctgacacacaccgaagtggtggagcgccgacgcctcctgctggaaaaagggacacaggagcgctcgcgatcgccctcctcctctcgacacggggactccaaaacggaccgtgagaagagtcagatggtagggatcagcaatagtgcattggtggacaagacagacaagacgcagacaatgaaaacccctaagggcctgggcaagaaaaaggagaaatcatgggaattggccaagaaagaggagaagttggggtctgggcagtcacccacacaaggaacccctaagaaggaagatgccacaaaggcaggcaaggggaaggtaaccatccctgaacagaagccaagcagggcaaaagggatcaagatcgggagcagagagaagcgcagcatcctcctggagtccgagcagctggttgttgaggctactgaggtggtcaaccctctcctggagcctgtggagcaccgagatgggaaagttttcatgcctgggaacaaggtccttttgcacctcaacctcatccggaaccgcatcacagaggtggggctggagggcttcctcgccacggtgcagtatcagatgcagttctccaaggccaagagtgcatccaagggtccagtggggctgctgtggctgtccctggctgtgagtccctttcactctctcctgctgaagcagacgttgcccctatcagctgtcatactagacagctgctgcaggcagcttctgtctccccatttccaaggaagaaaaattgcttcgccccacaatgtcctgcgtacgccataatccaggagctgatgttgccaagggatcccatcaaggccaaactcagggaggatgaggccatggcattcttcccctagccccctcccacctgcttgcctctaagactcggggctacagaagcacctcctgtccctgtgtggggtgacctccctgggggagatctcagaccaataacaaagtctgttgctatactttt

SEQ ID NO: 61577 - DNA, 2314 bp, Homo sapiens
ctccacccacccctcccacacaaatagaaggcctctgaacctaaccaccttgctggagcgaaagccagacagaactgacccacttctgccaagccccatcctcatctccctttctggtgaatgaggggtggtggtggttgtgttctagccctgggtggacagaggggcttccagaaagagaggaggaggatggccagcgggaatgggcttccttcatcctcggccctggtggccaagggcccctgcgccctgggcccattccccagatacatctggatccaccaggacacaccccaagacagcctagacaagacttgccatgaaatctggaagagagttcaaggcctgcctgaggcctcacagccctggacctccatggagcagctctctgtccctgtggttggaactctaagaggcaatgagctcagctttcaagaagaagctctggagctcagcagtggcaaagatgagatctccttgttggtggaacaggagttcctaagcctcaccaaagagcactcgatcctggtcgaagagagttctggggagctggaggtacccggcagctctcccgaggggaccagagagctggctccctgcattcttgcccctcctctagtggcaggcagtaatgagcgccccagagcctccatcattgtcggagacaagcttctgaagcagaaggtggccatgcccgttatcagcagcaggcaggactgtgattctgccacttctactgtcacagacattctgtgtgccgccgaggtcaagagcagcaaggggacagaggacaggggccgcatcctaggtgactccaacttgcaagtcagcaagcttctgtcccagttcccactgaagtccactgagacatccaaggtccctgacaacaagaatgtgctggacaagacaagggtcaccaaggacttcctacaggacaacctgttcagtggccctggacccaaggagcccacagggctgagcccatttctgctgctgcctccccgacctcctcctgcacgtcctgacaagctccctgagctccctgctcagaagaggcagctcccagtgtttgccaagatctgttccaagcccaaggctgaccctgctgtggagaggcaccacttgatggaatggagccctggcaccaaggagccaaaaaagggtcaagggagcctctttctcagccagtggccccagagccagaaggacgcctgtggtgaggagggttgctgtgacgcagtgggcaccgcatcactgaccctgccgcccaagaaacctacatgtccagccgagaagaacttgctctatgagttccttggggccaccaagaacccaagcgggcagccgagacttcgaaacaaagtggaagtggatgggccggagctgaaatttaacgcacctgtgacggttgctgacaagaacaacccgaagtacacagggaatgttttcactccacactttcctacagccatgacctcagcaaccctgaaccagccactctggctcaacctgaactatccacctccaccagtgttcacgaatcactctaccttcttgcagtatcagggcctgtacccacagcaggcagcgaggatgccctatcagcaggctttgcacccgcagctgggatgttactcccaacaggtgatgccatacaacccacagcagatgggacagcagatcttccgctcttcctacacccctctgctgagctacatcccttttgtccagcccaattatccctaccctcagaggacacctccaaagatgtctgccaacccccgagaccctcccctaatggcaggagatggaccgcagtacctctttccccaaggatatgggttcggctcgacatccggagggcccttgatgcacagcccctatttttcttccagtgggaatggcataaacttttagatctcctcttctcccttctcctcccttagcccttggatcaggactaggggctctgatttttggattctgcaaaagcttggtatgaagtttggaaaagcaaagttctgaccaggtcacagacaaaacagcaagaccagattcatctattggccaacactgacacaaaaatagccctcctcacacatggcacaagctacacacacacacacacacatgaccctcatattcatacttgcttgctcaaccacttatgcttctgtatttagctaacatgagtgatttttgtttttgtttttgttggtaaaatagaagtaagacacttaattttagaaagtttgtattttatgataaaagtatgagctacttgaaaaaaaaaaaaaaaaaaaaaaaaaaaaaa

SEQ ID NO: 61578 - DNA, 995 bp, Homo sapiens
tgctggctgaactgagaggaacagggttggtgcctggcactggtgttgctccattcatctctgaggtctcacagccccagcatgagtccatcagcaaagaagaggcccaagaacagcagggtttccaagatgcaagatgagaaactgcgggacgagacagagcagcctgtgagcaaagtaattgagcggaaccgtctgagaacggtgttaaaaaacttgtcgctcttgaagctactcaagagctcaaaccgccggatccaagaactgcataagctggccaaaaggtgttggcattcactgctcagtgttccaaagattctccgcatctcctctggggaaaacagtgcctgcaataaaacaaaacaaaataatgaagagttccaggagatcgggtgctccgagaaggaactcaagtccaagaaattagagtccacaggggaccctaagaaaaaagagtacaaggagtggaagtcccaggtgcagtcagggatgaggaacaaggagaaaacgtcattggcggcaatgccacggaaagaaaagcatatagagcctgaggttccaaggacatcgagggatgatagcttgaaccctggagtccaggggaggcaaccactcaccgagggcccccgagtcatcttcattaagccctaccgcaatagaactcccatggggcacatgaagcagctggatgtagccgaccagtggatctggtttgaggggctgcccacacgaatccacctcccggcgcccagggtgatgtgcagatcctccaccctgcgttgggtcaagcgccgctgcacccgcttctgctccgcatcacttgaaatgcctatgtggcatccatacaaggttgatgtgacctggacgagagccagaggtgcgagcagagggtggagatcgcgccatcagctgaaggggaggaatgggtggcgaaattcacgagtctacaaataagatcttccatatggcacctaagacgaaaaaaaaaaaaaaaa

SEQ ID NO: 61579 - DNA, 3481 bp, Homo sapiens
accaaccccgccaggtcgcgggcactcccaccagctcgcagccctccttcggaccctcgatccgagagcgccccagccagagcttgtgcccatgcccctgtcccgcaggggaaggggatcccgcctggccggctctcgagcggcgactagtaacctcccgcgggcgacagccctctccccaaagagtgccggccgcggggccctgtctataagccacgcgcaactcctcacccggcggcgccattcctccgagcaggtcccgccggagtccgagccgcgggctgacttccgctcgggaaagtggctccaagagcccgccacaggggacgccagggactcgcggcaggctctgcgggccaggatgagttctaagcacaggatctgtagtcaggaagaagtagtgatcccctgtgcctatgacagtgattcagaaagtgtggatttggagctgagcaacttagagattattaaaaaaggctcaagtagcattgaactgacagacttggacatccctgacatccctggactccattgtgagcccctgtcacatagccccagacacctgacccaacaggacccgctcagtgaggccattgttgagaaactgatccagtccatccagaaggttttcaatggtgagctaaagggtgaacttgaaaagctgaaattcctaggagatctgtcttctctcagccaagctttaccttatgatgaaaccgcaaaatcattcattcacagccacatagcagacattgtgcataccttaaatgtactggtacaagaggaacgcccgcattctctgtccagttccatgcgccaggaggtctttgtcaccatcgctgatctcagttaccaagatgtccatttgctgttgggctctgaagatcgagctgagttgttcagtcttaccatcaagagtataatcactctgccctctgtaaggacccttacccagatacaggaaatcatgcccaatgggacctgcaacacagagtgtctttacaggcagacgtttcaggcattctctgagatgctccagagtttggtggtaaaagacccacatttggaaaatcttgacaccattattaagcacttggtcccctggttacagtcagtcaaagaccatgagcgggaacgggccacggccagcatggctcaagttctgaagtgcctatccaaacatctcaacttgaagcttccactgcgattccaaagacttggacacctagtggctctgatggcactgctctgtggggacccacaggaaaaggtggctgaggaggctgcagagggcattcactccctgctgcatatcaccctgaggctgaagtatatcactcatgacaagaaagatcagcaaaacttgaaaagagcattgacaaaatgtcgagaattcctggagctccacagctctgccgctaaatgcttctacaactgtcccttcagaattgcccaggtctttgaaggttttcttgattcaaatgagctctgccagtttataatgactacatttgataccctgaaaaccctgaaacatccctgcatccagcgatcagcaggagaattactgctaactttggcgaaaaatacagagtcccaatttgagaaggtgccagaaattatgggagttatctgtgcccagttatccataatcagccagcctagagtccgccaacaaatcataaataccgtgagtttatttatatccagacccaagtacacagatatagtgctcagcttccttctgtgtcatccagtgccgtataacaggcacctggctgaggtgtggagaatgctgtcggtggagcttcccagcacgacctggattctgtggaggctcctgaggaagctgcagaaatgccataatgagcctgcacaggagaagatggcatatgtggctgtggctgcaacagatgccctttatgaggtgtttttgggaaacaggcttcgagcagctacgttccgactctttcctcagcttctcatgacactgcttatccagattcatcacagcatcggcctcaccatgtctgatgtcgacatcccaagtggcctgtacacagaacaggaagtgccttcagaggtcacccctttgtgctttgccatgcaggctacaaagactctcctcctcagaacatgctgcttgcaggaattcaacatcatggaaaagaataaaggatgggctctcctgggaggaaaagatggccatcttcagggactatttctccttgccaacgcattgctggaaagaaatcagctccttgcacagaaggtcatgtacttattagtccctcttcttaaccgagggaatgataaacataaactcacatctgcaggcttttttgtggagcttctccggagtccagtggccaagagactgcccagcatatactctgttgcccgctttaaagactggctacaagatggaaatcatctctttagaattctcggcctgaggggactgtacaatcttgttggacaccaggagatgagagaagacatcaagagcctgttgccatacattgtagacagcttgcgtgaaaccgatgagaagatcgttctgtcagccatccagatactcctgcaacttgttagaacaatggatttcactaccctggctgccatgatgaggaccctgttctccttatttggtgatgtgagatctgatgttcatcgtttctccgtgactctctttggagccgccataaagtctgtaaaaaacccagataagaagagtatagagaaccaagtcctggacagcttggtcccactacttctgtattctcaggatgaaaatgatgcagtagctgaggagagcaggcaagtcctaactatatgtgcccagttcctgaagtggaagctgccccaagaagtgtactccaaagatccctggcacatcaaacctactgaagcaggaacaatctgcagattctttgaaaaaaagtgcaaggggaaaattaacatcctagaacaaacactgatgtactccaagaacccaaaacttcccatcagaagatcagcagtcttgtttgtaggccttttatcgaagtacatggatcacaatgagctcaggaggatgggtactgactggatagaggacgatctgagagacctgctgtgtgaccctgagccctcgctgtgcatcatcgcttcccagactctgttactagtccagatggcgagggccgaaccaaaacctaagcagagagtgaactggttgcagaagctcatgggcaggtcctctgcctagaaacacaaggcaagcaacatcagagacagaatcttgctatgttgtgcggcaagctagtcttgaactcatggcctcaagtcatcctcctgtgtcagcctcccaaagtgctgggattacaagcatgcaccacggcacccagcagaattccagtcttgagaaacaggtcaaggacagcttcaaaagagattctaaataaatgttaatgttacaatgttaaaaaaaaaaaaaaaa

SEQ ID NO: 61580 - DNA, 741 bp, Homo sapiens
ggaggaggtgaggagggtttgctgggtgggtatgggggagggggagactctgcaggagcctaattccccactctgagctcacccttctgtctgcccgggccctaccccttcccctactctcacccttataatccttttcagcactaggtcttcccgtcacctccacctctctccatgacccggctctgcttacccagacccgaagcacgtgaggatccgatcccagttcctccaaggggcctgggtgctggggaggggtcaggtagtccagtgcgtccacctgtatccacctggggccctagctgggcccagctcctggacagtgtcctatggctgggggcactaggactgacaatccaggcagtcttttccaccactggcccagccctgctgctgcttctggtcagcttcctcacctttgacctgctccataggcccgcaggtcacactctgccacagcgcaaacttctcaccaggggccagagtcagggggccggtgaaggtcctggacagcaggaggctctactcctgcaaatgggtacagtctcaggacaacttagcctccaggacgcactgctgctgctgctcatggggctgggcccgctcctgagagcctgtggcatgcccttgaccctgcttggcctggctttctgcctccatccttgggcctgagagcccctccccacaactcagtgtccttcaaatatacaatgaccacccttcttcaaaaaaaaaaaaaaa

SEQ ID NO: 61581 - DNA, 541 bp, Homo sapiens
ggccatcgtccccagtggtgaccagccctgccatgggaaactatagttcccacaaaaggaccaaagcacccaagcaggcccgcaaggagaggccggctgacatggacaaggcctggtggaaatcgttcctcaaccacctcactcggaagaagccggctaccaggatcgtgctgattctccccctggacaagcggcagccgctggccaacgctgggcaacggattgactacgcgtccggcgctgggctgggctccccggcggcacccagattgcgcggagcgggcgaaggtagcgagcgcgagccgaggatgccggtactgctgctgctgcggcggcaagaggcgcggcggccggaagagggcggggccagggcagctctgagctggccgcggctgctctcgcgcttccggtccccggggaaggctccccgcgaagccggccccgccgaggagcagccgcgcaaacggtgccgctgccctcgcccgcagctttaaacgcttggcccggaccccgcccaataaagagtgcgtggcaaccctgg

SEQ ID NO: 61582 - DNA, 752 bp, Homo sapiens
ggggaagccatgtcctacttcaggactccacaaactcatccaggtcctctgccttccggccaaggtggggctgcttctccaggcttgtcccttggcctctgtagtcctgtagagccagtggtggtggcctctggtggaacaggcccactgagccagaaagctgagcaggtggcacctgctgcccaggcctggggcccagccctggcaatgccacaagccaggggctgccctggggggactagctgggagacactacggaaggaatacagccgaaactgccacaaattcccgcatgtgaggcagctggagagcttgggctgggacaatggctactccagaagcagagcccctgacctgggtggccccagcaggcctaggcccctgatgctgtgtgggctgtcaccacgggttctaccggtaccctctgaggcagtggggaaggaggccagctcccagcctgatatctgcatcctcaccctcgccatgatgatcgctggcatccccaccgtgcccgtcccaggagttcgggaagaggacctgatctgggccgctcaagctttcatgatggcccatccggagccagagggtgctgtggagggggcgcggtgggagcaggcacatgcccacacagcctctgggaagatgcccctagtgagatctaaaaggggccagcctcctggctcctgcttgtagatggatgaaatagcaccagatatgtaaaaaaaaaaaaaaaaaaaaaaaaaaaaaaaaaa

SEQ ID NO: 61583 - DNA, 470 bp, Homo sapiens
gggggatttgccccatgggcctaagacataagctgaacctctggcctgcagttccagatccaaggtgactgagacaaactgccggctgccactggcttatcaggagcacctggagatggacgacatgtctcccaggctgagagccttcctctccgaacccattggagaaaaggatgtctgctgggtggatggcatcagccatgagctcgcgatcaatttggtcaccaaaggtatcaataaggcctacatcctgctgggacaattccttctgatgcacaagaatgaagccgagtttcagaggtggctcatttgctgttttggtgccactgagtgtgaggcccagcagacttctcactgcctcaaggagtggtgtgcctgcttcctgtagacacaaacctcattgctgccccccaccaccctctggggaaaatgacgccttctccacaaaaaaaaaaaaaaaaaaaaaaaaa

SEQ ID NO: 61584 - DNA, 629 bp, Homo sapiens
ggggggcctaagacataagctgaacctctggcctgcagttccagatccaaggtgactgagacaaactgccggctgccactggcttatcaggagcacctgaatctgctgacacatcaaggccacttttcttaggagccccctgacttccaaaatcagtgcctttggattcatctcttccgggagagttcagtgtcttctgaaatgttacaaaacgtccttcagagcaagaaggcgtacacgaggagctcgactctgtagaaaggagatggacgacatgtctcccaggctgagagccttcctctccgaacccattggagaaaaggatgtctgctgggtggatggcatcagccatgagctcgcgatcaatttggtcaccaaaggtatcaataaggcctacatcctgctgggacaattccttctgatgcacaagaatgaagccgagtttcagaggtggctcatttgctgttttggtgccactgagtgtgaggcccagcagacttctcactgcctcaaggagtggtgtgcctgcttcctgtagacacaaacctcattgctgccccccaccaccctctggggaaaatgacgccttctccacctgtaaaaaaaaaaaaaaaaaaaaaaaaaaaaaa

SEQ ID NO: 61585 - DNA, 1124 bp, Homo sapiens
ggaagaggccccagcactgacctccgtgggggtggagatgaggaggatggaaagggtgtcttcctccagcatcttcctgaagctcccggataatgagcacccatgtggcaggcctgggcctggacaagatgaagctgggcaatccccagtccttcctggaccaggaggaggcagatgaccagcagctgctggaaccagaggcgtggaagacctacaccgagcgccgcaatgccctgcgtgagttcctgacctcggacctgagtccgcacctgctcaagcgccaccacgcccgcatgcagctgctgcgtaagtgctcctactacatcgaggtcctgcccaagcacctggccctgggcgaccagaacccgctggtgctgcctagcgccttgttccagctcatcgacccctggaagttccagcgcatgaagaaggtgggcacagctcagaccaagatccagctcctgctgctcggggacctgttggaacagctcgaccatggccgtgctgagctggatgccctgctccggtcgccagacccacggcccttcctggccgactgggcgctggtggagcggcggctggcggacgtgtcggccgtcatggacagcttcctgaccatgatggtgccggggcggctacacgtcaagcaccgcctggtgtctgatgtcagtgccaccaagatcccgcacatctggctcatgctgagcaccaagatgcctgtcgtgtttgaccgaaaggcgtcggcggctcaccaggactgggcccggctgcgctggttcgtcaccatccagccagccacatcggagcagtatgagttgcgcttcaggctgctggacccgcggacacagcaggagtgcgcccagtgtggcgtcatccccgtggctgcctgcaccttcgacgtccgaaacctgctgcccaaccgatcctataagttcaccatcaagagggccgagacctccacgctggtgtacgagccctggagggacagcctcaccctgcacaccaagccggagcccctggaggggcccgccctcagccactctgtctgagagatgattttctaatatttatccactaataaagaagagtgtaaatgcacatatggaattaaaaaaaaaaaaaaa

SEQ ID NO: 61586 - DNA, 2786 bp, Homo sapiens
tgaaataggagccaaggtatgctatgagccaaggattatgagtaatccaattttgtgcactttaagccatttgaaaaacagaaaagcaaaacaacaaaataatttttaagaaattgaatatagggtgttatgctctgaatgtgtccccctaaaattaatcaccaatgtcataagattaggaagtagggctttaaggtagtgattcagtcatgaagggagagtgttcacgaatgagtttaggatccttacacaaggactggatggagtgggcttcccctgttttgcccttccaccttctgccatgtgaggacacagtgcatctcctcctgaagacacagtgcacaagataccatcttggatgcagagaccagaccctcaccagacaccaatcctgctggcaccttgatcttggacttctagcctatggaactgtaagattggggaagatgccaggtgatagaatccaccctgcctctgacagcatccaatctggagcaaaggcttatttcaaccctcccccaagctcccaatacaagcccaaattctggaacaggtcctttccaacacctccttcagagaagctccctggctccaggcagtgcttgctcccctcactgcagcaggaagcctaacttgcgaactgcaggtgtgttccaggtggtcactggatgcaaggcattgacagatggatcccatcgatacccccactgcaaaaccatagtgcagtgaatagaagacacttctctgcaccccaaaagctccatgctgattgtgagaaggaaatgctggatggaggggttcctggaactactgtgagggtttcttttgatttctcctgcttagaaatggtgagagaactttggatgtggaacgtggaggaggaggaacacgaagtggggatctccacttggggtggtcagcactgcgggtgcccagcaaagtcactgcctggtccacatcccggaggggtctctgcgcctcagtcggcatcgcagctgatggtgaaacttttggtgtggcagaagagtgtccacaaacttcggaagatcgctgctcagagtgaggaatggagttgtattttgaataaaatatccacgcatccttttgtgagcaaggagcatgatggtacttagacctaccatttctcgttatggtggttgcggttacagtggggctggggtgtttacctggagcctggacatccactgggacatgatacccactgggaattttttgtgtcaatctggtctctgatgtccacctggggattgggtatccacctaaggcctgatgtttacctggagccagatgtgcacctgagacctgatgtctatctgtggccttatgttcccctggggaccgatgcacacctgaaggataggtattcatctggggcctgatacccaccagtagtatgggtgtcaaccttggggctggtgttcagctggcgtccactgtctacttggggcctggtgtacacatggggcctgggcatccacctgagacttgatgtttaatatggtctggagttcttttggggcctgttgtaccctggagcctgggtgtacacctggagcctgatgtcccaggtgaacaactgggtcccaggtgatcttcaggccctaggtgaaaactccaggctctaggtggacaaccaggctccaggctgatgtttactggggccagatgtctaccaggccccaggtgaaatccccaggctccaaatggacaacatagccccaggttccaggtggacattggaatccagatcaacaccaggccccagatggacacccaggcctgtggtggacatcggactgcagaaggtcatctggctcgaggtggacatcgggccccaggtggatgcctggtccccaggtggatatcgggccccacttggacaccagtccctgggtggataccttggcctcgggtggatatccagtctctagctaagcatcaggctccagggggacccaggccctagctgactggggactagtgttcatatggggccacatgtccatctgggccctaggtgtcaacttgtagcctgatgtcaacctggaagctggtgttcaccagagaggactaaggtcctcctggtgcctggtgtccaacttgggactttgtgtccacctggagaccgatgtccacttgggaccggatgtccagctggagcaagatgtccacctgcagcctaaaacttcacctaaggcctgatgttccccagggcctacagagcctatgtatctacctagggacttgtgtccaggtggggcctgaattccacctggggcctggaattaacctgggacctgatgtccacctgagacgtgggtgttcctctggagtctgatatctatctggggcccgggtgtcctcctgtggtctgatgtccacttgtaggctggtgtccacctggggcctgggtgtccacctaggaacctgatgtatacctgaagtccagtgtctacgtgggtactgatgtctaccaggaaagtgatataaacctggggcctgatagccacctgggccctgagtgtccacatatgttctgatttctcttttggcctgagtgtagggcctgagtgccacctgcttcctgacgttcaccaggaacctaggtattcacttgggagccctgggggcctctgcccttttggccgcgttgtctcctggcttttagggtggtgggattctcggctctgattgcagcaggtggattcacttagctctcctccccttttagcattactgtcttctgtaataaacctctcactttg

SEQ ID NO: 61587 - DNA, 579 bp, Homo sapiens
gcaatgccagagggaggcttgtgcaaatattctcatagattctggtgctgatccaaatattgtagatgtgtatggcaacacagctgtccattatgctgttaacagtgagaatttgtcagtggtggcaaaattgctgtcctgtggtacagacattaaagtgaagaacaaggctggccacacaccacttttattggccataaggaaaagaagtgagcaaattgtggaatttttactgacaaaaaaatgcaaatgcaaatggagttgataagtttaaatgcattcatcaacaacttttggaatataaacaaaagatatctaaaaattctcaaaatagtaatccagaaggaacatctgaaggaacacctgacgaggctgcacccttggcggaaagaacacctgacacggctgaaagcttggtggaaagaacacctgacgaataggatacagtgaattcctcttcaaagattttagcctgtaaacatcctttaaaattcaagaggggggaagattaagtacaatgagttctgagttcctcatcaaagaacaaatatgtcagtaaaaaaaaaaaaaaaaaaaaaa

SEQ ID NO: 61588 - DNA, 6218 bp, Homo sapiens
gttaaatctgtggcctttgcatcgaagccatgctttcaagatgtaaaacctatggagctgacaccaggggcccaacagcaaggtataaattatcaagagttgacttcaggatggcaagatgtgaaatcaatgatgttggtaccagagccaactaggaagttcccatcaggaccactgttgactagtgtcagattttcaaatttgtctccagaatcacagcaacaggatgtgaaatctttggagtttactgtagagccaaagttgcaaagcgtaaaacatgtgaaattatcttcagtgtctctgcagcaaactataaaatctgtggaattagcaccagggtcactgcctcaaagagtgaaatatggggagcaaactccaagaacaaattatcaaatcatggaatcctctgaactaatccctagaccagggcatcagtttgcaaaatatgcagagatgatcccacagccaaagtatcaaatccctaaatctgcaaatttgatttcaataccaatttatcacgccacagaatcttcagaaatggcacaaggattggcatataaaggcatagatactgtagagaaatctgtggggttgaccccaaagctaacaggtagagctaaggaatccttagggatgctgctgcagccagatcttcaggtaccaaaatttgttgatctgactccaatggtaagggatcaaggctcaaaattcttaggattaactccagagaaaagctaccaaatcctagaaactatggaattgctctctcagtcacggccccgagttaaggatgtgggggagttatatatgaagccactgcagcaaactgtggaatatgaagggattactccggaactcaagcattactttacagaagctatggggttgaccgctgaggcaaggatacaagcaaatgaattctttggaatgaccccaaagccaacaagtcaagccactggatttgcagagagatccccaaggctctgtcctcaaaacttagaatgtgtggaggtgatctctgagaaaagactgcaaggggaagaatctgtggtattgattccaaagtcattacatcacgtcccagattctgcttcagggatgacacctgggttaggacatcgagttcctgaatctgtggagttgacttctaagtcaggagtgcaggtagagaaaactttgcaattaacccccaaaccacagcatcatgtgggatctccagggataatatcagggttaggacatcaagtcccagaatctgtaaatctgacctgtaagcaatggctacaaatggaggaatctttagaggtgcccctgaagcaaacaagtcaagttataggacatgaagaatctgtagagctcacctctgaggcacggcagcacagggaggtatcaatggggctaacaaagtcaaagaatcaaagtatgaaatctccagggacaaccccaggaccactgggtcgaattgtagaatttatgaggattagtccagagccactagatcaagtcacagaatctgcaaggacacagcttcaagttgctcaatctgaagaggtaatcctcatagatgtcccaaaagttgttcaatctgtgaaagtgacccctggaccaccatttcaaattgtaaagtctgtgacgataccaaggccaacccctcaaatggtagaatatattgagttgactccaaaactgcaatatgtgagaccttcagagcaccacacagggccatgtttgcaagatgtgaaatctacaaaattaatcacaaagccaaaacaccagattttggaaacagtggagttgacagggtttcaaattgtaaaaactatgttaatcccagggccatcccttcaaatcgtaaaatctgaggagttagcaccaggaccaattcctctggttgtagaaccaataggagtagccctagaatcaggaattgaagcaataaattgtgtggatttacttccaaggccacatcttcaagaactgatagtacctgcagaattaactccaagtccatgtactcaagtgaagtctgcagaattaacctcaccgcaaacatctccatttgaggaacatacaatattgactcataaacaagggcttcaggctgtgaaatctacagtgataaaaacagagcctcctaaagttatggaaactgaggatttgaatctaggacacgtgtgtcagaatagggactgtcagaagttaacatcagaagagttacaagtagggactgacttctctaggttcctacaaagctcttcaaccacactcatttcaagctctgtcagaacagcatctgaattaggaggactttgggattctgggatacaggaagtatccagagctttggatataaaaaaccctgggacagatattttgcagcctgaagagacctatatagaccctactatgatacaatctttaacttttcctttggcccttcataatcaaagctccgataagacagctaacattgtggaaaacccatgtcctgagattctaggagtggatgtaatatctaaagagacaactaagaggaagcaaatggaggagctagagaactcacttcagagacatctaccacaaagctggagatcacgatctaggacattccaggcagaatcaggggttcagaaaggtctcatcaagtctttcccgggcaggcaacacaatgtctgggagagtcatgcctggaggcagcgactaccaagaaaatatctctccactatgctaatgctggggaatattttagggaccactatggaaaggaagctttgttctcaaacatctttagcagaaagagccactgcagatacctgtcaatctattcagaatttatttgggattccagctgaactgatggaaccttcccagagcctgccagagaagggtccagttactatttctcagccttctgtggtcaaaaactatattcagagacatactttttatcatggtcataagaaaagaatggccttaaggatatggacacgtggctccacatcttccataatacagcaatactctgggactagagtgagaataaagaagacaaactcaacgttcaatggtatatcccaagaagtcattcaacatatgcctgtctcatgtgcagggggccagcttcctgtcctggtaaagtcagagtcttccctcagcatattttacgatagagaagatcttgttccaatggaagaaagtgaggactcacagagtgattcccagacaaggatttctgagtcccaacactccctcaagccaaattatctttcccaggccaagactgacttctcagaacagttccagttgctagaagatctgcagctaaaaatagcagcaaaactcttaaggagtcaaataccccccgatgtgcctccacctctagcttcaggtctagtcctaaaataccctatctgcctacagtgtggccgatgttcaggacttaattgccatcataaattacagaccacttcggggccttatcttcttatctatccacagctccaccttgtacgcactcctgaaggccatggtgaggttcggttgcatcttggctttaggctgagaattgggaaaagatcccaaatctcaaagtatcgtgaaagagatagacccgtcatacggagaagccctatatcaccatcacaaaggaaagctaaaatctatactcaagcttccaagagtcctacttccacaatagatttgcagtctgggccttcccagtcccctgctcctgtacaagtctacatcaggcgaggacaacgcagcaggcctgacttagtagaaaagacaaaaactagagcacctgggcactatgaattcactcaagttcacaacctaccagagagtgactctgaaagcactcagaatgaaaaacgggctaaagtgagaaccaaaaagacctctgattcaaaatatccaatgaagagaatcaccaagcgacttagaaaacacagaaagttctacacaaacagtagaaccacaatagagagtccttctagggaattagcagcccatttaagaaggaagaggattggagcaactcagacaagtactgcctctttaaaaagacaacctaagaaaccttcccaacccaagttcatgcaactgctttttcagagcctaaagcgggcattccaaacagcacacagagttatagcttctgttgggcggaagcctgtggacgggacaaggccagacaatttgtgggcaagcaaaaactattatccaaaacaaaatgccagggactattgcttaccaagcagtatcaaaagagacaagaggtcagctgacaagctaacgccagcaggctcaaccattaagcaggaggacatattgtggggaggaacggtccagtgcagatcagctcaacagccaagaagagcttactctttccaacccagacctcttcgactgcccaagcccacagattcccaaagtggtattgctttccaaactgcctcagtggggcagcctctgagaactgttcaaaaggacagtagtagcagatcaaagaaaaacttctatagagatgaaacctccagccaggagtctaagaacttgtccacaccaggaaccagagttcaggcccgaggaagaatcctacctggttcccctgtgaagagaacctggcaccgacatcttaaagacaaactcacacacaaggagcataaccaccccagcttctatagggagagaaccccacgcggtccttctgagagaacccgtcacaacccctcttggagaaaccatcgcagtccctctgagagaagccaacgcagttccttggagagaagacatcacagtccctctcagaggagccactgcagtccctctaggaaaaaccattccagtccttctgagagaagctggcgcagtccgtctcagagaaatcactgcagtccccccgagaggagctgtcacagtctctctgaaaggggccttcacagtccctctcagaggagccatcgcggtccctctcagagaagacatcacagtccctcagagagaagccatcgcagtccctcagagagaagccatcgcagttcctctgagagaagacatcgcagtccctcccagaggagccatcgcggtccctcagagagaagccattgcagtccctctgagagaagacatcgcagtccctctcagaggagccatcgtggtccctctgagagaagacatcacagtccctctaagagaagccatcgcagtcccgctcggaggagccatcgcagtccctcagagagaagccatcacagtccctctgagagaagccatcacagtccctctgagagaagacatcacagtccctctgagagaagccattgcagtccctctgagagaagccattgcagtccctctgagagaagacatcgcagtccctctgagagaagacatcacagtccctcagagaaaagccatcacagtccctctgagagaagccatcacagtccctctgagagaagacgtcacagtcccttggagaggagccgtcacagtctcttggagaggagccatcgcagtccctctgagaggagatctcacaggtcctttgagaggagccatcgtaggatttctgagagaagtcacagtccctcagagaagagccacctcagtcccttggaaagaagccgttgcagtccctctgagaggagaggacacagttcctctgggaaaacctgtcacagtccctctgagagaagccatcgcagtccctccgggatgaggcaagggaggacctctgagaggagccatcgcagttcctgtgagagaacccgtcacagtccctctgagatgaggccagggaggccctctgggaggaaccattgcagtccctctgagaggagccgacgcagtccccttaaggagggactcaagtacagtttccctggagagaggcccagccatagtttgtctagagatttcaagaatcaaacaactctcctcgggaccacacataaaaatcccaaagcagggcaagtgtggaggcctgaagctactcgatgaggcgaggtccgcccctattattcattgtcctaagtcttcatcgtgctgccctttccaggcttctttcctgctcagccactgcctccaattcctgcgcccccagcgtggaaaggcttccatttctctctaccgggggggaggcgggtgagaatgggtctgtaatttctctaagatgaataaaggggcagtaaataaaaaaaaaaaaaaaaaaa

SEQ ID NO: 61589 - DNA, 4700 bp, Homo sapiens
gtccgcccgggcgcggcccagtgaggcggtggccgagtcctctggcctcagacgcgtaggctggcagcccgctgagcccgccagactccgccgccgtcgggagccggccgctgggagcccgtcgctatgggaccgcgctgagccgcccgctggcgggggagcagcgcggtcgaggatggaggggccggcagagtggggccccgaggcggcgctgggccccgaggcggtgctgcgcttcctggcggagcgcgggggccgggccctgcacgccgagctggtgcagcacttcaggggcgccctgggcggcgaaccggagcagcgcgcccgcgcccgcgcgcacttcaaggagctggtgaacgccgtggccactgtgcgcgtcgatcccgccgacggcgccaagtacgtgcacctcaagaagaggttctgtgaagggccgtccgagccctccggggacccgccgcgaatccaggtgaccgccgagcccgaggcccccgacggccctgccgggcccgaggcgcgcgatcggctccccgacgcggcggccccggagtcgctccctggacagggccgcgagctgggcgagggagagccccccgcccccgcgcactggccgcccctgagcgccggggctcgcaggaagaactcgcggcgcgacgtgcagcccctaccgcggactccagccccggggcccagcgaggacctggagctcccgccacatggctgcgaggaggcggacaggggcagctcccttgtgggggctaccgcacagaggccggcccgccagaacctccgtgacctggtgatgggcagctccccgcagctgaagaggagcgtgtgtcccgggggcagcagcccgggcagctcctccgggggaggacgcggcagaggcgggggcgactcagacagcgcatcggtggcctcgtcgtccgcggaggaggagagcagcggcggaggctccgtgacgctggaccccctggagcacgcgtggatgctctctgcctccgatggcaagtgggacagcctggagggcttgctcacctgcgagcccggcctgctggtcaagcgggacttcattaccggcttcacttgcctgcactgggccgccaagcacggcaggcaggagcttctggccatgctagtcaacttcgccaacaaacaccagctgccggtgaacatcgacgccaggacgagcgggggttacaccgccctgcacttggcagccatgcacggccacgtggaggtggtgaagctgctggtgggggcctacgacgccgatgtggacatcagggactacagtgggaaaaaggcctcccagtacctgagtcggagcatcgccgaggagatcaagaacctggtgggagccctggacgagggtgacggggaaagcgccgcgggtagcggcggcgggcgctggaggctttcaaaggtgcttccctcgcatctcatcacctacaaactctcacacgccctagaagatggaggggaccatcaccaccatcaccactcggctgaggggtgggtcggaggcaaagccaaggatccagggcgcaaagcctcgggcagctctagtggacgtataaaacccagactcaacaaaatccgattcagaacccagatcgtccacaccacaccctctttcagggacccagagcagccgctggagggcaggggggaggagggagtgggggaggaacgacctgttaaaggccactcgcccttcacattgagaccaaagtccaatgtatttgggtaaaaattgcttcttttagaaaatgcaaaggtttatttgtcttaataaattgaatactaggtgttgtaaggaagtgagaccagaaggacaagctaaattatgcattcttacttgagggatcggaatggatggggcggagttctcttcaggctagccttctgggaaaagtggatgtctttttcagagattcatcataccttgacctgtacctcttctctgccctccacttccctgccctggagtccgtttctggagactagaaatgtatctaaattgggggaacagaatgaatgaattaatgaatgagagttcctttgctttaaccattcctggatgcctgcaaagtaaggaataatgcagtttttatgtatctgattttataaggggttactctttcaagagtaacaaaaaaatgcaaactgtaatgaaactacattgtatttctaagtgtgaaaacgacaggctgccccgtttttactaattgcatttgcattttaaggtactactgaaggtcagatcaaagttgaaatgcaaaaatactaattagagaataatgtgaataaaatgggaatcttcttggtattttatgtgtattgtaagtagcagttaaattatttttttaaaagcaatttcagttttaatcactgaacaaaagaaacaggcaacattcacttctgtagtatggtttccacctatctctaacaccactattaaggtacaccagtgttaaggtacattaataactacacaaaattttatttaaagagaacacttagcagcctatgatagttttcaataaaatgttgcctctctttcggattctcactaacttttgttactattctaaaagtttgaatttgctggggtgtttattctgaggattatttaaccattgttctatttggcataaccctatttaatggtgcttagagctgaattacctacagaaactgtttctggtttaaataattagcacaaattggcctaagtattcatgagcccatgtttctgtgaagtaattattaaaccaacttaatgattcttatgtaaggtacactttttattttaatacattggtagtctctatgacttgtagcaatgttttacaaatgtttaaaatgctaaacttaattttccaagcttttcttgacaattagatacctatcctgtagttactgaaaatctgggtagtaaatctacccaattaaaatggcactttataaaagggaatagagaagagatgggactatttctatatttaaatgctgctggctattcctttgtatataaatgaaaaataccattcattaaaattaagtactcgtttaagtatggttcttaattacatttcattcatttatattagagtaaatggcttcataactactttaaaatttaacccacaagcatattaaatctgtttgttataagattggaaacaatttttgagagggactaatttaaacaagtcctcctttagtcttttgggtcgcgtagttgctgaaacctaagtacctgcagcctacaggataaggaagttcacagcctgcggggtgaatgaacccatgtgtgaactgcacagagcaattcatagaaaatgcatagaaatttgtaacactttggtcacatctgtctctagatggtcattgaatttgtttaaagatggatgaaaggccaggcatggtggctcatgcctgtaatcccagcactttgggaggccgaggcaggtggatcacttgaggccaggagtttgaaaccagcctggccaacatggtgaaaacctgtctctactaaaaatacaaaaattagccgagcgtggtggtgcgtgcctgtagtcccagctacttaggaggctgaggcatgagaatcacttaaacctgagaggtggaggttgcagttgagccaagatcacgacactgcactccagcctgggcaacggagactctgtctcaaaaaaaaaaaaaaaaaagatgaatgaaaatatgaaatatataaactagtatccatttatttgcatttattgtgggatttcagatatgaacggtgtaaatttgagaagcacttatgcatacatgtgggtgaaaaaccaatctaattttgtataaataaaaacaggctcctggaaggtgaaaagtagtcatttgttctaaatctatacatattacttgtatctagtgcagaataagctataacatcccattgaggaatcttaaatttcatagacatgtaaagctgaagtaactctaaagagcagatgcttcagaaccatcagaaggttctggtcaacagtcagtattatctcttaaatgtatatgttggtcactaattgcacaaaatctataatttgccagggctttagagattgagtcaatatgtcatttaccatggttttcccactgaaggctttaacttttctgataaaataatattttaaattttcaaaaacccattcctgaggagaactacttctagcattccttttcatgatgtgcttttgtgcagtaagtagcattttcggctacttaactttacattcctcttatttttcagtttccagtcaagattataaaaagcaaatgattgatataatttgatattcatagagttgtgcctacctttaatggaaaaatacatgtcagatacttagatgtttattgatatgagactatgtggttaaaaaacccaagtatgtccatgtgtttcttataaggtacacttgaaactagtgagtgtttgtcacatttcactttcatggtatataaaatgcagtttgcatatataacttgaatatctggtactagttttttcacgcctgcaatcttggagtctaggttgccttgtctctcctatttttaaataagtgaaatttgggagattgtaaaatctgtaaagtttgttttgtgaaaataaaatgttcacagtaaaaaaaaaaaaaaaaaaaaaaaaaaaa

SEQ ID NO: 61590 - DNA, 3300 bp, Homo sapiens
aacacaacctggagtagcccatgccatactgtgtccttttaagtcagtaaattgaactaagtcggttattcggcaagcagttcctataaaaaactacatggctaagatgtacacgttggataattccatgcccatcttggcattgcgaccaggagcttctgcatcccttgcttccaaagagaaccagtgaaacatctttttattcttgcaggttcttaatgattgaccacaagcagatctttcaccctcggatctctagctacaaaaggaaccactggctcaatgacctgtaagggccgtttcagcacatccattctgtccatctccaagccttcaccgtagggaagaacttttgctctcagtcacctctcagagagctctctttatagctgaaggtccctctcatgagttacatcaagagtaacctagaattatatcagcaatacacagccatggcccccaagctactggcccgcatctccaaactcctcatgatctgccagaatgcaggcatttctgtaccaaaaggcatcagaaacatctttgagttcacttgggaagagctcatcagtgacccttcagtgcctaccccgtccgacatcttgggcctggaggtcagctttggagcccccctggtggtgctcatggaacccacctttgtgcaggtccccacactgaagaagccactacctccaccaccaccagcaccaccacgtccagtgctgctggcaaccactggggcagccaagcgctccaccctctctcccaccatggcccgtcaggtgcgcacccaccaggagaccctgaacaggtttcagcagcagtccatccacctgctgacggagctcctcagactgaagatgaaggccatggtggagtctatgtcggtgggtgccaaccccttggacatcaccaggcgctttgtggaggccagccagctcctccacctcaatgccaaggagatggccttcaactgcctgatcagcacagccgggagaagtggctacagcagcggacagttgtggaaagagtccctcgcaaacatgtccgccattggggtgaactcgccttaccagctgatctaccactcttccacagcctgtctgagcttttctctctctgctggaaaagaagccaagaagaaaataggcaaatctagaactacagaagatgtcagcatgccgcccctgcatcgaggagtgggaacccctgccaacagcctggagttcagcgacccctgccctgaggcccgggagaagctgcaggagttgtgtcgccacatagaagctgaaaggaccacatggaaagggaggaatatctcctaccccatgatcttacgaaactacaaggcaaagatgccctctcatctaatgttggcccgcaaaggagactctcagaccccgggtttacattaccctcccactgcaggtgctcagactctcagccccacctctcacccatcttctgccaaccatcatttcagtcagcattgtcaagaggggaaggcacccaagaaggccttcaagtttcattacaccttctatgatggctcctccttcgtttactatccctctggaaacgtcgctgtatgtcagatccccacatgctgcagagggagaaccgtcacctgcctctttaatgacatacctggattctccttgctggccgtattcaatactgaaggccagggctgtgttcactacaacctaaaaaccagttgcccatatgtcttaatcttggatgaggaaggtgggaccaccaatgaccagcagggctatgtagtccacaagtggagctggacttccaggacagagaccctgctttccctggaatacaaggtgaatgaggaaatgaaactaaaggtactgggacaggactccatcacagtcaccttcacctccctgaatgagacagtaacactcactgtgtcggccaacaattgtccccatggaatggcatatgacaaacggctgaaccgcagaatcagcaacatggacgacaaggtgtataagatgagccgagccctggctgagatcaagaagcggtttcagaagacagtgactcagttcattaattctatcttgctggccgcaggtctgtttaccattgaatatcccaccaaaaaggaggaggaagaatttgttcggttcaagatgagatccagaactcatcccgagcggctccccaagctaagtttatactcaggagaaagtcttttacgatctcagtcaggccacctggaatcctcaattgcagagactttgaaggatgagcctgagtctgctcctgtgagcccagttcggaagaccaccaaaatccacaccaaagccaaggtcacatccagagggaaggcccgcgaggggcgcagccccaccaggtgggcggccttgccctcagactgcccgctggtgctgcggaagctcatgctcaaggaagacacccgtgctggctgcaagtgcctggtgaaggcgcccctggtctctgacgtggagctggagcgcttcctgttggcgccccgagaccccagccaagtgctggtgtttgggatcatctcaagccagaactacaccagcactgggcagctccagtggctgctgaacactctctacaaccaccagcagcggggccgtggctccccctgcatccagtgccggtatgactcctaccgcctgctgcagtatgacctggacagccccctgcaggaggaccctcccctgatggtgaagaagaactctgtggtgcaggggatgattctgatgtttgccggggggaagctcatttttgggggccgtgttttgaatggatatggcctcagcaagcagaatctgctgaaacagatcttccggtctcaacaggattacaagatgggctacttcctgccggatgactacaaattcagtgttcccaactctgtcctgagcctggaggattctgaatcagtcaagaaagccgagtcagaagatatccaaggaagcagctcctcattggccctggaagactatgtggagaaggagttatctctggaggctgagaagacaagagagcctgaagtggagctacatcctctcagcagggacagcaagataactagttggaagaagcaggcctccaagaagtagcgccatcctggcagcagccaagtgagccaggccccggcccggggtgctggggcttcttgccagcccagccctgcctccccggtctcccaccctgtcctccaagcttctataataaaccagcgggcctccagcattggggtgaggctctggggaaggacaaaaaaaaaaaaaaaaaaaaaaa

SEQ ID NO: 61591 - DNA, 662 bp, Homo sapiens
gtcgcgcgaggttttggtttgtgaggatcggcgagtggcgcccaccatctctgcttgctgaaaagctgcagaggccgccaggagcccacgcacctgagacttttacctttacccagaaaggaataaaagaggtcagatgatgacagctgtgtccttaacaaccaggccccaggaatcagtggcttttgaggacgtggctgtgtacttcactacgaaggaatgggccatcatggtgcctgccgagagggccttgtacagggatgtgatgctggagaactatgaggctgtggcctttgtagtgccacccacttccaaaccagctttggtctctcatctggagcaagggaaagagtcctgtttcacccagccacagggagtcctaagcaggaatgactggagagcaggctggataggatacttggaactaagaagatatacttacttagctaaagcagtgttacgtagaatagtatcaaaaatttttcgaaatcgtcaatgctgggaagacaggagaaaagcttaattcttgacatttaaataccagttttccaagtaaggagttgatgtaagagccaccttaaacgatgtcaaatacacattttctttttctgtagactggtagatttaatgtttttcattcattaaaataactcattttgatg

SEQ ID NO: 61592 - DNA, 6767 bp, Homo sapiens
agctcagccctacatagatcggcttctgccatggcctccaaacaaaccaaaaagaaagaggtgcatcgtatcaactcggcgcacggatcggataaatcgaaagatttctatccttttggcagtaatgtacaatctggttctactgaacaaaagaaggggaaattcccactctggccagagtggagtgaagctgacataaattcagaaaagtgggatgcaggcaaaggtgcaaaagaaaaggacaaaacaggaaaaagccctgtatttcatttttttgaggaccctgaaggaaagattgagttaccaccatccttgaaaatttattcctggaaacgtccacaagatattttatttagtcagactccagtagttgtgaaaaatgaaatcacgtttgacttattttcagcaaatgaacatttactctgcagcgagctgatgagatggattatcagtgaaatctatgcagtgtggaagatcttcaatggaggaattttgagcaattattttaaggggacttcaggggaacctcctcttctcccctggaagccctgggaacacatatactctctgtgcaaggctgtgaagggtcatatgcctttgttcaatagctatggaaagtatgttgtgaaactttactggatgcccgggatatatggacaaagtttgggagctcctgaaagaaatattgcctgagtttaagctgtcagatgaggccagctctgaaagcaaaatagcagtgttagattctaaattaaaagaaccagggaaagaagggaaggagggaaaagaaataaaggatggaaaggaagtaaaagacgtgaaggaattcaaacctgaaagttctttgacaacactaaaggctcctgagaaaagcgacaaagttccaaaggagaaagcagatgcaagagacattggaaagaagagaagcaaagatggagaaaaagaaaaattcaaattctcacttcatggttcaagaccctcatcagaagtgcagtactctgtgcagtccctatcagattgttcttctgcaatacagacctctcatatggtcgtatatgcgacatttacacctctttatttgtttgaaaacaagatcttttcattagagaagatggcagattctgctgagaaacttagagaatatgggctttcccacatctgtagccatcctgtgctggtgactagaagtaggtcttgtcctctggtagcaccaccaaaaccacctcctctacctccctggaaactcattcgtcaaaaaaaggaaactgttataacagatgaagctcaagagttaatagtaaagaagcctgaacggttccttgagatttcaagtccatttttgaattatagaatgactccatttacaattccaacagaaatgcattttgtgcgctccttaattaagaaaggaatacctccaggatctgatttaccttccgtcagtgaaactgatgaaactgcaacacatagccagacagacttgagtcaaataacaaaagctacatctcaggcacagatgaacaaacagactttggattgggtgatgctcatcagagtgatggattaaacttggaaagagagatagtcagccagaccacagcaacacaggaaaagtcacaggaagaacttccaacaacaaataatagtgtttctaaagaaatatggttagattttgaagatttctgtgtatgctttcaaaatatatatattttccacaagccaagttcatattgccttaactttcaaaaatcagaatttaagttctcagaagaacgagtgtcctactatctatttgtagatagtctaaaacctattgaactactggtttgcttttctgcattggtacgctggggggagtatggagccttaacaaaagacagtcctcccatagagcctggacttctcacagctgaaacgttttcttggaaatccctgaaaccaggcagtcttgttctgaagattcacacatatgctaccaaggctacagtggttcgtctgcctgttgggtatgaagtggcttcatttttcccataataaaaattgtttgaaggcttgcaaattgttggttactaaagaagtaaacaatatggactctaagacattgtttctcaaagcaatttctcaaggcataggtccatgattattattcttgagaaaaatatttccaaaaaactacattgagaaatactgtacaatgaatatccctttgggagattcataattgtcaaagattctgggaatatatttagtcaacaatactgcttgagcttgtttaacccagcattttctaaaattaatttataaatattatacacataacatttataatactttagtatgaattttctcataaatatttcttataagttttctcaccaatataatacttagcaaaaaccttgattttatttaaatgcaaattgagaaatatgcattttcccctaccaatctagattttcttgtggcttatttttgttagatattatttttaattcagataaagctggttaaacacattagtttcaattttaaagaaaatacatataatggaaaagattttattttgatgaataaaattcaaaatattacctcaaatttcagaagaaatattttcactaggctttgaaataaacattttcactagcttttacttttttcccaagatcaatcatgctaattctatgtgatcaatgaaaagctatgtctcttatgcaaaaagcaaagcctcagcaacaaatgctaaaataattgtgtcaagcatctagtacttctacaaaatactacattttgaaactctgacatttctcacatctcccctttatactccagcaaatcaaattactctgtctgagtgcttattcatttgagacaaccaaggacaaggaatttaataaagattcttcttatatccgcttttccccccacagaacctaaaccatcaacatgtatgttttgaacatgctctaaatctgcagtccccaactccagagccatggactggtcctggtccgaggcctgttaggaactgggccatgcagcaggaggttagcggtgcctgagctctgcctcctgtcagatcagcagcagcattagagtctcataggagcgggaatcctattgtgaactgcatatgcaagggatccaggttggacactccttataagaatctaatgcctgatgatctgaggtggaacagtttcatcctgaaaccatccccaaaccaagtccatggaaatattgtcttttgtgaaaccagtccttggtgccaaaaagaatggggatggctgctctaaatgctcaataactggaggaccatgaatatccctgctctcacgatacgacaacctggtagaggagacacgattaacatacatgaaatgatgcatttgtgagaaaaagactaggaagtctacacagccctatacctgcttgagtttttcttgttgttagggagaaatcaagactagtcttcacaccatgactgcagtgtgtgggaggtcactccagcatgtactgcagagaagtttggtatttagcctaactatttttgtcctacataataagtaaagcgtagatttcatgatcccgtagggttcttatagagtgcaaattcaaagatccttatctcatctgtgttaaaaattgaactcttccctaaccttttacttcatttgagttccaaagtgtgaataagcaactcacaggtcaaatgccaccacccaggaagcactcggttatcatccggcatcccttctctttaggagacacatgctactcttcaacgcatactccccagtaggacactccatacacatctgcagcatggtgtcatttgtcattggggatgaacacgttgtactgcccaactttgaaccagagagctgccgatttacggaacagtctctgttgattatgaaagctattggaaatgtgattgctaatttcaaagataagggtaaactctctgcagctttgaaggatctgcaaacagctcactaccctgtccccttccatgataaagaactaactgcacagcacttcagggtttttcatctttccttatggcgtttaatgaaaaaagttcaaataacaaaacctcctccaaacttcaaatttgcattccgggctatggttttggacttggagttactcaattcctccttggaagaggtttctttagtggaatggctggacgttaaatattgtatgcccacaagtgataaagagtattctgctgaggaagtagcagcagcaattaaaattcaagccatgtggagaggaacttacgttagattgcttatgaaagccagaataccagacacaaaagaaaatatcagtgttgcagatactcttcaaaaagtttgggctgtattggaaatgaatttagaacagtatgcagtttctctcttaagactaatgtttaaaagcaagtgcaagtctttggaatcttatccatgctatcaagatgaagaaactaagattgcttttgcagattatactgtgacttatcaagaacagccaccaaattcttggtttatagtattcagagaaacatttttggttcatcaagacatgattttggttcccaaagtatatactacacttccaatctgtatcctacacattgttaataatgacacaatggagcaagtgccaaaggtgttccaaaaagtggtgccttatctttataccaagaataagaagggatacacttttgtggcggaagcatttacaggcgacacatatgtagcagcctcacgatggaaactgcgtctcatcggttcttctgctccactgccatgcctctctcgagactctccatgcaattcctttgccataaaggaaatccgagattactacatacccaatgataagaaaattttattcaggtattcggttaaagttctaacaccacaacctgctacaatacaggtacgcacatccaaaccagatgcattcatcaagctgcaggtcctagaaaatgaagaaactatggtgagctccactggaaaaggccaagctataatcccagcatttcacttcttgaagagtgagaaaggtttgagctcccagtctagcaagcacattctttcatttcactctgcatccaagaaagagcaagaagtgtatgttaagaagaaagctgctcagggaattcagaaatcccccaagggtagagctgtaagtgcaatacaagacattggtctaccccttgtggaggaggaaactaccagtacacccactagagaagacagttccagcacaccactgcagaattacaagtatattatacagtgttcggtgttgtataacagttggcctctcactgaaagccagctgacatttgttcaagcactgaaagacttaaagaaaagtaataccaaagcttatggtgaaagacacgaggagttaattaacttaggaagcccagactcccacactattagtgagggacaaaaatcttcagtaacttccaaaacaacaaggaaaggcaaagaaaagtcttctgagaaagaaaagacagccaaagaaaaacaagcacctcgctttgagcctcagatatccactgttcaccctcaacaagaagacccaaataaaccctactggattttgaggttggtcactgaacacaatgaatcagaattatttgaagtgaaaaaggatacagaaagggcagatgaaatccgagccatgaaacaagcctgggagacaactgagccaggaagagcaatcaaggcttctcaggctcgtttgcattaccttagcgggttcattaagaaaacatctgatgctgagagtccgcctatatctgaaagccaaactaaaccaaaagaagaagtagaaacagctgcacgtggcgtaaaagaaccaaactcaaagaattctgcaggttcagagagcaaagagatgacacaaacaggatcagggagtgcggtgtggaagaagtggcaattgaccaaaggcttgagggatgtggcaaaatccacgagtagcgaaagtggaggagtgtcttcaccagggaaagaagagcgcgagcagagcacacggaaggaaaacattcaaacaggacctcgtacacgatctccaacaattttggaaacatctccacgacttattcgaaaagcactagaatttatggatttaagtcaatatgttcggaaaacagatacagatcctctgctgcaaacagatgaattgaatcagcagcaggcaatgcaaaaggcggaagaaattcatcagtttcgacagcataggaccagagtccttagcattcgaaacattgaccaagaagagcggttgaagttaaaggatgaagtcctggatatgtataaggaaatgcaggactccttagatgaagcccgacagaaaattttcgacatccgggaagagtacagaaacaaattgctggaagctgagcacctaaagctggaaactctggctgctcaggaagcagccatgaagctggagacagaaaagatgaccccagctcctgacacacagaaaaaaaagaaaggaaagaaaaagtaaccaggggatgtccaatactaccctgcttctggagagaaaaaatctatttgtaatgatctttaactgcctgctgttaagatattaggccaaatgaaaatagaaatttctctttcttagaaatattttaatgctaacttgttagttttcctcagaaagctagtatttgaagccatttgagtttaagatgctctaatttcaataaaatagcttccaaatatttaataaaatatgtttgacac

SEQ ID NO: 61593 - DNA, 1555 bp, Homo sapiens
gaaattccaacggcatcgcactgtgcggcctcttctgaggttcctctctcattgggcagggatgtgttcttcctcggtctcatcattgcatctctagcactagtgggagatgtcaataagtgtttaatgaatgaatgcatgaacatgccacaccagtgacctcagcttatggtgaaagacacgaggagttaattaacttaggaagcccagactcccacactattagtgagggacaaaaatcttcagtaacttccaaaacaacaaggaaaggcaaagaaaagtcttctgagaaagaaaagacagccaaagaaaaacaagcacctcgctttgagcctcagatatccactgttcaccctcaacaagaagacccaaataaaccctactggattttgaggttggtcactgaacacaatgaatcagaattatttgaagtgaaaaaggatacagaaagggcagatgaaatccgagccatgaaacaagcctgggagacaactgagccaggaagagcaatcaaggcttctcaggctcgtttgcattaccttagcgggttcattaagaaaacatctgatgctgagagtccgcctatatctgaaagccaaactaaaccaaaagaagaagtagaaacagctgcacgtggcgtaaaagaaccaaactcaaagaattctgcaggttcagagagcaaagagatgacacaaacaggatcagggagtgcggtgtggaagaagtggcaattgaccaaaggcttgagggatgtggcaaaatccacgagtagcgaaagtggaggagtgtcttcaccagggaaagaagagcgcgagcagagcacacggaaggaaaacattcaaacaggacctcgtacacgatctccaacaattttggaaacatctccacgacttattcgaaaagcactagaatttatggatttaagtcaatatgttcggaaaacagatacagatcctctgctgcaaacagatgaattgaatcagcagcaggcaatgcaaaaggcggaagaaattcatcagtttcgacagcataggaccagagtccttagcattcgaaacattgaccaagaagagcggttgaagttaaaggatgaagtcctggatatgtataaggaaatgcaggactccttagatgaagcccgacagaaaattttcgacatccgggaagagtacagaaacaaattgctggaagctgagcacctaaagctggaagctctctctgctcaggaagccgccatgaagctggagacagaaaagatgaccccagctcctgacacacagaaaaaaaagaaaggaaagaaaaagtaaccaggggatgtccaataccaccctgcttctggagagaaaaaatttatttgtaatgatctttaactgcctgctgataagatattgggccaactgaaaatagaaattgttctttcttagaaatattttaatgctaacttgttagttttcctcagaaagctagtatttgaagccattcgagtttaagatgctctaatttcaataaaatagcttccaaatatttaaaatgtaataaaatatatgtttgacac

SEQ ID NO: 61594 - DNA, 6767 bp, Homo sapiens
agctcagccctacatagatcggcttctgccatggcctccaaacaaaccaaaaagaaagaggtgcatcgtatcaactcggcgcacggatcggataaatcgaaagatttctatccttttggcagtaatgtacaatctggttctactgaacaaaagaaggggaaattcccactctggccagagtggagtgaagctgacataaattcagaaaagtgggatgcaggcaaaggtgcaaaagaaaaggacaaaacaggaaaaagccctgtatttcatttttttgaggaccctgaaggaaagattgagttaccaccatccttgaaaatttattcctggaaacgtccacaagatattttatttagtcagactccagtagttgtgaaaaatgaaatcacgtttgacttattttcagcaaatgaacatttactctgcagcgagctgatgagatggattatcagtgaaatctatgcagtgtggaagatcttcaatggaggaattttgagcaattattttaaggggacttcaggggaacctcctcttctcccctggaagccctgggaacacatatactctctgtgcaaggctgtgaagggtcatatgcctttgttcaatagctatggaaagtatgttgtgaaactttactggatgcccgggatatatggacaaagtttgggagctcctgaaagaaatattgcctgagtttaagctgtcagatgaggccagctctgaaagcaaaatagcagtgttagattctaaattaaaagaaccagggaaagaagggaaggagggaaaagaaataaaggatggaaaggaagtaaaagacgtgaaggaattcaaacctgaaagttctttgacaacactaaaggctcctgagaaaagcgacaaagttccaaaggagaaagcagatgcaagagacattggaaagaagagaagcaaagatggagaaaaagaaaaattcaaattctcacttcatggttcaagaccctcatcagaagtgcagtactctgtgcagtccctatcagattgttcttctgcaatacagacctctcatatggtcgtatatgcgacatttacacctctttatttgtttgaaaacaagatcttttcattagagaagatggcagattctgctgagaaacttagagaatatgggctttcccacatctgtagccatcctgtgctggtgactagaagtaggtcttgtcctctggtagcaccaccaaaaccacctcctctacctccctggaaactcattcgtcaaaaaaaggaaactgttataacagatgaagctcaagagttaatagtaaagaagcctgaacggttccttgagatttcaagtccatttttgaattatagaatgactccatttacaattccaacagaaatgcattttgtgcgctccttaattaagaaaggaatacctccaggatctgatttaccttccgtcagtgaaactgatgaaactgcaacacatagccagacagacttgagtcaaataacaaaagctacatctcaggcacagatgaacaaacagactttggattgggtgatgctcatcagagtgatggattaaacttggaaagagagatagtcagccagaccacagcaacacaggaaaagtcacaggaagaacttccaacaacaaataatagtgtttctaaagaaatatggttagattttgaagatttctgtgtatgctttcaaaatatatatattttccacaagccaagttcatattgccttaactttcaaaaatcagaatttaagttctcagaagaacgagtgtcctactatctatttgtagatagtctaaaacctattgaactactggtttgcttttctgcattggtacgctggggggagtatggagccttaacaaaagacagtcctcccatagagcctggacttctcacagctgaaacgttttcttggaaatccctgaaaccaggcagtcttgttctgaagattcacacatatgctaccaaggctacagtggttcgtctgcctgttgggtatgaagtggcttcatttttcccataataaaaattgtttgaaggcttgcaaattgttggttactaaagaagtaaacaatatggactctaagacattgtttctcaaagcaatttctcaaggcataggtccatgattattattcttgagaaaaatatttccaaaaaactacattgagaaatactgtacaatgaatatccctttgggagattcataattgtcaaagattctgggaatatatttagtcaacaatactgcttgagcttgtttaacccagcattttctaaaattaatttataaatattatacacataacatttataatactttagtatgaattttctcataaatatttcttataagttttctcaccaatataatacttagcaaaaaccttgattttatttaaatgcaaattgagaaatatgcattttcccctaccaatctagattttcttgtggcttatttttgttagatattatttttaattcagataaagctggttaaacacattagtttcaattttaaagaaaatacatataatggaaaagattttattttgatgaataaaattcaaaatattacctcaaatttcagaagaaatattttcactaggctttgaaataaacattttcactagcttttacttttttcccaagatcaatcatgctaattctatgtgatcaatgaaaagctatgtctcttatgcaaaaagcaaagcctcagcaacaaatgctaaaataattgtgtcaagcatctagtacttctacaaaatactacattttgaaactctgacatttctcacatctcccctttatactccagcaaatcaaattactctgtctgagtgcttattcatttgagacaaccaaggacaaggaatttaataaagattcttcttatatccgcttttccccccacagaacctaaaccatcaacatgtatgttttgaacatgctctaaatctgcagtccccaactccagagccatggactggtcctggtccgaggcctgttaggaactgggccatgcagcaggaggttagcggtgcctgagctctgcctcctgtcagatcagcagcagcattagagtctcataggagcgggaatcctattgtgaactgcacatgcaagggatccaggttggacactccttataagaatctaatgcctgatgatctgaggtggaacagtttcatcctgaaaccatccccaaaccaagtccatggaaatattgtcttttgtgaaaccagtccttggtgccaaaaagaatggggatggctgctctaaatgctcaataactggaggaccatgaatatccctgctctcacgatacgacaacctggtagaggagacacgattaacatacatgaaatgatgcatttgtgagaaaaagactaggaagtctacacagccctatacctgcttgagtttttcttgttgttagggagaaatcaagactagtcttcacaccatgactgcagtgtgtgggaggtcactccagcatgtactgcagagaagtttggtatttagcctaactatttttgtcctacataataagtaaagcgtagatttcatgatcccgtagggttcttatagagtgcaaattcaaagatccttatctcatctgtgttaaaaattgaactcttccctaaccttttacttcatttgagttccaaagtgtgaataagcaactcacaggtcaaatgccaccacccaggaagcactcggttatcatccggcatcccttctctttaggagacacatgctactcttcaacgcatactccccagtaggacactccatacacatctgcagcatggtgtcatttgtcattggggatgaacacgttgtactgcccaactttgaaccagagagctgccgatttacggaacagtctctgttgattatgaaagctattggaaatgtgattgctaatttcaaagataagggtaaactctctgcagctttgaaggatctgcaaacagctcactaccctgtccccttccatgataaagaactaactgcacagcacttcagggtttttcatctttccttatggcgtttaatgaaaaaagttcaaataacaaaacctcctccaaacttcaaatttgcattccgggctatggttttggacttggagttactcaattcctccttggaagaggtttctttagtggaatggctggacgttaaatattgtatgcccacaagtgataaagagtattctgctgaggaagtagcagcagcaattaaaattcaagccatgtggagaggaacttacgttagattgcttatgaaagccagaataccagacacaaaagaaaatatcagtgttgcagatactcttcaaaaagtttgggctgtattggaaatgaatttagaacagtatgcagtttctctcttaagactaatgtttaaaagcaagtgcaagtctttggaatcttatccatgctatcaagatgaagaaactaagattgcttttgcagattatactgtgacttatcaagaacagccaccaaattcttggtttatagtattcagagaaacatttttggttcatcaagacatgattttggttcccaaagtatatactacacttccaatctgtatcctacacattgttaataatgacacaatggagcaagtgccaaaggtgttccaaaaagtggtgccttatctttataccaagaataagaagggatacacttttgtggcggaagcatttacaggcgacacatatgtagcagcctcacgatggaaactgcgtctcatcggttcttctgctccactgccatgcctctctcgagactctccatgcaattcctttgccataaaggaaatccgagattactacatacccaatgataagaaaattttattcaggtattcggttaaagttctaacaccacaacctgctacaatacaggtacgcacatccaaaccagatgcattcatcaagctgcaggtcctagaaaatgaagaaactatggtgagctccactggaaaaggccaagctataatcccagcatttcacttcttgaagagtgagaaaggtttgagctcccagtctagcaagcacattctttcatttcactctgcatccaagaaagagcaagaagtgtatgttaagaagaaagctgctcagggaattcagaaatcccccaagggtagagctgtaagtgcaatacaagacattggtctaccccttgtggaggaggaaactaccagtacacccactagagaagacagttccagcacaccactgcagaattacaagtatattatacagtgttcggtgttgtataacagttggcctctcactgaaagccagctgacatttgttcaagcactgaaagacttaaagaaaagtaataccaaagcttatggtgaaagacacgaggagttaattaacttaggaagcccagactcccacactattagtgagggacaaaaatcttcagtaacttccaaaacaacaaggaaaggcaaagaaaagtcttctgagaaagaaaagacagccaaagaaaaacaagcacctcgctttgagcctcagatatccactgttcaccctcaacaagaagacccaaataaaccctactggattttgaggttggtcactgaacacaatgaatcagaattatttgaagtgaaaaaggatacagaaagggcagatgaaatccgagccatgaaacaagcctgggagacaactgagccaggaagagcaatcaaggcttctcaggctcgtttgcattaccttagcgggttcattaagaaaacatctgatgctgagagtccgcctatatctgaaagccaaactaaaccaaaagaagaagtagaaacagctgcacgtggcgtaaaagaaccaaactcaaagaattctgcaggttcagagagcaaagagatgacacaaacaggatcagggagtgcggtgtggaagaagtggcaattgaccaaaggcttgagggatgtggcaaaatccacgagtagcgaaagtggaggagtgtcttcaccagggaaagaagagcgcgagcagagcacacggaaggaaaacattcaaacaggacctcgtacacgatctccaacaattttggaaacatctccacgacttattcgaaaagcactagaatttatggatttaagtcaatatgttcggaaaacagatacagatcctctgctgcaaacagatgaattgaatcagcagcaggcaatgcaaaaggcggaagaaattcatcagtttcgacagcataggaccagagtccttagcattcgaaacattgaccaagaagagcggttgaagttaaaggatgaagtcctggatatgtataaggaaatgcaggactccttagatgaagcccgacagaaaattttcgacatccgggaagagtacagaaacaaattgctggaagctgagcacctaaagctggaaactctggctgctcaggaagcagccatgaagctggagacagaaaagatgaccccagctcctgacacacagaaaaaaaagaaaggaaagaaaaagtaaccaggggatgtccaatactaccctgcttctggagagaaaaaatctatttgtaatgatctttaactgcctgctgttaagatattaggccaaatgaaaatagaaatttctctttcttagaaatattttaatgctaacttgttagttttcctcagaaagctagtatttgaagccatttgagtttaagatgctctaatttcaataaaatagcttccaaatatttaataaaatatgtttgacac

SEQ ID NO: 61595 - DNA, 1555 bp, Homo sapiens; identical to SEQ ID NO: 61593

SEQ ID NO: 61596 - DNA, 4232 bp, Homo sapiens
cggcggagtggcgagaggcgagaggcggcggaggcggcggagctggggggggtgggaggggggggagagtgagtgagtggcagagtgagtttacccctatgagactgtgagaggcccggggcctacctcaaaggagcggggtcgcgaagctagctagcagcggcccccctccaggtccccgggcccggcggcgcggcggcggcttggttgtgaagaggcggggaagcgggtgtccggtccccgccatggagggcatggacgtagacctggacccggagctgatgcagaagttcagctgcctgggcaccaccgacaaggacgtgctcatctccgagttccagaggctgctcggcttccagctcaatcctgccggttgcgccttcttcctggacatgaccaactggaacctacaagcagcaattggcgcctattatgactttgagagcccaaacatcagtgtgccctctatgtcctttgttgaagatgtcaccataggagaaggggagtcaatacctccggatactcagtttgtaaaaacatggcggatccagaattctgatgtcatctgggtgattctcagtgtggaggtgggtggacttttaggagtaacgcagcagctgtcatcttttgaaacggagttcaacacacagccgcatcgtaaggtagaaggaaacttcaacccttttgcctctccccaaaagaaccgacaatcagatgaaaacaacttaaaagaccctgggggctccgagttcgactcgatcagcaaaaacacatgggctcctgctcctgacacatgggctcctgctcctgaccaaactgagcaagaccagaatagactgtcacagaactctgtaaatctgtctcccagcagtcacgcaaacaacttatcagtagtgacttacagtaaggggctccatgggccttaccccttcggccagtcttaaacgggtgtcagcaagaagaaaaattaacaaaagacagaaggcctgactttggggggttagggcaaggggttcctctggattgcagaccacatcgcacagacccctggctctgaccccctctcatcccggaagaagaggaagaagcagaacagactagttttgagtaaactcagtatgcatgtgtgaatgctgaatcacaggaatggtgttgaggctaccaagaagaaatccatgcagccactttgggttttgttataggcatcagtctaacaagtcattaggtcactcgggaagggggaaaaagtttaaaatgggggaaaaaaagccatctttttaaacaaaaattattttgcctacagaaaggttgtagttttgagcacatgttaatttttttccctctttccccacttttatttttttaaataagggataacatattctttatagaatagtgcttgttctggaagagattcaggtgaaaagttggcgtggcatgtttgaggactctgcggatcagtgctacaggagtacatctgccctgccacatgactccagaagtctctgaccccatttgtttttaatggcatcagccaatgagttatcacccttttcctcctcttttctctttaatcttctgttgatttacacctttgacatttgtattcgtcaaccctgtggcttgttagcatcagaacctctctgaagaccaaacttccctgtgtggccagcagaggaagccttgaggatagatctcgggtgacgtgggattttctaagcctgagaggtgtccttctgcacacccttgtaacaattaaaattgcttttcttccatgtttctcttggcagagagaaatgccatcatgcttactgctcttttggattcttcatgcagtggcttcccatttgctctgggaacagtgcctctgtgctggttatatgtatgcaccacatgtgcacacacgggtgtcggtgcaactcaccagcaggtgtgcagtaggcaagcttgaaggtggcccatgcttctctgttgtcacacaacacctttccctgtttctcttcagttgtcctctgatattttcacagcctgttagtggcggctgatctgtagaggtatgaaaatacagccccaaagggggaatttgtcatggggaagggccagccactgactacttgatcttggagaccacatttagatggaaatgagaggacctccacagccccgcctccctgccaggatgctagattattggctgggaggtgggcaagtggcagcccagctgaagcaagaggctgattgactggctgctcactcaggcaggtggcctgccctggcatcctgtagattctgagcaggttgagatgtggatatctccatgggaagcttgaaccaggctagaacagctgtctgccaaagatacaagaatatgcaaagtccctcttacccccctccttccctcaagtcttagttggtttgagagccagggatatggatccagggtgctgttgcagggtcacctgcctgttaccacacccccatccagctgggtggtgggtgagggtgtgagacaggcagggagaccaggtaatgagtggctgcaaggagtcatatagcctgggtgtgggtgagggtctgcctgcctgtttctgtctgggtgtctgagttccaaaaaatgtgtgttgtttgttcctcctcatcctcttctgagactgttgtttttttagagcttgattgtgggagaaaagcttgtgtgaaattccctcttcacctccccaccccccaaaaaataaaagggggcataaactttattccactggagaagccctgggggtggctggagccagcctgctgagaagcgtggtgcagctgggtctgggacttcactagagcttactctggagcacctattttctgtgcacatgggagtgctccactccctagcagagcagagggaagtctctgccaggtacccacgccacaggcctcaggatggctttttgtctgagggcctcattaggcccagactgctgctgctggtaccagtctcctgagacactgcctccctggagcccatgcatgcccagctgttcttactgcttagtagccttgaagcagcacatctccactgtccctggcaggattgtgggaggcttcacaacccctgctttcctgacttcctcttctgcccaacactgggtgccccttcccagtttcccagcaggggcttcatgggccaccgtcagtgggtctgggcctgccagagtcgtcttgctcttcctcttgcttctaggcaaccacacttggcaagttaaatgtcccaagcaccttgtctcccttcccaagaacaaaccatttctgtgcacatccttggaggcgagatgagctccttgcagagggccagagtaagtgcaagtcatggagtgcaggcagaggggtccatggcttccccagcccagggagggtatcagtatcattcattctctctcccctcactggtatgggttcagagcaatgcctagggcccctctctgctcccctgcctagtggggtggtagtggctacctctcagccccaatagtccctgctcctcttagaatcttcaccaagtggcaggccacctctgggcaggaccacctgcgtctggcacccaggaggtgaggcagacaccatggttaggtgatagggtctgaacccagttggggagacagaggggttcagacttgggaagaatctgtcagtgtgcatggagtgaggtgtgtgtgtgtggatggatgtgcacgtgtgcatgctttttttctttttgccgtgaggacagttgaatttggggcatttttctacaagaagcagtcagccttctctcccccataaggactggctgtaaccttaagcccatcaaagttacttccagcctggagagaacctcaccaaacagctggtgtggcctgagggtggccatggtgggaaatgggcatgagaataaatacctccccaaattcaatctgagcccagcaggagaggatggtagggttgccagggctcagaagtgcaagctgattactcaccccaccctgcctcgccgcacctttcctttgtttccttgggtgaatgcaggagcagcagtggctgcccttcccacctggacagtggtgtgtgtagaaagccagctggatgtttgtggtggggcctcatggtgcctaggaggagataaagatgaggaggtttttccttattgtataaatgaatatttgtatgattaaattaacacacacaccaaaaaaaaaaaaaaaaaa

SEQ ID NO: 61597 - DNA, 4430 bp, Homo sapiens
cggcggagtggcgagaggcgagaggcggcggaggcggcggagctggggggggtgggaggggggggagagtgagtgagtggcagagtgagtttacccctatgagactgtgagaggcccggggcctacctcaaaggagcggggtcgcgaagctagctagcagcggcccccctccaggtccccgggcccggcggcgcggcggcggcttggttgtgaagaggcggggaagcgggtgtccggtccccgccatggagggcatggacgtagacctggacccggagctgatgcagaagttcagctgcctgggcaccaccgacaaggacgtgctcatctccgagttccagaggctgctcggcttccagctcaatcctgccggttgcgccttcttcctggacatgaccaactggaacctacaagcagcaattggcgcctattatgactttgagagcccaaacatcagtgtgccctctatgtcctttgttgaagatgtcaccataggagaaggggagtcaatacctccggatactcagtttgtaaaaacatggcggatccagaattctggggcagaggcctggcctccaggggtttgtcttaaatatgtcgggggagaccaatttggacatgtgaacatggtgatggtgagatcgctagagccccaagagattgcagatgtcagcgtccagatgtgcagccccagcagagcaggaatgtatcagggacagtggcggatgtgcactgctacaggactctactatggagatgtcatctgggtgattctcagtgtggaggtgggtggacttttaggagtaacgcagcagctgtcatcttttgaaacggagttcaacacacagccgcatcgtaaggtagaaggaaacttcaacccttttgcctctccccaaaagaaccgacaatcagatgaaaacaacttaaaagaccctgggggctccgagttcgactcgatcagcaaaaacacatgggctcctgctcctgacacatgggctcctgctcctgaccaaactgagcaagaccagaatagactgtcacagaactctgtaaatctgtctcccagcagtcacgcaaacaacttatcagtagtgacttacagtaaggggctccatgggccttaccccttcggccagtcttaaacgggtgtcagcaagaagaaaaattaacaaaagacagaaggcctgactttggggggttagggcaaggggttcctctggattgcagaccacatcgcacagacccctggctctgaccccctctcatcccggaagaagaggaagaagcagaacagactagttttgagtaaactcagtatgcatgtgtgaatgctgaatcacaggaatggtgttgaggctaccaagaagaaatccatgcagccactttgggttttgttataggcatcagtctaacaagtcattaggtcactcgggaagggggaaaaagtttaaaatgggggaaaaaaagccatctttttaaacaaaaattattttgcctacagaaaggttgtagttttgagcacatgttaatttttttccctctttccccacttttatttttttaaataagggataacatattctttatagaatagtgcttgttctggaagagattcaggtgaaaagttggcgtggcatgtttgaggactctgcggatcagtgctacaggagtacatctgccctgccacatgactccagaagtctctgaccccatttgtttttaatggcatcagccaatgagttatcacccttttcctcctcttttctctttaatcttctgttgatttacacctttgacatttgtattcgtcaaccctgtggcttgttagcatcagaacctctctgaagaccaaacttccctgtgtggccagcagaggaagccttgaggatagatctcgggtgacgtgggattttctaagcctgagaggtgtccttctgcacacccttgtaacaattaaaattgcttttcttccatgtttctcttggcagagagaaatgccatcatgcttactgctcttttggattcttcatgcagtggcttcccatttgctctgggaacagtgcctctgtgctggttatatgtatgcaccacatgtgcacacacgggtgtcggtgcaactcaccagcaggtgtgcagtaggcaagcttgaaggtggcccatgcttctctgttgtcacacaacacctttccctgtttctcttcagttgtcctctgatattttcacagcctgttagtggcggctgatctgtagaggtatgaaaatacagccccaaagggggaatttgtcatggggaagggccagccactgactacttgatcttggagaccacatttagatggaaatgagaggacctccacagccccgcctccctgccaggatgctagattattggctgggaggtgggcaagtggcagcccagctgaagcaagaggctgattgactggctgctcactcaggcaggtggcctgccctggcatcctgtagattctgagcaggttgagatgtggatatctccatgggaagcttgaaccaggctagaacagctgtctgccaaagatacaagaatatgcaaagtccctcttacccccctccttccctcaagtcttagttggtttgagagccagggatatggatccagggtgctgttgcagggtcacctgcctgttaccacacccccatccagctgggtggtgggtgagggtgtgagacaggcagggagaccaggtaatgagtggctgcaaggagtcatatagcctgggtgtgggtgagggtctgcctgcctgtttctgtctgggtgtctgagttccaaaaaatgtgtgttgtttgttcctcctcatcctcttctgagactgttgtttttttagagcttgattgtgggagaaaagcttgtgtgaaattccctcttcacctccccaccccccaaaaaataaaagggggcataaactttattccactggagaagccctgggggtggctggagccagcctgctgagaagcgtggtgcagctgggtctgggacttcactagagcttactctggagcacctattttctgtgcacatgggagtgctccactccctagcagagcagagggaagtctctgccaggtacccacgccacaggcctcaggatggctttttgtctgagggcctcattaggcccagactgctgctgctggtaccagtctcctgagacactgcctccctggagcccatgcatgcccagctgttcttactgcttagtagccttgaagcagcacatctccactgtccctggcaggattgtgggaggcttcacaacccctgctttcctgacttcctcttctgcccaacactgggtgccccttcccagtttcccagcaggggcttcatgggccaccgtcagtgggtctgggcctgccagagtcgtcttgctcttcctcttgcttctaggcaaccacacttggcaagttaaatgtcccaagcaccttgtctcccttcccaagaacaaaccatttctgtgcacatccttggaggcgagatgagctccttgcagagggccagagtaagtgcaagtcatggagtgcaggcagaggggtccatggcttccccagcccagggagggtatcagtatcattcattctctctcccctcactggtatgggttcagagcaatgcctagggcccctctctgctcccctgcctagtggggtggtagtggctacctctcagccccaatagtccctgctcctcttagaatcttcaccaagtggcaggccacctctgggcaggaccacctgcgtctggcacccaggaggtgaggcagacaccatggttaggtgatagggtctgaacccagttggggagacagaggggttcagacttgggaagaatctgtcagtgtgcatggagtgaggtgtgtgtgtgtggatggatgtgcacgtgtgcatgctttttttctttttgccgtgaggacagttgaatttggggcatttttctacaagaagcagtcagccttctctcccccataaggactggctgtaaccttaagcccatcaaagttacttccagcctggagagaacctcaccaaacagctggtgtggcctgagggtggccatggtgggaaatgggcatgagaataaatacctccccaaattcaatctgagcccagcaggagaggatggtagggttgccagggctcagaagtgcaagctgattactcaccccaccctgcctcgccgcacctttcctttgtttccttgggtgaatgcaggagcagcagtggctgcccttcccacctggacagtggtgtgtgtagaaagccagctggatgtttgtggtggggcctcatggtgcctaggaggagataaagatgaggaggtttttccttattgtataaatgaatatttgtatgattaaattaacacacacaccaaaaaaaaaaaaaaaaaa

SEQ ID NO: 61598 - DNA, 1845 bp, Homo sapiens
aggcagctggagggaaggaagcgatggcggaggagcgggagcctgaattgtacctgaagtggaagcactgcgagacgccaggcgtgaagaccctgtgtaatctgaagcactgcgagacgccaggagtgaagaccctgtgtaatctgaagaaacttctgaaccggcttcagaaagaccaccgggaggacgtctacctctacatctctggacacctgaaccccaacaagctctaccagcctccggagacgatcttacagcactggcccaatgcccaccggcccaagggggagcgcgcctctgaggtgggagagccgcccgcagggaaggtggcgaggatgaaggaggccctggcccacttcaccatccacacggcgctggtccccagtgaggcccaggacaccccgctgttcaggtacctgaacccccaggcctctctttcccacacttcagaggaggatttccttccagtggaggctgtcagagaggggaaggaagaaaagaaaggaggccctcctggacggggccctcctggatggcgcaggagggaagaactccggctgcccgacttgaaggtgctgtgctaccaggaggccgggtccagaggcaccagggaccggcaccactatgtcagctcctacctggccggagccaccagcgcagacaggtacaggatgttcctgcgtttccagaaggaagtgctcgccaagcaagatctcctgaagaatgacttcactgggagcaaggcggccgcgggccacgagagaaagctgcagcaggagctccagaaaatgtgcacgtgcagcccccagcagttcaacagactgcacgtctttgaaaaagtctttgaagatatttgtaacagttctttgatatttggtgatctcttgaaaaaagttaaggatgaatatgaactctacatggcaacgctcctggagtcccagcctgcagcacagtacgaggctcttctggctcaactcaaggcgctggggcagaggccggtgaagacggcggacatggatctcgccagggaagagctgaggatgctcgtgacagccacaaaagcagccctggagcagaatgatagactcagaagtgaactggagatggagctggcattgctgcagtctgcaaaggaacgatcagaatcatctgagaaacatataattgatgaaaaccaacttactcttactgagaaggttgaaaagaagaggtgtgaaatactcagtaagtgggatgagatacaagctctggaaaaagaaattaaaacaactttggttcatactggaatttcagatatcactgagaataggattaaaagcatagagcatgaagctatacaattggaaacagaaaatatgattttaaagaagaaaataaaagggcctttggaaatttatcaaggaatttgtaaaatcagaggaaacagaagataacgctcaagtggctgaacaaatggccagtggaaattcttaacttccatgtatgtagcatggatatttgcagatgcatatacattcataaagatacatttcatttcatcagctttaatctctagtaaaattaatgtggtatatgtatcctactcaggatactgaaatacacacatgcgtacacatgattagtttctgttgcatacatatttacaacaatactagttcttaacgtatgttttactttcatttaataatgttcaactttggaaaatacttttgattatttgctaagaataaggaattcagcgctgcttgaatacagctcaaatttgtttatttgccaacacaagtttacatatatgcatttaataaaattttatacaaaaaaaaaaaaaaaaaaaaaaaaaaaaaa

SEQ ID NO: 61599 - DNA, 8483 bp, Homo sapiens
cccctgaaaaccgtacgttgccaaataatgatttctttggattagagaactacaactcccctgggtcctgagccggtatttcccttttgcggctgcaccgtagttaaaaacaaagctaagtgttctgggacgtatagttctagcgttccttgggtcccgctggcgagcgtgggctttctgcagctcgcaaccggcctcgtgctttgcggacggttcactgcgcttggaaaggggtgagtcggctttttgagggacagcaagtggtgagagtgaaggcccgaggaatgcttagtcccacgggacgaaaggaagcagggatgaagtggtacacttgagaaggggttcaggactttggaggtggtggaacagaggagcttggggcttcctctccttcgactcctgccagataagtgaggctagcagtagtcaagaaagctcattaagtaggatttcataagacttaggtcgagtttggcttttagttgtgcctgccgcctatcgaactcttaattcattatgtcatccgttaagtggacagctgacatttccctgatcttttataaaacatgagaataagtatctttgggaaatctttctattttcattaatctgtaacttatattccaagtagaaactttccctgaaggggcagcttgtagttgtttactagtttcctgctagccctcccaccaccatccactctgatagctgtgctaagttcattcatataaaagttctggagccatcactgttttctcctatgaaggacacaagctgtagtcttttcgctgggagaggctcccatctgcctttctctgtaataatggagagaacgccatagtgaaagggttaaaactcagcaaactgctgaagagtgacaagccctatcacttaactgtgaaattgcttgttattctgtcttacaaagggagacgtgttgttgagctgattgtcgtagacagtttttattctcacttatctgtgtgtctcctttgaaaatggaacttgaaattctaccctcctcagttttctgtttttaatttgaaaaacagccaacatcccctgtgaattgcagtaaaggaacaaagcattaaaaggcatatccttttcccaacaaaagctcacagtctaatcagtaaagatttattgagcaactatgccaggttttgagctgaggctgagcctgcaaagttgaaatctgtgttctctgacctcaaggaacatgaatgaataattagaatataataaaactgtgctagtaggtacaaaatgtgagagcccagaacatgcatataaagcaaacatatctgtaaacttcaaggaagactgggaaatggcttaataaaaatagatacaatgttatggcagatatttaaaaaagatgctcagatattatgtgtcaaggatcatcagcaatcagcaaatcattaattttgagaacttgggatcacagactctaatgttaagtattgtgctagaagccatgtacagagaagtaaaagtaagatgatcatacgtttacaatctcaaaataagcttacgtagacaaataagaatgttcctaagaggtcagtgagaccaaatatttgatatcagatcctttccaacaatatagaggcatcatatttgtagatataaattacagttttcattccttatgagcctaaatttcagcatcaaaatgttaaaagtgatatgtgaatacagatatcacagtgtaaaccacgattaattttcaaatgagttgtagaattaaaatatgtcaagtatttagaggaagggaagatcactgacagagtagactggaaagactttataatcaggagcttgacctgtgaaggacagatagatagaatttattgagaacttaccaagctctttacatctaattcatatttgttctttataaccctgagaggcagatttttgtcttacatctccattttatagatgagaaagctgacagaagttacttgccctgagtcacacacctaggaagtggtagaattagatttcagatctagctctgtcagactgtaaagaccatcctttgaactctaaatggtataaaagacatacagaggaaatgccaggcatcctcagtggcttaaatacgacatcacagtaaactcaggctagaccagggatgacacataaaagatgatagttttcatttgtgttgccatcagcctcctctataaataaacccagagtaaccacaaattgccatcctgaggggttcaacagggaatagtctcataatggatttagagtgaaggatgattggcattgttagtcaggcaagcagagggctgagcagtcaaataacagaatttcagaacaaaagattagagggcagaaatgctgtatgtgctgatagagtcagagagggcccggatcaagaaactgcaggaagagaaaactagaaacctagaatcgtctagaaaactagaacctacaatcgtctcagaacacaaaggaggcttgaggactgagcagactgacatagatgtacttggacaacacctcaccaaggagcatgtctcttcccactcacaatccccaatacgagattcacagtggttcacgctgagtccacaggaaaaattggcctggggtacatcatctaaagatcctaggattgctgcaggtcagcagtctccactggaaaaaaagatcttgaatctaggtggtgtgcatacaacagcagcaagacagttgataatgcagaaatatcaggaggagtgtgaaatactctgtagggagcaagctgtttctcttgactactggcttgccaaagcagagtcttattataataaaataatagtggaaatgatgaaagaagagacaggcaatgaaatctagaaaaaaatggaggagaaaacaacccagagcgtagaaggactaaaacagtactgtttggtacctgagagagagatgaaacacatagaaaggcacatacatcaaacaggaaaggctggagaatttaagaacaaaccatttagacaagtactacaaccccccaatgaaacaaaattaccaaaaattatgccagaagggcatggcatccagaacgcacagagaagaaagcaggtaaatgagagggaacagatgcagactaaggatcaccaggaacgcatgattcgagggagagaacttgcagaacaaagactcaaggagagaatcttgagaagaagccagagccagctacttacatatgagaagcatgagagagtaaaagagataaaggagtttgaaagagttattgcgtatcttcttttccaaccatgcagtagaagtcggattaaagtgagtattcttatggataagtctcagaatggagagaaggtgaatacaattgtgaaaccatatcaaagaaaattcttggcaatgccaccctttttaagaagtcaaataggaaaaataagagattaaagtttcaatgctgttatgataaaatcatatctcttaagtgaacccttttttttttcaaatgctcgttctctccagggttcagtgaatattcccatttgtatcagatacagatagatagttctgcacttgaaaattagcttaacttttttagttgacttgcatttgttcaagttgcatatcctttctagtgttcagtgtcctcatctttaaaatggcaataatatttgatggcatttatggaaggactgttttttttgtgaagtgtaggtatgtattagttgtttcataaatgttagtttccccacttggaaagaccggggttgggcaatggtggtgaataaagaattgttctaatctacttctcttattctccctgttcccagccctccaaggttattttgatgagattgctatagtttagtatatggtctttaatatcataccttcatcagataactactagccagcccctaaaagtgtaacttgctctgtacaatttatttgaatgagaaacttaattttgagagcctcctacatgctaggcattatgttagttactgaaggtgaataaagagaagtctctgcccttgaataattttcaactaatggcatagatcactctataaacagataatgtagtaaataaaggttacaatagaaaggtacagggtgctttacaaaggacggattctaacctggcccaggtgagcagggtgaaaaggaggaaggttagggaagggagtattatagtctgtcatgtttcttccagctttttttgtcacttcctatcacccacttaagcaagaccttcctaatgcttggatccactcagggataatcaaactcagcctttctcaaactcatgtttttggcactcattgataaatcagaaagcaaatttataaatttagtgagaattacagttgtcaagcagaatgaaatttgtgttttctagtcagtttattttcttcccagataccagaaagttgggaaagcaggggttcagagttggtaagcagagaagcaaataaatggaaatagatgccctcaggaatattatgcttaagttgtgataattctgatgcccaccttgctttactagcagaacaccctttaccctggatactgctaggtcagccactgatacaaatgttctgtgtctgtgctcctcagtacagtagcccttgctacacgtggctgttgaggcatttaaaatgtggctggtgcagctgtggaatggaatgtttaattgaatttcatttaaatttaaattgccacatgtggcaagtgactaccctgttgcacagtgtagcactggataaacataacttctgtgttctagattccagtcccaccattagctttctgtttttgacagtgtttgctggtatgataggtcactgttcattttacattactatcagtttagtttcctttgcatttcagaggctccctaatcccttaaagagatttaaaaatcaatgtagaccacttctgtgtgaaaataagatgactgaatttgctttgattggaattaggaactgacctctctttgctagttctggaatttggccaggatgcacatcaaaatctcattcctaccctcctgatttgcctcatggaaacttcgttgctgtgtctgttctctggtcctctattgctatgtctcagctttagattctatgttttgcatagaaatggatcatcagaatgcaacaggcagaagacttagaagtgcaaatcagtagggtaatgacaagccctttgagctgagtgggactgaaaagtaacctaacatataacctattagtaattgtttaccatgaaggttttcagtgctggacacataaattgctgagttcaactgccctctttcccctccaaatctagcataaaagcaactggtgctctcagggcaatttcacacctaatacggctaagaataaaagtctatgtttcaggaactcagtttgtccaaacctgcatccatcatctacctcaaattatatccaccttttcatttctttgcactgtgtctgcttaaatcttgagtcacacttaatgttttttttttggtcttttttctttttaatgtgaaatagaatatacaatacacaaatgaaaatgtatatttagaagaacaataataaatgtccaggtgcccgttgctcagactgagaaatggaacattactacatcccaggagcctcgtatgctctcattcatatctctctcccctgcagccagaggcaaccactatcctgaattttgtataactgtcacctagcttttatagattttactgtctgtgtatccctaacagttgcttatttatagcctttatataaatagaattatactgtatatgactgactacttttgctcattattatttttggattcatccatgttgatgtgtgacactgtagttcatttccatgacatgaatatgccacaacttaattatatattctgttgatgtcatttagttgtttccagtttttgttttatttttcttttaaaaatgatacttagataaacattaacatgtttaatcttatgttctggtgactgtgtactagatatatgtatgatatataaattgtggtacatttatttgacaggcctgatcttgaagcctgttagatttctgttcctttgtggcattatgcctgtaagcctgttctgtagagtctggcacatgttagcctcttaatagatatttgttgaaagaaaggacatttgttaactgctggagacaggcccaaaatacataaatagctgataacagaccactttagctttttactcatcttgtccaggtacaatcatagtcaacctctgtttatgcttatatttcagttgaggtactaaaatatttgtttacttagttggttttcagtgagcttccagtacaggatttgtttctctttctgtcacttttcccaaaactttcactccactgccttctagaaaagatcacccacatgtcgtctcctcaaggcacctgcagcacgaaagttttatttctgaacaaaagggtccccagagaaggagacaaggagtctcctttcagtacgaggttgctggagtccctagagggtcaaaggctgtgtaataacagttccttcttgtctgctggacaaaagcttctgagccctcaagcaccctgtgacttagttctgatagagtactgagtttggaaatggcagagtggggacccaaaacaaatcttccaattccaaattcagttttatccaccttttcaaataagattaaaaaatgttaatgtctgttgatttgtgtgtgttgaaccactcttgtatccctgggatgaatcccaattaattgtggtatatttttgatatgttgttggattcagtttgctaaaattttgttcaggatttttgtgtatattttcactaggaagattggcctgtaattttctttttttttgtattcttctctgcttttggtatcagggcaatgcaggcttcataaaatgagttaagaataattccttcctcttcagttttttttaaatattttgagaagtattggtattaatttttctttgtatgtatggtagaatttgacaggaaagccatctggtcctgggcttttctttattgagacacttttaattactgattcagtcttattactcattgttggtctgttcaagttttctatttgttcctggtgaaatgtctacaaaaattacaaaaattagctgggtgtggtggcatgtgcatgtagtcccagctacttagggggctgaggcaggaggatcgcttgaacctcaggaggttaaggctgcagtgagctggtattgcgccactgtgttgcagcctgggtgacaaagtgagaccctatctcaaaaataaaaaaaattcatatggaaccacaaaagagccccatccaatagttaagctatagtaatagctttgtaactgttatagtagaaaccaaatcatcatggtaccggcctaaaacagacacatagaccaatggaaagaatagagaacccagaaataatttcatatacttacagccaactgactttcaacaaaggcaccaagaaaggacacccttttcaataaatggtgctgggaaaactggatatccatatgcagaagattgcagctaggctcatatctcttaccatattaaaaaatcaaccaaaaatggattaaaggcttaaatgatagatccgaaactatgaaactactaaaagagaatataggggaaatgctcaagaacattggtctaggcaaagattttatggttaagacatcaaaagcataggcaacaacaacaaaaaataggcaggtgggactatattaaactaaaaatctgcacagcaaagaaaacaacagagtgaagagaccaactgtagatgggaacaatattttcaaattatccaacaggggactaatatccagagtgtacaaggaacacaattcaacagtaaaaaaaaaaaaaaaaaaaaaaaaaaatccccttaaaaatggtcaagggatctgaatagaaatttcttaagaaatacaaatggccaacatgtatgtgaaaaagatgctcaacatcactaattatcagggaaatttaaagcaaaccacaataatatatcatcttaccctagctagaatagctattattaaaaagacaaaaatggtagctaggatataaagacaaactcttacacacggttggtgggaaggtgaattagtacagccactatggaaaacagtatggagatttcttagaaaactgaaaatagatctgtgtgatccagcaataccaccactgggtatttatccaaaggtaaggaaatcgatacatcaaagggatactggcacccccatgtttactgtggtactatttacaatagcaaagacagggaatcaacctaactgtccatcaatggatgaatggattaaaaagatacggcatatatacacaatggaatactatttagctataaaaagaatggaatcttgtcatttccactaacatggacagaactggaggttctgatattaaatgaa

SEQ ID NO: 61600 - DNA, 1546 bp, Homo sapiens
agttcctacccgcgagagggaagaagcaggaggtctcagcatgaaacagcagcagtggtgtgggatgactgccaaaatgggcaccgtgttgtcaggggtcttcaccatcatggccgtagacatgtatctcatctttgaacagaagcacctagggaatggcagttgcactgagatcacaccaaagtacaggggtgcaagtaacatcataaataacttcatcatctgctggagttttaaaatcgtcctcttcctgtctttcatcaccatcctcatcagctgcttcctcctgtactcagtgtatgcccagatcttcaggggcctggtcatctacattgtctggatttttttctatgaaactgcaaacgtcgtaatacaaatcctcaccaacaatgactttgacattaaagaggtcagaatcatgcgctggtttggcttggtgtctcgtacagtcatgcactgtttctggatgttctttgtcatcaactatgcccacataacctacaaaaaccggagccagggcaatataatttcctacaagagacgaatttctacagcggagattctccacagcagaaataaaagattatcaatttcgagtgggttcagtggctcacacctggaatcccagtactttgagaggcagagcttccacactagcatatttacctgtctgtctccagtgccaagctcagcccccagcacctgtagatacacaatagatgtctgctgagaggtgctctggtaaaacaagtataaaatgaatgtcaggatgttctccctcatggtgggcatcttctctgtccttaataccacccagttcttcatctttgacctgaaccagaagacacacatttgctatgaggccaagttcagcatctacgtggactcaaagtcggagctagtcacttggaccctgttccacagggctaatatcagcactggcctctccctcaccaccatcatcatcggctgcttcctcctttattgtatccacaagaatatctacatggggctgctgatctatgccatgtggatcatcacttacgagctcatcaacttctccatagtcctgctcctcaacgggatcatcaaagatcacttcaagacgctgagttatttgcactggatcttccaaatctcacacatgttcctgcactttttctgtctgcccttcatcgtcaagcatgcatacaacctttacaaggaatcccagactgtgggcaggaaacgccgccacaggctctgctccaccattgcagtgaacttatgactacctgtccgtctgggaatgttgtaccggaagttaaactgaaccatgccagatgccaggaaaggtgggagggaatggtgttcctcaacaatggaaccctccctaccctgcctgtcttctgttgatgctgcttggtttgtcagggcttttgagttttacgcactgaggaatgattctcgggagagggcaggttgtgcggatcaattattttacagatgtgttgtgtgacttgttttagcagttaatgatatgtggccttgtgcttacttaaccatc

SEQ ID NO: 61601 - DNA, 2230 bp, Homo sapiens
agttgccgggagacccggccggtggggaagcccgcggagccgcagccccggccccggaaggtctctctgggccccgggcccgactcccacccctgcgccggcccgcgggcttcgcaggccctgcactgccgaccgggctgcgctcaaggccgccagccgcccgccgccctctttgtccccccgctgcaggaaggccgcggcagagggggcgccctccaagccgtcagccacgcacgcggaggcgctcgggcctcggggcggcgcaccgggagagcacgccggggaggacacgtgggccttcgcgcggattttaaggaaacagagcaacagctacaacaaaatggggagaagaaatgagaactgtgctaacagcctacgtgtgtcaaacatctctcaggagaacttatctcactggaatttggattcagaagtacctgtttctgaaaataaaaacctcccagctggaagggatggagcagcaggtggcaaaattaacaagaactatttggaaattccagtggagcaactgatgctagaacctaatttgtcggtgcatagtcaaaaaagtacacagaatagtaaacaagggatctttcaattatggaattgtcctcttaatgaaggaagtaccatagagaagagggaattcaaaaaatcttcagtggaaactggctttaatgtaatcaatcatcctataagggtcttcactctgaaccatccattaacaattgcttcagttgataagcaagttggtccttaccctggactgccaatgccattaggtctctgctggccctatgctgatggagacttttttaagaacagaaatgagattcatgttagttcatgttcaactatagaaaacaatgatggtgaaacattacctgctccaaattggaatttgaaacatggaaacagcagtgtggaagaaaatttcacagatgaaagtgatttatcagaaaatgagaagacaaatgatactttactcagctattttaaaaaggtggacctgaacttgaagccagaaacaataaaaaatgttgaggaacctttcaccgaggagccaaatgaagtatttccatatcctgattttctccctcctcctttcagtgctctagacttgcacaatttagccctctccaaatctgacaattggaaagtgacagtggaccctgcagaaacctctgttgaacacttgataactcgtttactggaactagaacgattacaacatatgactattcaaaaagagaggccaagactacaaacgactttctgtactccagcagttactgaacgaccctcttcctccaaagctacaccaaaagtgagacagccaaaactttgcgactctttgagtcttcagataccttgtgtagataaaagtcaagaaaaaagtaaaaacaactctggttcttgtaagcttgaacaaaatgctttaaaacggaattggagcaatgctggcaaatatagatggaattctagaccactgtctctaaaaagttcttccaccccaaaacaattgattgaaacttatgataagaatcccaaaagttctattttaagtccatgccaagaactctcattcaaacctactattggccatacaaatcaatcaatggttaaaatgatctccacaagatgtctgccatggaggtctccaatgccagtttcacctatacctctgacttttcccgaaaatcagaaggaagaaattaaggcaccgaagagaaactttgggaccaaaaagaaactttaccgacaaaatatagtgttgaatagaccattctctattcagaagctaaactgtttgtcgccttcccttattgctaaggataagtgctgctcacccattgaacaaaaataactcttttctttcatacatctcaatgtgaacacatctactctaagaagcccaactaagatatggttaattattccaagacacaggtactattaacagtcccccaaaatcaccaaacagttgcttgatgtgatatggagtagaacttgtgaaaagcactgctgagatgtctatatataaacccacaggcttctatactgacatatttcacaatctgttgcatgttgtgtttcaagtaaatggttcacttggtagactattctattcaaaaggctactcttttttcagtgattgttttccagtataattccatcaataaatggtataattgaaaaaaaaaaaaaaaaaaaaaaaaaaaaaaaaaaa

SEQ ID NO: 61602 - DNA, 2121 bp, Homo sapiens
gagggaacagtgccctggattccggcgggggtatggaccttaggaacggggaaggatggaagaatgggcagaagcagcagtaaccgtgcccaacgccatctccacggggcgtgcctccattccgctccccgtcagccctacccactcagccctgccgcctgccgcctgccagttggctgaccccactcccaagggaagagcggcctatcgctcccagctccttgccccgaaccacccagtgtacgcgaacctcgcgggccggcgtggccttggccgggcagggggcggggcgagcgccggtgacgcggccgttgccatgggaactcgccgcccgctcgctctctggagctggagccggagctgccgccagccgcccgcctcaggctctctctgccagccgtgcggccaggcccgcggggtggtcggggggagccgggcggcagagaaggagggagcgggtacggcctcctagccgagaccggtaagccgaagcccttgagccgctcgctgccgctgccgccgccgccgccgcgaccgcgagggacaaggacaagcgccgagcagcgcctgcccaacccccggaacgcgcacccgccccaacgcccagacacggaccgtgcgggccgcccccgccccagcgccgccccacttcagcccggcccgcgccctggacgcctccgcacctctggccggctccggctcagtcccggtagctcttctccgcccccgccgcagcctccgccgcagccgcagcctccgccacagccgccgcctccacccccggccccactccgcccgcgacccctgccggggccccgaccccggccctatccccggccccgcccgcggccccaccaacctccgttccggccccgtacccggaggcccagccgtgggcacgatgctgcccagctccatccagatttcgggggagccgctgtccggcgccgaggtgcgggacatctgccgcggccttcgcgacaacgccgtgcgcctgctctcactgcgcggctgccgcctctgcgaccgcgactttggccgcatctgccgggccctggccggggccacgtccctggcgcagctcaaccttaacctgggcgtcgtgtccagccccagccgcatcaagcagctggctgaggctctgcggaccaaccgctccatccagtccctcttcctgcatgggagccccctgacagatgcggggctggccttgctgaacccagccctggccctccaccctgccctcgtggctctggacctgggggactgcatgctgggtgatgaagccatcaacctcatctgtggcctcctgcccccagatggggccaaatctggcttgaaggagctaacgctgagtgccaaccctggcatcacccctaagggctggagccgccttgccattgccgtggcccacagctcccaggtccgcgtcctcaatctggattacaaccccctgggtgaccatgtggcaggaatgctggctgtagctgtggcctctagtcgtaccctagaggtcctagacttggagggcacagggctcaccaaccagtcagctcagaccctgctggacatggtagaaaattaccccacagctttgcggagcctggtgttggctgagaacagcattagcccagagctgcagcaacagatctgtgacctcctctctgagggagaggaggaggaggaagtggcaggaggggctggcgacacccaggaatgggagagagggcgggagcctgctgcccaccagagaggcagcagctcctggatgtgccccagcgatcccagctctcagatggtgctaatgacgtcaggactaggggacagtctgttggctgagaccgagatgtgactctccactgggcctctgcacaccatttcacttatctatgtcccgagcaccttgccccagatatcagggtcaggccctgggacttgggagggaactggggtcaggggctgcatgggggctctggcagctcctggcagtgtggtgggaaggaagctctggaagctgtgactgagcaacagccttggggggcacttgaacccacggcaatgcctttgaacttggcagctctggctgcaacccgctggctcggaaaagattttatgaactcc

SEQ ID NO: 61603 - DNA, 2215 bp, Homo sapiens
gcgggcgcccaactgctccgactgtcgcggtgagggccccaggacagaagcagacagacacggctcatgctgtcgattccgatccagccagaatgcctccaactcaggccgaaagtgttataaggagtattatacgagaaataggacaagaatgtgcagcccatggagagattgtttctgaaactctgattgcttttatggtgaaagctgttgtcctggatccaagtaatggctttaacatggatagaaccctcatgaaaagtgatgtgcagaatcttgttaagctttgtatgactcggctattggatactaaaaatccatccctggacactattaagatgcaagtctacttcgatatgaattatacgaatcgagtggaatttctcgaagaacatcaccgggtcctagagtctagattaggctctgttacccgagaaattacagataacagagcatgtgctaaagaagaattggaaagcctctaccggaagattatcagctatgtgttactccgctctggccttggatcccctacagacatcaagactgtcagagaggtaacagctgctctacagagtgtttttcctcaggcagagcttgggacatttctaactctttctaagaaggacaaagaacgccagctgaaagaactcaccatgattgttactggaattcgtttatttaacagagactgtggaaaaggaggagaaggcattgatgatttgccagctgttctccatgtagcaatcccagccaccatgcagcatattgattaccagcttgagactgcccggagccaggtataccgctacacagccatccttgagaaggcagccaacgacccactcatgagggctgaacttcagccatatatgttaaaagaagcgctatataatatacgacaatatgaggtcttccttcagatcattttgtcagatataattactggtgctcaagaagtggaaatgatgacaaaacagttaggagcccatctggaacaactaaaaatgaccataaaatcaaagatagcggtcccaacatcacaagtctttcctatcttcattgcactttctactctgtggaccagcttgcaagacgaaactattgtggttggtgtcctcagtaatttattcactcacattcagccattcttgggtgctcacgaactatactttcctgagagagtgatgcaatgtcatcttaatggagcgactgtgaaaactgatgtgtgtagaatgaaagaacacatggaagatagagtaaatgtggcagatttcagaaaactagaatggcttttcccagaaacaacagcaaattttgataaactgttaattcaatatcggggattttgtgcttacacgtttgctgcaacagatggtcttctccttccaggaaatccagcaattggaattttaaaatataaagaaaaatattacacattcaatagtaaagatgctgcatattcatttgcagaaaatcctgaacattatattgacatagttagagaaaaggccaaaaagaatacagagttaattcaactattggaacttcatcaacagtttgaaacatttattccatattctcagatgagagatgctgacaaacattatataaaaccaattacaaaatgtgaaagtagcacacagacgaatacacacatactgccaccaacgattgtgagatcatatgagtggaatgaatgggaattaagaagaaaagctataaaattggctaatttgcgccagaaagttactcactcagtacaaactgatcttagtcacttgagaagagaaaattgttcccaagtgtaccctccaaaggacactagcacccagtccatgagggaagacagcactggggtgcccaggcctcagatttacttggctggtcttcgtggaggaaagagcgaaatcaccgatgaggtcaaggtgaacttaactagagatgtggatgaaacctaattacagacaacgttttaaaatagatgctactcaattatgaacaatagcaagtacttaaaggtatattaacatctatacaaattaattttgtaggggtggcacattcattggttgtgtgactgtttattgggttgccatattttataaaactgttttctgtaacacatttttcattctgttgaaattgaaaaataaaactgtccatttatcttttaaaaaaaaaaaaaaaaaaaaaaagaaaaaaaaaaaaaaaa

SEQ ID NO: 61604 - DNA, 2580 bp, Homo sapiens
aactgctccgactgtcgcggtgagggccccaggacagaagcagacagacacggctcctgctgtcgattccgatccagccagaatgcctccaactcaggccgaaagtgttataaggagtattatacgagaaataggacaagaatgtgcagcccatggagagattgtttctgaaactctgattgcttttatggtgaaagctgttgtcctggatccaagtaatggctttaacatggatagaaccctcatgaaaagtgatgtgcagaatcttgttaagctttgtatgactcggctattggatactaaaaatccatccctggacactattaagatgcaagtctacttcgatatgaattatacgaatcgagtggaatttctcgaagaacatcaccgggtcctagagtctagattaggctctgttacccgagaaattacagataacagagcatgtgctaaagaagaattggaaagcctctaccggaagattatcagctatgtgttactccgctctggccttggatcccctacagacatcaagactgtcagagaggtaacagctgctctacagagtgtttttcctcaggcagagcttgggacatttctaactctttctaagaaggacaaagaacgccagctgaaagaactcaccatgattgttactggaattcgtttatttaacagagactgtggaaaaggaggagaaggcattgatgatttgccagctgttctccatgtagcaatcccagccaccatgcagcatattgattaccagcttgagactgcccggagccaggtataccgctacacagccatccttgagaaggcagccaacgacccactcatgagggctgaacttcagccatatatgttaaaagaagcgctatataatatacgacaatatgaggtcttccttcagatcattttgtcagatataattactggtgctcaagaagtggaaatgatgacaaaacagttaggagcccatctggaacaactaaaaatgaccataaaatcaaagatagcggtcccaacatcacaagtctttcctatcttcattgcactttctactctgtggaccagcttgcaagacgaaactattgtggttggtgtcctcagtaatttattcactcacattcagccattcttgggtgctcacgaactatactttcctgagagagtgatgcaatgtcatcttaatggagcgactgtgaaaactgatgtgtgtagaatgaaagaacacatggaagatagagtaaatgtggcagatttcagaaaactagaatggcttttcccagaaacaacagcaaattttgataaactgttaattcaatatcggggattttgtgcttacacgtttgctgcaacagatggtcttctccttccaggaaatccagcaattggaattttaaaatataaagaaaaatattacacattcaatagtaaagatgctgcatattcatttgcagaaaatcctgaacattatattgacatagttagagaaaaggccaaaaaaaatacagagttaattcaactattggaacttcatcaacagtttgaaacatttattccatattctcaggtaagcagggtcaatattttatgaatttatgacatttaaaaatatagttaatttaaaagttgtattttgttgtagaatgcttcccaggtccacacagagagagtcagatgagggtctttacaggttgtctgaaagggattcatatctgaagatgaaaactaattgaatcaaagaataatgaaaacaggatatggagtcaaattgatgaattaggaaatggggaaaatctgaatcagaacaacttcattgacttataaataattgaagctgcagtatatttctgtatctgaaattggaggagctcaacacagataacacagatagtaacttatactcagagctgcaaaacaatttaacaggtttaaattgtagtagtctgaaaggccacagaatggatctcaaggtgggtttcttgtatgtctgtgcctattgattaattcattcatcttatttagtaagccacttattgtgtgtcagtaattattcttggcataagggatttcatgaaacaaaacagataaaaatctctaccggtttggaactcacatttgaatgccgtatattctaatgttcttcctctttgtctctcattttcgttgttcatctctttttttgttctttttagaggcaaggtctcactctgtcacccaggatggagagcactggcacaatcatagcttactgtaccttccaactcctgggttcaagggatcgtcttgcctcagtctcccaagtagctgggactacaggcaggtgccaccatgcctggctaatttttttaaaaaacttttttgtagagatggggtctcgccatgttgcccgggctggtctcaaacttgtggcttcaagttatcctcccgccttggcatcccaaagtgttgggattataggcacgagccaccatgccaagcctgttgttcatctcttaagtggtctttctttctctcctgtctcttgttgaattcctctcttttaaactcactaaaatgaaaacattttgaaat

SEQ ID NO: 61605 - DNA, 1639 bp, Homo sapiens
caccagccagcctctgggtctgtagcaaccgcccagcgttgaggcgcggctcatgcccccagtatcccggtccagctattccgaggacatcgtgggctctcggagaaggcgacgcagctcctcggggagcccaccatccccgcagagcagatgttcctcttgggatggctgttcccgctctcactcccgcggccgtgagggcctcaggcctccttggagtgagttggacgtgggcgctctttacccctttagtcgctctgggtcgcgagggcggctcccaagattccgcaactacgccttcgcgtcctcctggtcgacctcgtatagtggatatcgctaccatcgtcactgctatgcagaagaacggcagtcagcggaagactacgagaaggaagagagccatcggcagaggaggctgaaggagagagagaggattggggaattgggagcgcctgaagtgtgggggccgtctccaaagttccctcagctagattctgacgaacataccccagttgaggatgaagaagaggtaacgcatcagaaaagcagcagttcagattccaactcggaagaacataggaaaaagaagaccagtcgttcaagaaacaagaaaaaaagaaagaataagtcgtctaaaagaaagcataggaaatattctgatagtgacagtaactcagagtctgacacaaattctgactctgatgatgataaaaagagagttaaagccaagaagaaaaagaagaaaaagaaacacaaaacaaagaaaaagaagaataagaaaaccaaaaaagaatccagtgactcaagctgtaaagactcagaagaggacttgtcagaagctacctggatggagcagccaaatgtggcagatactatggatttaatagggccagaagcacctataatacatacctctcaagatgaaaaacctttgaagtatggccatgctttgcttcccggtgaaggtgcagctatggctgagtatgtaaaagctggaaagcgaatcccacgaagaggtgaaattgggttgacaagtgaagagatcggttcttttgaatgctcaggttatgtcatgagtggtagcaggcatcgcagaatggaggctgtacgactgcgtaaggagaaccagatctacagtgctgatgagaagagagctcttgcatcctttaaccaagaagagagacgaaagagagaaagtaagattttagccagtttccgagagatggtgcacaaaaagacaaaagagaaagatgacaagtaaggacttacttgttgcacagcaggaattttaacaacaaaaattttatgtgaccaaaagtgttaaaaggctttacagtgctactgtacttaccatattagtaagtccctcaggaaaaagcttcttttgagatatctttagcagcttattttttgttattttaactttaaaaagtaatatgtgcacatggttttaaaaatattcaaccattataggaggagagttagtaaaaagtgaatctttcactttagcccctgacacctttcccccaaaaatatatattttggtgtcttatatacagaatatacattctgtgcatatacaagagtatatgttgcagcataaagattaaaagctattaaagttttttttcgctcgtta

SEQ ID NO: 61606 - DNA, 6058 bp, Homo sapiens
  misc_feature 4153: n = A,T,C or G
tggtgaggttgcctgtaactgacttcaaaaggccattccaccattccgtcaagccagctgctttagaacggttgggaacaccgtgagaccagtgaattccacgagcacgaacccactgctgcgcttcatttgctgtgaagtgagtcccttgatcagagcaatgctgtgtggaccatcatgaaggtggacaaggcattttaaaggggatgtttgggctgaaggtgaagaagaagagaaataaggcagagaaggggttaatcctagccaacaaggctgcgaaagatagtcaaggtgacactgaagcactgcaggaggagccttctcaccaggaaggaccgagaggagatttggtccatgatgatgcttctatctttcctgtcccctcagcttctccaaagagaagatcaaaactattgactaagatccatgatggggaggtcagatcccaaaattatcaaattgccataaccatcaccgaggctcgccagctggtgggtgagaacattgacccagttgtgaccattgagattggggatgagaagaagcaaagcacagtgaaggaaggaaccaacagcccattttataatgaatactttgtcttcgacttcattgggccccaagtgcatctttttgacaagatcatcaaaatctccgtctttcaccacaagctgataggaagtgtactgattggctctttcaaagtagacctggggaccgtgtacaaccaacctggtcatcagttctgcaacaagtgggccctgctcacagaccctggtgacatcaggactggcaccaaggggtacctgaaatgtgacatcagtgtcatgggaaaaggtgatgtcttgaagaccagccctaaaacttctgacaccgaggagccaatagaaaagaaccttttgatccccaatgggtttccactggagagaccgtgggccagattctatgtgagactctacaaagcagaagggttgcccaaaatgaattcaagcatcatggcgaacgtcaccaaggcatttgtgggtgacagtaaggacctggtggatccctttgtggaggtctcctttgctgggcagatggggcgaaccacagtgcagaagaactgtgctgatcctgtgtggcatgaacaggtgatcttcaaggaaatgttccctcccttgtgtcggagggtgaaaatccaggtgtgggatgaaggcagcatgaatgacgtagccctggcaacccatttcattgacctgaagaaaatctccaacgaacaggatggagacaaaggctttctgcccacctttgggcctgcctggattaacctgtatggctcgcccaggaaccacagtctgatggatgactaccaggaaatgaacgaaggctttggggaaggtgtgtcattcaggggcagaatcttggtagaaattgctgtggaaatcctctcaggacgggcacaggaatctaaattttccaaggccctgaaggagctcaagttgccttccaaggacaaagactccaaatcttccaaaggtaaagacaaggctgacaaaactgaagatggaaaatcccaacaggcttcaaacaaaactaactcaaccgaggtggaggtggaatcgttcgatgtccccccggagattgtaccagaaaaaaatgaggaatttttactctttggagcattttttgaagctaccatgattgaccggaagattggagataaacccatcagctttgaagtttctattggtaattttggaaacctgattgatggaggatcccattatgggagtaagaagtcagctgaatcagctgaagaagacctccttccactgcttcacgaagggcaaggggatgtggcccatgatgttcccattcctatggcctccaccactcacccggagaagccactggtgacagaagggaacaggaattacaactatttgccatttgaggctaagaagccctgtgtctatttcatcagctcttggggagaccagaccttcaggctgcactggtccaacatgctggagaaaatggcagacttcctggaagaaagtatagaagaagtgagagaattgatcaagatttcacaggaggcacctgaagagaaaatgaaaacagtgctcagtgacttcatcagtcggagcagtgcctttatctctgaagcagaaaaaaagcccaagatgttgaaccaaaccactttagataagaagcgacttacgctctgctggcaggagctggaagcaatgtgcaaggaggccaaggggatcattcagcagcagaagaaaaagttatctgttgatgaaatgattcacgaagcccaaaactttgtggaaaaaatccgctttcttgttgatgagccccagcacactatccctgacgttttcatctggatgctcagcaacaacaggagagtggcctatgcccgcatcgcctccaaagacctcctctattcccctgtcgcggggcagatgggcaaacactgcggcaagatcaaaactcacttcctcaaacctcctgggaaacgaccggctggttggtctgtgcaagcaaaagtcgacgtgtacctgtggctgggctccatcaagcatgccagtgccattttggacaacttgccagtaggctatgaagcagaaatgtcctccaaaggggctggcaccaatcaccccccatctaacctgctctaccaagaacagcatgtttttcagctgagggctcacatgtaccaagcccggggcctcatcgcagctgacagcaatggactttcagacccttttgccaaagtcacgttcctttctcactgccagacaacaaagataatctcccagaccctctctccgacctggaaccagatgctgctgttcaatgatttggtgctgcatggagatgtgaaggagctggcagagtccccgcccttagtggtggtggagctgtatgacagcgacgctgtggggaagccagaatatttgggtgccacagtggctgctcctgttgtgaagctggctgaccaggactatgagccccccaggttatgctatcaccccatcttttgtgggaatctctctggaggggatctccttgctgtatttgaactgctgcaggttcctccttctgggctgcaaggcctcccacccgttgagccaccagacatcacccagatctacccggttcctgccaacattcggccggtgctgagcaaataccgagtggaggttctcttctggggagttcgggaaatgaagaaggtgcagctcctctctgtggatcggcctcaggctctcattgagtgcggaggacaaggtgtgaagtcctgcgtgatccagagctacaagaacaacccgaacttcagcatccaggcagacgctttcgaagtggaactgcctgagaacgagcttctgcacccgccactgagcatctgcgtggtggactggagagcttttgggaggagtacccttgtgggcacctacaccatcaactacttgaagcagtttttgtgtaaactcagagagccccttgcccccatcacacaggtggatggaacccagcctgggcacgatatttcagattcgctaacagccactgagtcctctggagcccacagctcctcccaggatcccccagcagatcacatttatgtggatgttgagccacctcccacagtggtgcccgactctgcccaggcccagccggccatcctggttgacgtccctgactcatccccgatgctggagcctgaacacacacctgtagcccaggagccaccaaaagatggaaaacctaaggatcccaggaagccttcccggaggtccactaagaggagaaagaggaccatagcagatgaatctgctgaaaacgtgattgactggtggtctaagtattatgcctccctgaagaaagcccagaaggcaaaggagagaaatcccaagggaaaaaaaggcaatacagaggcaaagccagatgaggtagtggtagatatagaagatgggccaaagaagaagaaagacaaaatgctcaagaagaaacccaaagatgatggaatccccaacctggccatcttgcagatatatgacggtgatctcgagagtgaattcaacaattttgaagactgggtgaaaacttttgagctcttcagaggcaagtctacggaagatgaccatggtcttgatggagaccnagtcataggaaaatttaagggctccttctgcatctacaaaagcccccaggattctagctctgaggacagcgggcagctgagaatccagcaagggattccgcccaatcaccctgtcacagtgctgatcagagtatacattgtcgcggcatttaatcttagtccagctgatccagatggcaaatcagatccctacattgtgatcaagcttggcaagacagaaatcaaagaccgggataaatacatccctaaacaactgaacccagtatttggaaggtcatttgagatccaagccacattcccaaaagagtccctgctctccatcctgatctatgaccatgacatgattggcacagatgaccttattggtgagaccaagatcgacctggagaaccgcttctacagcaaacaccgagccatctgtggcttgcagagccagtatgagatagaaggatacaatgcctggagagacacgtccaaacccaccgaaatcctcactaagctctgcaaagacaacaagctggatggaccctactttcaccctgggaaaatacagataggaaaccaagtcttttctggaaaaactatcttcactgaagaggacactgatgagacagtggagtcttatgaacacctggccctcaaggttttacactcttgggaggatatcccagaagttgggtgtaggctggttcctgaacacatagaaactcggccactgtaccacaaggataagccaggaatggagcagggccgcctgcagatgtgggtggacatgtttcccaaggatatgcctcaacctggacctcctgttgacatctctccaaggcgacccaaaggatacgaattgagagtgaccatctggaacactgaagatgtcattttagaggatgagaatatcttcacaggccaaaaatcaagtgatatttatgtgaaagggtggttaaagggcttggaggatgacaagcaggagacagatgtgcattacaactccctgactggagagggcaacttcaactggcgcttcctgtttccctttcagtatctcccagctgagaagcaaatggtcattaccaagagggagaacatcttctctttagagaagatggagtgtaagactcctgctgtgttggtgctgcaggtttgggattttgaaaggctgtcctcagatgacttcctgggcaccctggaaatgaacctcaacagtttccctcgagcagctaagtctgccaaagcctgtgatcttgccaagtttgaaaatgcaagtgaggagaccaagatctctatattccagcaaaaacgtgtgcgtggctggtggcctttttctaaaagcaaagaactcacaggcaaggttgaagctgagttccacctagttacagcagaagaagctgagaaaaatcctgttggaaaagcccgaaaggagccagagcccctggccaagcccaaccgcccagacacctccttttcgtggttcatgagcccctttaagtgcctgtactacctcatctggaagaattacaaaaagtacatcatcattgctttcattctcatcatcctcatcatcttcctcgtccttttcatctacaccttgccaggagccatcagccgaaggatcgttgtgggctcatagaggatcatggaggacccagatcctcgccatatactaatcctctcttccttatctgggagcatctaagaacatgtcccatgcatggcactgtgctgagtgctaaggggacagatcaacccttcttggaagagatggaaaagaaacatttcctccctgctccaacccctgcctccaagtttcaaacttgtaaggcatgttttattccttgggcagcatgaaataaggcactttcacctcatggtaatcaacaatgacctcaaattgacttagaaaaaaaa

SEQ ID NO: 61607 - DNA, 1023 bp, Homo sapiens
gttagacacaggacctgctgggccacagaaaggaggctctgggtagacgcactagattactggataaatcacttcaatttcccaatgaattttatattgtttatttttatacctggagttttttccttaaaaagtagcactttgaagcctactattgaagcattgcctaatgtgctacctttaaatgaagatgttaataagcaggaagaaaagaatgaagatcatactcccaattatgctcctgctaatgagaaaaatggcaattattataaagatataaaacaatatgtgttcacaacacaaaatccaaatggcactgagtctgaaatatctgtgagagccacaactgacctgaattttgctctaaaaaacgataaaactgtcaatgcaactacatatgaaaaatccaccattgaagaagaaacaactactagcgaaccctctcataaaaatattcaaagatcaaccccaaacgtgcctgcattttggacaatgttagctaaagctataaatggaacagcagtggtcatggatgataaagatcaattatttcacccaattccagagtctgatgtgaatgctacacagggagaaaatcagccagatctagaggatctgaagatcaaaataatgctgggaatctcgttgatgaccctcctcctctttgtggtcctcttggcattctgtagtgctacactgtacaaactgaggcatctgagttataaaagttgtgagagtcagtactctgtcaacccagagctggccacgatgtcttactttcatccatcagaaggtgtttcagatacatccttttccaagagtgcagagagcagcacatttttgggtaccacttcttcagatatgagaagatcaggcacaagaacatcagaatctaagataatgacggatatcatttccataggctcaaataatgagatgcatgaaaacgatgagtcggttacccggtgaagaaatcaaggaacccggtgaagaaatcttattgatgaataaataactttaatt

SEQ ID NO: 61608 - DNA, 1722 bp, Homo sapiens
ggttccggaggcttcagtcaagaccctccctcattggccctagaccccttgtccctacccacttccccaggtcatgccagagctcctttgcgaagttctgcagatatccaagtccccttcccagatagcagactttcaggcaaggcatttcaacactcagcacctgcagctgaggcacatccacaaccaagagcctttcctccctgaggatcaacacctccccctgccatcctaagtcaaggtcttgacctaaggacttgtaacaaccaagccaaagcccagaggatggaagcacatgagatcatagaagagcctcatatcaccatggatgcagagaagcaccccccttcaaaggacccctctgctgaggacttacaggagaaccatatctctgaaagcttcttgaagccttccacctctgagaccccgttagagccccatacctctgaatcccctttggtgccatccccttcccagatccccttagaggcccattcccctgaaacccatcaggagccttccatctctgagactccttcagagacccctacctatgaggcttcattggatagtcccatctcagtggtgccagagaaacaccttactcttcctccccaatcacgagactatgtctgtctgtcttcttctgatactctgaaggaagacctctcctctgagtcttcttccaatgaggtcccatggacaaggaggtctacccatctctctgaatctgagagccttccagaacactgtctttcaggcccttcatcccaggtccaagtggacacaaccgaaaagcaggaggaagaagcaggagaggttgaaaagggagtagatgccagtgacagcactgctcacacagcccaacctggacaccaactaggtaacacagcccgcccagtgttccctgctaggcagacagagctggtggaagtggctaaggcaatgcatagagaggagtttggtgctcaagtgaacaatcttttccagtgggagaaggatgcagccctgaatgccatccagacagacagaattcggaactcctctagtggaatcctggctcccgcccacctgcattgtgactgcctataccttgctctctcaacaaagcctccctggtgtaagggggcactggcactacaggcaatcagcatcaagacagaagaagcaaagccaaaagccacatctagacaggctttagatcctgacagactatgggtctctacattggctggcgctgcccccattacctatgggactgtttccggattggggatgagtccagatgcttttgtggacacttgttgagagagcaccggatcatctcagacatatcggtgccctgcaaggtaagccagtgccgctgcttcatgttctgctttatcccatcacgcccagaggaggtgggtgagttctggctcaagagacgggccacctttgaccccaaggcctggagggcccaatgtcgctgcaaacacagccacgaagaacatgcagccactgggccccatccctgcaggcatcatggctgttgctgcggctgttttgagtctaatttcctctgtgcggcctgtgaccggcgctgggaggaacacgagactttctttgacacccagaagacccggcaacgaggaggaaggcctcgcgggacagacactgtcagcaactggcacaggcctttgtgagtctggcccagatcagcaataaaagaggagtcattgg

SEQ ID NO: 61609 - DNA, 1898 bp, Homo sapiens
gtctggactgcggaggccggggcggtggcgtgcagggtgaggtctcccgggctggcgcgcgtgcaagccccctgctgctacctcgcgctaggccagctccaggagggcaacagacgacaggacatttcaaaagggccacttaaattttccttcgagtaaacagaacacctgccaagaccctcgagcctgggcgtgccccaagacaggtggttggggtctaggagtcggctgcagctggcgatgctctgaggggacgtcagggcctcaggatcgcccctatgaagacgaagtgcatctgtgaactgtgctcctgcgggcggcatcactgtccacatctccctaccaagatttatgatgaaacagagaaaccatgtcttctctccgaatataccgagaactaccctttctatcactcctacctgcccagagagtccttcaagccaaggcgggagtaccagaaagggtctataccaatggaaggcctgactacatcaaggagagattttgggcctcacaaagtggcaccagtgaaggtccaccagtatgaccagttcgtcccgagtgaagagaatatggatttgctcacgacgtataagaaagattacaatccctaccctgtctgtcgagtggaccccatcaaacctcgggacagtaaatatccatgtagcgacaagatggagtgtttgcctacttataaagctgattatttgccttggaaccaaccaaggcgagagccacttcgtctggaacacaaataccagccggcatcagtcaggtttgataacagaaccacacaccaggacgattaccccataaaaggccttgtgaagaccataagctgtaaacctctggccatgccaaagctctgtaacatccccttggaggatgtgactaactacaagatgagctatgtggcccaccccgtggagaagcgctttgtgcatgaagcagagaagttcaggccctgtgaaatcccctttgaaagccttaccactcaaaaacaatcctaccggggcctgatgggggagcctgccaagagcttgaaacctctagccaggcctcctgggctagacatgcctttctgtaacaccactgagtttcgagataagtaccaagcttggccaatgccccggatgttctccaaagctcccatcacctacgtccctcccgaagacaggatggatcttctgacaacagtgcaggcccattacacatgccctaagggtgccccagctcagtcctgccgacctgcacttcagattaagaagtgcggtcgctttgaaggctcttccaccaccaaggatgactacaagcagtggtccagcatgcgcacagagccagtcaagcccgttccccagctggacttgcccaccgagcccctggactgcctgaccaccactcgggcccactatgtgccccacctgcctatcaataccaaaagctgtaagcctcattggtctggccctcgaggaaatgtccctgtggaaagccagaccacctacaccatcagctttactcccaaggaaatgggcaggtgcctagcttcatatcctgagcctcctggctacacctttgaggaagtggatgctttgggtcacaggatatacaaaccagtttcccaggcaggctctcagcagagcagccatctttctgtagatgattcagaaaaccccaaccagagggagttggaagtgttagcctgattttgaaaaacagtaatttagaaattacacagtacttttaaaagcagacaactgagaattatttgttggacaaaaaagaattccctaaaatgacaaaaaacaaaaaacaaaaaaccttcaccacttccagagcacttgaataaaatgagaatcacttaaaaaaaaaaaaaaaaaaaaaaaaaaaaaaaaaaaaaa

SEQ ID NO: 61610 - DNA, 2219 bp, Homo sapiens
gcggatggaggcctgagggtggcgggggcggagcgcgccgcgagctgggggcatgtccgcggcgggcgccgtctagaggaaggccaagcagccgccaccacgctgtcggtcgcggagagacgcaagcgagccaggccgagggccgcggcggcgatgcagcgacggcgtcgccctccgccgcccacctcccggctgcccgagggctgcgggggaggaggcggtggcagcgaggaggtggaagtgcagttttccgccgggcgttggggctcggccgcggcggtttcggcggcagcggcggcggccacgcgcagcaccgaggaggaggaggagaggcttgagcgtgagcacttctggaagatcattaatgccttccgctactacggcaccagtatgcatgagcgggtgaaccgaacagaaagacagtttcgatcacttccagctaaccaacagaaactacttcctcagtttcttcttcacttggacaagatccggaaatgcattgatcataatcaagaaatactactgaccattgtgaatgattgcatacatatgtttgaaaataaagaatatggagaagatgggaatggaaagattatgccagcatctacatttgacatggataagttaaaatccacgctgaaacagtttgtgagagactggagtgaaactgggaaagcagaaagggatgcctgttaccagccaatcattaaagaaattttaaaaaattttccaaaagagagatgggatccttctaaagtaaatattctggtacctggtgctggactaggaagactggcctgggaaatagctatgctaggttatgcttgtcaaggaaatgaatggagtttttttatgctcttttcttccaactttgtactcaacagatgttctgaaattaataaatataaactttatccttggatccatcagtttagcaataaccggagatcagctgatcagattcgacccatctttttccctgatgttgacccccacagtcttcctcctggttctaacttttctatgacagcaggagattttcaagagatttattcagaatgcaatacctgggactgtattgctacctgtttcttcatagacacagctcacaatgtaattgattatattgatacaatatggaaaatactcaagccaggtggaatttggataaatctaggtcctctgctgtaccactttgaaaatctggcaaatgaactttccatagaattgagctatgaggatataaaaaacgttgttctgcagtatggattcaaggtagaggtggaaaaagaatctgtattgtcaacatatactgtgaatgatctctctatgatgaaatactactatgaatgtgtcttgtttgtggtccgtaagccacaataatggtctcaagtgataccacctggaaaaaagtttagtaagaacaaatgctgaaatcaacgactcaaaatcaactatcagtgatgacaggacacaacctcaaatcagtggtgccttcttattcctaacgaaatttagaaatagtgtctattttcttaatatgtctattgctttttcagaaatatactatgccatgcagatttgtactacacaagtaaaaatggaggaaatgtcttgaagtatactttttccttgaagcccagaattgtgtttcagtaggaaaaaaacctaatctccagtgtcttcatgatgctgtccattgcaagtctgccgaattaatgactaatagtattgaagtacataataatcttcctttttttgttgttttgtatgcattgcacatgtaacttttagaagagtctaaggatcctcagtcatattcaacatctggagttgggactttgttcactttcaatctaagaaaactatgcgtaaaatatgtctttttttttttttttcttcagagacaggatcccgctctgtctcccaggccggagtgcagtggcacgatcatagctcactgtaacctcaaactcctggactcaagcgatcttcctgccttagccttagcctcctgagtagctaggactgtaggcatgtaccaccgcgcctggcctgtgtctattttatcattcagattaatttaattttgtattttctggctcagatgaacttaaagaagcatcaaacatttcttttttatgaaatgttaaatttaatagcatcacaggccggtaaaatatattcaagtaaaaaaaaaaaaaaaaaaaaaaaaaaaa

SEQ ID NO: 61611 - DNA, 1618 bp, Homo sapiens
atttttcaggtgaggaaacagaggctctgggagctctcgcctgaagccactcgctgtccgccgggccggtggcgttcaccccgcaccgcgctgccccgcccggggcactatggcctggggctggactatgccctccccacctcagccggcgccccccacccacgcgcgctgagggtgcggtgagctgagtgcggggccaagcatgttctggcgtcgacttcgcccaggggcccaggacctggcgcccaaggggctccctggcgacggagacttccgacgcagcagcgacccgcggctgcccaagctgaccccgcccgcgctccgagcggctctgggcgcgcggggctccggggactggaggatcccggggggcggcgccgcgtggtggccggaaggggacgccaagcccggggtgggcgtcggacgcctcccgccgcgcctgcccgccttgctcaccgcgacccggcgggccgtgcggaagcgggggctgctgcggtccctgctgccgcctcccctgctgtcggccggcgcgtcccgggaatcggcgcccaggcagccagggcctggagagcgcgagcgcccccggaggcgcgtggccagggaggaccccgacttcttgggcgccttcctaggagagctcctccccagcaggttccgtgagttcctgcaccagctccaggagaagtgcaccgaggagccggagccactgacatccccagcaccgcaacatcaaaggggtgtattagagcactgcccagggtctccgcggtgtcccaactgttcattcctcccagacctgtggggccagtcatcgcacctccaggatagtcttacgaagatttcgctccagcagacacctattctggggcccctgaagggtgatcactcacaattcaccactgtcagaaaggccaaccacaggccccacggtgcacaggtccccaggctcaaggctgcgctgacccacaacccctcgggggaaggctctaggccctgcaggcagcgttgccctttccgggtgcgattcgctgacgagaccctgcaggacacaacgctccgctactgggagcgcagacgctcagtccaacagagcgtcattgtgaaccagaaggccgccctgccagtggcgtccgagcgggtgtttgggagtgtcggaaaacggctggagagtttgcccaaagccctgtaccctggggccaaggaggagaccctggccagctcctcgtgttgggactgcgctggcctgtccacccagaagacacagggctacctttctgaggacacctccatgaacagcagcctgcccttctgttcatggaagaaggccgctgctcagaggccgcgaagcagcctccgagccttcttggacccgcacagaaacctggagcaggagtccctcctgcccaaccgggtgctgcagtcggtcctgaagcaaggctgccctaaggggtaccatctcctcctggcctccgcaacactgcagccagataagaggtgaacactcgcgaacccaaggccaggggcacacatgggccaggcaatgaggagcgtccttccttgccccacaaataaaggcacatcccaggtggctgggacctgccagtaggtgtcacaccac

SEQ ID NO: 61612 - DNA, 1570 bp, Homo sapiens
atgggggtgggattcactgagctagaatacttggctccctggcttcggccccccttttcagtggatcagagtgtcgctttcagttgtaacggacttcatcacatcacaaattgtactcgttctcatccttttaagaaagttcagacccaggaaaatttccatagtaccttaatgaaaaagatagaaatcagtgggacgtgtctttcctttcatctccttttcggcttggaaatcagaatgagaaggattgtttttgctggtgttatcttattccgcctcttaggtgttatcttattccgcctcttaggtgttatcttattcggccgcttaggtgacctgggaacctgccagacaaaacctggtcagtactggaaagaagaggtccacattcaagatgttggaggtttgatttgcagagcatgcaatctttcactgcccttccatggatgtcttttagacctgggaacctgccaggcagaacctggtcagtactgtaaagaagaggtccacattcaaggtggcattcaatggtattcagtcaaaggctgcacaaagaacacatcagagtgcttcaagagtactctcgtcaagagaattctgcaactgcatgaacttgtaactactcactgctgcaatcattctttgtgcaatttctgagtcagtggcccatatctaaaatgcttggcagatcaatcagtctcgaagcctgacctggctatcacaaaatgatggctattgtcaattagcccacttcagaaacctcagacccttgtaggtagaaggaattttgatctgaaattgactttggttttcaatattcccaatatctcccccaccacctccaactcatctgagaaatagccctttcaacaccatttctctcctctcctccttctgcttaatttaccttcctaccacaaggctacaaagaaggaaaaatgttagtgattctccaagtcaaactaggcatgtcacctctaactactttcatttccctcaataattccatactccaaaatatggttacaaatgtttcacaagacagcaagtgacctgagaatattcatttggtttccaaagcaaactgccttgctcctttggggtgatttatggtatagaagaaactgacttaacatatactatagggaaaaaataagccatgaatcagcaagccaggcctgcgggaaaagtatgaacccaaacaggaaagggctgaggcaggtggtagggctggcacttatttcttccatctgcctcagagtttatccaaattttgaattttccgtaccttaaccatgcctaaatgctttggcttgttcaattttggcagattaagcagttcaaggtaagcagagaagtaagttcccaaccacaaggaatttaaaaggagtaggaacgtactttgaactacatttcccattttgcgatcattacgtcttctattacaatgccctactttggcagcatgaagagtactgcattaatttaatttaatttaaaatttaatttaaaactgtctttctctgtattttcaggagtttgaaaattcaaaaaataaataataaatgtc

SEQ ID NO: 61613 - DNA, 1570 bp, Homo sapiens; identical to SEQ ID NO: 61612

SEQ ID NO: 61614 - DNA, 4445 bp, Homo sapiens
aaaggggatgcccagagctcagttgcttgaaggcgatgggaaatctcgtcatccctctagggaagggcagggcaggcagggttgagagtgggcagaggattccacccccagctcccagaccatctgtggagtgcacaggagacgacattgcacttcagatggagaaaatgctctttcctctgaagagccctagtgccacatggctgagccctagctccactccctggatgatggatttcatcctcaccagtgtgtgtggcctagtgctcctcttcctattgctcctctacgtccacagtgacccaccctcacccccgcccgggaggaagaggagcagcagggagcctcaaagggagagaagcgggaggtccaggagcaggaagatctcagctctgaaagcttgcagaatcctcctgagggagctggaggagactcgggacctgaactaccttctggaaagccacctgaggaagctcgctggcgaaggcagctcccacctgcccttaggtggagaccccctgggggacgtgtgtaaaccagtgcctgctaaggcccaccagccgcatgggaaatgcatgcaagatccgtctcctgccagcttgtccccaccagctcccccagctcctctggcctccaccctgtcaccaggcccgatgaccttctcagagccttttggaccacactcaaccctgagtgcctccgggccaccagagcccttgcttcccctaaaatgccctgcaacccagccacatgtggtttttcctccttcaccacagccgcatggtcccctggcctcctctccacctccacccgactccagcctggctggacttcagtgtggctccacaacatgccccgtcccccagagctcccctctacacaaccaggtgctgcctcctccaaccagggtgatctctggcctggggtgctccagcgatcccatctgggacctctattgctggagggaggctgccaccacctggggcctctccacctactcacatggcaaatcccagccacggcatcttcccgaccacccctcagaggcttccttctggggagaccccacacccaagcacatggaggtaggtggctgcacattcatccaccctgacgtgcagaagctgctggagaccctcatcgccaagagagcactgatgaagatgtggcaggagaaagaaagaaaacgggccgaccacccgcacatgacatcactggggaaggagtgggacatcacgaccctaaatcccttctggaacgtgtcaacccagccacagcagctgccccgtcctcagcaagtctctgatgccacaaccgtggggaaccacttacagcagaaacgcagccagcttttctgggacctcccctctctcaatagcgagtccctggcgaccacagtctgggtttctaggaacccttcctcacagaatgcacactctgtaccactggataaagcctccacttctcttccaggtgaacctgaggttgaggcatcctcacagctttcccaggcaccgccccagccccaccacatggcccagccccaacatttcactccagcctggccccagtcccagcccccacctttggctgagatccagacccaggcccacctctcaccccctgtcccaagcctggggtgctcttctccaccccagattaggggctgtggggcatcttaccctacatcccaggagaggacacagtctgtcatccccactggaaaggagtatcttgaatggcccttgaagaagcgaccaaagtggaagagggttttgccctctctcctcaaaaagtctcaggctgttctgagccagcccactgcccaccttccccaagagaggccggcctcctggagccccaagtcagcccccatccttcccggggttgtcaccagccctgagctcccagagcactggtggcaaggaaggaatgccatccaccaggagcagtcctgtggccctcccagcagattgcaggcatctggggacctgctacagcctgatggggaattcccagggaggccccagagtcaggcagaagacacgcagcaggccctcttgccctcccagccttctgaatttgcagggaagggcaggaaggatgtgcagaagaccgggttcaggagctccggaaggttctctgacaaggggtgcttagggtccaaactagggccggacccaagccgggatcaaggctcaggaaggacctcagtgaaggctctggacgaagacaaggaggcagaaggtgacttacggaggtcctggaagtaccaatcagtaagttccacacccagggacccagacaaggagcatctggaaaacaagctgcaaatccatctggccaggaaggtaggggagatcaaagagggctggatccccatgcctgtgcgtcgctcctggctcatggccaaatgtgctgttcccaagtctgacacccacaggaaacctgagaagctggcatcctggaggggtgggaaagcccacgtgaacacctcccaggagctttccttcctccatccctgcacccagcagatactggaagtacatcttgtaaggttctgtgtgaggcacagctggggtacagacctccagtccctggagcccataaatgtctggtcaggtgaggctcaggccccgcccttcccacaatccacctttaccccctgggcctcctgggtatctcgggttgaatctgtacccaaggttcccattttcctgggaaaacgtcctcagagtggtccaggagacaacagaacaacaagcaagtcagtcccgaccgtgagtggccctctcgctgccccaccgcctgagcaggagggagtccagaggcccccgagagggtcccagtcagctgatacccatgggcgatcagaggcctttccgactggacacaagggcagggggtgttctcagcccccaacatgcagccttgtgggcagaacctggcagagcaggactgtcctggaatccgggaaacccaaacccagactagaggggagtatgggttcagaaatggctgggaacgaggcatggcttgagagtgagagcatgtccccaggagacccctgtagtagcagagccctgcaagagctcagcatagggtcccagtgggcaagggctgaagatgccctgcaggcactgaaagtgggggagaagcccccaacttgggaagtcaccttgggagccagtgtgagggcaagttcgggaagtgttcaggaggatctgaggagcacaggggctctggggaccactggtaacccctcagcgtcttcagtctgtgttgctcaggatccagagcagctgcacctgaaagcgcaggtggtcagtgagattgcgctcatagtgcaggtggactcagaggagcagctgccaggccgtgccccgggcatcctcctccaggacggcgccacaggcctgtgccttccaggccgccacatggacatgctcaccgccgcagacaggctgcccactcaagcccctctgtccacctcccagagtgtgtctggtaagaacatgacagcttcccaggggccatgtgccctcctatggaagggaggggacagtccagggcagcaggagcctgggagcccaaaagcaaaggccccacagaagagtcagaagacgctgggctgtgcgggcaagggcgaggcccacaggaggcccagaacaggggagcagggacacaggtccaagggacccaggacctctgaagccagtgggaggagccaccctgcccaagccagggaaataggagacaaacaagaaaggaaatacaaccagcttcagctggagaagggacagacaccaccagaaagccacttccagagaaagatcagtcaccatccacagggtctacaccccaggaaaggaggcacacggtgggaagatgtcctgcagaaaggcaagcctggggcagatgctttccagagctgggggtctggcccaccaaggcagtttatggactgcatggctgacaaagcctggaccatcagcagagttgtgggacaaatcctggtggacaaactggggcttcagtggggacgaggtccctcagaggtcaatcgccacaaaggtgacttccacgcccaggagaatgtgccttcctgctgccacaggggtcactgccaccaagaacgtagcagagagatgagagctctggcctgcagccctaaagccacccccaagggccaccactgtcctgtcaaaaacaggggcatcagagacagagacagcagttgggccccacctcccagggagcctgtgtccccagctggtccccaccaccacaggccaagaatggcaagcacctcgggcggcccccatccacagctgcaggaactgatgtctgcacagaggtgtcttgcctcctgaactagaccagtcttcttgcatgtctcctgggggagacagggggttctactcaaataaaactgatgcctacac

SEQ ID NO: 61615 - DNA, 5269 bp, Homo sapiens
ggggcctggtctggccaatggaagcacagagtgcaggctcagtggtcacgtgtccagcgggcgggaattttaccccaggaagagatgcaggaggcgatttttacctcagatgttgaaatttacactgctttgaaagaaagaagatatgttttcagcattgaaatatcatgcaatagactatttatatgagaatgtggttagaaagaagttttacagagatgctttattgcttcgaatcccttcatgtttatatcaagatgaaagttaccatgtagcagttactgataataaatttaggaggccatggacgagagtctcagctgtttcagttccgggaatgacagatacctcagtcttggaccaatggaaagcaagtttctttgtggaggatttccttgagaaaaaaacaattacaagaatggtgacccagattaattgtgaatttgaggaagttgttccaagttcaaatccagactcccaaattgaagtagaggaggtcagtttatacacccacatggactacaatgaagtctttacccctgtcagttgtttagaaaaatgttcagcacttcaaaaccagaaccaagatttatttattgatgataaaggaatactttttgtaagtagtagaaaacacctaccaactttgcctactctcttgagtagactaaaactgtttttggtaaaggatcctcttttagatttcaaaggacagatcttcacagaagctaatttttccagggaatgtttctctcttcaagaaactttggaagcttttgtgaaagaagatttttgtatggataaagtgaacttttgtcaagagaaactagaagatacaatatgtttaaatgagccgtcaagttttcttattgagtatgaattcttaatacctccaagcctcaaaccagaaattgatattccatcactctcagaactgaaggagttattaaacccagtgccagaaataataaactatgtagatgaaaaggaaaagctttttgaaagagatcttactaacaagcatggaattgaggatatcggggatataaaattcagctccacagagattttgaccattcaaagccagagtgaaccagaagagtgcagtaaaccaggagagttagaaatgccactaactcctctattcctaacatgccaacattcttcagtgaattcattacgtacagaacttcagacatttccattatctccggtttgtaaaattaatttgcttactgctgaagaatcagctaatgaatactacatgatgtggcaattagaaagatgtagaagccctttgaacccatttttgcttacagtgccaagaattcaagagccccacagccaatattcagttacagatttgaaaaagatattttctgttaaagaagaaagccttgtgattaatctggaaaaggcagagtggtggaaacaagcaggactaaatctgaaaatgatggaaacattggaacatctgaatacatatttatgtcatgataatttgtcttctaatgacactaaaattgagatatttttgcctacgaaagtgcttcaattagaatcatgtctagaacataaaagtcgttcttcacctattgcacttattgatgaaaaatctacaaatgctcatttatcacttccacaaaagagtccatctctggcaaaagaagtaccagatctatgtttttctgatgactatttctctgataaaggagcagcaaaagaagaaaaaccaaagaatgaccaagaaccagtaaacagaataatccaaaagaaagaaaataacgatcactttgaacttgactgcacaggaccatctattaaatcaccttcctcttcaataattaaaaaagcatcttttgaacatggcaaaaaacaagagaatgatttggaccttttgagcgactttattatgctgcgaaataaatataagacttgcacctcaaagactgaagtcacaaacagtgatgaaaaacatgataaagaagcatgttctttgacacttcaagaagaaagtcctattgttcatattaataaaaccctggaggaaataaatcaggaaaggggaacagatagtgtcattgaaattcaagcgtcagatagccagtgccaagcattttgcctcctcgaagcagcagcttctcctatcttaaaaaaccttgtatccttgtgtaccctccctactgctaattggaaatttgccactgttatttttgaccaaacaaggtttctcttaaaggaacaagaaaaagtagtaagtgatgctgttcgccaaggtacaattgatgaaagagaaatgactttcaagcatgccgctctcttacatcttctggtaacaattagagatgtccttttaacatgcagcttggacacagcattgggatatttgtcgaaggcaaaagatatctacaacagcattttaggcccctatttgggtgacatttggagacagctggagattgtacagtttattagggggaaaaagcctgaaaccaactacaagatacaagaattgcaatgtcagatactaagttggatgcaaagtcaacagcaaattaaggtactgattataataagaatggactcagacggtgaaaaacattttctcattaaaattcttaacaaaatagaaggtttaacactgactgtccttcattcaaatgaaagaaaagattttctggaatctgaaggtgttttaaggggtacaagttcctgtgtagttgtacataatcaatatattggagcagatttcccctggagtaatttctcatttgtggtggaatacaattatgtggaagactcttgttggactaaacactgcaaagagttgaatattccttacatggcctttaaagtgattcttccagacacagttttagaaagaagcaccttgctggatagatttggaggttttcttttggaaattcagattccatatgtgttttttgcatctgaaggacttcttaatactccagacatacttcagctgctagaatccaactataacatctcactagtagagagaggctgcagtgagtcattgaaactctttggaagttcagagtgttatgtagtggtgacaattgatgaacacactgccataattttgcaggatctagaagaattgaattgtgagaaggcatcagacaatatcattatgaggctgatggcattatcattacagtacagatattgttggataattttatataccaaagaaacattaaattcagagtatccgcttacagaaaagacacttcatcacctagcactgatttatgcagctttggtttcatttgggctaaactctgaagaactggatgtaaagcttataattgccccaggagtagaagcaactgccttgataattcgacaaattgctgaccacagtttaatgacctcaaagagagatcctcatgaatggttggataaatcctggcttaaagtttcaccatctgaggaagaaatgtacttacttgattttccatgtattaacccattggtggctcagctcatgctaaataaaggaccttcactgcattggatattattagcaactctgtgtcaacttcaggaactcctacctgaagtcccagaaaaagtgttaaagcatttttgtagcatcacttccctattcaagattggttcttcttccataacaaaatcaccgcaaatttcgtcacctcaggaaaataggaatcagattagtaccttgtcttctcaaagttcagcttctgatttagactctgtcattcaagaacataatgaatattatcagtatttaggattaggagagacagtgcaggaagacaaaaccaccactttgaatgacaactcttccattatggaactaaaaggaatctcaagttttttaccacctgtgacttcatacaatcagaccagctactggaaagactccagctgtaaatctaatatagggcagaatactccttttctaattaatatagaatcaaggagaccggcttataactcctttctaaaccacagtgattcagagtcagatgtcttttctttgggtctaacacaaatgaactgtgaaactataaaatcaccaactgacactcagaagagagtgtcagttgtcccccgttttataaattctcagaaaaggagaacacatgaagcaaaaggtttcataaataaagatgtatcggaccctatcttttcactagagggcactcaatctcctcttcattggaactttaagaaaaatatatgggaacaagagaatcacccgttcaacttacaatatggtgcacagcagactgcatgtaacaaattgtactctcagaaaggtaatttattcactgatcagcaaaaatgtctatcagatgagtctgaaggcctcacatgtgaaagttcaaaagatgagactttctggagagaattaccatctgtccccagtttggatttatttcgtgcttctgattctaatgcaaatcaaaaagaattcaacagcctttatttctaccaaagagctggaaaaagtttaggacagaaaaggcaccatgaatcttcatttaactcaggagacaaggaatcattaacaggttttatgtgctcacaactaccacaattcaaaaaacgacgtctagcatatgaaaaagtccctggtagagttgatgggcagactcggctgaggtttttttgaaggaggagaagagcaatgttacatgccatattccactgtttttgatgctaatccactagcgcaattatttagatttgctcatacactaaagaaaacacaattgttcatatatgtctcagtatttctgtattaaatattcataatatgtattctgccctatggtttgcatctttgtaagttaaatattctaatttatcaattagcagaataattatcataagatccaaaatgtcttccagacacccctgcacacaggccatttaaatgagtctccatcacagtctgaccctttgagtcaggaagtgaagatcatcacagttaaccctcccacatcaagaaagttaaaacctaggacaaaattgaagttagaaaacttccaacttaaagtatcattttctgtaaacacaatttaagaacaaattactaagaggaaatatttgcaacccagataataggaaaaaaagtttacatttctcatatataaagaattcctacaaattgatagaaagaagacaacctgatagaagaatgggcaaaatatatgaacagatatttcctcagaaaaaaacaaaaattgtcattaaacatttgaaacac

SEQ ID NO: 61616 - DNA, 2785 bp, Homo sapiens
agaaccttcaactgtcaagcaccgagctagccaccagcatgctgtactccccagggccgagtcttccggagtcagcagagagcctggatggatcacaggaggataagcctcggggctcatgtgcggagcccacttttactgatacgggaatggtggctcacataaacaacagccggctcaaggccaagggcgtgggccagcacgacaacgcccagaactttggtaaccagagctttgaggagctgcgagcagcctgtctaagaaagggggagctcttcgaggaccccttattccctgctgaacccagctcactgggcttcaaggacctgggccccaactccaaaaatgtgcagaacatctcctggcagcggcccaaggatatcataaacaaccctctattcatcatggatgggatttctccaacagacatctgccaggggatcctcggggactgctggctgctggctgccatcggctcccttaccacctgccccaaactgctataccgcgtggtgcccagaggacagagcttcaagaaaaactatgctggcatcttccattttcagatttggcagtttggacagtgggtgaacgtggtggtagatgaccggctgcccacaaagaatgacaagctggtgtttgtgcactcaaccgaacgcagtgagttctggagtgccctgctggagaaggcgtatgccaagctgagtgggtcctatgaagcattgtcagggggcagtaccatggagggccttgaggacttcacaggaggcgtggcccagagcttccaactccagaggccccctcagaacctgctcaggctccttaggaaggccgtggagcgatcctccctcatgggttgctccattgaagtcaccagtgatagtgaactggaatccatgactgacaagatgctggtgagagggcacgcttactctgtgactggccttcaggatgtccactacagaggcaaaatggaaacactgattcgggtccggaatccctggggccggattgagtggaatggagcttggagtgacagtgccagggagtgggaagaggtggcctcagacatccagatgcagctgctgcacaagacggaggacggggagttctggatgtcctaccaagatttcctgaacaacttcacgctcctggagatctgcaacctcacgcctgatacactctctggggactacaagagctactggcacaccaccttctacgagggcagctggcgcagaggcagctccgcagggggctgcaggaaccaccctggcacgttctggaccaacccccagtttaagatctctcttcctgagggggatgacccagaggatgacgcagagggcaatgttgtggtctgcacctgcctggtggccctaatgcagaagaactggcggcatgcacggcagcagggagcccagctgcagaccattggctttgtcctctacgcggtcccaaaagagtttcagaacattcaggatgtccacttgaagaaggaattcttcacgaagtatcaggaccacggcttctcagagatcttcaccaactcacgggaggtgagcagccaactccggctgcctccgggggaatatatcattattccctccacctttgagccacacagagatgctgacttcctgcttcgggtcttcaccgagaagcacagcgagtcatgggaattggatgaagtcaactatgctgagcaactccaagaggaaaaggtctctgaggatgacatggaccaggacttcctacatttgtttaagatagtggcaggagagggcaaggagataggggtgtatgagctccagaggctgctcaacaggatggccatcaaattcaaaagcttcaagaccaagggctttggcctggatgcttgccgctgcatgatcaacctcatggataaagatggctctggcaagctggggcttctagagttcaagatcctgtggaaaaaactcaagaaatggatggacatcttcagagagtgtgaccaggaccattcaggcaccttgaactcctatgagatgcgcctggttattgagaaagcaggcatcaagctgaacaacaaggtaatgcaggtcctggtggccaggtatgcagatgatgacctgatcatagactttgacagcttcatcagctgtttcctgaggctaaagaccatgttcacattctttctaaccatggaccccaagaatactggccatatttgcttgagcctggaacagtggctgcagatgaccatgtggggatagaggcgctgtaggagcctggtcatctctaccagcagcagcagcagcgaggttctagcccaggagggtggggtgcttcttgtagccctcagctctccggtctctgctgatgaaatgggctccaggtggcagtgcccgggtcccaggtgccgtgtttactgcagcagtgggacctccgtgcccactcccccagctcagaggctttctcttttttccccaacccggcttctgatggctggctttcccccaccatcgctctctcagagtatattttactaaagagtagttgatgcttccccagggtccccctggctggggaggccaagaatagggaagggacttgtagcccgtttcttaccctccatgcttgctgtcctgctcacacctacctgctgaccacccatcctggcacagcctctgttttcctccccatctgtggatactattctaataaatagcacatgccattggctaaaaaaaaaaaaaaaaaaaaaaaaaaaaaaaaaaaaaaaaaaaaaaaaaaaaaaaaa

SEQ ID NO: 61617 - DNA, 1085 bp, Homo sapiens
ggaggctcagaccttgccagactgcctgctttcatggatagacataaaaaccttcagcttgaatgttaacaccttgatgggaaaggtggctcatggaatgttttcttatcctttgaacactcctcatttcagaagctttgcttctgttgcaaccaaacatgacacttagcgtgctgagcaggaaggacaaggaaagagtaattcgcagactgttattacaggcccctccaggggaatttgtaaatgcctttgatgatctctgtctgcttatccgtgatgaaaaacttatgcaccaccaaggtgagtgtgcaggccaccaacactgccaaaaatattctgtaccactctgcatcgatggaaatccagtactcttgtctcaccacaatgtaatgggcgactaccgattttttgaccatcaaagcaaactttctttcaaatatgacctgcttcaaaatcagctgaaagacatccaaagtcatggtatcattcagaatgaggcagaatacctgagagttgttcttctgtgcgccttaaaactgtatgtgaatgaccactatccaaaaggaaattgcaacatgctgagaaaaactgtcaaaagtaaggagtacttgatagcttgcattgaagatcacaactatgaaacaggagagtgctggaacggactttggaaatctaaatggattttccaagttaacccatttctaacccaagtaacgggaagaatatttgtgcaagctcacttcttcaggtgtgtcaaccttcatattgaaatatccaaggacctgaaagaaagcttggaaatagttaaccaagctcaactggctctaagttttgcaaggcttgtggaagagcaagagaacaaatttcaagctgcagtcttggaagaattacaggagttatccaatgaagccctgagaaaaattctacgaagggatcttccagtgacccgcactcttattgactggcacaggatactctctgacttgaatctggtgatgtatcctaaattaggatatgtcatttattcaagaagtgtgttgtgcaactggataatataaagaattgctcctggtaactaaaaaaaa

SEQ ID NO: 61618 - DNA, 11242 bp, Homo sapiens
cccggatagccggcggcggcggcggcggcggcggcggcggcggccgggagaggcccctccttcacgccctgcttctctccctcgctcgcagtcgagccgagccggcggacccgcctgggctccgaccctgcccaggccatggccggcaacgtgaagaagagctctggggccgggggcggcagcggctccgggggctcgggttcgggtggcctgattgggctcatgaaggacgccttccagccgcaccaccaccaccaccaccacctcagcccccacccgccggggacggtggacaagaagatggtggagaagtgctggaagctcatggacaaggtggtgcggttgtgtcagaacccaaagctggcgctaaagaatagcccaccttatatcttagacctgctaccagatacctaccagcatctccgtactatcttgtcaagatatgaggggaagatggagacacttggagaaaatgagtattttagggtgtttatggagaatttgatgaagaaaactaagcaaaccataagcctcttcaaggagggaaaagaaagaatgtatgaggagaattctcagcctaggcgaaacctaaccaaactgtccctcatcttcagccacatgctggcagaactaaaaggaatctttccaagtggactctttcagggagacacatttcggattactaaagcagatgctgcggaattttggagaaaagcttttggggaaaagacaatagtcccttggaagagctttcgacaggctctacatgaagtgcatcccatcagttctgggctggaggccatggctctgaaatccactattgatctgacctgcaatgattatatttcggtttttgaatttgacatctttacccgactctttcagccctggtcctctttgctcaggaattggaacagccttgctgtaactcatcctggctacatggcttttttgacgtatgacgaagtgaaagctcggctccagaaattcattcacaaacctggcagttatatcttccggctgagctgtactcgtctgggtcagtgggctattgggtatgttactgctgatgggaacattctccagacaatccctcacaataaacctctcttccaagcactgattgatggcttcagggaaggcttctatttgtttcctgatggacgaaatcagaatcctgatctgactggcttatgtgaaccaactccccaagaccatatcaaagtgacccaggaacaatatgaattatactgtgagatgggctccacattccaactatgtaaaatatgtgctgaaaatgataaggatgtaaagattgagccctgtggacacctcatgtgcacatcctgtcttacatcctggcaggaatcagaaggtcagggctgtcctttctgccgatgtgaaattaaaggtactgaacccatcgtggtagatccgtttgatcctagagggagtggcagcctgttgaggcaaggagcagagggagctccctccccaaattatgatgatgatgatgatgaacgagctgatgatactctcttcatgatgaaggaattggctggtgccaaggtggaacggccgccttctccattctccatggccccacaagcttcccttcccccggtgccaccacgacttgaccttctgccgcagcgagtatgtgttccctcaagtgcttctgctcttggaactgcttctaaggctgcttctggctcccttcataaagacaaaccattgccagtacctcccacacttcgagatcttccaccaccaccgcctccagaccggccatattctgttggagcagaatcccgacctcaaagacgccccttgccttgtacaccaggcgactgtccctccagagacaaactgccccctgtcccctctagccgccttggagactcatggctgccccggccaatccccaaagtaccagtatctgccccaagttccagtgatccctggacaggaagagaattaaccaaccggcactcacttccattttcattgccctcacaaatggagcccagaccagatgtgcctaggctcggaagcacgttcagtctggatacctccatgagtatgaatagcagcccattagtaggtccagagtgtgaccaccccaaaatcaaaccttcctcatctgccaatgccatttattctctggctgccagacctcttcctgtgccaaaactgccacctggggagcaatgtgagggtgaagaggacacagagtacatgactccctcttccaggcctctacggcctttggatacatcccagagttcacgagcatgtgattgcgaccagcagattgatagctgtacgtatgaagcaatgtataatattcagtcccaggcgccatctatcaccgagagcagcacctttggtgaagggaatttggccgcagcccatgccaacactggtcccgaggagtcagaaaatgaggatgatgggtatgatgtcccaaagccacctgtgccggccgtgctggcccgccgaactctctcagatatctctaatgccagctcctcctttggctggttgtctctggatggtgatcctacaacaaatgtcactgaaggttcccaagttcccgagaggcctccaaaaccattcccgcggagaatcaactctgaacggaaagctggcagctgtcagcaaggtagtggtcctgccgcctctgctgccaccgcctcacctcagctctccagtgagatcgagaacctcatgagtcaggggtactcctaccaggacatccagaaagctttggtcattgcccagaacaacatcgagatggccaaaaacatcctccgggaatttgtttccatttcttctcctgcccatgtagctacctagcacaccatctccctgctgcaggtttagaggaccagtgagttgggagttattactcaagtggcacctagaagggcaggagttcctttggtgacttcacagtgaagtcttgccctctctgtgggatatcacatcagtggttccaagatttcaaagtggtgaaatgaaaatggagcagctagtatgttttattattttatgggtcttgagtgcatttgaaggtgtccttcagttcccacgtagagagagtgtggattatattacatgataacctacctggggaacagtccagaaagctatagaacaagtattttgctggaaatcctaattgaggacttaagacttcctgggttaaggatgtggccgtgtgtgtgtgtgtctgcctgtggttgtatgtgtccttgtgattataagattaacctgctgtgtgtgttaattccaggcagggaattagcacaaaaggtttaggaaggaatctttttttaaagacttccatctactgtggtattatacccaagcctagtgtgtattacaacttcaacactcccctttggcttatattaccatgtgcatagctaaagtcttctatttttagaacaccttctgtctgttctttccccatcaactccttcctcatccttcttggtgttctgtcatgggccatgggcttgctatggccagccttactgaggccaagcagcttatgggatgttctttattgtgtgtgatggtattggtttgtttggtagataagtgggaggaaaagtactgttgctacactattataggcatgtttgatactagcagctaacactggtcactccaaagcactgtttctataggaacattgaagctattaagatgttttgattatcctaattacataatgaccgatttgagatagaggcctttaaatacattccatgccctccccagaaaatagtctgtgggagtcagttgccttggtgccaggtatgtgttctgatgtaggtcatgagtctttctacttaatgggaagggaagaacatttgtttccaggatgactttctggccagaataccggaaagcttttaggaagcttcgttcacatgctatttaaatgcacaaaatagacagtaaggatttatctgttcagtttttcttcccagtgaattaatttcagcttatatgggtgtcttcatttgaacatgaggaatattaggttatattttcagcagtggttttttcctttgccctttaaggagtggggataatgtccacggtggcccagcctcttgctgatggcaccttccctgcattgctgcctcccgatgatgtggttcttttcttgtgcctgtggctttgggaatgtaacatctctttcctcctttccttcccttttcctcttcacctgaggtcctaaatactctctgtaattactgtgttcttcacggtaattagacatcattcagtgaataaattactgtagtcaaagacagtatgggctggcagtttgtgtaattgcaagttcataaagagaattgagggtccagttgggagaactattagtcagttcttttatatgctgataaatgatccctcgagttcagttagtattctgtccagagtgtttagctcactttcttagcagtgtgtaagctttctccatgtcagaagcaagcctgctctttgataaatctgtcttcctgaaaatctaaatcatgcttttgtctttagatctacacagaaatgaccctccttggatcagttttctttccagtctaatcatctttggaactaaaacttgttctaactcgtctcttggcattcagctactcctagatcttttggttttatcccctggcctcagagccatttatattcccagagtaggcagtacaggatctcgtgttgatttgctgtggttacccagtgtcttctctacatggcataaagcggcaaagcccaccattaggtgaggcggtcccgagttgaggtagagtggggcagaggaagatggcagtgaatatcaaacagtagaccgccatcaacttctaacagccagtacacacactgtttcattttgaggtaacgttcagttttgcattttgtttaaatattgaaggcctagacaaagaactagaaaaaaaaaagcagtttccaggcccatccatattgtaatttttctttatctgcagatattgcctgtagtctaaagatctctttggaagacaaagcattggctatatatcttttgccttttccatgcatctaaatcttctctggagattatctccctactgtgtaggttaagggcagtctcgacttttccttttttgagtcctgtgtggctctttgaatcagcgtgaaactgaggctccagctccctgtgttgtgtgtgtgtgccatccatgggcttgggtgtcagtttgtcacaggtatctgccagcattcaaggttttggatcatttcatgaggatctttcctttgactgggtgctgtgaggacacacctgggtctgtgcctgagattgccaggcaagattaaggaaagttttcatgtggcttttgttttgaggttattctcaaaaccttaatttcttatattttctgttgactaaggcaccagtaacccattcttcaccctccatttgtatggcaatttaaaagtctttggctttgctctgaatttaattaaaactgccttttatgaacagacttcgagttttgccattttgggcaagcccttccgcttgtcccttcctagtggctaataaagtaaaaaaacccacactactttgttctctttttctcatattcattgggctgttgtattcagccagtctcatgctttccctgggtcttcacggattgctttccaagctgccttgttgcggggttgctgcagagcagcaactggacctttccagctgtcgccatgttccttccactaaagtagagggttcttaaaatggaaaaacctgtgggctcttcatatacctccctttagttaagtaatagaccaggcagcttctcatctcagcatttacctgttaatatttttgtgaatagtgctctctacctgtgggtggccgttctcttccacttgctcgtctccccccagccccattctgcataatctaccattcttctcctctctttctcttcttatacagaccctcattactggggcccaagatgtgggatactactgttagtattatttaactattttgtagatttaaaagatttctggttaagggaggtgggggtcactgttcatcactcttaaaatatgtgttttctctatagaaaagtaaaatgtgtttatggtcccaaacagtcaactcacaaatttttataacaaaatttccttgtaaaaactagggaccatctatatattccctttaagatctagttctttttgtaggtgttcagcaatggtgataaagcagaatattctcctacctcacgtcattaaagtcagaagattatagaccttctcaaactataagtccctcttcttgccgttggcctttctgactctggaatgaccactgttcattgaaaaatagttttctgactattggtctggctctaacagtttgtttgttcatccagcaaatgtttatgagtgatgaccatgtgccagaaatgtcaggtatgtgtccttcccttggcgccacatagtagtttactaatgtttgggggattgtacttggactgtcatagcctctgcgtttgaccttaaaatagctcttcccagtaagattgtgcaatttttattcacagctcttccatgtagacttacctttcctcatagagctatcctggttaataacaggccaagattctcccattatcccctgttgtctcctgtagctttgataatgcctgggagattccttggtgtaagtgtcatggataccgactgtttttatgttggaatttgttccaacataattagaatctgtttggtgagttgaaaggtaagttggctcagagttgcacagtagggcattaaatgtttaagcaaagcatctgcccacactcccctttccaatctagtgccttccttgaactttttcctgagctgctacgtccctaatcccccttgttgggaggattttcgtatcacccttatgggacctgtcaccatgtcctgtactatttggaattggttttccagtctttcaacaaccgttgtggctaactatgttttagaagggctggaggtgtgggccctgtcttcgggtctcaggacccaaagatcctttagtcagttgttgggtcttccaagagccagacattaatacagattgaactccatcagtcccctaattgtcagcctttacctccctcccagagcaaggagtttagggattctaaagcttagtgtccacacatcattctaccagaccttagagctttagaagctcaatctaaaatactgtaactcagcataaactattactatcactcctttgaactcagtctccatgagcagtgttttgttggaaatacatagaacggcttaatgcctagagggtggtggatagtgaaggacggtcaaggttatatttttgactgcttagggattctttggatccaagaaacagaaatgttcaagcggaataaaggagggagtggagttgtggtaaggatgcagggtatttcgcagaacccaggacgggaagtgcctttggttcttgggtggagctggaactgcagagctttgcacctagtcctttctcccgcttcacagtctgcttatggtatatgtggcccccaaataggcactctagtcctcaagtctacaccaccttccaactctggggatcaccatgaacaaattctcaatttcccatacttaattttttttttttttgagatggagtctcgctgtgtcgcccaggctggagtgcagtggtgcagtctcaactcaccacaacctctgcctcccaggttcaagcagttctctgcctcaacctcccgagtagctgggattacaggcgcctgccaccatgcccagctaatgttcatatttttagtagagacagggtttcaccgtcttggctaggctggtcttgaactcctgaccctcatgatccacccacctcggcctcccaaagtgctaagattacaggcgtgagccaccgcgcccggcccatacttcgtattcttaaaaaaaactacactcagcccagcacattgatcaagtatctatctctgagcagttggccttgccagggagagcagagatgtggcaggctccttcagctggagacagggagcttctcagagaagtgagcagagactccacagacaccctaaaaaggcttctactcaagaagtaaagccactactcctgcctttttgcttagtggacaggaaggcacaggagtttgtctgggacatcatagaaattcttaggtttaacttaattctggtcattgtcttctttatttcctgtttttcttccctttgtcagtcttcgcatccaagatttcttccctccctcttgtgggccagcctgtcctgttccagagctagcctgttcctgggtagccttccttagcctccattcagcctcaggtcttttgccttcttccgtgtttatttagagagcagaatctaataacgggttccactgtagccactatccatggacttctgggtcctcttcaggtttgagtgcttgaaaatgttcattctctgggcttgtggcctgtctcctccactctcctcctcaccctctcgctccttcctgtgtgagggccgctctgcagtaatgttctcaggcaagccttcctaggcacctcagaaactactttgccagagccagtaagaatatataatattggagcagttgccaggatagaaattaaatatagattccagtttaggatagagtttttaccgagagctctttagacagtatacctgtgtcttctctggcaattgctttcattttagtcctatataaaagctttccttttctgtttttttttaaaactatgcttttgcttgcctaaatcttttgatcttatatttctctcatctcagagcctgtcctgagttgtaaggtatttcatactgccttacttaaaagttttttaaactactagagtcatttgatacacacagaagttacctaataatccaaagatgtccatcaagggaggaagggtgggtcatcagactttgcctttgatgttgtagactaggctcctgagttaagcagcagagggacagcagtgccatgtgccttcactgtgtcccaggaaatctgggttggttccagtgggaaataccagtatttcttggttctggaaagtagcaaaagagtaggagatggggaaatagggatggggagagcaagccccgcatgtccatggcgagtcaggtggggagcacgggtggaagggccggctgttgacagacagactaagctgtgtggtgctcttgccgccccttcctgggtacagagcttgagaaaaatgcagccgaccactccctgtgtttgtacagagcaaagcccaaaagccaacctcagatctcctgatttggcagctgaagaaatcagcagagtcctgattgcctgattcagtcccaaaaatgaatgtcaggccccgccccctccccaccaacattgcctctcctacattctccttctgcccctaaatcagacaggaggccagagaggagtattgctcaatgcgtgctatgtgcaactcctcaggccttgtgccacctccatgctgagccctgaagcagggtgtcctgggtgcctgtgtgtcagctccctcctctctacctacctctgaccttcttgtgggtgagggtggccatgcttatggccatcttaaaactggagaggcagagaactacttatgagtctgtagaccacgtgttgtcttccatggcctgtttctcctgctgtctgggtgagtgagcctgcaacgcaatgcccatgagagtaaatgcctcctgacctaccctgctcagcactgttctagtgtcttggccttgaaagaaaagcctgacttcctgctgacacatgtggtaggggcatggcagctatgaggcacctcctacgtctgttttctggctgtggtgacttgggatttttaaccttatatatctttttcctttactcaaaacaaaacaatttttagcacactgaaaaaaaaaaaaagccaaatgttttgtgcctttctaaggcagcactgtatcccaggctgcattttaggacttaatatggaaataccagagtctgagctcctctaccttgagtttcattagtccttagtgtctaggagacaggaaagaatgctctctgtgactggagaggtgacatgcaggtgcagtgtgtctggagtccctttcccctgctgtgagacttcagtggaggagagaagcattgtaccctgggatcatttggttggttccaatcacaagcttagttatcaggttgcatgccttgtctcctgcaaaagacagaatgtttcacaattcccaggtaaactctggaccattccaagtgtcctagccttctgatgacattaattacctagttgtgtcgaggagtataggatggactctcctgagaaggggaggttggtggctttgtcttttctttttgctggatcctgaactggtctagacctcctgcccccaccccccagcccccatcagatgtggctggcctttcatttgaaggcttcagacttaaagcattaagcagctagtgccctctgcagggcctggtttccccagggaagggcagcaaggaacatgggaccagaagcctgtcctcagtaatgtgactatagtgagctttagcaaaagtttttctatataatgacatcttacttatcttttaccctttcctcagttttcccctgcctttaactaataaagaattgggagacagaaattttaaagtcctccttattcaagattttgaaattcttagcctgggagtgctggagagaacctgatgctttctccagaatgaagagtcccaatttgtatatcagtgttaagaagaaaacaaaacaaacacataggtgagattttcgtggactattttaaaaatgtgtcattaatataaaaaatttatattagcagtatttaatcattctcacctgtaaagaataagaaaaacagaaggtaaatattcttacagagaatagcagagctttaagattcattttcattttaagtccattttattttgccagtgtattaatgtttagaagtctgttttactaatgttatttattaattttttttcatttccatacacagttagttaactaaagagctttttcaagcacccatgtctgtaaaaaaatatttttaaataaagtttcttttgttgtagcagaaaaaaaaaaaaaaaa

SEQ ID NO: 61619 - DNA, 2177 bp, Homo sapiens
gtgatgccaccactgctcccaggagcccacaggacctggagctctggaagctgatctcctcccactgcaccagccagcaggttcatgttcgaggccatcttcccctccacaccccaagccaggctgaagagagatccacgggaaaagccgggcctgtcctcattcaggtccacattcaggcaacaaagctcacttggtctttgcatcccatgcctcatgttacctaaggaggccagcccgtctgagaggcacagttcgatgtccagctcgatggccagggccctggtgctcctccagagcatggccagccgggacgcccggtgcccagaatggaaaccgcaccaaaagccacgcacgctcagcaagtcggtccagaccatcagccgctactacaggaagacgagtgaacccaaggatgccgccagcctcaccggcttcatgtccaaaatggaacttcgaagggtcttccccacgcatcctgactgcccccagttcagcaccagggccacatccatgtcccactgtggttcacccactgaggccgatttgtccggagagattgacaacagctcggagacctggagaggcacccaggacctgttcttggccaggcggggctcagacacgaacgtggacgggtacctccttcccttcagtaagagcatctgcgagttcgattacttgcggaagaggagaaaatcccagactttgagtccggtcaccagcagctcagtcgcatctcagagctgcctgagaaagaggatgccctggtacctctcagtcatccacgagaaggatcactgcctgtctgagctggagatacaggttcagaagaaagacgaggagatcctgctgctccaggaggagagggaggccctgaagacgcagctgaaatgccttctgaaaggcaaaggccaagagacatccatgtccccaggcaggagggagcagctctcagacgcttcgctgaagctgggcaggctgagcctcctgaaggccttctccagacatgaggaggagctgcagcactggtggcagatgcaggaggagtctgcggcaccggagaggggcaaggagcccgacctgggaggtggcgaggaggacgagggcctggaaggggagcccgatggggtggaggacacgggtgcctggggaggtgtgagccagatgggatccgtgcatgaggagggaagcgaggaggaggaagaggaggaaggggacaaggatgaggactcagaggaaagggagctgccggaggaagaggagatccccaggagaagggcctcctccctggccgagtcgtttgaggaggagctgctggcccagctggaggagtacgagcaggtcatcctggacttccagttcaacctggaggccaccaggaccagatactcccttgcaacaggagtgattgcgtctttacaacaacaagtggatttccaagaaacccagctgcgaaagatcaatacggaaaatgagacgctgcagaaggagctccgagagcggaggcagcagctacaagccatgaccgacaagttctccaacctccgagaagataagaaacaccaagagatgatggggctcattgaaaaggacaaccagctcctccgacagcaagtgtcggaactggagagaaagctcaccaagcgggactgtgtcatctcagagttggacaccaaggtcagccagctgcaggagcaggtggaactggaccagaaccacctgcagaggtggaagcagctgcaggaggatttgcagagcaagaaggagatgattcagcaggcagagcagcacacccgcgtggccctggagagctcccagtccaggctcgagaggttaaggaataagatcatccaggccacctttagcatctccgggaccaagtccttggccaacgagatctctgacaatgacatcctggaagccctgcagagaattatctcagagagaagcgactactataatcagctgaagcagaaaggcgtcaaagtgccccccctgcaacagtcagaggccttcctgaccagcaaatccaagaaggggacctccaagtaggcccagccaggcccccaaatacggtcagcccagcagaggccggggcccagctccagaaccacccgcccccaccatgcgtcctgctctcagactcagaattaaaccccggtgttggcactgtc

SEQ ID NO: 61620 - DNA, 2125 bp, Homo sapiens
caggactgctagcagtaaagatgggggagccagggcccccatcccctccagcccccaaggctgccccaggcctcattgacagcttctctgagatgaacaactaccggcgggccatgcagaagatggcagaggacatcctgtctctgcggagacaggccagcatcctggaaggagagaaccgcatactgaggagccgcctggcccagcaggaggaggaagaggggcagggcaaagccagtgaggcccagaacacggtgtccatgaagcagaaactgctgctgagtgagctggatatgaagaaactgagggacagggtgcagcatttgcagaatgagctgattcgaaagaatgatcgagagaaggagctgctccttctgtatcaggcccagcagccacaggccgctctgctgaagcagtaccagggcaagctgcagaagatgaaggcgctggaggagactgtgcggcaccaagagaaggtgatcgagaagatggagcgggtgctggaggacaggctgcaggacaggagcaagccccctcctctgaacaggcagcagggaaagccctacacgggcttccctatgctctcagcctctggccttcccttgggttctatgggagagaacctgccggttgaactttactcggtgctgctggcagaaaacgcgaagctgcggacggagctggataagaaccgccaccagcaggcccatcattctgcagcaacaggccctgccggtggaccccggggagttgggagcaggaggagacttgacagagaggctacaagagacgcatggcccaggccactcagagtgcacagagaccctgcccgcacaggatctcctctctggtacttcagacaagttcaacctcctggccaagctggaacacgctcagagccggatcctgtccctggaaagccagttagaggactcagctcgacgctggggacgagagaagcaggatctggccacacggctgcaggagcaagaaaaaggtttcaggcacccctcgaactccatcatcatagaacagcctgtgagtgacccccctggagtagctcccaggggttcaggtggtggagcaggaagccaccgcacccccaaagtcactgggccctgagaaaagccattgtggagccaactccagggctgggggtcaggagtcctaggctcccattcctgctccattaccaaccgaaggctcggtcttaattcccccacctgtctaaggggaacagaaaacccctgccaaaactaccctttcccccatggggtgctgtgaaactcaaggagatgactgtggatgaggggtccatgcaggcatctccaggatgccctgacactgtgctttaggactggctgcgctcatgggcagagtagcttgtggccctacccccctgaatccatagagcctaagattctcaaattagcacacccttctcagatggccacgatgtaggctccactttgccaacttcccgagaacaaacaggcctgctcacaactgcccctcaagttcaaccccgggaccgcccagccccgcaaagcaaagaccctgacttctcctgctcttgagccagctgtgctttgcccgtggccagaagctcagcagcggctcctgggaaaggcctggaaaggatgagggaacaggcgaggaacaaaggcaacctttgcacactcacctgagccctggggacccttggagaaattaggtgtcacctgctgtggcaaaatgggtttagaaatctttgccaggtcatggcccactggattctggatactctgaggcctggtttgtcaggcaatatgcccttgagcaggtcaccccctgggaatggggggtactcacgcaccccgctttgcacaccacagagtgccctcacccactccatggacctcaagcagccctcagagctggagcccctgctgcccagctcagactctaagctcaacaagcccttgagcccccagaaggagaccgctaactctcagcagacctgagccccagagcaggcctccttccctgtgtgctggggagtctcatcaccgccccctaaaaatgacgttattaaatgttgtagctctgtgaaaaaaaaaaaaaaaaaaaaaaaaaaaaaaaaaaa

SEQ ID NO: 61621 - DNA, 1953 bp, Homo sapiens
aggtgctcctgggtccgcgcgggtggcgggtgccgcgcacttatccgttggccagctgcgttccgggatcagctaccagacggtccctgagatgaccgggaaccgggctgggggaggatagagccgagactggaggatcgattggcacctccgcccacttttcccacaacgccttcccgaacgataggttggaaaggctcctggatccaaactcgctgagggccaggcaagaaaatgtcctcaaatttattgccaacactgaattctggaggtaaagtaaaagatggctcaaccaaagaggacaggccttataagatctttttcagagatctctttcttgtcaaagaaaatgaaatggcagcaaaggaaacggaaaaatttatgaaccgtaacatgaaagtctaccagaaaactactttttcatccagaatgaagagtcattcatacctgagccaactagctttctaccctaaaaggagtggtaggtcatttgaaaagtttgggccaggtcctgctccgattcctagattaatagaaggttccgacacaaaaaggactgtccatgaatttattaatgaccagagagacaggtttctgctcgagtatgctttgtcaaccaaaagaaacacaatcaaaaagtttgaaaaagacatagcaatgagggaacggcaactaaaaaaagcagagaaaaagctccaagatgatgcactggcctttgaagagttccttcgagaaaatgaccagagatctgtagacgctctgaaaatggcagcacaggaaacaataaacaaactccaaatgacagcagagctgaagaaagcaagcatggaggtacaagcagtgaaaagtgaaatagcaaaaacagaattcctcctcagggagtatatgaaatatggtttttttctgctgcaaatgtctccaaaacattggcaaatccagcaagcactaaaaagagcacaggcatcaaaaagtaaagcaaatatcatccttccaaaaatattagcaaaattatcattacattcaagtaacaaggaaggcatccttgaggagtccgggaggacagctgtcctttcagaagatgcttctcagggaagagacagccaaggaaagccaagcagaagcctgactcgcactccagagaaaaagaaatcaaacctggctgaaagtttcggttcagaagacagtttggaattccttttagatgatgaaatggacgttgatttggagccagcactttatttcaaggaaccagaggagttacttcaagtcctcagagagctggaagagcagaatcttactttgtttcaatattcccaagatgtagatgaaaatcttgaagaggtaaacaaaagagaaaaagttatacaggataaaacaaatagcaacatagagtttcttttggagcaagaaaaaatgcttaaagctaactgtgtgagagaagaagagaaagcagcagaattgcaattaaagtccaagctctttagctttggagaatttaattcagatgctcaggaaatactgatagactcacttagtaaaaagattactcaagtatacaaagtctgcattggagatgctgaggatgacggcctcaacccaattcaaaagctggtaaaagtagaatctcgcctggtagaactgtgtgacctcatcgaatccattcccaaagaaaatgtggaggcaattgagaggatgaaacagaaagaatggcggcaaaagtttcgtgatgagaaaatgaaagaaaaacaaagacaccaacaggaaaggctaaaagctgctctggaaaaagcagtagcacaaccaaagaaaaagttgggaagacaacttgtctttcattcaaaacctccatctggtaacaaacagcagctacctttagtcaatgaaacaaaaacaaaatcacaagaggaagaatatttttttacttgaataaaagcagtaagacattttattacc

SEQ ID NO: 61622 - DNA, 1930 bp, Homo sapiens
tctccctggtcaaccgctctgcaaacaaccatcaatctgatcccacaggcctgagaaagtctgctctccagtacctgctgctgatctgtttcagccgacaagaggcaccatgaaattggaattcacggagaaaaactacaatagcttcgtgctgcagaacctgaacagacagaggaaacgcaaagagtactgggacatggccctgagtgtggacaaccacgtcttctttgcacatcgcaatgtgctggctgctgtctccccactggtgaggagcctcatctccagcaatgacatgaagaccgctgatgagcttttcatcaccattgacaccagttacctgagcccggtcacagtggaccagcttctggactacttctatagcggcaaggtggtgatctccgagcaaaatgtggaggagctgcttcgtggggctcagtatttcaacacaccacgccttcgagttcactgtaacgacttccttattaagtccatctgccgtgccaactgcttgcgctacctcttcttggctgagctgtttgagctcaaagaggtatcagacgtagcttactctggcattcgggacaacttccactactgggccagtcctgagggctccatgcacttcatgcgctgtccacctgttatctttggccgcctgctccgtgatgaaaaccttcacgtgctcaatgaagaccaggcgctcagcgcactcatcaattgggtgtacttccggaaggaggatcgggagaagtatttcaagaagttcttcaattacatcaatctcaatgctgtctccaataagacgctggtgtttgccagcaacaagctggtgggcatggagaacacctcatcccatacaaccctgattgagagtgtcctgatggaccgcaagcaggagcggccatgcagcctgctggtctaccagcggaaaggggccctgcttgattccgtggtcatcctcggtggccagaaggcccacggccagttcaatgatggagtgtttgcttatatcatccaggagaacctgtggatgaagctctcagacatgccctatcgggcagcagcacttagtgccacctctgctggtcgctacatctacatctctggtggcaccactgagcagatttcagggctgaagacagcctggcggtatgacatggatgacaactcctggaccaagttgcctgacctgcccatcgggcttgtcttccacaccatggtgacctgtggggggacagtgtactcagtgggcgggagcattgccccaaggcggtatgtctccaacatctatcgctatgatgagcggaaggaagtctggtgcctggcaggaaagatgagcatccccatggatggcaccgccgtgatcactaaaggagacaggcatctgtacattgtcactggacggtggttggtgaaaggttatatctcccgggtcggggtagtggactgctttgacaccagcactggggacgtggtccagtgtatcaccttccccattgagttcaaccatcggcccctgctctctttccaacaggacaacatcctctgcgtgcacagccaccggcagagtgtggaaatcaatctgcagaaggtgaaggcaagcaagacgaccacctcagtgcctgtcttgcccaacagctgccccttggatgtgtcccatgctatatgctccattggagacagcaaggtgtttgtatgtgggggtgtcaccactgccagcgatgtccagacaaaggactacaccatcaatccaaatgccttcttgctggaccaaaagacaggcaagtggaagaccctggctcctccaccagaggcactggactgtcctgcctgctgtctagccaagctaccttgcaagattcttcaaaggatttaaacattttaagtgggagaataagtaaatgcattattattcacgatttaatgagag

SEQ ID NO: 61623 - DNA, 2438 bp, Homo sapiens
cgaagaggatccggagcagctgctgccagcccgcgggcactgaagtcctcccggctgccgctcgagtagccacgggcgcgatcgggaccagaagtctcctcctccatgatcactttggaagccgggggaagactttgccctgccctgagagctggtctgcgtttcccaggcgcggcggcggcggagcagcagctgcagcagccgagtccaaataggagcggccacagccaggggcgtgtgcgccccgcgcggagcgagctcgggttcccctcggaatgtccccggggcgcccggcgcgctgaccccgaagccgcctccgccttcggcgcctgctgcctccctcggccaggcttgttgttcgggactgtgagcttcctggctcctgggcagtggggaagcccccgggggcgagtgacctcagctggccacgacccagccctcccccgtgcgtatctcgcttaagatggcagcggagtcaggggaactaatcggggcttgtgagttcatgaaagatcggttatattttgctactttaaggaatagaccaaaaagcacagtaaatacccactatttctccatcgatgaggagctggtctatgaaaatttctatgcagattttggaccgctgaacttggcaatggtgtacagatattgctgcaaactaaacaagaaactaaaatcatacagtttgtcaagaaagaaaatagtgcactacacctgttttgaccaacggaaaagagcaaatgcagcatttttgataggtgcctatgcagtaatctatttaaagaagacaccagaagaagcctacagagcactcctgtctggctcaaaccccccctatcttccattcagggatgcttcctttggaaattgcacttacaatctcaccattctcgactgtttgcagggaatcagaaagggattacaacatggattttttgactttgagacatttgatgtggatgaatatgaacattatgagcgagttgaaaatggtgacttcaactggattgttccaggaaaatttttagcatttagtggaccacatcctaaaagcaaaattgagaatggttatcctcttcacgcccctgaagcctactttccttatttcaaaaagcataatgtgactgcagttgtgaggctaaacaaaaagatttatgaggcaaagcgcttcacagacgctggcttcgagcactatgacctcttcttcatagatggcagcacacccagtgacaacatcgtgcgaaggttcctgaacatctgtgagaacaccgaaggggccatcgccgttcactgcaaagctggtcttggaagaacagggacattgatagcctgttatgtaatgaaacactacaggtttacacatgctgaaataattgcttggattagaatatgccggccaggctctattataggaccccagcagcacttcctggaagaaaaacaagcatcgttgtgggtccaaggagacattttccgatccaaactgaaaaatcgaccatccagtgaaggaagtattaataaaattctttctggcctagatgatatgtctattggtggaaatctttcaaaaacacaaaacatggaacgatttggagaggataacttagaagatgatgatgtggaaatgaaaaatggtataacccagggagacaaactacgtgccttaaaaagtcagagacagccacgtacctcaccatcctgtgcatttaggtcagatgatacaaaaggacatccaagagcagtgtcccagcctttcagattaagttcatccctgcaaggatctgcagttactttgaagacatcaaaaatggcactgtccccttcagcaacggccaagaggatcaacagaacttctttgtcttcgggtgccactgtaagaagcttttccataaactcccggctagccagttctctagggaacttgaatgctgcaacagatgatccagagaacaaaaagacctcctcatcctctaaggcaggcttcacagccagcccgtttaccaacctcttgaatggcagctcccagccaactaccagaaattaccctgagctcaacaataatcagtacaacagaagcagcaacagcaacgggggcaacctgaacagccccccaggcccccacagcgccaagacagaggagcacaccaccatcctccgaccctcctacaccgggctttcttcttcttcagcgagattcctgagccgttctatccctgtaagtgcgcagacaccacctcctggtcctcagaaccctgaatgcaacttctgtgccttgccttcccagccgaggctgccaccaaagaaatttaatagtgccaaggaagccttctgagcgatgccttccctctgtgctgtgaaactgtctatgcactacattctgctagctcctcttcaagtaaacgccaagtcacaaaaaaaaaaaaaaaaaaaaaaaa

SEQ ID NO: 61624 - DNA, 567 bp, Homo sapiens
atgttctcgtgttgcttccccacttcgagaggttgctgcttcaggaatggagggagtgagagccttttccgacgatgccgaagaaggctcatccctcaccccagacgcctgtcgcccgttgtaataaggcgcatccaggtaccacaggacagcctggggcaggccctagcaggccaggccacaccagagatcccattggggctgcagctgcacactgtccttgtccaggagattcaggagctcattgaggcacagacacttgctcctggtccatgtgcagaagtaagagcactgccagcaccagcggcggagccagagccagcatgggaagaggcccctccagagagagcactggagctggagggagctccagccaaggaccagaccaacgaggagctgcctgaaatcacggaggtgccggagagcattaaaagaaggctgggaagaagagttccagcagctacgcctgctcccagaggcaacctcctcctccaggcatggatgcgggtccacagctgggcatccaggctgtttgcccctaatgtgctgcccgggacaggcccttaa

SEQ ID NO: 61625 - DNA, 2625 bp, Homo sapiens
gctgctgctgtgatccaggaccagggcgcaccggctcagcctctcacttgtcagaggccggggaagagaagcaaagcgcaacggtgtggtccaagccggggcttctgcttcgcctctaggacatacacgggaccccctaacttcagtcccccaaacgcgcaccctcgaagtcttgaactccagccccgcacatccacgcgcggcacaggcgcggcaggcggcaggtcccggccgaaggcgatgcgcgcagggggtcgggcagctgggctcgggcggcgggagtagggcccggcagggaggcagggaggctgcagagtcagagtcgcgggctgcgccctgggcagaggccgccctcgctccacgcaacacctgctgctgccaccgcgccgcgatgagccgcgtggtctcgctgctgctgggcgccgcgctgctctgcggccacggagccttctgccgccgcgtggtcagcggccaaaaggtgtgttttgctgacttcaagcatccctgctacaaaatggcctacttccatgaactgtccagccgagtgagctttcaggaggcacgcctggcttgtgagagtgagggaggagtcctcctcagccttgagaatgaagcagaacagaagttaatagagagcatgttgcaaaacctgacaaaacccgggacagggatttctgatggtgatttctggatagggctttggaggaatggagatgggcaaacatctggtgcctgcccagatctctaccagtggtctgatggaagcaattcccagtaccgaaactggtacacagatgaaccttcctgcggaagtgaaaagtgtgttgtgatgtatcaccaaccaactgccaatcctggccttgggggtccctacctttaccagtggaatgatgacaggtgtaacatgaagcacaattatatttgcaagtatgaaccagagattaatccaacagcccctgtagaaaagccttatcttacaaatcaaccaggagacacccatcagaatgtggttgttactgaagcaggtataattcccaatctaatttatgttgttataccaacaatacccctgctcttactgatactggttgcttttggaacctgttgtttccagatgctgcataaaagtaaaggaagaacaaaaactagtccaaaccagtctacactgtggatttcaaagagtaccagaaaagaaagtggcatggaagtataataactcattgacttggttccagaattttgtaattctggatctgtataaggaatggcatcagaacaatagcttggaatggcttgaaatcacaaaggatctgcaagatgaactgtaagctcccccttgaggcaaatattaaagtaatttttatatgtctattatttcatttaaagaatatgctgtgctaataatggagtgagacatgcttattttgctaaaggatgcacccaaacttcaaacttcaagcaaatgaaatggacaatgcagataaagttgttatcaacacgtcgggagtatgtgtgttagaagcaattccttttatttctttcacctttcataagttgttatctagtcaatgtaatgtatattgtattgaaatttacagtgtgcaaaagtattttacctttgcataagtgtttgataaaaatgaactgttctaatatttatttttatggcatctcatttttcaatacatgctcttttgattaaagaaacttattactgttgtcaactgaattcacacacacacaaatatagtaccatagaaaaagtttgttttctcgaaataattcatctttcagcttctctgcttttggtcaatgtctaggaaatctcttcagaaataagaagctatttcattaagtgtgatataaacctcctcaaacattttacttagaggcaaggattgtctaatttcaattgtgcaagacatgtgccttataattatttttagcttaaaattaaacagattttgtaataatgtaactttgttaataggtgcataaacactaatgcagtcaatttgaacaaaagaagtgacatacacaatataaatcatatgtcttcacacgttgcctatataatgagaagcagctctctgagggttctgaaatcaatgtggtccctctcttgcccactaaacaaagatggttgttcggggtttgggattgacactggaggcagatagttgcaaagttagtctaaggtttccctagctgtatttagcctctgactatattagtatacaaagaggtcatgtggttgagaccaggtgaatagtcactatcagtgtggagacaagcacagcacacagacattttaggaaggaaaggaactacgaaatcgtgtgaaaatgggttggaacccatcagtgatcgcatattcattgatgagggtttgcttgagatagaaaatggtggctcctttctgtcttatctcctagtttcttcaatgcttacgccttgttcttctcaagagaaagttgtaactctctggtcttcatatgtccctgtgctccttttaaccaaataaagagttcttgtttctgaagaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 61626 - DNA, 1203 bp, Homo sapiens
gtggaaattgaggggagaaaaaaaaagggaaaaaaagggtctgtccttcctgggattcctagccgaggccagtctgctgccgtgtgcgtgtgcgtcagggctctccgggcggcaatgggggcttgagagccgggtccccagcgccgggaagggagcgcggtggccgccaccgccaccgccccggagtccggcgccgaagctgcgggcgggcgggcgggcaccagctcggtcaggggctgcttggcgcggcactgtgcggtgcagcggcggcgcggcgcggtgcgggcttttcccaggcgccccggggtcgggtggccaacggcgcggccgcgggcgctgagcgcgaccggttcgcggtagcggtggcggcggcgtgcgtgccaggggctgggggctccgccgcctctcttgcggctcaccgagctccgcgcttccctctctccagggcaggcggcttctcagagcacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaacctgcaccccgcccctcacttgctggctagtatgcagctgcagaaacttaatagccagtatcaggggatggctgctgccactccaggccaacccggggaggcaggacccctgcaaaactgggactttggggcccaggcgggaggggcagaatcactctctccttctgctggtgcccagagccctgctatcatcgattcggacccagtggatgaggaagtgctgatgtcgctggtggtggaactggggttggaccgagccaatgagcttccggagctgtggctggggcagaatgagtttgacttcactgcggactttccatctagctgctaatgccaagtgtccctaaagatggaggaataaagccaccaattctgttgtaaataaaaataaagttacttacaaaaaaaaaaaaaaaaaaaaaa

SEQ ID NO: 61627 - DNA, 2169 bp, Homo sapiens
gtccccgccgtgcgcccttcgccgctgagctcgcagcctccggcgcccacctccacctccagtgtcccgcctcgggccgtcgccctccagcggctcgcgagcgtgggagacgtacctgggcaggcactgtccagcccaggcccaggcacagccgtgaggggcgaggcacggggacatcctggcggccaccatggtggccacgtgcctgcaggtggtgggcttcgtcacgagcttcgtgggctggatcggggtcatcgtgaccacctccaccaatgactgggtggtgacctgcggctacaccatccccacctgccgcaagctggatgagctgggctccaaggggctgtgggccgactgcgtcatggccacggggctgtaccactgcaagcccctggtggacatcctcatcctgccgggctacgtgcaggcctgccgcgccctgatgattgctgcctcggtcctgggtctgccggccattttactgctgctgactgttcttccctgcatccggatgggccaggagcccggtgtggctaagtacaggcgggcccagctggctggtgttttgctcattctgctggctctctgcgcccttgttgccaccatctggttccctgtgtgcgcccaccgtgagaccaccatcgtgagctttggctactccctgtatgcaggctggattggtgctgtgctgtgcctcgtgggtggctgtgtcatcctctgctgcgctggagatgcccaggcctttggtgaaaaccgtttctactacactgcgggctctagctccccgactcatgcgaagagtgcccacgtataagagggctgcccggctgcccacagaggtgctgtagatgctgggcccagggccctaggtttgctcgtcacagtgtggggaagcccattcctctgccaggctctaaagccaaaggtctagaaaagcatcctgtctggcattttgtagtcttaacttctccccatttcccccatcttttggttgccttaaaagaaatctctagctcagataatgcccagacatttttttcccttggtgttgcccctattagctcttttcttgggcattcttttgctgtttattaaaaatatattatatatattttgtttctttaaatttcaaatgttttgcaaacatcactgagttaggtgggggtggggaagagaaatacaagatacttttttttttttttttttttttttttttttaaatagggcctcactctgttgctcaggctggagtgcggtggtgtgatctcggctcatgtagcctcaacctccccggctcaagtgatcctcctgcctcagcctcccaagtagctgggactacaggcgttcactactacacccagctaatttttaagttttttatagagatgagggctccctatgttgcccaggttggtctcgaactcctggactcaaagtatcctcccgcctcggcctcccaaagtgttgggattataggagtgagccaccacaccaggccaagatgcttttcaaactgatacagatgacaatgggagcctcataaagatggcttttgtttcttcccttcaaggtcatttacttgtacgagacagaaaaagatagcattggggacatgggatgggggagggagggcaatagtggaacgaactttccatgggaaactttcccttttgtaagttgagggccaggggtagggatattttttagtttgtgattttacatttatctgtacatactttttcaagattgatcatttttataaccatggttttcctgaaatcctcaattcatcaatatgaaggaaatgaaccacatagactttatgcaataaataacagtgcaagtgagtataactctaactgatgttccacaaaacatttttgatttcaggtttgtatgatgtagtttttaatcgtacattttcatatgcttcaaactaacacatttttaaagctttcccccacttttctctctatttgtattgttagccatcttgaagtgatgttgtttaacataaattgtactgttgaatttggctttacgggtgtaaacactgatggtatatcagtatctgagaccccaaactctccaaatactgatggtgcattttattcttgaagtgaaatctgtgcaataaaataacagactgtctgcaaaaaaaaaaaaaaa

SEQ ID NO: 61628 - DNA, 780 bp, Homo sapiens
aaggaaagccaccacacgcccacccccaaagcccacactcccaccccccacgccctctgcacacactgaatccaaactcttaaatgagatggcgatcaaagagcgcgtggagggccgagccaaagtcccgtacaaattcagggacagcctcaaacgtttctccttctcgcccactggaatgttgaagatcctgagactgagtcttatcttaggagcattagcttgtttcatcatcacccaagccaatgagtcatttataacaatcacaagtctggaaatctgcattgtcgttttttttattctaatatatgtgctaacccttcaccacttgctgacctatttacattggcccttacttgatcttaccaacagtatcattacagctgtgttcctttcagtagttgccatcttggccatgcaagaaaagaaaagaaggcatttactctatgtcggggggtccctgtgtctcacagcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaaaaaaaaaaaaaaaaaaaa

SEQ ID NO: 61629 - DNA, 764 bp, Homo sapiens
aaggaaagccaccacacgcccacccccaaagcccacactcccaccccccacgccctctgcacacactgaatccaaactcttaaatgagatggcgatcaaagagcgcgtggagggccgagccaaagtcccgtacaaattcagggacagcctcaaacgtttctccttctcgcccactggaatgttgaagatcctgagactgagtcttatcttaggagcattagcttgtttcatcatcacccaagccaatgagtcatttataacaatcacaagtctggaaatctgcattgtcgttttttttattctaatatatgtgctaacccttcaccacttgctgacctatttacattggcccttacttgatcttaccaacagtatcattacagctgtgttcctttcagtagttgccatcttggccatgcaagaaaagaaaagaaggcatttactctatgtcggggggcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaaaaaaaaaaaaaaaaaaaa

SEQ ID NO: 61630 - DNA, 784 bp, Homo sapiens
agagccgggtgcacgcgccggggaggtagccaacagccgttgggacgcgacgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctgagtcttatcttaggagcattagcttgtttcatcatcacccaagccaatgagtcatttataacaatcacaagtctggaaatctgcattgtcgttttttttattctaatatatgtgctaacccttcaccacttgctgacctatttacattggcccttacttgatcttaccaacagtatcattacagctgtgttcctttcagtagttgccatcttggccatgcaagaaaagaaaagaaggcatttactctatgtcggggggtccctgtgtctcacagcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaaaaaaaaaaaaaaaaaaaaa

SEQ ID NO: 61631 - DNA, 768 bp, Homo sapiens
agagccgggtgcacgcgccggggaggtagccaacagccgttgggacgcgacgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctgagtcttatcttaggagcattagcttgtttcatcatcacccaagccaatgagtcatttataacaatcacaagtctggaaatctgcattgtcgttttttttattctaatatatgtgctaacccttcaccacttgctgacctatttacattggcccttacttgatcttaccaacagtatcattacagctgtgttcctttcagtagttgccatcttggccatgcaagaaaagaaaagaaggcatttactctatgtcggggggcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaaaaaaaaaaaaaaaaaaaaa

SEQ ID NO: 61632 - DNA, 643 bp, Homo sapiens
agagccgggtgcacgcgccggggaggtagccaacagccgttgggacgcgacgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctggcaagtagcggcagcgtagatcttaccaacagtatcattacagctgtgttcctttcagtagttgccatcttggccatgcaagaaaagaaaagaaggcatttactctatgtcggggggtccctgtgtctcacagcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaaaaaaaaaaaaaaaaaaaaa

SEQ ID NO: 61633 - DNA, 625 bp, Homo sapiens
agagccgggtgcacgcgccggggaggtagccaacagccgttgggacgcgacgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctggatcttaccaacagtatcattacagctgtgttcctttcagtagttgccatcttggccatgcaagaaaagaaaagaaggcatttactctatgtcggggggtccctgtgtctcacagcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaaaaaaaaaaaaaaaaaaaaa

SEQ ID NO: 61634 - DNA, 610 bp, Homo sapiens
agagccgggtgcacgcgccggggaggtagccaacagccgttgggacgcgacgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctggatcttaccaacagtatcattacagctgtgttcctttcagtagttgccatcttggccatgcaagaaaagaaaagaaggcatttactctatgtcggggggcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaaaaaaaaaaaaaaaaaaaaaa

SEQ ID NO: 61635 - DNA, 780 bp, Homo sapiens
agagccgggtgcacgcgccggggaggtagccaacagccgttgggacgcgacgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctggcaagtagcggcagcgtagtgagttctgtacccaaggcacagcgcaacatctcagcgaagaccgcaccccggaagcaccccgcagtctcaattcgcagtgcgcagtccgcagccgccgcacgtccccaaggcagtgagggcaccgcaccctcaaggatcttaccaacagtatcattacagctgtgttcctttcagtagttgccatcttggccatgcaagaaaagaaaagaaggcatttactctatgtcggggggtccctgtgtctcacagcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaaaaaaaaaaaaaaaaaaaaa

SEQ ID NO: 61636 - DNA, 764 bp, Homo sapiens
agagccgggtgcacgcgccggggaggtagccaacagccgttgggacgcgacgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctggcaagtagcggcagcgtagtgagttctgtacccaaggcacagcgcaacatctcagcgaagaccgcaccccggaagcaccccgcagtctcaattcgcagtgcgcagtccgcagccgccgcacgtccccaaggcagtgagggcaccgcaccctcaaggatcttaccaacagtatcattacagctgtgttcctttcagtagttgccatcttggccatgcaagaaaagaaaagaaggcatttactctatgtcggggggcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaaaaaaaaaaaaaaaaaaaaa

SEQ ID NO: 61637 - DNA, 918 bp, Homo sapiens
agagccgggtgcacgcgccggggaggtagccaacagccgttgggacgcgacgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctgagtcttatcttaggagcattagcttgtttcatcatcacccaagccaatgagtcatttataacaatcacaagtctggaaatctgcattgtcgttttttttattctaatatatgtgctaacccttcaccacttgctgacctatttacattggcccttacttaatgccgagtacaggaagcagacaaagcaaatatgagcaactttaattgaacatgtggaagacccttttagttatggagaggtttctcaggggaaactcaaatctctgtccgtggaaattttcaagaagggaaggatcttaccaacagtatcattacagctgtgttcctttcagtagttgccatcttggccatgcaagaaaagaaaagaaggcatttactctatgtcggggggtccctgtgtctcacagcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaaaaaaaaaaaaaaaaaaaaa

SEQ ID NO: 61638 - DNA, 902 bp, Homo sapiens
agagccgggtgcacgcgccggggaggtagccaacagccgttgggacgcgacgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctgagtcttatcttaggagcattagcttgtttcatcatcacccaagccaatgagtcatttataacaatcacaagtctggaaatctgcattgtcgttttttttattctaatatatgtgctaacccttcaccacttgctgacctatttacattggcccttacttaatgccgagtacaggaagcagacaaagcaaatatgagcaactttaattgaacatgtggaagacccttttagttatggagaggtttctcaggggaaactcaaatctctgtccgtggaaattttcaagaagggaaggatcttaccaacagtatcattacagctgtgttcctttcagtagttgccatcttggccatgcaagaaaagaaaagaaggcatttactctatgtcggggggcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaaaaaaaaaaaaaaaaaaaaa

SEQ ID NO: 61639 - DNA, 745 bp, Homo sapiens
agagccgggtgcacgcgccggggaggtagccaacagccgttgggacgcgacgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctggaagcagacaaagcaaatatgagcaactttaattgaacatgtggaagacccttttagttatggagaggtttctcaggggaaactcaaatctctgtccgtggaaattttcaagaagggaaggatcttaccaacagtatcattacagctgtgttcctttcagtagttgccatcttggccatgcaagaaaagaaaagaaggcatttactctatgtcggggggtccctgtgtctcacagcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaaaaaaaaaaaaaaaaaaaaa

SEQ ID NO: 61640 - DNA, 770 bp, Homo sapiens
agagccgggtgcacgcgccggggaggtagccaacagccgttgggacgcgacgctggttcccaggggagagccagccgctgccgcggcactggttcagacggccaggccctagggacccaccatggatcctgaacacgccaagctaacccttcaccacttgctgacctatttacattggcccttacttgctgctgagctctctctgtcccacagaatgccgagtacaggaagcagacaaagcaaatatgagcaactttaattgaacatgtggaagacccttttagttatggagaggtttctcaggggaaactcaaatctctgtccgtggaaattttcaagaagggaaggatcttaccaacagtatcattacagctgtgttcctttcagtagttgccatcttggccatgcaagaaaagaaaagaaggcatttactctatgtcggggggtccctgtgtctcacagcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaaaaaaaaaaaaaaaaaaaaa

SEQ ID NO: 61641 - DNA, 943 bp, Homo sapiens
agagccgggtgcacgcgccggggaggtagccaacagccgttgggacgcgacgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctggaagcagacaaagcaaatatgagcaactttaattgaacatgtggaagacccttttagttatggagaggtttctcaggggaaactcaaatctctgtccgtggaaattttcaagaagggaaggtgtaagcttcctgcaaagctgcaaaccactgtacctgcctcagtcaggcctgcccactatgggcagacctctcgctcagcctgcagaacccagctgggacttacttccaacctccaccagccctgctacatacccctgttccagcattaactaccaggcaccaaaacagtaggcattagtgcctttccaagaggcaagatcttaccaacagtatcattacagctgtgttcctttcagtagttgccatcttggccatgcaagaaaagaaaagaaggcatttactctatgtcggggggtccctgtgtctcacagcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaaaaaaaaaaaaaaaaaaaaa

SEQ ID NO: 61642 - DNA, 3067 bp, Homo sapiens
agaggtgcgcgctgcgcgtgggatcagcccggcgccgacgggtggctccgaggagctcgctccttcctcgcccccgccccctcgccgcgcggggccagcccggccgctcctcccctgggtgggtccctgctccttttctggcagggtctatttgcatagaggaaactgcccaaagtggccgctgtggaggagctggctgcggcgaagggggcgtgcgcggcgatccgctgctacccggaggctaacccccgcgcccggcggacctcgtgcctcgggctgtcccgcctgctcctctcgcacccagcctctgccccagcagcaccgccccctcggagagtccacgcgcgacgaacgcgccatgggcccaggcgagcgcgccggtggcggcggcgacgcggggaagggcaatgcggcgggcggcggcggcggagggcgctcggcgacgacggccgggtcccgggcggtgagcgcgctgtgcctgctgctctccgtgggctcggcggctgcctgcctgctgctgggtgtccaggcggccgcgctgcagggccgggtggcggcgctcgaggaggagcgggagctgctgcggcgcgcggggccgccaggcgccctggacgcctgggccgagccgcacctggagcgcctgctgcgggagaagttggacggactagcgaagatccggactgctcgggaagctccatccgaatgtgtctgccccccagggccccctggacggcgcggcaagcctgggagaagaggcgaccctggtcctccagggcaatcaggacgagatggctacccgggacccctgggtttggatggcaagcccggacttccaggcccgaaaggggaaaagggtgcaccaggagactttggcccccggggagaccaaggacaagatggagctgctgggcctccggggccccctggacctcctggggcccggggccctcctggcgacactgggaaagatggccccaggggagcacaaggcccagcgggccccaaaggagagcccggacaagacggcgagatgggcccaaagggacccccagggcccaagggtgagcctggagtacctggaaagaagggcgacgatgggacaccaagccagcctggaccaccagggcccaagggcgagccagggagcatggggcctcggggagagaacggtgtggacggtgccccaggaccgaagggggagcctggccaccgaggcacggatggagctgcagggccccggggtgccccaggcctcaagggcgagcagggagacacagtggtgatcgactatgatggcaggatcttggatgccctcaaggggcctcccggaccacaggggcccccagggccaccagggatccctggagccaagggcgagcttggattgcccggtgccccaggaatcgatggagagaagggccccaaaggacagaaaggagacccaggagagcctgggccagcaggactcaaaggggaagcaggcgagatgggcttgtccggcctcccgggcgctgacggcctcaagggggagaagggggagtcggcgtctgacagcctacaggagagcctggctcagctcatagtggagccagggccccctggcccccctggccccccaggcccgatgggcctccagggaatccagggtcccaagggcttggatggagcaaagggagagaagggtgcgtcgggtgagagaggccccagcggcctgcctgggccagttggcccaccgggccttattgggctgccaggaaccaaaggagagaagggcagacccggggagccaggactagatggtttccctggaccccgaggagagaaaggtgatcggagcgagcgtggagagaagggagaacgaggggtccccggccggaaaggagtgaagggccagaagggcgagccgggaccaccaggcctggaccagccgtgtcccgtgggccccgacgggctgcctgtgcctggctgctggcataagtgacccacaggcccagctcacacctgtacagatccgtgtggacatttttaatttttgtaaaaacaaaacagtaatatattgatcttttttcatggaatgcgctacctgtggccttttaacattcaagagtatgcccacccagccccaaagccaccggcatgtgaagctgccggaaagtggacaggccagaccagggagatgtgtacctgaggggcacccttgggcctgggctttcccaggaaggagatgaaggtagaagcacctggctcgggcaaggctagaaagatgctacgttgggccttcagtcacctgatcagcagagagactctcagctgtggtactgccctgtaagaacctgcccccgcaaaactctggagtccctgggacacaccctatccaagaagacccaggggtggaacagcggctgctgttgctcctggcctcatcagcctccaaactcaaccacaaccagctgcctctgcagttggacaagacttggcccccggacaagactcgcccagcacttgcggctgggcccggggagcagtgagtggaaatcccccacgagggtctagctctaccacattcaggaggcctcaggaggccagcctgccatgagagcacatgtcctctggccaggagtagtggctgagctctgtgatcgctgtgatgtggacccagctccagggagcagagtgtcggggatggaggggcccagcctggactgactgtacttcctgtctctgtttccattatcacccagagagggacaagataggacatggcctggaccagggaggcaggcctcccactcagagtctgggtctcactggccccaagtctcccacccagaactctggccaaaaatggctctctaggtgggctgtgcaggcaaagcaaagctcagggctggttcccagctggcctgagcagggggcctgccaccagacccacccacgctctgacgagaggcttttccacctccagcaagtgttcccagcaaccagctccatcctggctgcttgccttccatttccgtgtagatggagatcactgtgtgtaataaaccacaagtgcgtgtcaaaaaaa

SEQ ID NO: 61643 - DNA, 2511 bp, Homo sapiens
ccgacgccgcagctcagactccgctcagccatggccgggccgcgcgcgtgcgccccgctcctgctcctgctcctgctcggggagcttctggcggccgccggggcgcagagagtgggactccccggcccccccggccccccagggccgcccggcaagcccggccaggacggcattgacggagaagctggtcctccaggtctgcctgggcccccgggaccaaagggggccccaggaaagccggggaaaccaggagaggctgggctgccgggactgccgggtgtggatggtctgactggacgagatggaccccctggacccaagggtgcccctggggaacggggaagtctgggacccccggggccgcccgggctggggggcaaaggcctccctggaccccccggagaggcaggagtgagcggccccccaggtgggatcggcctccgcggccccccgggacctcctggactccccggcctccctggtcccccaggacctcccggaccccctggacacccaggagttctccctgaaggcgctactgaccttcagtgcccaagtatctgcccgccaggtcccccagggccccctggaatgccagggttcaagggacccactggctacaaaggcgagcagggggaagtcggcaaggacggcgagaagggtgaccctggcccccctgggcccgccggcctcccgggcagcgtggggctgcagggcccccggggattacgaggactgccagggccactcgggccccctggggaccggggtcccattgggttccgagggccgcctgggatcccaggagcgcctgggaaagcgggtgaccgaggcgagaggggcccagaagggttccgcggccccaagggtgacctcggcagacctggtcccaagggaacccccggagtggccgggccaagcggagagccgggcatgccgggcaaggacggccagaatggcgtgccaggactcgatggccagaagggagaggctggtcgcaacggtgctccgggagagaagggccccaacgggctgccgggcctccctggacgagcggggtccaaaggcgagaagggagaacggggcagagctggggagctgggtgaggccggcccctctggagagccaggcgtccctggagatgctggcatgcctggggagcgcggtgaggctggccaccggggctcagcgggggccctcggcccacaaggccctcccggagcccctggtgtccgaggcttccagggccagaagggcagcatgggagaccccggccttccaggcccccagggcctccgaggtgacgtgggcgaccggggtccgggaggtgccgcaggccctaagggagaccagggtattgcaggttccgacggtcttcctggggataaaggagaactgggtcccagcggcctggtcggacccaaaggagagtctggcagtcgaggggagctgggccccaaaggcacccagggtcccaacggcaccagcggtgttcagggtgtccccgggccccccggtcctctgggcctgcagggcgtcccgggtgttcctggcatcacggggaagccgggagttccggggaaggaggccagcgagcagcgcatcagggagctgtgtggggggatgatcagcgaacaaattgcacagttagccgcgcacctaaggaagcctttggcacccgggtccattggtcggcccggtccagctggcccccctgggcccccaggacccccaggctccattggtcaccctggcgctcgaggaccccctggataccgcggtcccactggggagctgggagaccccgggcccagaggaaaccagggtgacagaggagacaaaggcgcggcaggagcagggctggacgggcctgaaggagaccaggggccccaaggaccccaaggcgtgcccggcaccagcaaggacggccaggacggtgctcccggcgagcctgggcctcccggagatcctgggcttccaggtgccattggggcccaggggacaccggggatctgcgacacctcagcctgccaaggagccgtgttaggaggggtcggggagaaatcaggctctcgaagctcataaaattcaacgtgaggaagcaagtgacaaggacgcccgaagcacagtggacggtcatgaaggagcgggggtgtggcaggcgggtgacgtccaggagagggagcgcccctggctgcccctcggccgccgactggacgcgcgggccttgccagcgagcaccctcatcgggctgtcgcctgacagcatacctcaaaaggccctagctaataaacctgtaagcccagcatttgagagaaggtagggtgtgtatatataaaaggttgtgtacaactccacgaggtgaaaaatattcagtaacttgtttacatagcatttgtgtaaagactatgatctcatcccaataaaatgatatattaaaccttcagattaatgactggctacagagtaacaaaaaataaagaatttaatgtacagtaaattctctcccat

SEQ ID NO: 61644 - DNA, 499 bp, Homo sapiens
gtgatcatcttttctttgacattggaagcagaatctgaaactttctgaggagagcatttgagcttcagatttctaacagcctctttgcaacaaaatagaccagtagctgaaggcaactgcaatccttcatgatgtttcccttggccagaaatgcactaagcagtctcaagattcaaagcattctgcaaagcatggcaagacatagccatgtaaaacactcaccagattttcatgataaatatggtaatgctgtgctagccagtggaactgctttctgtgttgctacatgggtgtttacagccactcagattggaatagaatggaacctatcccctgttggcagagttaccccaaaagagtggaaacatcagtaaccatcacagttgctgtaatgacagaattgtttaaaaaaccaacttgtcatgtaagcactctactgcttattaaaatatagcacaattgaaaaaataaaatgtgttttaaatctttaaaaaaaaaa

SEQ ID NO: 61645 - DNA, 5840 bp, Homo sapiens
gtctccactagaggctgcacagcccgcccggaccaacgcctccgcgcctgccgccgtctggccggcgccctcccgtttccttcctccagggggaaaaaatgtctttcgggccgctttccaggaagcagcaggatgcgccgctccactgtcggtagcaacaagctgcgcaaaccatgcaggatgatttactgatggacaaaagcaaaacccagccccagccccagcagcagcagcggcagcagcagcagccccaacctgagtccagcgtatccgaagccccgtccacgcccctctcctcagagacccccaagccggaggaaaacagcgcagtgccggccctcagcccagccgctgcccccccggcccccaacggcccggacaagatgcagatggaatcaccgctcctgccaggcttgagtttccatcagcctcctcagcagccgccgccgcctcaggagcccgcggcaccgggcgcgtcgctgtcgccgtccttcggcagcacctggtccacgggcaccaccaacgcggtagaggacagcttcttccaggggatcaccccagtcaacgggaccatgctcttccagaacttcccgcaccatgtcaacccagtcttcggaggcactttctccccgcagatcggcctggcgcagacccagcaccaccagcagccgccgccgcctgcgcccgcgccgcagccggcacagccagcgcagccaccacaggcgcagcccccgcagcagcgccgctcacccgccagccccagccaggcgccctacgcgcagaggagcgccgccgcggcgtacggccaccagcccatcatgaccagcaagccgtcctcgtcttcggcggttgcagccgctgctgccgcagccgccgcctcgtcggcctcgtccagctggaacacgcaccaaagcgtgaatgcagcctggagcgcaccgtccaacccctggggcggcctgcaggcgggccgggaccctcgccgggcggtcggtgtgggcgtgggtgtgggtgtcggggtgccttccccgctcaaccccatctcgccgctcaaaaagcccttctccagcaacgtgatcgcgccgcccaagttccctcgcgcggcccctctcacttccaagtcctggatggaggataacgctttccggaccgataatggtaacaatctgttgccatttcaggaccggagtaggccctatgatacttttaacttgcactcgttggagaactccttaatggatatgataaggactgatcatgaacctctgaaaggtaaacactaccctcccagtggcccaccaatgagtttcgctgatataatgtggaggaatcattttgcaggacgcatggggataaatttccatcatccaggaacagataatattatggcacttaacaatgccttcctggatgatagccatggtgatcaagccttgtcatctggcttaagttctcccactcgctgtcaaaatggggaacgagtagaacgctactctagaaaggtgtttgttggaggacttcctcctgatattgatgaagatgagatcactgccagctttcgcaggtttggacctctcgtagtagactggcctcacaaagctgaaagcaagtcttattttcctcctaaaggctatgcctttctgctgttccaagaggaaagctcagtacaagctttgatagatgcctgcctagaagaagatgggaaactctacctgtgtgtgtcaagccccaccatcaaggacaagccagtgcaaattcgaccatggaacctaagtgacagtgactttgtaatggatggttctcagcctttggaccccagaaaaactatctttgttgggggagttccacgaccccttcgagctgttgaactggcaatgatcatggaccgtttgtacggtggtgtctgctatgctggcattgatacggacccagagctgaagtaccccaaaggtgctggccgcgtggcattctccaatcagcagagttacattgcagccatcagcgctcgttttgtgcagcttcagcacaatgacattgacaaacgggttgaagtaaagccatatgtgctggatgatcagatgtgtgatgagtgccagggcacacgctgtggtgggaagtttgccccgttcttctgtgccaacgtcacctgtctgcagtattactgtgaatactgctgggcgagcatacattcccgagccgggcgggagttccacaaaccgctggtgaaggagggaggcgaccgccctcgtcacgtcccgttccgctggagctgagccacgggccgacccagccacaagtactggagtagataacaaggagggaaaagagagggcactgcctcagggcttacagtgttctggaaatctgtgcattcgttctcgatttttaaagaagaattgggtctttttattattattattattatttacagtcatattactgaactcagtgtccagtataatgcagaattgcagagtgtagaatggtactgatttgcactttgattcacacctttgtctgcttggtaccttaattttttatacctgatttgtcactcgtgacagtatgtagactgccattctcatcagcggccgtcaggctactgtctgtgattcttttgtttgttgttgtggtgttgttctgattgttttgaactggagcatgcacttattttcagaaacttagagagttgcccctaggacaagacttaccaaaggtaatactcgtgagtaggtggcagatgtagcaaaaacttcacaacaattcagcaatcattagctcgggtcacttagagtaaggataacccttcatgaaaataagcctttagttgctctctattttgacttgtaaggatacctcataagctggatcttttatttttccttcatgtttgatttttgttttgccgaggattttggttagatcttttagtattatgtaaatttatgctgcaatagcttttgctgctattaaaatggtattattaataccataatactctattcaggctaggatatcaattaaacacaaaaacccaacaacacacttttgtgattttagggatagagtcagctgccgaacggagatcagaatagacttcagaaagcttcggtggaaggtcactatttctgactgcatgtttacttaatcaggttgctgcatgcaataaattttatatccaatgtctagtataaaacgttcccacaatgcacaaattaagaatctatataagctataaaaatactcattttttaaaaaaagtttttttcattcaaagaattggtaattgaccggaggaaggcatgcctcaataaatggaatgctctgaatgggaagagcccataacagaatgacctatattacaaccgatataaaacctaggtgtaggatattcttcaagcaaatttgtggatggtagatgaagtactttgcggtgctctgttatatattgtgaaatttattttatatagtaaagtgattatgtctaactgtgatcaaacttaactgtttaaagcctctgtcagacattaatgaacttgacagttcataactgatatattataaactaacacatgagctcttagttacaatctcttagtgcttgcaccattttacatagcttcagaccttgtccagaaaaccaaagagctcatcttagcttacaaacactaagaatatatacaggatatagagataagttgtcagattgacaaactaggcacatttttaagaaagttgtgtaatggtgatgctaaagaaatgtctgtacaaaataagatggcctgggcagagttggttgtctgagtgagaaactaactacttaattccctggatttatcctgttaagcttgagtagaatgaaggcctgctagcactagcgtggtctagaatgaaggcctgctagcactagcgtggacatttttctagcattcacccttgggctgcagatagtaatatataaacacacacaatgattgcaagactatgtaaatctttttttaatcttcttcctatgttttggaattctggggacaatctgactggatatgacactgcagaatagatttaagtcgctgtgttttctgtgctgtgatgtccttgtactgtcttaagttagtgttgcttgtttttgttttgttctcccatgtttagttgcaattactggctctcaagctatagtttgttttcaaaaaggaaaaacaaaatagttttttactggattaaaaatgcttattttagaatcctcccctttttgaggctttttggtaataattgcttttttccagcccaggtgtggttttgtttgtttttttctatgtttgtgggttttttttcatctgtacaagaaattttgttatgcactactactttttgtattctagacagttttcaaaagttggcagatttttttttttgtttttaaggaaaaaggcatgctttctgactgacatgatcttttgcaatacctcaattttgaaatataggaaagaaaatgatattttctaagtaagtttattcagaaaaatatatattaatttaattctgcaagaaaatgatttaacagatgggtaactttatttttttcatgcttatttgtgttttttgaaaatgaagaagttagagctttataactataatattaaagatcatatctaacctacagaaatctacctaattatgtgaaagaagcaaaactttttgaagaagcacccctctttcatgtattaaaataacactgagatttttttaaaagctggaagattgtacagcataaagctaaagtgaaggcaaaaaacattgtcctgaagaataggttacaaaaaataaactccatttggtgctgaaagttgtgaatagatggtggaaactactttcccttaatttgtatatttctaatcaagtgttgattgtgcgcgactgaccaggattgtgaaagagttcttctgtttgtatttttttaaagagaacttttttagtttattaaattataacatgttcccttttgttttgtaaataaatgtgcccccaagttgttaatgttatattaaaagagagggtccttcaaaaaaattattttttaaaacacagaggtgttctgacctgcaacttgactgggaagcccctgggtaacacaggtcctgctgtggcctttccttggtgtgacacttgaactagtcgattttttgaaggctataacctaacctcgactatttgttgttatgtgcaatactgtttgtactgtttgtataaaaaatagaaaaaaaaaagaaaagaaaaaaggcataaatctttattgcagatttattttcattgcaaactttagacattgtgattcactgaaatcatttttctactgtcaaatatgtaccttttcttcatgctggtattttttcaatagtaatgtagcctttgtactgagacaaattttcattgttatttttagaaagattttttgctaagaaaaaaattaaacatatttacatatttttcattttatttcgtattttctttaaggagtgctttctcaatcattaatagagttgtttctgggagggactttcatatctggtcaatgtcataatattattttgtatttttattggaataaattaattttatgatgctaattctttaaaagtttatttttttcattttcagttatttttgaagctaaaacctttgtaatattgttactaaagtgtctagttttttgaaatgcaaagctttatgtattaacttgctgatgtggtttacaatagtgtgacaacgatgaaaatgcttggttatgtaaagtgattggaaatgtaatggataattgggtaataaaatgacagaatgagcag

SEQ ID NO: 61646 - DNA, 2225 bp, Homo sapiens
gacccgcctgcctcctcgcgaacttgggacgagttggaaaatcctccctgagagagccgtgcggctcaggggagcggtttaactcggaaaaggaaaaggaatccagaagataaataaagaaaacaggaaaggaggaaagcattgattacaaatatcttaacaatgagcaaatgtgcaaggaaaaaatatattaagacaaatccaagacaaatgaccatggaaacagttgaatcccagcatgatggaagtataacagcttctttgacagagagcaagtctgctcatgtgcagactcagactggccaaaattcaatccctgctttagctcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacattgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacaaaaaa

SEQ ID NO: 61647 - DNA, 1553 bp, Homo sapiens
tggaacactttatgttgaactgtggtagaggaaacaagacagttctgtctgcagaagcccattatggctgtaactggagatgacacagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacaaaaaa

SEQ ID NO: 61648 - DNA, 1589 bp, Homo sapiens
tggaacactttatgttgaactgtggtagaggaaacaagacagttctgtctgcagaagcccattatggctgtaactggagatgacacagatgaggaaactgaacttgccccaagtcacatggctgctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacaaaaaa

SEQ ID NO: 61649 - DNA, 1663 bp, Homo sapiens
gtaaaatgctgctgacagatttagagttaactagctcaccactgcctctgcctccaagctgccttttagactgaatagcttttcttgttagccctactttaacatttcttttgaagtggttgtctgcttgaagagggaaacacgtcatgaaactgtaatgcatgaacagaactcaggagttgtctggccagcttagtgctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacaaaaaa

SEQ ID NO: 61650 - DNA, 1706 bp, Homo sapiens
gtaaaatgctgctgacagatttagagttaactagctcaccactgcctctgcctccaagctgccttttagactgaatagcttttcttgttagccctactttaacatttcttttgaagtggttgtctgcttgaagagggaaacacgtcatgaaactgtaatgcatgaacagaactcaggagttgtctggccagcttagtggtaagatcgagcctcctactgaggccgtccctgcatgcgcctgctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacaaaaaa

SEQ ID NO: 61651 - DNA, 2005 bp, Homo sapiens
acattcttagccaccgaagtatgggcaccaaaagcgataaggagcatgtgttccttaataaatgtcacatcagaaaatgactgttccaggacagtaaccacctcccgatggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacattgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacaaaaaa

SEQ ID NO: 61652 - DNA, 1816 bp, Homo sapiens
acattcttagccaccgaagtatgggcaccaaaagcgataaggagcatgtgttccttaataaatgtcacatcagaaaatgactgttccaggacagtaaccacctcccgatggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacactgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacaaaaaa

SEQ ID NO: 61653 - DNA, 2160 bp, Homo sapiens
agctacgggtcagagctagtccactaggtgctaatcaaatgctgtgttacaacactgtgaggttttcccagttataagtgtcactattagggttttttttaattgcaaagccaaataaggctgtcaattgcatcatcttaccttatttcttcagattaagtactgtttatagtgggatttttggtggatgtggtggcatcagcataatctatgtttcaggcgtcctatagaagaggattattcttcaggggatgtggaagaaaaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacattgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacaaaaaa

SEQ ID NO: 61654 - DNA, 1971 bp, Homo sapiens
agctacgggtcagagctagtccactaggtgctaatcaaatgctgtgttacaacactgtgaggttttcccagttataagtgtcactattagggttttttttaattgcaaagccaaataaggctgtcaattgcatcatcttaccttatttcttcagattaagtactgtttatagtgggatttttggtggatgtggtggcatcagcataatctatgtttcaggcgtcctatagaagaggattattcttcaggggatgtggaagaaaaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacactgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacaaaaaa

SEQ ID NO: 61655 - DNA, 1786 bp, Homo sapiens
gctggcggccggcagggggcggagttcgagcctggatttttttcctcggggcctcccccgggaggccgtcccggcgtgggggaggggaggacggggcgggaggacgcggttcggtcggctgcagcgctacttttggtccggggtcggcagggaggccgcggctaccgcatcacagctgacgtgaggactacgtggggccgctgccggctccgggttgctgggcggcggcgccgctgctgagcggcggtcgggctcgccgtctccacctcctcgcgtccgtaatcagtgacgaggtccgctacgtaaatccctttgcggcggctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacaaaaaa

SEQ ID NO: 61656 - DNA, 1938 bp, Homo sapiens
gacccgcctgcctcctcgcgaacttgggacgagttggaaaatcctccctgagagagccgtgcggctcaggggagcggtttaactcggaaaaggaaaaggaatccagaaacaaatgaccatggaaacagttgaatcccagcatgatggaagtataacagcttctttgacagagagcaagtctgctcatgtgcagactcagactggccaaaattcaatccctgctttagctcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacactgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacaaaaaa

SEQ ID NO: 61657 - DNA, 2446 bp, Homo sapiens
gggatttgcacggcagcagagtcaccgtggagaggccagggtatcacaaacttatggattttgacaagaaaggagggaaaggggagacggaggagggccggagaatgtccaaggccggcgggggccggagcagccacggcatccggagctcggggaccagctcgggggtcctgatggtgggccccaacttccgcgtcggcaagaagatcggctgcggcaacttcggggagctccgcctaggaaagaatctctatacaaatgaatacgtggctatcaaattggagccgatcaagtcccgggccccgcagctgcacctggagtaccggttctacaagcagctcagcgccacagagggcgtccctcaggtctactacttcggtccgtgcgggaattacaacgccatggtgctggagctgctggggcccagcctggaggacctgttcgacctgtgcgaccggaccttcacgctcaagacggtgctgatgatcgccatccagctgatcacgcgcatggagtatgtgcacaccaagagcctaatctaccgggacgtgaagcccgagaacttcctggtgggccgcccggggaccaagcggcagcatgccatccacatcatcgacttcgggctggccaaggagtacatcgaccccgagaccaagaagcacatcccgtaccgcgagcacaagagcctgacgggcacggcgcgctacatgagcatcaacacgcacctgggcaaggagcagagccgccgcgacgacctggaggcgctgggccacatgttcatgtacttcctgcgcggcagcctcccctggcaggggctcaaggccgacacgctcaaggagcggtaccagaagatcggggacaccaaacgcgccacgcccatcgaggtgctctgcgagaacttcccagaggagatggccacgtacctgcgctatgtgcggcgcctggacttcttcgagaagcccgactatgactacctgcggaagctcttcaccgacctcttcgaccgcagtggcttcgtgttcgactatgagtacgactgggccgggaagcccctgccgacccccatcggcaccgtccacaccgacctgccctcccagcctcagctccgggacaaaacccagccgcacagcaaaaaccaggcgttgaactccaccaacggggagctgaatgcggacgaccccacggccggccactccaacgccccgatcacagcgcctgcagaggtggaggtggccgatgaaaccaaatgctgctgtttcttcaagaggagaaagagaaaatcgctgcagcgacacaagtgaccctgggcgcgtgcagccccctgaatcttctccgtgcagccccttggggcgcgaccttgtgcgaggccctcggggcccacccacagcggcccagggccagaccctggctggaagccagaacgcagactgcaggggccgcgcctggctcaggcggccccacccccgggacgtggggtcacttccttcatgtaagactttggccgaaatttctacacctgtgtctagtcctcccctccaagagcattaactatttaaaacaaggaaaagaggaaaaaaaaaacagaggcccgccctaccccactcctgcccctccgtttctttgctgaagtgagtagtgtgatcctggaggccccccggcctggccccgccccgccagccgcccccgttagcgtcataaagtccagcttgtctccctcgatccaaaggccgttttctcgaggggagggcaggcccggcctggaggggtgctgtggagctgtcttgcccaggccctcctgggagggggacaggcattgttgccaggggtgaggccgtgccccaggcctccccgaaaccaaaggggaaggcaggggtggggccgtggctgaagccggctccccaaccaaaatgctgcaccaaagctcgggcgccgcgggcacggctgctgcagtctcttcccagcctggccctggcaaggggcgggtgggcgctgccaggcgggtgcttctcgacgcacttgctcccggaggctgcgccccggcgcctggaacccgaggtgggaggaccggttggtgtcaccctgctcggccctcagccctgccgcgtggggcgcgtgggcacggagcttcctgcctctgctccgacacccggcaagcagccggagacaaaacgccttaaagcccccggcccagccctgcaggtatattgcaggggcctgggggcggccctggactggcgggcggttccccagtggggtgccctggaggctgccgggcagagtggagcagcttggggccgtgcccagggcggtggctgtgagtctagtttttgctttaccaagtgtacagaaatggcatttacgtttctctgatgctcccttgaagccatagaatttaggggcttttttaaaaaaataaaagaaaaatgaaaccaaaaaaaaaaaaaaa

SEQ ID NO: 61658 - DNA, 895 bp, Homo sapiens
ctgggccacaggcatgaactaagagtgctgaagacctaggagaaccactggtcaggtcagctcccagctccacagggagtaagaaggagctgcaggcacagcaggctgaaagtccaccaagggctgaggccacaaggcctctggggcagccacagttttcatgatcacatcatacaggactgagaagcagataacaagagtgacgctcacagggctgggctgacgctaacaggaggcagtgtgtggctcgaagattcttgaacccacagcagcagctgcggccaccccatcctgcccacagctccagccctgagacgacgaggaggagagtcgactttgcctcttgcccaagggaccatgcccaggtgccggtggctctccctgatcctcctcaccattcccctggccctggtggccaggaaagacccaaaaaagaatgagacaggggtgctgaggaaattaaaacccgtcaatgcctcaaatgccaacgtgaagcagtgtctgtggtttgccatgcaagaatacaacaaagagagcgaggacaagtatgtcttcctggtggtcaagacactgcaagcccagcttcaggtcacaaatcttctggaataccttattgatgtagaaattgcccgcagcgattgcagaaagcctttaagcactaatgaaatctgcgccattcaagaaaactccaagctgaaaaggaaattaagctgcagctttttggtaggagcacttccctggaatggtgaattcactgtgatggagaaaaagtgtgaagatgcttaatggtgttttgaggcatccctccaacctctgtgactactttatccatgaaaatgaagcaatggcaggtgggaggctcttcccaatgtgctttcttcatgcatgccaaaaa

SEQ ID NO: 61659 - DNA, 2799 bp, Homo sapiens
atggaggagcctagggctacccctcagctgtacttggggctggtcctgcagttgctacccagggttatggcagcactgcctgaaggtgtgagaccaaattcgaatccttatggttttccatgggaattggtgatatgtgcagctgtccttggatttgttgctgttcccttttttttgtggagaagttttagatcggttaggagtcggctttatgtgggaagagagaaagagcttgctatagcgctttctggactaattgaagaaaaatgtagactacttgaaaaatttagccttgttcaaaaagagtatgaaggctatgaagtagagtcatctttagaggatgccagctttgagaaggaggcaacagaagcacaaagtctggaggcaaactgtgaaaagctgaacaggtccaattctgaactggagcatgaaatactctgtctagaaaaggggataaaagaagagaaatctaaacattctgaacaagatgaggtgatggcagatatttccaaaaagatacagtctctagaagatgagtcaaaatccctcaaatcactactaactgaagccaaaatgaccttcaagggatttcaaatgaatgaagaaaaactggagataggaatacaagatgcttcgagtgaaaattgtcaacttcaggaaagccagaaacagcttttgcaagaagctgaagtatggaaagaacaagtgagtgaacttaataaacagaaaataacatttgaagactccaaagtacacgcagaacaagttctaaatgataaagaaaatcacatcgagactctgactgaacgcttgctaaagatcaaagatcaggctgctgtgctggaagaagacataacggatgatggtaacttggaattagaaatgaacagtgaattgaaagatggtgcttacttagataatcctccaaaaggagctttgaagaaactgattcatgctgctaagttaaatgcttctttaacaaccttagaaggagaaagaaaccaatttatattcagttatctgaagttgataaaaccaaggaagagcttagagagcatattaaaaatcttcagacggaacaagcatctttgcagtcggaaaacacacattttgaaagtgagaatcagaaacttcaacagaaagttaatgactgagttatatcaagaaaatgaaatgaaactctacaggaaattaatagtagaggaaaataaccggttagagaaagagaaactttctaaagtagacgaaatgatcagccatgccactgaagagctggagacctgcagaaagcgagccaaagatcttgaagaagaacttgagagaactattcttttttatcaagggaagattatataccatgagaaaaaagcacatgataattgtttggcagcatggactgctgaaagaaacctcaatgatttaaggaaagaaaatgctcacaaaagacaaaaattagctgaaacagagtttaaaattaaacttttagaaaaagatccttatgcacttgatgttccaaatacagcatttggcagagagcattcctcatatggtccctcaccattgggtcggccttcatctgaaacgagagcttttctctatcttccgactttgttggagggtccactgagactctcacctttgcttccagggggaggaggaagaggcccaagaggcccagggaatcctctggaccaccagattaccaaggaaagaggagaatcaagctgtgataggtttactgatcctcacaaggctccttctgacactgggcccctgtcacctccgtgggaacaggaccgtaggatgatgtttcctccaccaggacaatcatatcctgattcagctcttcctccacaaaggcaagacagattttattctaattctgctagacgctctggactagcagaactcagaagttttaatataccttctttggataaaatggatgggtcaatgccttcagaaatggaatccagtggaaatgataccaaagataatcttggtaatttaaatgtggctgattcatctctccctgctggaaatgaagtgagtggccctggctttgttcctccacctcttgctccaatcagaggtccgttgtttccagtggatacgaggggcccgttcatgagaagaggacctcctttccctccacctcctccaggaaccatgtttggagcttctccagattattttccaccaagggatgtcccaggtccaccacgtgctccatttgcaatgagaaatgtctgtccaccgaggggttttcctccttaccttcccccaagacctggattttgcccccacccccacccccacattctgaagatagagtgagttccctttagggttgagtctgccttcaaatgagcctgctgctgaagatccagaaccacagcaagaaacctgataatatttttgctgtcttcaaaagtcattttgactattctcattttcagttgaagtaactgctgttacttcagtgattacacttttgctcaaattgaaacaatagaattataattctcaggatagtattttgtaaataaggatgatttaaataggaatcttatgagtaaattatttccattttattttattctagatagtgttaactattttaatttgattaatccactattatctaaacagtagtgggagttttatatatgtaatcttgcaggtggtgaggttttaaattctaaagtctttgtccttattccaagaactgtatttactgtggttgtagacaaatgtgaaagtaaatttatgcttaattgaataaattatagttgattt

SEQ ID NO: 61660 - DNA, 4700 bp, Homo sapiens
ggtgtctcggacaacgagtgtacgcagttaccacacagttaccaagcagttacctcagagccgcggcgcagacgtaggcctcaggtctcgggcctcaggtctcgggcctcagagccagaccccgccatctcacgatgtcagagaggacccaggaacaggattttgttattataactgtcgacgacagtgatgataacaatgattgcagtattgagatggtggaagtttctgaaacagcagataattccactaatgacatagcagatgattccacttatgtcacagcagataatcccactgatgacacagccacacaaccaaattttccaggcggcaatgatggccatcaccgtccactccaaatgtcatatgggtctggctctgtcacccaggctggagtgcagtggcatgatcacagctcactgcagcctcaacctcttggactcaagcaattcttccacctcagccttcccagtagctgggatgacaggcgcacgccaccatgcccagtagcccatggtgaccaaatagtttcacagataaaccacccagtacatttaagaagatacagttacaactcagaggaagtggattttccaaaaagaggaagattctatactccagaggtacagtctagcatatcaccaccagcggaaaggcaggaaacccatgcctgggccagccctgctgtaacatctcttgagtcagcagcatgtcatgaactgcaggaagcagacctcagtgagagtttatcatatcccagaattgtctcctcaagttcattacagcagtatgtcgcacaaggtggctcatttccttgtttcggtatgccatggaactttatcagtggaggtgctgaaagtaccaatgctgtcatctcatttgccaatgctactacagcagtacctatggcagttctgtcacgaagagaatccagtctggcaaataaccctggtgtggtgaattactctgctctaccagaaaatgaaaatgtgggcccaggtagagccttgtcatctttctgcttccatcccaatttggaaatgccagaaagaccagcaaacagcagtaaaaacagcactgagacagcgaattatccaactttaatgggaaattacaatggccaaaatactgcctctttatctgtcttcatccctccctattttgctgagaaaattatacttactgaaatgccaggaacaacagaaaccaacgtggaaaataactctcagacagtgtattacccagctttatcgggaaatacgagtgccccatatccagcctcttcatatcttcccatcacttctaattttgaatctggcccacaaatgagttatgggacaatgagttactcaactgaaatgaaaaataactgtgaccaagatgatgcttcagcatctgcctgcctcactcccgattttgcactgttacctctgaatattttggtaaaagtagacaccaacacggaaaacagcgtcaacacaatgaatcgctcaactttattggacagtgacagtggccaggattcttcctcatcatctgtctgtatccctcccaagtatggctatcttggtgatccaaaaagaaatgtcagagtacttaaaatccatttgctggccgtacaaaatatggccaaacctaagcaagcagcctgctacttggttcgtattttgttctccaaggaaatcctgattagcagctcagtggatatccatttgaaagacagccaatccctcgacccgaacaaaatggctgcattgagagaatatctggcaacaacttttcccacctgtgatttgcatgaacatggaaaagactggcaggactgtatttctggtatcaattctatgatctactgtttatgttctgaaggcaagagtactccaaaaactgttcgcaaaaataaaaaacgtaccaaccgtgttgcatcggcatctgcagatagaaatgaccaaaggggcagagatggtggtgaaggctgttcttggatgtttcagccaatgaataactccaaaatgagagtaaagaggaacttgcagccaaacagtaatgctatccctgaaggaatgcgagaaccttccactgataatccagaggaacctggtgaagcatggagctattttggaagaccatggagaaatatacggatgccatgttcagtactgactttggcaaaaactaagtcttgcgcaagcctgtcggctagataccttattcagaaactcttcacaaaagatgtcctggtccaaagtaacgtctatggcaatctgaagcatggcctgtgtgcccttgaccccaataagattagtgctctccgagagttcctccaagaaaactacccaatttgtgatctctcggaaaatggaagagactggaagtcgtgtgtgacctccatcaacagcggtatccgtagccttagacatgacgtcagaagggctgaagccaggtctcagtcgcttccagcagtgacccctccagagctggagcaggagtcaaagccaggagatcccgacgccactgacccaagcacctgaacggcagctgccaaacttttttttttttttaactgttaagactattttgtaagtttctcaagttctaattccaaaatcagcctgctgtactggcagagtagtttgcattgacacctgtagtaatcgccaaacctctttttctgctcataaaggaggtagaatcacattaggaagatacgtaatgtttcatctgtggatttgatgacaacctctgattgagggaatggtggtaaactcctcatgggcttgtgacccatggctttgacttagataattgacattaatatactttgtttttttgataaggtagagaaagaaattcaatagaaagtaaggagccactcagtcaaataatataattcgtataaaacttgacaagtctttttatttttgtgacttgtgagatagtttaagatatttttatgtgaccaatttgtagaatgaatacatattttcaaagttatcttttcaaaattcaacttttagagtattttagcaaaatatatgtatagtttataatatagaagtatagctttataaagatattaaggatttattttttaaaataattctctgaatagtttgctgtagtagttgccttcagcttaataaaaccatagtacttctacatacatctttataagttaggctatgcctacaaaggtcttaaaaagtagataatttaccgggtgtagtggctcacacctgtaatcccagcactttgggaggccgagacgggtggatcacctgaggtcaggggttcgagaccagcctggccaacatgacgaaaccccatctctactaaaaatacaaaaaaagtagccaggcatggtggcaagcacctgtagtcccagttactcgggtggctgaggcaggagaatcacttgaacctgggaggtggagactgcagtgagccgagattgtgccactgcactcgagcctgggtgacagagtgagactccgtctcgggaaaagaaaaaaaagaagtagataattaaaaaaatcttgcataaaaaaaaatcttccataaagggcaaaaaggctttaacttccattattcagatttaatccaactaagatagtctttggcttcattcactgttcagtttcacaagttttttacaactactagtaacagagctaatacagaatagtaatccacattataaacatagatcaaaataccacatcataccccataaatacatgcagttattatttgtcaattaaaaataaaatttttttaaaagaaaagtacagttcgaccctaggcaagaagaaatttcaaattgtatatgcatattttgaattttggtttatattttgtggtatctgaaatattccctggactagaagcaaaaccacagaaacaaaactttacatttagaaaaaaatttcaagacttctattgctaactttattacattagtggtttttagaagttatttagagcagtcttgtctgatagaactttccaccatgatggaaatgtaaataaatataccacattaaaaatataaatttgcaatgtccaataggctcgtatggctattgagcatttaagatgtaattaattagacagaggaagtaaatttaacattttctctcattttagctaattagaatttaaagtgaaatagccacaagtggatagtggctactgtgttggatggcacagttcaaaatgcctcttatttataaaaaaaagtgtttaaaagtggttcccatggcttgaagaggaataatatacacataacttctttaaaatcacattttgtttgagatggagatcttgctatattgcccaggcttatctggaactcctgggctcaagagggaggatcacatttgactggacaaaatacattttataaaggtgttttgtattttatgttaaagtggaattgtgtcttcaaaattgtgtcttcaaaatttcacaagttaatactattactgtattagtccaatgttaaacattttaaatgcctgctcataagactcatttttgataaataaatgtatctttaatgttttgtttcccaaatagatacaataaataaacatttaaaatgccttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 61661 - DNA, 1454 bp, Homo sapiens
gggggccggagcgggaggcgtggggagaggtcgtgggcgggaccgcgaagggcggggagcggggcgggccggctcggattccggaaggctgagactccagtgacccggcgggaggagaggcaactttccctgtcgggcttgagttgggagaggagcagggcggccttgtagggacccgtccctgctcctgaccatcaccgtcactggggtcactgtgctcgtgttggtcctgaagagcatgaactccaggaggagagagccaatcaccttacaggaccctgaagccaagtacccgctgcccttgattgagaaagagaaaatcagccacaacacccggaggttccgctttggactgccttcgccggaccatgtcttagggcttcctgtaggtaactatgtccagctcttggcaaaaatcgataatgaattggtggtcagggcttacacccctgtctccagtgatgatgacagaggctttgtggacctaattataaagatctacttcaaaaatgtacacccccaatatcctgaaggtgggaagatgactcagtatttggagaacatgaaaatcggggagaccatcttttttcgagggccaaggggacgcttgttttaccatgggccagggaatcttggaatcagaccagaccagacgagtgagcctaaaaaaacactggccgatcacctgggaatgattgctgggggcacaggcatcacacccatgttgcagctcattcgccacatcaccaaggaccccagtgacaggaccaggatgtccctcatctttgccaaccagacagaggaggatatcttggtcagaaaagagcttgaagaaattgccaggactcacccagaccagttcaacctgtggtacaccctggacaggcctcccattggtccctggtcggcagagggcgctaccctactgagcaattctgcgcagttccactaacaccaggccacaccctgccggacaactccagctggctgtactgattcacacacctcggctggaagtacagctcaggcttcgttactgccgacatgatcaaggagcaccttcctcctccagcgaagtccacgctcatcctggtgtgtggcccgccaccactaatccagacggcggctcaccctaacctggagaagctgggttatacccaggacatgattttcacctactaacacctccacgtgctcagcaattttgcatgtcccttttcatctgtttcagagtaagttcaatttcaccacggtaaactgggatgttttcaaaagtgccttgccatgtaccttcgcgcacacactggttctcctcttttgggtgtgggcctaacaaaaagggctcaaggggctggagactggctgctggggcctccttgcttggaggctggaaagagctccatttcagtatctttctccgtggttttgtgaaataaactcaagtacaaagcaga

SEQ ID NO: 61662 - DNA, 1341 bp, Homo sapiens
gggggccggagcgggaggcgtggggagaggtcgtgggcgggaccgcgaagggcggggagcggggcgggccggctcggattccggaaggctgagactccagtgacccggcgggaggagaggcaactttccctgtcgggcttgagttgggagaggagcagggcggccttgtagggacccgtccctgctcctgaccatcaccgtcactggggtcactgtgctcgtgttggtcctgaagagcatgaactccaggaggagagagccaatcaccttacaggaccctgaagccaagtacccgctgcccttgattgagaaagagaaaatcagccacaacacccggaggttccgctttggactgccttcgccggaccatgtcttagggcttcctgtaggtaactatgtccagctcttggcaaaaatcgataatgaattggtggtcagggcttacacccctgtctccagtgatgatgacagaggctttgtggacctaattataaagatctacttcaaaaatgtacacccccaatatcctgaaggtgggaagatgactcagtatttggagaacatgaaaatcggggagaccatcttttttcgagggccaaggggacgcttgttttaccatgggccagggaatcttggaatcagaccagaccagacgagtgagcctaaaaaaacactggccgatcacctgggaatgattgctgggggcacaggcatcacacccatgttgcagctcattcgccacatcaccaaggaccccagtgacaggaccaggatgtccctcatctttgccaaccagacagaggaggatatcttggtcagaaaagagcttgaagaaattgccaggactcacccagaccagttcaacctgtggtacaccctggacaggcctcccattggctggaagtacagctcaggcttcgttactgccgacatgatcaaggagcaccttcctcctccagcgaagtccacgctcatcctggtgtgtggcccgccaccactaatccagacggcggctcaccctaacctggagaagctgggttatacccaggacatgattttcacctactaacacctccacgtgctcagcaattttgcatgtcccttttcatctgtttcagagtaagttcaatttcaccacggtaaactgggatgttttcaaaagtgccttgccatgtaccttcgcgcacacactggttctcctcttttgggtgtgggcctaacaaaaagggctcaaggggctggagactggctgctggggcctccttgcttggaggctggaaagagctccatttcagtatctttctccgtggttttgtgaaataaactcaagtacaaagcaga

SEQ ID NO: 61663 - DNA, 2094 bp, Homo sapiens
ctcaagtccaggcaacgtacaggcaggggaaatgtctcttccaaggttgctaaaagtaaacatcagaacatatgataattccattccaatcagtgaatcaagcagaaaatcatggaatcaaaaacactttgctttgacatttcccaaaccactccagagaggtacaaatgataaatcaagacctttgaaatcacaaataacagttactagacatgacaaaagaaaactagaagaaggccagaaaccagctcataaatggataaggcattctttcagaaaaattttgcaatggccacccatttacacagctgccagggaacagactccattcagacatctttatacttccaaaacccatcttaaaaaagcagaatataaaaagtccaaagatgaaaaaggaggaacacctttgaagaaagattccaagaaaaaaggaggttcatatgcaacaaatccagaatccaagcaaatagtagaagagaaaactaaaagacaaaatgaggcagataaaactcccttaaaatcatcacatgaaaatgaacaatccaagaagtcaaaatccagttcagaaactaatccagaatcccaaaattctaagacagtctcaaaaaattgttcacaaaaagataagaaagattcaaagaattccaagaagacaaacactgaattcctacatacaaagaacaatccaaagaaagatttgaagaggtcaaagactagtaatgatcccatatcagagatttgctcagaaaatagtttaaatgttgatttcctcatgttagtgggacagtctgatgatgaatccataaattttgatgcatggttaaggaattactcacagaataattcaaagaattattctttgaagtatacaaagtatacaaagaaggacacaaaaaagaatgcaaagaaaagctctgatgctgaatctgaagactcaaaggatgctaagaaagattcaaagaaagttaagaaaaatgtcaagaaagatgacaagaaaaaggatgtaaagaaggacacagagtctactgatgctgaatctggagactcaaaggatgaaaggaaagatacaaagaaggataagaaaaaattaaagaaagatgacaagaaaaaggacacaaagaagtacccagagtctactgatactgaatcaggagatgcaaaggatgcaagaaatgattcaagaaatttgaagaaagcttcaaagaatgatgacaagaaaaaggatgcaaagaaaattacattctctactgattctgaatctgaactggagtcaaaggagagtcagaaagatgaaaaaaaggataaaaaagattcaaagacagataataaaaagtctgtcaagaatgatgaagagtctactgatgctgactctgaaccgaagggagattcaaaaaagggtaaaaaggatgaaaagaaggggaagaaagattcaaagaaagatgacaaaaagaaggatgcaaagaaaaatgcagaatctactgaaatggaatctgatttggagttaaagaaggacaagaaacactcaaaggaaaagaaaggttcaaagaaagatatcaagaaggatgcaagaaaggacacagagtctactgatgctgaatttgatgaatcttccaagacaggctttaaaacatctacaaaaatcaaaggttcagatactgaatctgaagagtcactatataaacctggggctaagaagaaaattgatgaatcagatggcacatctgcaaattcaaagatggaaggactggaatcaaagagaggattcagaatgtcatccaaaaagactacattcaatgaaaaaggggaaaaagcaagtacaggtagagttcctccatcaagagaaaaaccaccactccctgcttgtgagccttctctaccatcaccaaaggtcagacgtctttgttggtgcaagatgcctcctccacctccaaaaccaagatatgctcctttgcctgaagcaccgtggattcataagctgctttaaagaacaactgagcacttggtttcacagaatggccttaccacagtaagcaccacctactctcaaatgagcatttctacctctgtggaactgaaataaaaacaagtctt

SEQ ID NO: 61664 - DNA, 2110 bp, Homo sapiens
ctcaagtccaggcaacgtacaggcaggggaaatgtctcttccaaggttgctaaaagtaaacatcagaacatatgataattccattccaatcagtgaatcaagcagaaaatcatggaatcaaaaacactttgctttgacatttcccaaaccactccagagaggtacaaatgataaatcaagacctttgaaatcacaaataacagttactagacatgacaaaagaaaactagaagaaggccagaaaccagctcataaatggataaggcattctttcagaaaaattttgcaatggccacccatttacacagctgccagggaacagactccattcagacatctttatacttccaaaacccatcttaaaaaagcagaatataaaaagtccaaagatgaaaaaggaggaacacctttgaagaaagattccaagaaaaaaggaggttcatatgcaacaaatccagaatccaagcaaatagtagaagagaaaactaaaagacaaaatgaggcagataaaactcccttaaaatcatcacatgaaaatgaacaatccaagaagtcaaaatccagttcagaaactaatccagaatcccaaaattctaagacagtctcaaaaaattgttcacaaaaagataagaaagattcaaagaattccaagaagacaaacactgaattcctacatacaaagaacaatccaaagaaagatttgaagaggtcaaagactagtaatgatcccatatcagagatttgctcagaaaatagtttaaatgttgatttcctcatgttagtgggacagtctgatgatgaatccataaattttgatgcatggttaaggaattactcacagaataattcaaagaattattctttgaagtatacaaagtatacaaagaaggacacaaaaaagaatgcaaagaaaagctctgatgctgaatctgaagactcaaaggatgctaagaaagattcaaagaaagttaagaaaaatgtcaagaaagatgacaagaaaaaggatgtaaagaaggacacagagtctactgatgctgaatctggagactcaaaggatgaaaggaaagatacaaagaaggataagaaaaaattaaagaaagatgacaagaaaaaggacacaaagaagtacccagagtctactgatactgaatcaggagatgcaaaggatgcaagaaatgattcaagaaatttgaagaaagcttcaaagaatgatgacaagaaaaaggatgcaaagaaaattacattctctactgattctgaatctgaactggagtcaaaggagagtcagaaagatgaaaaaaaggataaaaaagattcaaagacagataataaaaagtctgtcaagaatgatgaagagtctactgatgctgactctgaaccgaagggagattcaaaaaagggtaaaaaggatgaaaagaaggggaagaaagattcaaagaaagatgacaaaaagaaggatgcaaagaaaaatgcagaatctactgaaatggaatctgatttggagttaaagaaggacaagaaacactcaaaggaaaagaaaggttcaaagaaagatatcaagaaggatgcaagaaaggacacagagtctactgatgctgaatttgatgaatcttccaagacaggctttaaaacatctacaaaaatcaaaggttcagatactgaatctgaagagtcactatataaacctggggctaagaagaaaattgatgaatcagatggcacatctgcaaattcaaagatggaaggactggaatcaaagagaggattcagaatgtcatccaaaaagactacattcaatgaaaaaggggaaaaagcaagtacaggtagagttcctccatcaagagaaaaaccaccactccctgcttgtgagccttctctaccatcaccaaaggtcagacgtctttgttggtgcaagatgcctcctccacctccaaaaccaagatatgctcctttgattcaaagaagacagcgtttaggagtcagaagatgtcaactacttatgtgatgctagtcaagtcatcaaaccacttcaggtctcagttttctcatcttacaatgttgttgggaaggctccagggcaaaatggatgagaattaaaaagcactctgca

SEQ ID NO: 61665 - DNA, 2094 bp, Homo sapiens; identical to SEQ ID NO: 61663

SEQ ID NO: 61666 - DNA, 2110 bp, Homo sapiens; identical to SEQ ID NO: 61664

SEQ ID NO: 61667 - DNA, 4416 bp, Homo sapiens
ccagtgtaagagttccgctattcggtctcacacctacagtggactacccgatttttcgcttctcttcagggatgagtcatgtggtggtgaaaaatgaccctgaactggaccagcagcttgctaatctggacctgaactctgaaaaacagagtggaggagcaagtacagcgagcaaagggcgctatatacctcctcacttaaggaacagagaagcatctaaaggattccatgataaagacagttcaggttggagttgcagcaaagataaggatgcatatagcagttttgggtctcgagattctagaggaaagcctggttatttcagtgaacgtggaagtggatcaaggggaagatttgatgatcgtggacggagtgactatgatggtattggcaatcgtgaaagacctggctttggcagatttgaacggagtggacatagtcgttggtgtgacaagtcagttgaagatgattggtcaaaaccacttccaccaagtgaacgcttggagcaagaactgttttctggaggaaacacggggattaactttgagaaatatgatgatataccagtagaggcaaccggcagtaactgtcctccacatattgagaattttagcgatattgacatgggagaaattatcatggggaacattgaacttactcgctatactcgtcctactccagtgcaaaaacatgccattcctattattaagggaaaaagagacttaatggcttgtgcccaaacaggatctgggaaaactgcagcatttcttttacccatactgagtcagatatatacagatggtccaggagaagctttgaaggctgtgaaggaaaatggaaggtatgggcgccgcaaacaatatccaatatccttggttttagccccaacaagagaattggctgtacagatctatgaggaagccagaaaattttcctaccgatctagagttcgtccttgtgtagtttatggtggtgctgatattggtcagcagattcgggacttagaacgtggatgccacttgttagtagccactccaggacgtctagtggatatgatggaaagaggaaagattggattagacttctgcaagtacttagtgttggatgaagctgataggatgctggatatgggatttgaacctcagatacgtcgtatagttgaacaagatactatgccaccaaagggcgttcgtcacaccatgatgtttagtgctacttttcctaaggaaatacagatgcttgctcgtgactttttggatgaatatatctttttggctgtaggcagagtaggctctacctctgagaacatcacacagaaagtagtttgggtggaagacttagataaacggtcatttctactggacattttaggtgcaacagggagtgattcacttactttagtgtttgtggagaccaaaaagggagcagattccctggaggatttcttataccatgaaggatatgcttgtactagtattcatggagaccggtcacagagagatcgagaggaggcccttcaccagtttcgctcaggaaaaagcccaattctagtggctacagctgtggcagcacgaggactagacatttcaaatgtgagacatgttatcaattttgatttgccaagtgatattgaagaatatgtgcatcgtattggccgtacaggacgtgtaggaaacctgggccttgccacctcattctttaatgaaaaaaatatgaatattacaaaggatttgttggatcttcttgtagaagctaaacaagaagtgccttcttggttggaaaatatggcttatgaacaccactacaagggtggcagtcgtggacgatctaaaagtaatagattcagtggaggatttggtgccagagactatcgacaaagtagtggttccagcagttctggctttggtgctagtcgcggaagcagcagccgcagtggtggaggtggttacggcaacagcagaggatttggtggaggtggctatggaggcttctacaatagtgatggatatggaggaaattataactcccagggggttgactggtggggcaactgaatctgctttgcagcaaagtcacccttacaaagaagctaatatggaaaccacatgtaacttagccagactatattgtgtagcttcaagaacttgcagtacattaccagctgtgattctcctgataattcaagggagctcaaagtcacaagaagaaaaatgaaaggaaaaaacagcagccctattcagaaattggtttgaagatgtaattgctctagtttggattaaactcttcccctcctgctttagtgccaccccaaactgcatttataattttgtgactgaggatcgtttgtttgttaacgtactgtgactttaactttagacaacttactactttgatgtcctgttggctcagtaatgctcacgataccaattgttttgacaaaataaatttactaaacttggcctaaaatcaaaccttggcacagaggtatgatacaactttaacaggagtcatcaattcatccataaatataaaaagggaaaaaaacttaaggcagtagtctgcattaggactgtttgagttttgcagacttggggttgggagaacatcttaaagcattaaagcatagttttttgtatggccaaccttactaaattaagttctgacttgctcactctatcctggataggcacttgggaacttacactctttaagccattccagtcatgatgaggtggaatgtatcagtataccaattaatatttttgaaagagttcttttaggttaatttaagtacagcaatttctcatgtaatgtttagggagtttattctaacctaggcaaacggcatgctatcacaagaaaggtttaaagctttgataaaatgggggagatttaatcagtttttttaatgcctgctataaaaatttgaaatattagaatggccgaccatggcagtgaccaggcctcactacaggcctggttggattctggtctttaatgcatgctagtgttgatgttttttggtcaagaacggtttaaacaggaaggattgtgcagcaggctttaatttaatgtagattcatactgctctgttaaagctgcattgaaatgttaaaatggcttacacttgcagactttgcaaatcttaagactaacaaatccttgaaatcacacagcttgcaaatacgtactaaactgcacaaggtgtgtgttctatatgtgcagttttagcgtattttagttgcataggtttccatggtatttatagtctcttgtgctaaatttggccaaagatgattgtccaccactaaaaatgcctctcccacttggaattctgtactgattttgtggccagatgcaatgatctttaaaaacaaatcttttcaatggcataagaagttgacaaaaatttcttaaagtgcaatagattttcaagttattgtgccttgttctaaaattttaagtagggcacttgacagtattgaggtcatttgttaaggtgctatttcaattagtgtaggtttagactcttgtacatttctcccataactttttacaaagtattttgttgcacattcagagaattttatatatatatgtcttgtgtgggtgtcctcgaccttccaatcttatttcgtctcttggagattgttgaatgcagccagtgaagaagtagattcctaaattttattggggaccatggaatggtagttgagaagaaaactatttgcacacaacagattttagatactttttgctgctagttgtgtaatatttattgaacattttgacaaatatttatttttgtaagcctaaaaatgattctttgaaagtttaaagaaacttgaccaaaagacagtacaaaaaacactggcacttgaatgttgaatgtcaccgtatgtgaaataatatattttggggtagtgtgagcttttaatgttaagtctgttaaacttgagtcaaattaagcagacccggcattggcaatgtagctgtaattttctgacaaaatttaagacaaaattgtcaacttgaaactaaaacatgccaaggttttgatatacttgtcttaagatattaatgaaacaattttgaacactgataggaaggtccacatccacaaagtttctcttgagttttgttatgtgttttgctgtgtttgattttcagtgattgtctggtatatttacagtcctcaaacatggttatttctgtcagtgacttaacattcggttttaccagccagcagtattcttcagtaaataaagaatggaattgctgaatgtaatcattgaacctcgagtcactgtaaaagttcagtaattgcttattgtattagttttagatgctggcaccgcatgtgctctgtttattctgattttactaaaataaaaagttcaaaagtcaaaaaaaaaa

SEQ ID NO: 61668 - DNA, 2411 bp, Homo sapiens
gagaacttgaagccaccatgggagatgaagattgggaagcagaaatcaaccctcatatgtcttcctatgttcccatatttgagaaggataggtattctggagaaaatggagacaattttaacaggactccagcttcatcatcagaaatggatgatggaccttctcgaagagatcatttcatgaaaagtggatttgcctctgggcggaattttggaaacagagatgctggtgagtgtaataagcgagataatacatccacaatgggtggttttggagttggaaagagttttggaaacagaggtttttcaaacagcaggtttgaagatggtgatagctctggtttctggagagagtctagtaatgactgcgaagataatccaacacggaacagagggttttccaagagaggcggctatcgagatggaaataattcagaagcttcagggccatacagaagaggtggaagaggtagtttccgaggttgccgtggaggatttggtctaggaagtccaaataatgacttagacccagacgaatgtatgcagcgcactggtggcctttttggttctagaagaccagtattaagtggcacaggtaatggtgatacttctcaaagcagaagtggcagtggaagtgaacgaggtggttacaaaggtttaaatgaagaagtaataacaggctctggaaagaattcttggaagtcagaagcagaaggaggagaaagtagtgatactcaaggaccaaaagtgacctacataccccctcctccacctgaggatgaggactccatctttgcacattatcagacaggcataaacttcgacaaatacgacactattcttgtggaagtgtctggacatgatgcaccaccagcaattctgacttttgaagaagctaatctctgtcagacactgaataacaacattgctaaagctggttatactaagcttactcctgtgcaaaaatacagtattcctatcatacttgcaggacgagatttgatggcttgcgctcaaacagggtctgggaagactgcggcttttctcctaccaattttggctcatatgatgcatgatggaataactgccagtcgttttaaagagttgcaggaaccagagtgtattattgtagcaccaactcgagaattggtcaaccagatttatttggaagccagaaaattttcttttgggacttgtgtaagagctgttgttatatatgggggaacccagctgggacattcaattcgacaaatagtacaaggctgtaatatattatgtgctactcctggaagactgatggatatcataggcaaagaaaagattggtctcaaacagatcaaatacttagttttggatgaagctgatcgcatgttggatatgggttttggtccagaaatgaagaagttaatttcttgcccaggaatgccatcaaaggaacagcgccaaacccttatgttcagtgcaacttttccagaggaaattcaaaggttggctgcagagtttttaaagtcaaattatctgtttgttgctgttggacaagtgggtggagcatgtagagatgttcagcagaccgttctccaagttggccagttctcaaaaagagaaaagctcgttgaaattctgcgaaacataggggatgaaagaactatggtctttgttgaaactaagaaaaaagcagattttattgcaacttttctttgtcaagaaaaaatatcaactacaagtattcatggtgatcgggaacagagagagcgggagcaagctcttggagattttcgctttggaaagtgcccagttcttgttgctacttcagtagctgccagagggctggatattgaaaatgtgcaacatgttatcaattttgatcttccttctaccattgatgaatatgttcatcgaattgggcgtactggtcgttgtgggaatactggcagagcaatttccttttttgatcttgaatcggataaccatttagcacagcctctagtaaaagtattgacagatgctcaacaggatgttcctgcatggttggaagaaattgcctttagtacatacattcctggcttcagtggtagtacaagaggaaacgtgtttgcatcagttgataccagaaagggcaagagcactttgaacacagctgggttttcttcttcacaagctcccaatccagtagatgatgagtcatgggattaaagccaaaacatccttcaagtctgtggttttgatgcagagaagaaaatagttttgatttttgagtttttaacagaagtataaaacttaacattctcatagctcctgtccttgtattctcactcctacactactgatacaaatggtgttaactgggaatattaaagcattctaaatgtcaaaaaaaaaaaaaaaaaaaaaaaaaaaaaaaaaaaaaaaaaa

SEQ ID NO: 61669 - DNA, 2471 bp, Homo sapiens
gagaacttgaagccaccatgggagatgaagattgggaagcagaaatcaaccctcatatgtcttcctatgttcccatatttgagaaggataggtattctggagaaaatggagacaattttaacaggactccagcttcatcatcagaaatggatgatggaccttctcgaagagatcatttcatgaaaagtggatttgcctctgggcggaattttggaaacagagatgctggtgagtgtaataagcgagataatacatccacaatgggtggttttggagttggaaagagttttggaaacagaggtttttcaaacagcaggtttgaagatggtgatagctctggtttctggagagagtctagtaatgactgcgaagataatccaacacggaacagagggttttccaagagaggcggctatcgagatggaaataattcagaagcttcagggccatacagaagaggtggaagaggtagtttccgaggttgccgtggaggatttggtctaggaagtccaaataatgacttagacccagacgaatgtatgcagcgcactggtggcctttttggttctagaagaccagtattaagtggcacaggtaatggtgatacttctcaaagcagaagtggcagtggaagtgaacgaggtggttacaaaggtttaaatgaagaagtaataacaggctctggaaagaattcttggaagtcagaagcagaaggaggagaaagtagtgatactcaaggaccaaaagtgacctacataccccctcctccacctgaggatgaggactccatctttgcacattatcagacaggcataaacttcgacaaatacgacactattcttgtggaagtgtctggacatgatgcaccaccagcaattctgacttttgaagaagctaatctctgtcagacactgaataacaacattgctaaagctggttatactaagcttactcctgtgcaaaaatacagtattcctatcatacttgcaggacgagatttgatggcttgcgctcaaacagggtctgggaagactgcggcttttctcctaccaattttggctcatatgatgcatgatggaataactgccagtcgttttaaagagttgcaggaaccagagtgtattattgtagcaccaactcgagaattggtcaaccagatttatttggaagccagaaaattttcttttgggacttgtgtaagagctgttgttatatatgggggaacccagctgggacattcaattcgacaaatagtacaaggctgtaatatattatgtgctactcctggaagactgatggatatcataggcaaagaaaagattggtctcaaacagatcaaatacttagttttggatgaagctgatcgcatgttggatatgggttttggtccagaaatgaagaagttaatttcttgcccaggaatgccatcaaaggaacagcgccaaacccttatgttcagtgcaacttttccagaggaaattcaaaggttggctgcagagtttttaaagtcaaattatctgtttgttgctgttggacaagtgggtggagcatgtagagatgttcagcagaccgttctccaagttggccagttctcaaaaagagaaaagctcgttgaaattctgcgaaacataggggatgaaagaactatggtctttgttgaaactaagaaaaaagcagattttattgcaacttttctttgtcaagaaaaaatatcaactacaagtattcatggtgatcgggaacagagagagcgggagcaagctcttggagattttcgctttggaaagtgcccagttcttgttgctacttcagtagctgccagagggctggatattgaaaatgtgcaacatgttatcaattttgatcttccttctaccattgatgaatatgttcatcgaattgggcgtactggtcgttgtgggaatactggcagagcaatttccttttttgatcttgaatcggataaccatttagcacagcctctagtaaaagtattgacagatgctcaacaggatgttcctgcatggttggaagaaattgcctttagtacatacattcctggcttcagtggtagtacaagaggaaacgtgtttgcatcagttgataccagaaagggcaagagcactttgaacacagctgggttttcttcttcacaagctcccaatccagtagatgatgagtcatgggattaaagccaaaacatccttcaagtctgtggttttgatgcagagaagaaaatagttttgatttttgagtttttaacagaagtataaaacttaacattctcatagctcctgtccttgtattctcactcctacacttaaaaaaaaaatccttactgactagttatgtgagatgctaaaacttacaacattgcagttactgatacaaatggtgttaactgggaatattaaagcattctaaatgtcaaaaaaaaaaaaaaaaaaaaaaaaaaaaaaaaaaaaaaaaaa

SEQ ID NO: 61670 - DNA, 2142 bp, Homo sapiens
gcagaaggtgacgggaaacaggccgcagacctgaacttccaaccgtatgtaggcgagaagccggtgccgatactcccactatcccacaatgtcccactgggccccagagtggaagagggcggaggctaatccaagagaccttggggccagctgggatgtcaggggcagcagaggcagtggctggagtggccccttcggccatcagggaccgagagcagcaggctcccgtgaaccaccactctgctttaaaataaagaacaatatggttggtgtggtcattggttacagtggatcaaaaataaaagatctacaacattcgacaaacactaaaatacagatcataaacggggaatctgaagcaaaagtcagaatttttggcaatagggaaatgaaagcaaaggccaaagcggctatagaaacacttattagaaaacaagaaagctacaactcagaatccagtgtggataatgctgcatcccaaacccctattggaagaaatctaggcagaaatgacattgttggagaagctgagccattgtcaaattgggatcgcattagggcagcagtcgtggagtgcgaaaagagaaaatgggcagatctaccaccagttaagaaaaacttttacatagaatccaaagcaacaagctgcatgtctgaaatgcaggtgattaactggagaaaggaaaatttcaacataacgtgtgatgacttgaaaagtggtgaaaagcgtctcattccaaaaccaacttgcaggtttaaagacgcttttcagcaataccctgatcttctgaaaagcataataagggtagggattgtaaagccaacgccaattcagtcacaggcatggccaattattctacaaggaatagatcttatagtagttgcacaaaccggaacagggaaaacattgtcctatctaatgcctgggtttattcatcttgattctcaaccaatatctagagagcaaaggaatgggcctgggatgctagtccttacacccactagagagttggctcttcacgtggaagctgaatgttcaaagtattcatataaaggtctcaaaagcatttgcatatatggtggtagaaacagaaatggacaaatagaagacattagcaaaggtgtagatatcattattgcaactcctgggaggctgaatgacctacaaatgaataactctgtcaacctaagaagcataacctacttggttatagatgaggcagataaaatgctggatatggaatttgaaccccagataaggaagattttattagatgtgcgcccagaccgacagactgttatgacaagtgcaacttggccagatactgtacgtcaactagcactttcttatttgaaagatcctatgattgtttatgttggtaatctgaatctagtggctgtaaatacagtgaagcaaaatataattgttaccacagaaaaagaaaaacgagctctcacccaagaattcgtagagaacatgtcacccaacgacaaagtcatcatgtttgtcagccaaaaacatattgctgatgacttgtcaagcgacttcaatatccaaggcatatctgcagaatcattacatggcaacagtgaacagagtgatcaagagcgagcagtagaggactttaaaagcggaaacataaagatactgattacaactgatatagtatcccgaggtcttgatcttaatgatgtcacacatgtatataattatgatttcccaaggaatattgacgtatatgtacacagagtagggtacattggacggacaggaaagactggcacatcagttaccctcatcactcagagagattcgaaaatggccggtgaattgattaaaattctggacagagcaaatcagagtgttccggaagatcttgtagtaatggctgagcaatacaagttaaatcaacaaaagaggcacagagaaacacgatcaagaaaacctggacaaagacgcaaggagttttattttttaagttgaaaagttgtaccaggctactggaagattccaggcatgttaaagatatgcagtattgaatatatgtaaggaagtattggaaacatactagccatttgaagacataactaattcttaaataatactgctaaactttcaaaaaaaaaaaaaaaaaaaaaaaa

SEQ ID NO: 61671 - DNA, 3076 bp, Homo sapiens
gtggggagggaggggggaggagcatgtctaggtgctgaccacctggagcacttggccagcaagtgggccgcatgctttgggagcaatgggtgacccagcaggaagcacaaaagaccggccagtgtgccatcatcaagggctgctgagcagcttgaagagccactgggtggggagggcacacggggaggtctcagctggggctgcccctggaggacagggcagggaacttgagggctgaggacagaaatctcacatgactccaggaaatagaggaagaggaggatgctgagcgagggattgtgagggagtgggggtaggtcagagggggctgaactgcaggaagccagggggagtcgtggaccactggagctggccagccccagggcattggggacaaggccaggtcagagggagacagtgtgggcctggtgggtggaccctggcagaggccctcttgtcccccacaaggccaggccacactgtgattctgcctgtacctgagcatctgtcctgtgctcctaggccggagaccactgtgtgtcaggtggggcggttggctgagtcccagagaaaaacactcctcactgggcactcttgatgcttgcacacaccctgtggtttatttggtggtcagtaaggaacgtctttgctgctaagtggaagaaagctaatggaacgtaatcaaaatagtggtttaattgacgaattttacttgcacctgtgccttcttcagatcctacctgcctacttagtttacgtgaaggccgactgcaccatgccccccaaccccgacccccaccacacacaacggggccattgtcatgctaggtgcttgctttccccacctcagctccggagatgtgatggtctttggccctggaggtctcggccagcctgtcctccatcctgttctcgttctcgggcaccaccagcagccggtgctgggttttggctccaagcttgtggtcgggccggtggtcgggcctcaagcctgtcttggtgtccagtttgcactcagcgcggtacttgccctccccctccctcttgaaggaggcagaagacgtggctttgggcttggggggctgcagccacgagtggctgaggatctcatcgatgtggagccgctggctgacgtcgggctgcagcatgcggtagatgaggtccttgcactcgcaggtcaggttcttggagcgcgggaagtccacacggtgctccttctggatacgcagcatcttcctgatgtcggagtcgtcatagggcatggagccgcagaccatgatgtacaggatcacgcccaggctccagatgtcatacaccttgggctggtaggggatgctctgcagcacctcgggggctgcatatgctgccgacccgcagaaggtcttgctgaggatgatgcgcccattgctgtcccgcaggcagcgcttggagaagccaaagtcagacagcttgatgttgaagtccttgtcgaggagaaggttctcgcacttgaggtcccggtggacgatgtccaggtcgtggcagtacttgacggcggaggagagctgtcggaacatcttgcgtgccacgtcctcatgcagggctccctggcacttgatgaactcgaggaggtcgccctggacgccaagctccatgatgatgtagatccgtccgtcagaggtctcaaagatctcgtaagtcttgatgatggagccgtggttgacagttgccaggatgtccatctcccgaggaaggaatctctccacaaagtcagtaggtgttttcttgcggtcgatgatcttgacagccacattgaacttgaggcgctcagagtaggcagatttgacttttgcgtaggaacccttgccaagattgatgcctacgatgtaacccttcttccttaggactgtggcatcgtccatggtgccaggagcgactggcgccgctgccgtctacatccccccgtcatgtgggccagcaggcattgtcctcatttacactaccggaggcgtctggctgggctgccctgggctgggcttcgactcaggggtggaacactcagcattgtctccgggtgacttcagccaatgaactcataaagccaaggagtgggggcggggactgggctgagggagaacagggtctctggaaccgtggaagccaggctggtctggcaggagcacccactccccgcccgctggaaggaagcctgtccccaggacaggactctggtggccctgctgctgctgcattggtttccctgtcacaagtcaagctggaggggaggcggcccacgtccagcctgtttgcatcacctggctgtggggactgaccctgcattggtctttgtcccactagggtgggtttcctgcagcttctttggctatgaagaaaagcacccccagggctgtgtccttggtgtggtaggacagttgtccctgacagtcacccagacaggcctgcatagcaccccagttacacagacagatttccacagcactgccttaccattgagcacatagttaaatctagggaaatcagtgcccagacatcaaagctagaaatgaaacatggtcagcaggagccttgcatgggcttctcttttgctggagcaagccaaaataataggaacggttttacattcctagtgccaggacccatctcgggtcgacaaaatctgaagacaagttaagggaacaggcagctgtttgaatagatcaattggatagtctaaggcagctctctggaccaagctgtaaaggagatacaatcgaaataatcactccggtaccacagtagacaggccttgaaggcactgggccccttttaatcggacttagcaagcattttttttgcctctgaccttctccttggaacaaaattagttaccagtagacttaggtgattgctgtactgcatgtaggcacataaccccaacctatataaacagtaagaaaattgtagcactttgagttggtctgctggaattatctccagccttctccctgtatccagttacagtgataaactcccttctttcctaaaaaaaaaaaaaaaaaaaaaaaaaaaaaaaaaaaaaaaaaaaaaaaaaaaaaaa

SEQ ID NO: 61672 - DNA, 2939 bp, Homo sapiens
atctgaaaaattaataattccttaattatcaaatatccattatttaaatttataattgtgtcataaatattgtcataaatagatttgctgttttaaagcttgttccttcattttctctgttttgttttagataaacattgtcataaatagatttgttgttttaaagcttgttccttcattttctctgattgttttgttttagattcagaggttacttatgcttgtttgttacatggatgttacatgtgtaatgggggatattggacttctagtgtactcatcacccatatactgaacactgtactcaaaagggattgaaagaaactaggaaacttggcaggaagatcattcttaagccaggaaaaaaatttttaatgctcacatgtgaacatgtgatggtcataccagaaggagcacccacctccctccctctgtgacagacacattttcttagccttcacctttccttctttcaagttgctgaaaatccacagtgtttctgttcatttgttactttcattctcacctatcttctctcttgctccatctaccagaacaataattccccatataatacttctcacttcacttttcaacgcaggacctcttgttggtctgatctgtttgtctgtccgctttatcaatattatcagatgtaagtttacatgaatacacacacatattcactaaactgaggggaaaaaatgccttgtaggtcataaaaaagcagggaaattcccaacaattcatatttgatccctggatccaggggtggcagcaataagcctgctttagatatttactccccattttatgatccggtggtttggtttttcaaatgatgatatggctcctttcgcaatgacttgatgtttaggaggtgtgcttcaataaatacattttaaaatcaacaatcaagttagagttgtacaaatggctctgaaatgtcccactacactgttagaccaagggcacagattgtgcttctgtactatttatcctagtatccctcggcatatattaactgctctaaaaatctccttggctacacgctgcatcaaatcaaagttaaatgttataccacctttctattctatttttaatattcaaagagggtgctcagattttagaacaaatttcaatgtttaagtacacacaaaaaaatcattaactcatatatttcaagagtaggaaatgggaactggtgttaaaactcttataacaaatgtcactgtcttaagggacagtgtttaaaaacgcatacctggccgggcgcggtggctcatgcctgtaatcccagcactttgggaggccgaggccggcggatcacaaggaaaacaaactcaggaagaaaaaggaaagcagaagtgatcaaggagagcgctcgagttgcaatattttcctttggctgctgacaggcagttactataaagcattgtgcatggacaccatcttcttgtattatacaagaaaggagtgtacctatcacacacagggggaaaaatgctcttttgggtgctaggcctcctaatcctctgtggttttctgtggactcgtaaaggaaaactaaagattgaagacatcactgataagtacatttttatcactggatgtgactcgggctttggaaacttggcagccagaacttttgataaaaagggatttcatgtaatcgctgcctgtctgactgaatcaggatcaacagctttaaaggcagaaacctcagagagacttcgtactgtgcttctggatgtgaccgacccagagaatgtcaagaggactgcccagtgggtgaagaaccaagttggggagaaaggtctctggggtctgatcaataatgctggtgttcccggcgtgctggctcccactgactggctgacactagaggactacagagaacctattgaagtgaacctgtttggactcatcagtgtgacactaaatatgcttcctttggtcaagaaagctcaagggagagttattaatgtctccagtgttggaggtcgccttgcaatcgttggagggggctatactccatccaaatatgcagtggaaggtttcaatgacagcttaagacgggacatgaaagcttttggtgtgcacgtctcatgcattgaaccaggattgttcaaaacaaacttggcagatccagtaaaggtaattgaaaaaaaactcgccatttgggagcagctgtctccagacatcaaacaacaatatggagaaggttacattgaaaaaagtctagacaaactgaaaggcaataaatcctatgtgaacatggacctctctccggtggtagagtgcatggaccacgctctaacaagtctcttccctaagactcattatgccgctggaaaagatgccaaaattttctggatacctctgtctcacatgccagcagctttgcaagactttttattgttgaaacagaaagcagagctggctaatcccaaggcagtgtgactcagctaaccacaaatgtctcctccaggctatgaaattggccgatttcaagaacacatctccttttcaaccccattccttatctgctccaacctggactcatttagatcgtgcttatttggattgcaaaagggagtcccaccatcgctggtggtatcccagggtccctgctcaagttttctttgaaaaggagggctggaatggtacatcacataggcaagtcctgccctgtatttaggctttgcctgcttggtgtgatgtaagggaaattgaaagacttgcccattcaaaatgatctttaccgtggcctgccccatgcttatggtccccagcatttacagtaacttgtgaatgttaagtatcatctcttatctaaatattaaaagataagtcaaacattaaaaaaaaaaaaaaaaaaaaaaaaaaaaaaaaaaaaaaaaaaaaaaaaaaaaaaaaaaaaaaaaaaaaaaaaaaaa

SEQ ID NO: 61673 - DNA, 2706 bp, Homo sapiens
attgtccggagtgggtccttgacattcaggaaagatacatccttagacctttcaaaatttgtcatgcctctctaacctaaaacagccctcattaaatgcactttaatccgagcactgtatggcttggaaagaattatgagtgaggagaggagcctttccttattggccaaagccgtggatcccagacaccccaatatgatgacagatgtggttaaacttctctctgcggtatgcattgtaggggaagaaagcatccttgaagaagttttagaagctttaacttcagctggtgaagaaaaaaaaattgacagatttttttgtattgtggaaggcctccggcacaattcagttcaactgcaagtagcttgtatgcagctcatcaatgccctggttacatctcctgatgatttggatttcaggcttcacatcagaaatgaatttatgcgttgtggattgaaagagatattgccaaatttaaaatgcattaagaatgatggcctggatatccaacttaaagtctttgatgagcataaagaagaagatttgtttgagttatcccatcgccttgaagatattagagctgaacttgatgaagcatatgatgtttacaacatggtgtggagcacagttaaagaaactagagcagagggatattttatttctattcttcagcatcttttgctgattcgaaatgattattttataaggcaacaatacttcaaattaattgatgagtgtgtatcccagattgtattgcatagagatggaatggatccagacttcacatatcgaaaaagactagatttagatttaacccagtttgtagacatttgcatagatcaagcaaaactagaagagtttgaagagaaagcatcagaactttacaagaaatttgaaaaagagtttaccgaccaccaagaaactcaggctgaattgcagaaaaaagaggcaaagattaatgagcttcaagcagagctacaagcttttaagtctcagtttggtgccttgccagctgattgtaatattcctttgcctccctctaaagaaggtggaactggccactcagcacttcctcctccgcctccactgccttctggtggaggggtgccgcctccacctcctcccccaccacctcctccacttccaggaatgcggatgccattcagtggtcctgtgcctccaccacctcccctgggattccttggaggacaaaattctcctcctctaccaatcctgccatttgggttgaaaccaaagaaagaatttaaacctgaaatcagcatgagaagattgaattggttaaagatcagacctcatgaaatgactgaaaactgtttctggataaaagtaaatgaaaataagtatgaaaacgtggatttgctttgtaaacttgagaatacattttgttgccaacaaaaagagagaagagaagaggaagatattgaagagaagaaatcgattaagaaaaaaattaaagaacttaagtttttagattctaaaattgcccagaacctttcaatcttcctgagctcttttcgggtgccatatgaggaaatcagaatgatgatattggaagtagatgaaacacggttggcagagtctatgattcagaacttaataaagcatcttcctgatcaagagcaattaaattcattgtctcagttcaagagtgaatatagcaacttatgtgaacctgagcagtttgtggttgtgatgagcaatgtgaagagactacggccacggctcagtgctattctctttaagcttcagtttgaagagcaggtgaacaacatcaaacctgacatcatggctgtcagtactgcctgcgaagagataaagaagagcaaaagctttagcaagttgctggaacttgtattgctaatgggaaactacatgaatgctggctcccggaatgctcaaaccttcggatttaaccttagctctctctgtaaactaaaggacacaaaatcagcagatcagaaaacaacgctacttcatttcctggtagaaatatgtgaagagaagtaccctgatatactgaattttgtggatgatttggaacctttagacaaagctagtaaagtctctgtagaaacgctggaaaagaatttgaggcagatgggaaggcagcttcaacagcttgagaaggaattggaaacctttccccctcctgaggacttgcatgacaagtttgtgacaaagatgtccagatttgttatcagtgcaaaagaacaatatgagacactttcgaagttacacgaaaacatggaaaagttataccagagtataataggatactatgccattgatgtgaagaaggtgtctgtggaagactttcttactgacctgaataacttcagaaccacattcatgcaagcaataaaggagaatatcaaaaaaagagaagcagaggaaaaagaaaaacgtgtcagaatagctaaagaattagcagagcgagaaagactcgaacgccaacaaaagaaaaagcgtttattagaaatgaagactgagggtgatgagacaggagtgatggataatctgctggaggccttgcagtccggggctgccttccgcgacagaagaaaaaggacaccgatgccaaaagatgttcggcagagtctcagtccaatgtctcagaggcctgttctgaaagtttgtaaccatggtaataaaccgtatttataaattacaaaaaaaaaaaaaaaa

SEQ ID NO: 61674 - DNA, 1957 bp, Homo sapiens
atgcttttgaactggttgcggattttgagttggaggaacacttgggacaaccggtcacattccttcagtgcgcggccactcctcagcacatatcccaaagccgatgacttccatcatacaatcttcagcaaccttgaaagattggacaagcttcagcccactcttgaagcctctgaggagtctctagttcacaaggacagaggagatggagagaggccagtcaacgtgagggtggtgcaggtggcccctctgaggcgtgaatctagtaagtattctggaatcacttgccaagaaaacaatctggatgccaagaaaggtgtggcatccttgcctggtttcaatgtgaagagccaccctgatcctgggattgtgataggaataactccccatggggacaccatccacgacatcacgaacgaggacgccgtccacgacaccaccgacgaggacgccgtccatggcaccgccgacgaggacgccgtccagggcatcgccgacgaggacgccgtccacggcatcgctgactgggacgccatccagggcctcgctgacagggacgccgtccacggcttcgctgatggggacgccgtcaagggcatcgctgacggggacgccacccagggcatcgctgaaggggacgacgtccatggcatcgctgatggtgtcgccgtccagggcatcgctgacgaggatgcagtccagctcattgctgacgaggaccccgtccatggcatcactaaagaggatgccacccagggcttcgcgaacaaggacgctgcccagggcatcgctaatgaggaggccatccacggcatccctaacgaggtcgccatccagggcgtcgctaacgacgacgccgtccagggcggcatcgctaacgaggacgccaccgagggcatcgctaacgatgacgccgtccacggcatcactaacgaggacaccgcccagggcatcgccaactgggatgccgtccaggacatcgccaactgggatgccgtccactgcatcgctaacgaagatggattccacggcatcgataacgaggacgctgtccagggcatcgccgactgggacgccgcccagggcatcgccgacggggtcgccgcccagggcatcgctctcgatgatgccgtccacggcattgctaataaggacgccgcccagggcatcgccaactgggatgctgtccaggacatcgctaacgaagatggattccacggcatcgataacgaggacgccgtccagggcatcaccaactgggacgtcgtccagggcatcgccaactgggacaccgtccacagcttcgccgacggggtagccttccacggcatcgccgacggggacgccgtccagggcatcgctctcgatgacgccgtccacggcatcgctaatgaggatgctgcccagggcatcgccaactgggatgctgtccaggacatcgctaacgaagatggattccacggcatcgatatcgaggacgccgcccagggcatcgataacgaggacgccttccagggcatcgccaacagggaagccttccacggcatcgccgacggggacgccgtccagggcatcgccgacggggtcgccgtccacggcatcgctgacggggttgtcgtccacggcatcgccgactgggacgccgcccagggcatcgccgacggggacgccgtccacggcatcgctgacgaggaagccgcccagggcatcgccaactgggatgctgtccaggacatcaataacgaagatggattccacggcatcgccaacgaggacgccacccagggcatcgccgacggggacgccgcccagggcatcgccgacggggacgccgtccagggcatcgccgactgggacacagtccacggcttcgccaacagggtcgccatccacggcttcgccaacagggtcgccttccacagcatcgccaacggggtgccgtccagggcatcgctaa

SEQ ID NO: 61675 - DNA, 5191 bp, Homo sapiens
ttgacatcagtggtgtcaagacaactctaagaaggttttccgtgatcctgcaagccctgcgttccttcctgggatcctgccttcaatttgattgcacaggtaccacagcaagccagtgctgtgtgctccgagttccagggcgtcctccagctcagccactgcactgagaacatggactctctgtggggcccaggagccgggagtcacccctttggggtccacaacacccggctgtccccagacttgtgtccagggaagatagtgttgagggccctcaaggagagcggggcagggatgcctgagcaggacaaggaccctagagtccaagagaatcctggtgatcagagaagggtccccgaggtcaccggggatgcaccgtctgcatttcggcccctgcgggacaatggaggcctctctccctttgtgcccgggcccgggcctctgcagacagacctccatgcccagaggtcagaaatcagatataacccgacatcccagacctcctggacgagctcctgcaccaaccgaaatgccatctccagctcctacagctccacgggaggcttgccggggctaaagcggaggagggggccagcctcatcccactgccagctgaccctcagttcctcaaagacagtgagtgaggacaggcctcaggctgtctcttcaggtcacacccagtgtgaaaaggcagcagatatagcaccagggcagacactcaccctcaggaatgactcctccacatccgaggcctctaggcccagtacacacaagtttcccctgctgccacgcaggcgaggggagcctttgatgctgccacctcccttagagctggggtaccgggtcactgttgaagacctggaccgggagaaggaggcggccttccagcgcatcaacagtgcactgcaggttgaggacaaggccatctcggactgcagaccctcacggccttcccacactttgtcctcacttgcaacaggggcttctggtctgcctgccgtttctaaagcacccagtatggatgcacagcaggagacacacaagtcccaagactgcctgggcctactggaccccttagcatctgctgcaggggtcccctctacagctcccatgtctgggaagaagcacagaccaccaggccccctgttctcctcctcagatccccttcctgccacctcttctgattcccaggactcagcccaggtcacctcgctgattcctgcccccttcccagctgcaagcatggatgcgggcatgagaagaacaaggcatggcacttctgctcctgcagctgccgcagcagcccctccccgctccacattgaaccccacgttggggtcactactggagtggatggaggcccttcacatttctgggcctcagccacagctgcagcaggtgcccagaggtcagaaccagagatcccagacctcctggaccagctcgtgccccaaatgaaatgccatctcgagcccctacagctctacgggaggcctcccggaacaaaagcggaagaggggccagcctcatcccactgccagctgaccctcagttcctcaaacacagacccagggtgcatgcccatctccagcccagggcagctcccctgtaagctgggtgagctactgaagccaaggtgggaggcagctgacaacaccacccacggcccatgcagaggtggtagaaaggctggactcagcaggaacaccaaatcccggaccaggcagaaaccacccaagactgaggggctcgtgccagagcggtggccacagggctgaatggtcgctgagacagagatggaagccaggacaagggagcccaccgggcccagatagagacttcagaacccactcctgagaacagcggagccaggcgcttagaggaagaccaaatgctgccaggacacggattgtccagggattacattccagcatcttattagaggacggaagcagagggtgctgtttcaacgccaccaccaggagagaggcagaggggctgtgccgtgctagagtcctcagggagggagtgacctcgaccctggctgtgctgcaagctgactccagccttgggctcagcagcacccggtgaacagcagcaggaggagccgctagagcagctgctcatgggcagagcagcccttgggcaactcctgccaccaccccctccccagggagcccaaggcaggggaggctcagcatggaatgaaacaggggagtgagggacacaaggaggtgggaagtgggagggtcccagccccaccaagtacgcagagacccccttgtcgtcctggacaccacaggggcacctgcaggctgggagaccaggtcctctgtgcatgggcccgggaggcagacctgccccaagggtgatgcagaggccacaggtgctgcacgctccagcgcccactctagacatcagcctccaggttgactaagggtcaggtcatgtttgaaaccatgcttggctggaccgggacccatggcaagagcacctgggcaccagtgtttagccctggtctgcaggaaggaggacagcagactttaggaccccacagcatggcagtgctgaccatttcacccacttggcctccttgaggaatagggatggggagccctctggggatgagcaaggccttccaggacaggctcggttctggtcccctgctttttgaggttgggttaaaatgccgaccatggcagaggggtcacagctcaggttcccacacctcacttttcacagcctccaagggcagcagtgcacatggaggagacgtctcccacgaggccaaggcctccaatgctcaccgatgccctctgcgaagctggggtagaactcgtcagtgaagaggggctcaggcagctcacggaagtacagcttcagcgtgcctgcgatggcgttcatgtccgtctcgctcatcatcaccgacatgtccttcttatctggaaagagcacggaaatgcagcggcctccttgaagatcctgataaatgaagaaaagacacagagaaggatgtgacatgcctgggccatggagcactctgagatctcatcgcggacaccactgcccacacctccatcccgtcctgcgcaggccaacactcactgacatcgaaggctgccttcagtgcctggatgtctgcggccacaccggccggacacgtggtagatgcccacctcctccatgcctcggcgctcgatctcctccacgcactggcgcacgatgtagggcaccttggacctctctctcctgtgggaggggggaatgttctcagtgtcctaacagccctgcttgggccataacacaggagacctgctccctatctgcgcacccggaggtggggtgaggacggtgacgaaggtacccaggtctggggctgcacacagagccttctgcatgcctgtcctccctctgcaagctctgtcttcacggcatgtgctttctcaggaacctttcaagcggccagaacccctgcgaatcacacatgacctttgcgggaaggtcaggaggcctgtctaagtcaagtcagcacgggaagggcatctgacagattccaggcctggggttagcagcctgtgcccccggctgggagatcagacccggtgttggtcctgccacccacgtgctgtgtgagaggagaatccctgacccctgccctgggccttaacacacatccgacgaatgaatgaagggttgcctcagtaccggtgctccaagtcctgcgatgctaagtgcttttctcctctgagtcttagcaatggacaattccaatacctccacacaggacactagagtaagaaaccttcacagttagaacgcagtgctgtgcggaggccttaacttgagttctgttttgcacctggatttaccagcacatcaaagctgcttcgcaagccccctcattagcagggcttatctgggggagctgctgatggagtcctcgctgctcatgcccacagccctcccagagtgctatgcgagtggctgccgtgcagttgggggtggggcgtggtgtttagacacagataggagtccagggtatgactgatggaggccccggcccacgtgaccagcaaggtcagaggcccagccagattccatcctggggaagcaaatgaattctcagaggaagtggtctgtgtctgcatgaactgctctcaaaccaacaaacaggcttctcttggcaacagactcatgacaaaggattcaagattgtttgaaaaaaaaaaaaggggagcagggaggcagaaagtcctggaaaagtaaattgtttattttacaataagaaagtgattacatatttttttttttacaatggtggaaaattagaagtcattgtgaaaatgatgtctacctgccttgctgatgagtaggatgtgatttggctctttaggaaactgaatttgcagaacttaagaatattgatttataaagggcatggccattgacccagtccatcttatgcaaatctggatgccataaataatatttaaaaatgaaagtattggggtggaggttgcagtgagcagagattgcccccgctacactccagcctggtcgacagagtgaactctgtctcaaaaaaaaaaaaaaaagaaaagaaagaagaagccattcccaacgttgctcatcaaattatgaccataaatttccaggatcagactaacggctaaagagactgatgcatcaacaccaggcagagaataaagcagatttttttgttgttgttctggagagcttctaggaacttgaaaaatacatatgccacactcttaagacccggtggttcttaatcagggatgttcattaaaatgctggaaaactgtaaagacttccaggtcccatccaaggagattttgcttctgattgactggctagtggcctggccattggtattttgaaaaatccctccaagtgattcttttacatcccagatagaaaaccctaaattaaaggtgaaaaaaccagacaccaagtggcatttaaataaatgtcaactttaactccacaaagcatctggttgcatgtggacagaaagagaaggaaagagggccctatatctggataacttagaaatgtgctccccctagcaagatatctaccaaaattaaaaccatatttgaggatgctggcactgcgagtaatatataaatgatgcatgtaacgtcatttaatatgatcttatttttaa

SEQ ID NO: 61676 - DNA, 5191 bp, Homo sapiens
ttgacatcagtggtgtcaagacaactctaagaaggttttccgtgatcctgcaagccctgccttccttcctgggatcctgccttcaatttgattgcacaggtaccacagcaagccagtgctgtgtgctccgagttccagggcgtcctccagctcagccactgcactgagaacatggactctctgtggggcccaggagccgggagtcacccctttggggtccacaacacccggctgtccccagacttgtgtccagggaagatagtgttgagggccctcaaggagagcggggcagggatgcctgagcaggacaaggaccctagagtccaagagaatcctggtgatcagagaagggtccccgaggtcaccggggatgcaccgtctgcatttcggcccctgcgggacaatggaggcctctctccctttgtgcccgggcccgggcctctgcagacagacctccatgcccagaggtcagaaatcagatataaccagacatcccagacctcctggacgagctcctgcaccaaccgaaatgccatctccagctcctacagctccacgggaggcttgccggggctaaagcggaggagggggccagcctcatcccactgccagctgaccctcagttcctcaaagacagtgagtgaggacaggcctcaggctgtctcttcaggtcacacccagtgtgaaaaggcagcagatatagcaccagggcagacactcgccctcaggaatgactcctccacatccgaggcctctaggcccagtacacacaagtttcccctgctgccacgcaggcgaggggagcctttgatgctgccacctcccttagagctggggtaccgggtcactgttgaagacctggaccgggagaaggaggcggcattccagcgcatcaacagtgcactgcaggttgaggacaaggccatctcggactgcagaccctcacggccttcccacactttgtcctcacttgcaacaggggcttctggtctgcctgccgtttctaaagcacccagtatggatgcacagcaggagacacacaagtcccaagactgcctgggcctactggaccccttagcatctgctgcaggggtcccctctacagctcccatgtctgggaagaagcacagaccaccaggccccctgttctcctcctcagatccccttcctgccacctcttctgattcccaggactcagcccaggtcacctcgctgattcctgcccccttcccagctgcaagcatggatgcgggcatgagaagaacaaggcatggcacttctgctcctgcagctgccgcagcagcccctccccgctccacattgaaccccacgttggggtcactactggagtggatggaggcccttcacatttctgggcctcagccacagctgcagcaggtgcccagaggtcagaaccagagatcccagacctcctggaccagctcgtgccccaaatgaaatgccatctcgagcccctacagctctacgggaggcctcccggaacaaaagcggaagaggggccagcctcatcccactgccagctgaccctcagttcctcaaacacagacccagggtgcatgcccatctccagcccagggcagctcccctgtaagctgggtgagctactgaagccaaggtgggaggcagctgacaacaccacccacggcccatgcggaggtggcagaaaggctggactcagcaggaacaccaaatcccggaccaggcagaaaccacccaagactgaggggctcgtgccagagcggtggccacagggctgaatggtcgctgagacagagatggaagccaggacaagggagcccaccgggcccagatagagacttcagaacccactcctgagaacagcggagccaggcgcttagaggaagaccaaatgctgccaggacacggattgtccagggattacattccagcatcttattagaggacggaagcagagggtgctgtttcaacgccaccaccaggagagaggcagaggggctgtgccgtgctagagtcctcagggagggagtgacctcgaccctggctgtgctgcaagctgactccagccttgggctcagcagcacccggtgaacagcagcaggaggagccgctagagcagctgctcatgggcagagcagcccttgggcaactcctgccaccaccccctccccagggagcccaaggcaggggaggctcagcatggaatgaaacaggggagtgagggacacaaggaggtgggaagtgggagggtcccagccccaccaagtacgcagagacccccttgtcgtcctggacaccacaggggcacctgcaggctgggagaccaggtcctctgtgcatgggcccgggaggcagacctgccccaagggtgatgcagaggccacaggtgctgcacgctccagcgcccactctagacatcagcctccaggttgactaagggtcaggtcatgtttgaaaccatgcttggctggaccgggacccatggcaagagcacctgggcaccagtgtttagccctggtctgcaggaaggaggacagcagactttaggaccccacagcatggcagtgctgaccatttcacccacttggcctccttgaggaatagggatggggagccctctggggatgagcaaggccttccaggacaggctcggttctggtcccctgctttttgaggttgggttaaaatgccgaccatggcagaggggtcacagctcaggttcccacacctcacttttcacagcctccaagggcagcagtgcacatggaggagacgtctcccacgaggccaaggcctccaatgctcaccgatgccctctgcgaagctggggtagaactcgtcagtgaagaggggctcaggcagctcacggaagtacagcttcagcgtgcctgcgatggcgttcatgtccgtctcgctcatcatcaccgacatgtccttcttatctggaaagagcacggaaatgcagcggcctccttgaagatcctgataaatgaagaaaagacacagagaaggatgtgacatgcctgggccatggagcactctgagatctcatcgcggacaccactgcccacacctccatcccgtcctgcgcaggccaacactcactgacatcgaaggctgccttcagtgcctggatgtctgcggccacaccggccggacacgtggtagatgcccacctcctccatgcctcggcgctcgatctcctccacgcactggcgcacgatgtagggcaccttggacctctctctcctgtgggaggggggaatgttctcagtgtcctaacagccctgcttgggccataacacaggagacctgctccctatctgcgcacccggaggtggggtgaggacggtgacgaaggtacccaggtctggggctgcacacagagccttctgcatgcctgtcctccctctgcaagctctgtcttcacggcatgtgctttctcaggaacctttcaagcggccagaacccctgcgaatcacacatgacctttgcgggaaggtcaggaggcctgtctaagtcaagtcagcacgggaagggcatctgacagattccaggcctggggttagcagcctgtgcccccggctgggagatcagacccggtgttggtcctgccacccacgtgctgtgtgagaggagaatccctgacccctgccctgggccttaacacacatccgacgaatgaatgaagggttgcctcagtaccggtgctccaagtcctgcgatgctaagtgcttttctcctctgagtcttagcaatggacaattccaatacctccacacaggacactagagtaagaaaccttcacagttagaacgcagtgctgtgcggaggccttaacttgagttctgttttgcacctggatttaccagcacatcaaagctgcttcgcaagccccctcattagcagggcttatctgggggagctgctgatggagtcctcgctgctcatgcccacagccctcccagagtgctatgcgagtggctgccgtgcagttgggggtggggcgtggtgtttagacacagataggagtccagggtatgactgatggaggccccggcccacgtgaccagcaaggtcagaggcccagccagattccatcctggggaagcaaatgaattctcagaggaagtggtctgtgtctgcatgaactgctctcaaaccaacaaacaggcttctcttggcaacagactcatgacaaaggattcaagattgtttgaaaaaaaaaaaaggggagcagggaggcagaaagtcctggaaaagtaaattgtttattttacaataagaaagtgattacatatttttttttttacaatggtggaaaattagaagtcattgtgaaaatgatgtctacctgccttgctgatgagtaggatgtgatttggctctttaggaaactgaatttgcagaacttaagaatattgatttataaagggcatggccattgacccagtccatcttatgcaaatctggatgccataaataatatttaaaaatgaaagtattggggtggaggttgcagtgagcagagattgcccccgctacactccagcctggtcgacagagtgaactctgtctcaaaaaaaaaaaaaaaagaaaagaaagaagaagccattcccaacgttgctcatcaaattatgaccataaatttccaggatcagactaacggctaaagagactgatgcatcaacaccaggcagagaataaagcagatttttttgttgttgttctggagagcttctaggaacttgaaaaatacatatgccacactcttaagacccggtggttcttaatcagggatgttcattaaaatgctggaaaactgtaaagacttccaggtcccatccaaggagattttgcttctgattgactggctagtggcctggccattggtattttgaaaaatccctccaagtgattcttttacatcccagatagaaaaccctaaattaaaggtgaaaaaaccagacaccaagtggcatttaaataaatgtcaactttaactccacaaagcatctggttgcatgtggacagaaagagaaggaaagagggccctatatctggataacttagaaatgtgctccccctagcaagatatctaccaaaattaaaaccatatttgaggatgctggcactgcgagtaatatataaatgatgcatgtaacgtcatttaatatgatcttatttttaa

SEQ ID NO: 61677 - DNA, 6036 bp, Homo sapiens
ggagacggagttgagctggtgaagaagagctcgggctcatcatgaaacaacgaaaaggccaagggtctgggggcagccgtgggcgcaaaaaaagaggtttaagtgacatttctccatctacaagcctgccacctctggttgaaggccagctacgctgttttctaaaacttactgttaatagagtcatatggaagattgcaaagcctcccacttgtgtacttgtccgagtgagatggtggggagaaacatcagatggaaccctcttttgtcccagggatgcattgcagactgaaccaaaagctgtgagaacaactacgcgttacgctattcgttgtggtccaaaacagtttacctcttatctaacagatatggctgtgctggtgctggaagtaatcaccaaacttgatggtcttccaattggtagagttcagatcaatggactagctcaactttctccaacccatcaaaccaatggattttttaccattgtttcatcaacgtctaagaaacttggagaactccaggtctcacttgccctggaacctctgtcagaaacttacgacagctaccatccacttcctaccactgacatgacagaaaatgtgcttttatctaagcagggattcagagagaatactgaacccagcagtacccagtttcaggttccatcaaggcctcgcgacatacataccatcaaaattgatggaaaagagttagcagccaacagcagtagatcaaccactccgaggggaaaagaccatgtatgctttgcagagaaccctgatacaataaaggattcttcctttggactacagcacagtcttaattcaggacagagtttagagtctgtaactctgaaaggcagagctccacggaagcagatgtcccttctgaacagttctgaattccagcctcaaattagaacagttgccaagagtcacagtgactcatgcattctttcttcaaacaacctccctaccaaggatcttctttcagctctgttagaacaaggcaataaactgcgtaatgccatggtgatttctgcaatgaaatcaagcccagagaccagcatgttgttggaccaagttcatcctcctattaatgaagattctcttagagcatcaacacagatcagagccttttctaggaatcggtttaaagaccacattgaagatcacctcctcccttcaactgagaatacattttggagacatgacacaaaagctgataccagagctatacagctgctattaggcagtgctgaattatcccaaggcaatttctgggatgggctaggctctcctccagattccccatctcctgggagtgatgtgtattgcatcagtgagctgaatgaccctcagtatgaccagagtcttctggagaatttattttatacagcacctaaatctgataccagcatcagtgatttcctcagtgaagaggatgatatcgtcccttctaaaaaaataagccagtcaacagctcttgccagatcatctaaggttctggagtcaagtgatcataagctgaagaagaggtcagcaggcaagagaaatagaaatttggttgaacaacagatgctctcagaaactccagaagatgcccaaacgatgacactaagtgtggatagactggcccttttgggtagaacacattcagtcagaatcatcatcgaaaccatgggagttcctccagatagtcctcagatgacccctggcaaaaaaagctatgctggtccaccacctaaggtgactacagcaaaaaagcgcactttctttgtagaatatcactttcctgtgggcttttcggaaagcggattgggaaagacagctttgatcactgaggttgttcgactcgcctccagtaaaattacagatggaaaggtgaagttccagcagcgatttgtgtttccagtacagtttggtggcccaatgatagagcactggtggaattccaacctcactttccaaatttatgtaaagaaaactccacagaaaaagccagaagtcattggatctgtgtcactttctttgcgagctgtcattcaatcagagctgctttctttcagtgatcagcttccagtgcaacaagaaaatggtcagtctccatttggccccctcaaggtaaccatggagcttattacagataacaaagatttcactggtatcaatactaagttaagtggcaacacccattataccccactttgtgctcctacaagtccaaataaggcactaccagaacttaaccaagatgtgacctgtaccaaaaatccacaaaacttaaaccaaattcatgaggaaactgcaaagaaagcacagaacttggtgctccccaaccgaaagtcaccaagccctgtagcaccacatccttcaaccttcgtagctacgccagcctcccataatttagtcaatcagacaaatgggacaacaaaagagagtgctttgctgttgcatgtgctgttgatggtgccagatgggaaagattttattagtggagaatctgagaaacaatcaccatgcaatgtttatttaaattgtaaactcttcagcacagaggaagtcaccagatctgtcatcgcatggggcacaacacaaccggtctttaacttttctcaggtgattcctgtctctctgtcttccaaatacctggaaaggcttaagaacaatgtgatggtaattgaaacttggaataaggtgcggagcccaggacaggacaagctgctcgggctggtgaaacttcccctccaccagttttacatgtcattcaaagatgctaagatttctcgcctgttgctggatgcccagtacccagttgttgctgtcgacagctacatgcctgtgattgatgtgttttcaggccaccaaaatgggagtcttcgagtctttttagctatgggttcttcaaatcaaataatggcactacaaagattaaagaatgaagaaggaacactccctcccttcagccctaggccagcccatttcctggaccagccaactgcagcatctgttgctatggcagaggaccgaggaaatggactgatggagcactgctttgagatccatatagagatggttaaagggctagcccctcttcaggcaacagtctggggagaagcagattgttatgtccagtactactttccagttcaacactctcaatccagtgtgctgaaaggacctgagttccttgaaaatggaattactctgaagcccttcagaactgcaaccacactctgtgttccagatcccatctttaatagtgaacaccatcactctctcctgttgccagctgaggttccagtgcaaaggctcctactaagtgctttctctgcacagggcctcgtgcctggaggtggagtccagtttgaaatctggtgcagatactattatcctaatgtgagagaccagaaggtcgccaaaggaaccttgccattatcaaggatctgtgctatggtagccacccagcatcgtgaggatgtgggaatacagacctttaatctccctttaacccccaggattgagaacaggaaagaattgaggaaccagtcatcaggtttactggatgtgggcctaaggtacaggcgtagtccaagaacagcagagggagttcttgctgcccgaaccgtttccatctcagtccagattatcagagcctgtggtctgcaagcagcagccaaggctttggctgaacaggaacccgctctacagtttagtgccacagtcggggtcaatgcctctgtcaccactcatctctccttcctgccccagggagaacagcgccgaacccaccctgtggcctgttctttctgccctgagttctcccatcacgttgagttcacatgtaacttggtgactcagcactgtagtggagaggcctgtttcctagcagagttgttggagtttgcagaagttatttttgctgtctatcatgaaaataccaagtcagcaagtgatataatcagtattgagtcatgcaaagagtatctgcttggagtagtaaaagttccaacaaaagagctgctgatcaagagatctgggatcacaggatggtatcctatcattttaccagaagacgggggcctacctcgtggcctggagctcatgcagaagatcgtgggtggtctggagctttcgatttccttcacgcatcgtggagatagagaacgggtgttggaagctgctgagcatttgggctggagctttgagaacagcctgaaagattttgtcagaatggatgaaggggagccagccactgtcaccatctccaccccaaggctgtggctgtccatccattgtgtgctgcttgctggccacaaccacattcataagaatacatattgctaccttcgctacaagttctatgatcatgaagccttttggacccctctcaagaagcctaaggaatctgtaaacaaaaagcagattatggtcactttcaaggcatccaaaagagcagaagtcaccaggggcccatcactgctttggtacttcagggaggagaggctagagatccaagtgtggcgagcttatggcaatgacagtgtggagagaccccatcagacagacagctggattggctcagcctatgtggacctggccagacttggggagaggtcagcgaggacgctaactgtcagtggtgtgtatcctctgtttggacgaaatgcttccaacctctcaggagctgccttgcgagttcatgtggttctttcctctctttcctcacaccttgagcccactcatgagctggactccatggactgcagcagccacagtgagtctgagcagctccccagaaggaatgatgaggtccagctctctccaccagaagtcatctcctgccaccagaagtctcctgcctccacccaggtcccctgcagcagcaccacagctgaagtccgcctgacgcaggagggccctgctgatttggatggaacgtttgcagtcagcatcctagtggaaagagcaatgcacttgagcttgaaagggagccccttgacagagcggaaagtatcgatacccagttgttgtgtatcctttgcaacagccgatgagtcatctcctgtatacacccaagtggttgaaaacacagattcccccatctggaattttcaacagcagtcaaggctatcaaaagagctgcttctggacccacaacaaaccctggtcttcaaagtttggcataaaggagatgaggagagggtgattggctttgcctcggtggacctctccccacttctctctggcttccagtttgtctgtggctggtacaacatcacagacttcagtggagagtgccaggggcagataaaagttgctgtctcccctttggagagtttgatacacttcaaagaagaaaggcaagcaaggcgtggagtggagacctcaaaatcactgatcccaatatacagtcccttttccttccctgcctctgatacgtatgctgcattctccagccacatggcaaggcagaccctagaccaacttgctcatgcctcctcaaaggagcttgatttctcctctcctgggagaagtgataccacaagaagccaagcatcacgccatgaagagcatgtgcagaacattcgccggtttcatgaatccctgcatcttcagggagaggcacccttgccatgtgatgacaaactgaccacatcacctttgtcctcccaaacctccattctgacttctctcaggaagaatctgagtgagcttgatcagattcagaggtacttccgccagaagctcaccaagcctttcctacccctcagccctcagactcaaacggccatctcacagcaccaggagagctgtagggaccatcttgggccaggtgccagcagcctagaccctgggagccagtgtatcctggagaaatccagtaacctggtgttgcaagtcagctccttaatcacaggtagttactgaagtaactggaagcatgaacatgcccaccaggactcccagctcccaacgattcctgagcatgagcagatagtctctgaaagcatttccacagatgtatccacaa

SEQ ID NO: 61678 - DNA, 3641 bp, Homo sapiens
atgcccagagctcagttgctagaaagcaatgcgcctattcacatggagaatcttccctttcctctaaaattacttagtgcctcatcactaaacacccccagctccacaccatgggtgttggatatcttcctcaccttggtgtttgccctggggctcttcttcctattactcccctacttctcttacctccgttgtgacaacccaccctcaccatcgcctaggaagagaaagcttgtagagagtgcccgagaggcctggaggagacttgggacctgctttcacaactgcagagacccgccaggtgaggtgggcaaaagaacacctgatggagcctcccggtcctctcatgagcctatggaagatgctgctcccattgtctccccgttagcttccccggatcctcgaaccaagcatcctcaggatctggcctccaccccaccaccaggcccaatgaccacctcagtctcctccctaagtgcctcccagccaccagaaccttcccttctcctagaacgcccctcacccgagccacctgcacttttccctcacccaccacacacccctgatcctctggcctgctctccacctcctccgaaaggcttcactcctcctcccctgcgggactccactctgttaacaccatctcactgtgactcagtggcacttccactggacaccgtccctcaaagcttgtctccacgtgaggatttggcggcttctgtcccagccatctcaggccttggcggctcaaacagtcaagtttctgccctctcctggtcgcaggagactaccaaaacctggtgcatcttcaactcgtcagtccagcaagatcatctttcccgccaaagggacaccacaatgtccccactgcttttccaggcccagcccctgtcccatctggggcctgagtcccaaccctttatttcatccacaccccaattccggcccacacctatggctcaggccgaggctcaggcccatcttcaatcctctttcccagtcctatctcctgcttttctatccccgatgaagaacactggagtagcttgccctgcgtcgcagaataaagtgcaagctctctccttacctgaaactcagcaccctgaaaggcctttgttgaggaaacaactagaaggtgggttggctttaccctctagggtccaaaaatctcaggacgtctttagtgtctccactcctaaccttccccaggaaagactgacatccattctgcctgagaactttccagtcagtcctgaactctggagacaactggagcaatacatggggcaacgtggaaggatccaagagtctctggatctgatgcagcttcaggatgaattgccagggacaagtcaggccaagggcaaacccaggccctggcagtcctccacgtccacaggtgaaagcagcaaggaggcacagacggtgaagttccagctagagagggacccatgcccacatctggggcaaattctgggtgagaccccacaaaatctatccaggggcatggaaagcttcccagggaaggttctgggggcgacctctgaggagtcagaaaggaacctgaggaagcccttgaggagtgactcaggaagtgatttattaagacgcacagagaggaatcatatagaaaacatcctgaaagcccacatgggcagaaagttgggccagaccaacgagggcttgatccccgtgagtgtgcgtcgatcctggcttgctgtcaaccaggcttttcccgtatccaacacccacgtgaaaaccagcaatctagcagccccgaaaagtaggaaagcctgtgtaaacacagcccaggtgctttccttccttgagctgtgtactcagcaggtgctggaagcccatattgtgaggttttgggccaaacacaggtggggtctacccctcagggtcctcaagcccattcagtgctttcaactggaaaaggtttcatccttgtcccttatacagcttgctggtccctcctcagacacctgcgaatctggggctggctcaaaagttgaggtggccacgctccttggagagccaccaatggcaagtctgagaaagcaagtgctgaccaaaccatctgttcacatgccagagaggcttcaggcctcctcacctgcatgtaagcagttccagagggccccgcgagggatcccatcttcaaatgatcatgggtccttgaaggctcctacagctggacaggagggcaggtggccatctaagcccctcacatacagcctcaaaggcagcacccagcagagcaggagcttaggagcccaatcttcaagggctggagagaccagggaggcagtgccacaacccacagtccccttgggaacctgtatgagagcaaacctccaagccacaagtgaggatgtgcgtggtttcaaggctccaggcgccagcaaaagctctctactccctagaatgtctgtctcccaagacccaagaaagctgtgtctcatggaggaggctgttagtgaatttgagcctggaatggccacgaagtcagagacccagcctcaagtttctgccgctgttgtgctccttccagatgggcaagcatctgttgtgccccatgcttcagagaatttggcttctcaagtgccccagggccatctccagagcacgcctactgggaacatgcaggcttcccaggagctatgtgacctcatgtcagccagaaggagtaacatggggcacaaggagcccaggaacccaaactgtcaaggctcatgcaagagccaaagcccaatgtttccccctactcacaagagggagaactctaggaagcccaacttagaaaaacatgaagaaatgtttcaaggattgaggactcctcaacttaccccaggcagaaaaacagaagacacccgtcagaatgaaggcgtccagctactgccatcaaagaaacagcctccttcaataagccactttggagaaaacatcaagcaattttttgagacgattttttcaaagaaagaaaggaagccagcaccagtcactgctgagagccaaaaaacagtaaaaaacagatcatgcgtgtacggcagcagtgctgaagctgagaggctcatgacagcagttggacagataccggaggagaacatgtcactttgccatgcgcgccatgcctcgaaggtaaatcagcaaagacagcagtttcaagccccagtctgtgggtttccctgcaaccacagacacccgttctactcagaccacagcagaatgctgagctatgcagccagcagtcaacaagccactctcaagaaccagagtcgtcccaacagagacagacaaatcagagatcagcagcccttgaaaagtgtccggtgcaacaatgagcaatggggcctgcgacatccccaactcttgctccccaagaaagctgtatccccagtcagtccccctcagcaccggccgaagacacccagtgcctccagccaccatcaccactgaccaaggcactgtctttttcagggaggtatctaatttggtcagtcacaaattcctttttagccttccctagagaaaaacaagtcaccaagaaaaaattcactctatgtagaggaaaagtattttctctcatgttagtacacgcagaacatttaatattccacaatatatacggtttttta

SEQ ID NO: 61679 - DNA, 3656 bp, Homo sapiens
atgcccagagctcagttgctagaaagcaatgcgcctattcacatggagaatcttccctttcctctaaaattacttagtgcctcatcactaaacacccccagctccacaccatgggtgttggatatcttcctcaccttggtgtttgccctggggctcttcttcctattactcccctacttctcttacctccgttgtgacaacccaccctcaccatcgcctaggaagagaaagcttgtgcctcctgtctcctgcagcctcctggggccacaccttgaaaaaggtgactttggtcagctctctggtccagacccgccaggtgaggtgggcaaaagaacacctgatggagcctcccggtcctctcatgagcctatggaagatgctgctcccattgtctccccgttagcttccccggatcctcgaaccaagcatcctcaggatctggcctccaccccaccaccaggcccaatgaccacctcagtctcctccctaagtgcctcccagccaccagaaccttcccttctcctagaacgcccctcacccgagccacctgcacttttccctcacccaccacacacccctgatcctctggcctgctctccacctcctccgaaaggcttcactcctcctcccctgcgggactccactctgttaacaccatctcactgtgactcagtggcacttccactggacaccgtccctcaaagcttgtctccacgtgaggatttggcggcttctgtcccagccatctcaggccttggcggctcaaacagtcaagtttctgccctctcctggtcgcaggagactaccaaaacctggtgcatcttcaactcgtcagtccagcaagatcatctttcccgccaaagggacactacaatgtccccactgcttttccaggcccagcccctgtcccatctggggcctgagtcccaaccctttatttcatccacaccccaattccggcccacacctatggctcaggccgaggctcaggcccatcttcaatcctctttcccagtcctatctcctgcttttctatccccgatgaagaacactggagtagcttgccctgcgtcgcagaataaagtgcaagctctctccctacctgaaactcagcaccctgaaaggcctttgttgaagaaacaactagaaggtgggttggctttaccctctagggtccaaaaatctcaggacgtctttagtgtctccactcctaaccttccccaggaaagactgacatccattctgcctgagaactttccagtcagtcctgaactctggagacaactggagcaacacatggggcaacgtggaaggatccaagagtctctggatctgatgcagcttcaggatgaattgccagggacaagtcaggccaagggcaaacccaggccctggcagtcctccacgtccacaggtgaaagcagcaaggaggcacagacggtgaagttccagctagagagggacccatgcccacatctggggcaaattctgggtgagaccccacaaaatctatccaggggcatggaaagcttcccagggaaggttctgggggcgacctctgaggagtcggaaaggaacctgaggaagcccttgaggagtgactcaggaagtgatttattaagacgcacagagaggaatcatatagaaaacatcctgaaagcccacatgagcagaaagttgggccagaccaacgagggcttgatccccgtgagtgtgcgtcgatcctggcttgctgtcaaccaggcttttcccgtatccaacacccacgtgaaaaccagcaatctagcagccccgaaaagtaggaaagcctgtgtaaacacagcccaggtgctttccttccttgagctgtgtactcagcaggtgctggaagcccatattgtgaggttttgggccaaacacaggtggggtctacccctcagggtcctcaagcccattcagtgctttcaactggaaaaggtttcatccttgtcccttatacagcttgctggtccctcctcagacacctgcgaatctggggctggctcaaaagttgaggtggccacgctccttggagagccaccaatggcaagtctgagaaagcaagtgctgaccaaaccatctgttcacatgccagagaggcttcaggcctcctcacctgcatgtaagcagttccagagggccccgcgagggatcccatcttcaaatgatcatgggtccttgaaggctcctacagctggacaggagggcaggtggccatctaagcccctcacatacagcctcaaaggcagcacccagcagagcaggagcttaggagcccaatcttcaagggctggagagaccagggaggcagtgccacaacccacagtccccttgggaacctgtatgagagcaaacctccaagccacaagtgaggatgtgcgtggtttcaaggctccaggcgccagcaaaagctctctactccctagaatgtctgtctcccaagacccaagaaagctgtgtctcatggaggaggctgttagtgaatttgagcctggaaaggccacgaagtcagagacccagcctcaagtttctgccgctgttgtgctccttccagatgggcaagcatctgttgtgccccatgcttcagagaatttggcttctcaagtgccccagggccatctccagagcatgcctactgggaacatgcaggcttcccaggagctatgtgacctcatgtcagccagaaggagtaacatggggcacaaggagcccaggaacccaaactgtcaaggctcatgcaagagccaaagcccaatgtttccccctactcacaagagggagaactctaggaagcccaacttagaaaaacatgaagaaatgtttcaaggattgaggactcctcaacttaccccaggcaggaaaacagaagacacccgtcagaatgaaggcgtccagctactgccatcaaagaaacagcctccttcaataagccactttggagaaaacatcaagcaattttttcagacgattttttcaaagaaagaaaggaagccagcaccagtcactgctgagagccaaaaaacagtaaaaaacagatcatgcgtgtacggcagcagtgctgaagctgagaggctcatgacagcagttggacagataccggaggagaacatgtcactttgccatgcgcgccatgcctcgaaggtaaatcagcaaagacagcagtttcaagccccagtctgtgggtttccctgcaaccacagacacccgttctactcagaccacagcagaatgctgagctatgcagccagcagtcaacaagccactctcaagaaccagagtcgtcccaacagagacagacaaatcagagatcagcagcccttgaaaagtgtccggtgcaacaatgagcaatggggcctgcgacatccccaactcttgctccccaagaaagctgtatccccagtcagtccccctcagcaccggccgaagacacccagtgcctccagccaccatcaccactgaccaaggcactgtctttttcagggaggtatctaatttggtcagtcacaaattcctttttagccttccctagagaaaaacaagtcaccaagaaaaaattcactctatgtagaggaaaagtattttctctcatgttagtacacgcagaacatttaatattccacaatatatacggtttttta

SEQ ID NO: 61680 - DNA, 1284 bp, Homo sapiens
caacggtcccccagccatgggcgctgcagctccggccgagtccgcagacctcgggaacttctggaaggcgggagaacccctgctgcaaggccccgacgccctggcggctcccatgagcaggtcacccagcacgccccagaccacgccatctccccagggtcgccagagtccctggcccctgaggtccctgactcagagccatattgagtacttccagtggggacgcccggtgcccagcacccacctcatcgaggtgcggcccacccaggaccccgccaagccgcagcgggtggtctccgagggctggaggcgccctgcccttcccggggagaccgctctggggcgagacctctcctgtgcctgggagggttgcatgaaaggggggctgtgtcgtgcctggaacccaggacggacctggagcccggtgaccatcgggatcgcgccccctgagcgtcaggagagcccctggagatcccctggacagagagcccgccccgcaggccgccccgccgcccaggagctcctggacccctgcacccgggagactctgctgggggcgctcagccagtgccccaagggaagcgctaggttcgacgggccgttgtggttcgaggtctcagacagcaagggtggcaggcggaacctgcagccccggccctctgccttcaagcccctgagcaaaaatggagcggttgcttccttcgtgcccaggccagggcctctgaagccgagcctcggcccctggagcctcagtttttgtgatgatgcttggccttccgtgctggtccagcccgccccatccgccatctgggacttctgggaggcgacaacgccttcctgcggcagctgcagtagggtctccttcgccctcgaggtcacccagtctgctggcccctttggctcctaagaatctgggctctgctacccacctccggagacacaagcccacgtatctactttcacttgctcatccttgctctacctcaacgtggggccctgacaccacgttatcaaacatgcagcccccacacccctcgtctgcccgcccccagatcttccctctgtgctccctgccaccccagcagctgttgatttcagaacccttgccttcgccctgctggccctctcctccctgcccttcttcctgcccttcctctgaaaagaggcatttcgggaaggcttgctttttctccatgtctcccagtttgtatagttaaattgtccagttgtatagttaaatatttgatcttattaaaaacatttgtctgcaaaaaaaaaaaaaaa

SEQ ID NO: 61681 - DNA, 5772 bp, Homo sapiens
gaggttactggtggtggcggcggcggcggcggcccgggctccggctgtcggggaagctgctgagctgtgatggtgatgacgaggtgaaaatggcggatctttcgaaatacaatcccggcccctgacataccagaggcggcggcgacggcgacgtcgccaccccggctcccttctcggtccccgggtaccctggagcgctccagtttggacaaactgggaaaggaagctgctggccagagctatcgtgcacgggcaaaacaagccccgccggggctcgggattgcccaggaccttctggagcccctacctcggagcccgagggaggagaaagcggcagccgctggagtgcctgatcaactttctagcgggagaacgatcatggaggtggtgccagctgaggtgagtagtttgcttccagaggaaataatggacactggtataactttagtggatgatgatagtattgaggctgttattgtttcatccccaattcccatggagacagaactggaagaaattgtcaacataaattctactggtgactctacagccacgcccatttccacggaaccaatcacagtgtacagtaaccacactaaccaagttgcagtgaataccacaattactaaagcagattctaataccacagtgaaaccagcttttccaagtggccttcaaaaacttggtgctcagactcctgtgactatatcagccaatcagattattttaaacaaagtatcacagacatctgatcttaaacttggcaatcagacccttaaaccagatggacagaagttaattttaacaactttgggcaagtctggttcaccaattgttttagcactaccccatagccaactaccccaggctcagaaagttacaactcaggcccagtcaggagatgctaagttaccaccgcagcaaattaaagtagttaccattggagggaggccagaggtgaaacctgtcattggtgtctcagcattgaccccaggaagtcaactgattaatactacaactcagccctctgtgttacagacccaacagttaaaaacagtacagattgctaagaagcctcgaacgccaacctctggtccagtaatcacgaagctgatctttgcaaaaccaattaatagtaaagcagttacaggacagacaactcaagtttcaccaccagtcattgcaggtagggttctttcacagtctactcccggaactccatcaaagaccataacaatatctgaaagtggtgttattggatcaactttaaattctacaacacagacaccaaataaaatagccatctcacctttgaaatcgccaaataaggcagtgaaatcaactgtgcagaccatcactgttggaggagtgagcacatcacagtttaagacaattattcctctggcaactgctcccaatgtccagcagattcaagtgcctggaagcaagtttcattatgtccgacttgttactgccacatcagccagtagctcaacccagccagttagtcagaatcccagtacaaacactcagcctcttcagcaagcaaagccagtggttgttaatacaaccccagtgcggatgtcagttccaattgtctcagctcaggctgtcaaacaagttgttccaaaaccaatcaatccaacttcacaaatagtaactactagccagccacagcaacggcttatcatgcccgccacaccactgccacagatccagcccaacctcactaacctgccaccaggcactgtcctggcaccagctccgggaacagggaatgtgggttatgcagtgcttccagctcagtatgttactcagctacagcagtcttcatatgtatcaatagcaagcaactctacctttactggaacatctggtatccagacccaggcacggcttccattcaatggcataatcccatcagagtcggccagtcggccccgaaagccctgtaattgtacaaaatcactgtgtttgaaattgtattgtgattgctttgcaaatggtgaattttgcaacaactgcaattgtactaattgttacaacaatttggaacatgaaaatgaaaggcaaaaagcaataaaggcatgccttgacagaaatccagaagcctttaagcctaagatagggaaaggaaaggagggagaatctgatcgacgtcatagcaaagggtgtaattgcaaacgatcaggatgtcttaaaaactactgtgaatgctatgaggcaaaaataatgtgttcctcaatatgcaaatgtattggctgtaagaattttgaagaaagcccggaaaggaagacattgatgcatttggcagatgcagctgaagtaagggtacagcaacaaacagcagccaagacgaagttatcctctcaaatttcagacttgcttactaggccaacaccagctttaaatagtggaggcggaaaattgccatttacatttgtaactaaggaagtagctgaagccacatgtaattgcctccttgcccaggcagagcaggcagacaagaagggaaaatcaaaggcagcagcggaacggatgatacttgaggaattcggacgatgtttgatgagtgtcatcaactctgcaggaaaggcaaaaagtgccccttgtgccatgaattgctaactcttgcacaaaagactgataaatggaactgtacagaaaatttaaggtgcagggacacttgattttctggaagaaaaacaattactgtattttaattcagtccttgttttaaaagacctgaaattataatactgaaggagaagaaattttaaatgaggaaattagtacattttaaatcttagttaaatctgcttatgccccttctaaattgaatttttctttattatatagattttttaatttgcttgggtttcttaagaattagatgttctctttctgatacctttgacaaaaaatgtttataaattcatataatttataatgtatggtgttgtatgactttgttaatagaaaagccaaagcagcagtggttagcacccattctttgggacttgatctagaatatctgcagacagaatgttacataaacaaattcttatgaaacacattcaaatgacattttgtatttagaaaaggactatcttttaaagaaaaagcagccttttagggccgattctggaataatatcctgttgtcactttgggaatgtcagaaggggaaacaatccccaggcacactaaaaattttttaaagttatttaaaaaaacatataaaatattaaaggacagtaaatctcagaggatgggcaatgtgtttctataataaggaaaggctaacagatgctctgggctgtctccattttctttcaaagaggtggtatgtatttgaagtaataaattgtcaaagtgattactgggtactattaaaatgataggtggatataaatggaagtaaacattatgtagtgataatatagaacctcacatagtaatcaagtataaaatttggcatgggtggagaaacaaagaatagggaagctgcaaaagatgaatttagagaagttttcatctatacaatcaattatttttacagacttttttttttttttttgagacggagtctcgctgtgtagcccaggctggagtgcaatggtgagatctcagctcactgcaacgcctctgcctcccaggttcaagcgattctcctgcctcagcctcccgtgtagctgggactacaggtgcatgccaccatgcccggctcattttttgtatttttagtagagacggggtttcaccgtgttagccaggatggtctcgatctcctgacctcgtgattcgcccgcctcggcctcccaaagtgctgggattacaggcataagccgccgtgccaggccctttttatagacttttgaactaagaggtttcaaaccaaatcgcaactcttacttgatttacagaaatgggcctcctaacaaaattttcaaaattgtggtgggatttctttttataagggaagtttaatatggcattattttcagccagtgatttgggaggtctgttttcctataattactaaaataacctaaatcattttcagtattcaaaaactctatgaatttaagagcctgttgtgacaggactcttgattttatgacaagaaaaaaccatgttggaattcaggcattttgttaggtaccttaatcatcagtaattagtatatgattatttcatttcctacaaggactctatagttgtatgtattaagtgtgtatatatgttcatatgaacatgcaagatataggcaatagaaattaagtaatccaaaagaggattccgttattcactaaagtatcttccttttaaatttggatttataaaatcatagtgcagtaactttaaatgtagatagttcaaacattcttagcacctcaatctagtatgtttaattaaaatttgtataaatgtaaattagtgtaagagggtaaaataataatcaagttatttttcaaaagattgcaataagtttttggtctaaacttaaactttgttcattttgtacatactctgtgttaattctaattgcacctttgtgatgtgtatttatatacagtgtgcagaaaatgttcgtgaaattttgattacaattgtagattatgtatgatggcattgcttacgaatgttttgcttgtaaaaaaatttcaaggtgcaatcaaatgctactagtttttctgattttcaaaaatctatctatctaaaatattaagccttttccttcctgtgtagtacttactaaataactttttgtattcaggcatttgcatcaaattgctgaacaagatgaatagccacattaattcaatgattttaaaagactatttggggagggttgggtatataattttttagctctatttacatcccaaagtagaaagattaaatttatatttactagagctattcaaagaatacacttttctatattgtaaaaacaggacagcaaagtaaatcatacagaaaataaacatttatactattctgtaaaaaaggttttgcattttttctttagtataataacaccactttattaaccatttaatatgcaaaaaaccttttaaattatctgaagtaaatttgacattacttctgaaaacacacaactaaaaaattctatcattttgctcagttattactaacataaattgctttgaaatgagaatatgtcttctctttttttccccactgtttcttttaagagcagaaactcagccgggcatggtggctcacgcctgtaattccagcactttgggaggtcaaggcgggtgaatcacttgagtccaggagttctagaccagcccaggctacatggtgaaaccctgtctctactaaaaatataaaaaaattaactgcgtgtggtggcgcacacctgcagtcctcgctactttgaaggcctgagcctgcagaggttgaggctgtagtgagtcaaaattacaccactgcactccagcctggcaatcagagtgagaccttgtctcaaaaacaaaaatacctagaaaatcaatctactctgtcttttaatgtgaaatgttcttatgatagctatctttcttagtttcctttttttctgaagcactaaacacaacctgtaggtcttatctctggggtctgggaaacagaaccttaatgttacaggtacaaaagcaaacagagtgattagttccccattttctggtagtgaacaactgacatttttttcaatcttatgtaaaatgtgaataaaaataattttaaaaaaaaaaaaaaaaaa

SEQ ID NO: 61682 - DNA, 1034 bp, Homo sapiens
ccgggctcctgggtgaggccggcaagtttggagcgtggtcagacaataggggcgtggctacggctcgcggagcgcaaccaacgctctagaccagacctgggctcgagaccataactgtttggctttaacagtacgtgggcggccggaatccgggagtccggtgacccgggctgtggtctagcataaaggcggagcccagaagaaggggcggggtatgggagaagcctccccacctgcccccgcaaggcggcatctgctggtcctgctgctgctcctctctaccctggtgatcccctccgctgcagctcctatccatgatgctgacgcccaagagagctccttgggtctcacaggcctccagagcctactccaaggcttcagccgacttttcctgaaaggtaacctgcttcggggcatagacagcttattctctgcccccatggacttccggggcctccctgggaactaccacaaagaggagaaccaggagcaccagctggggaacaacaccctctccagccacctccagatcgacaagatgaccgacaacaagacaggagaggtgctgatctccgagaatgtggtggcatccattcaaccagcggaggggagcttcgagggtgatttgaaggtacccaggatggaggagaaggaggccctggtacccatccagaaggccacggacagcttccacacagaactccatccccgggtggccttctggatcattaagctgccacggcggaggtcccaccaggatgccctggagggcggccactggctcagcgagaagcgacaccgcctgcaggccatccgggatggactccgcaaggggacccacaaggacgtcctagaagaggggaccgagagctcctcccactccaggctgtccccccgaaagacccacttactgtacatcctcaggccctctcggcagctgtaggggtggggaccggggagcacctgcctgtagcccccatcagaccctgccccaagcaccatatggaaataaagttctttcttacatctaaaaa

SEQ ID NO: 61683 - DNA, 2229 bp, Homo sapiens
cctcgccactccagctgcgcctccggctgcagcgcacacgtctcctgcgcctcctcctccggagcgtcgctgtccgtcgggttcatccctcgcagcagtctccaggcgagagagggggccagagtgctcgcacttctcctaggggcaccatgcccaacgacgaggcattcagcaagccctctacaccgtcggaagcccctcacgcccccggggtaccgccgcagggcagagccgggggctttggcaaagcgtctggggcgctagtgggggcggccagcggctcgagcgccgggggcagcagcagaggaggcggctccggctccggggcgtcggacctgggtgccgggagcaagaagtccccgcggctgcccaagtgcgcacgctgcaggaaccacggctacgcctcgccgctcaagggccacaagcgcttctgcatgtggcgcgactgccagtgcaagaagtgcaacctgatcgccgagaggcagcgcgtgatggccgcgcaggtggccctgagaaggcagcaggcccaggaggaggaattgggtatcagccaccccatcccactgcccagtgcggccgagctgcttgtcaaaagagagaacaatggcagtaacccgtgcctcatgactgagtgcagtggcacctctcagccaccgccggccagtgtccccaccactgcagcttcagagggacgtatggtcatccaggatattcctgctgtcaccagcagagggcatgtggagaacacacctgacctggtttcagactccacctactacagcagcttctaccagccgtctctgtttccttattacaacaatctatacaactgcccgcagtactccatggccttggctgctgattctgcttctggggaggtgggaaatcccctcgggggatcccctgtgaagaacagccttcggggcctccccggaccttatgtgcctggtcagacaggaaaccagtggcagatgaagaacatggagaaccgccatgcaatgagctcccagtacaggatgcattcttactacccgcctccctcttacctgggccagagcgtgccccagttcttcacttttgaggatgctccctcttacccggaagccagggcgagcgtattctcgccgcccagcagtcaagattctggcttggtttccctctcgagcagctctcctattagtaacaagagcacaaaggcagtgcttgaatgtgagcctgcgtcggagcccagcagcttcacagtcactcccgtcatcgaggaggacgagtgagcagtgcctgctgccgatggcggttcacttggagtaacaggcttattccactttccatggggtttgttaatattttgcattgactcatactatcttaactgttgagaacgtatttggtttatattccttagagtttagtccagaggctgtaacacatttgtaatactttagggtccgtgactaccatctgcatggtttaagtgctttactcacggagtttaaataatagtgttcatttttttaatgacactggtttcatgtagttttcaagaaataaaagaattcattcaagtgaagccatttgtgtgcctctaaatgagtcatctaattagatgttacttttagttttaaaatgaaatcttaggtgccttaggggttttttttttttttaagtattttttaaaaacctgcaaagatataaatttagccaagttacctgacgggtgagaagaaaagagcaggcaaaattagtgatttttttagaagtctgctaaatggatatattgtgtgtgttgctgttggaaatagccccaccccatcctcccaatccaaaacgtaactgaaatataatcagaaacattaaagcctgtaaaaaaaaattgctgcgtttttggtaaagggtgtaatttgtaaacagtgcaatttaaagtgaccttagtgatgcagagttcctgagtggtgtttgtagaatgagtttatcatacattctttctactactggaaaaaaatggatgcagtctggactgttgtaaccttaggttgtaatctgatttggaaataagtacatctttaaaagttgctacagatttgagttcatgattttgttaaaaattgctatggagtactttgttatataacagaagccatcctgaaatgaaactagtctaaaaaaattcattgttctacttagttgcagctgtacctgaaataaaaatgttattgatgactgaaaaaaaaa

SEQ ID NO: 61684 - DNA, 4800 bp, Homo sapiens
cgtgctgcgggtacgagccagaaagttcccagctgtggtcaactgcacggccatcgactggttccacgagtggccggaagatgcgctggtgtccgtcagcgcccgcttcctggaggagactgaggggattccgtgggaagtcaaggcctccatcagcttcttcatgtcctacgtgcacaccaccgtcaacgagatgtccagggtatacctggctactgagaggcgctacaactacaccacacccaaaacctttctggagcagatcaaactgtaccagaacctgctggccaagaagagaacggaacttgttgccaaaatcgagaggctggagaacggcctgatgaagctgcagagcacggcttcccaggtggatgatttgaaagccaagttggcgattcaggaggctgagctcaagcagaagaatgagagcgcagaccaactgatccaggtggtcggcatcgaggccgagaaggtcagcaaagagaaggccattgctgaccaggaagaagtcaaggtcgaggtcatcaataagaacgtcactgagaagcaaaaggcctgtgaaacagacctggccaaagcagaaccggccctgctggcagcccaggaggctctggacactctgaataagaacaacctgacagagctgaagtcctttgggtccccgccggatgctgtggtcaacgtcaccgccgccgtcatgattctgaccgcacctgggggcaagatccccaaggacaagagctggaaggcggccaagatcatgatgggcaaggtggacaccttcctagactccctgaagaagttcgacaaggagcacatccctgaggcctgcctgaaggccttcaagccctaccaaggcaacccgacgttcgaccccgagttcatccgctccaagtccacggccgccgccggcctgtgctcctggtgcatcaacatcgtccgcttctacgaggtctactgcgacgtggcgcccaagaggcaggcactggaggaggctaatgcagagctggcagaggcacaagagaagctgtcccggatcaaaaacaagattgccgaacttaacgccaacctgagcaacctaacctcagcgtttgaaaaagcaacagctgagaaaatcaagtgtcagcaagaggccgatgccacgaacagggtgatcttactggcgaacaggctggtcgggggattagcatcggaaaacatccgctgggctgagtctgtggagaacttcaggagccagggggtcacgctgtgtggggacgtcctgctcatctctgccttcgtgtcctacgtgggctacttcaccaagaaataccggaatgagctgatggagaaattctggatcccttacatacataacttaaaggtccccatcccgatcacgaatggcctggatcccttgagcctgctgacagatgacgcggacgtggccacctggaacaaccagggcctccccagcgaccgcatgtccaccgagaatgccaccatcctgggcaacaccgagcggtggccgctgatcgtggacgcccagctccaaggaatcaagtggatcaaaaacaaatacaggagtgaactgaaagccatccgcctgggacagaagagctacctggatgtcatcgagcaggccatctcggaaggggacaccttgctcattgagaacatcggcgaaaccgtggaccccgtgctggaccctctactgggcaggaacacgattaaaaagggaaagtacattaagatcggtgacaaggaggtggagtaccaccccaagttccgcctgatcctacacaccaagtacttcaacccacactacaagccagagatgcaggctcagtgcaccctcatcaacttcctggtcaccagggatggactcgaggaccaactcttggccgctgtggtggccaaagagcgcccagatctggaacagctgaaggcaaacctcaccaagtctcaaaacgaatttaagattgttctgaaagagctggaagattcgctcctggcccgtctgtcggctgcgtcggggaactttctgggagacacggccttggtggagaatctggagaccaccaagcacacagccagcgagatcgaggagaaggtggtggaggcaaaaatcacagaagttaaaatcaacgaagcgagagagaactaccgcccggctgcggagagggcatctctgctctacttcatactgaacgatctcaacaaaatcaaccccgtctaccagttctccctcaaggccttcaacgtggtgtttgagaaagccatccagaggaccacccctgccaacgaggtgaagcagcgggtgatcaacctgacggacgagatcacctactccgtctacatgtacacggcccggggactcttcgagagggacaaactcattttcctggcacaagttacgtttcaggtcctgtccatgaagaaggagctgaacccagtggagctggatttcctcctgcggttcccttttaaggccggagtggtctcaccagtggacttcctccagcatcaaggctggggcgggatcaaggccctctcggagatggatgagttcaaaaatctggacagtgacatcgaaggatctgccaagcgctggaaaaagctggtggagtcggaagcccccgagaaggagatcttccccaaggagtggaagaacaagacggccctgcagaagctgtgcatggtgcgctgcctgcggccagatcgcatgacctacgctatcaagaacttcgtggaggaaaagatgggcagcaagttcgtggaaggccggagtgttgagttttctaagtcctacgaggagagcagcccctccacgtcaatcttcttcatcctctccccgggggttgaccccttgaaagacgtggaagccctgggaaaaaaactagggtttaccatagacaatggaaaactccataatgtgtccctggggcagggacaagaggtggtggctgagaacgccctggacgtggctgcagagaaaggacactgggtcattctgcagaatatccacctggtggcccggtggctgggaacactggacaagaagctggagcgctacagcacgggcagccatgaggactaccgggtgttcatcagcgcggagcctgcccccagccccgagacccacatcatcccccagggcattctggagaacgccatcaagatcaccaacgagccccccacgggcatgcacgccaacttgcacaaggccctggacctgttcacccaggacaccctggagatgtgcaccaaggagatggagttcaagtgcatgctcttcgccctgtgctacttccacgctgtggtggcagagaggcgcaagttcggcgcccagggctggaaccggtcgtaccccttcaacaacggggacctcaccatctccatcaacgtgctctacaactacctggaggccaaccccaaggtgccctgggacgatctccgctacctttttggtgaaatcatgtatggcggccacatcacagatgactgggaccgtcggctgtgcaggacctacctggctgaatacatccggacggagatgctggagggagacgtcctgctggcccccggctttcagatcccccccaacctggactacaagggttaccacgaatacatcgatgagaacctgccccctgagagtccctatctgtatggcctgcaccccaacgcagagattggctttctgacggtcacctcagagaagctgttccgcactgtcctggaaatgcagccaaaagagacggactcgggggcaggcacgggagtgtcccgcgaggagaaggtgaaggccgtgctggacgacatcctggagaagattccggagactttcaacatggctgagatcatggcaaaggcagcggaaaagaccccctacgtggtagtcgcctttcaagaatgtgaaagaatgaacatcctgaccaacgaaatgcgccgttcgctcaaggagctgaacctggggctgaagggagaactgaccatcacgaccgacgtggaagatctgtccacggctctcttctatgacaccgtgcctgatacgtgggtggcccgggcctacccctccatgatgggcctggcggcctggtacgcagacctgctgctccgcatcagggaactcgaggcctggacgacagactttgccctgcccaccaccgtgtggctggccggcttcttcaacccccagtcgttcctcacggccatcatgcagtccatggccaggaagaacgagtggcccctggacaagatgtgtctgtctgtcgaggtgaccaagaaaaaccgagaggacatgaccgctcctccgcgagagggctcctacgtgtacggactcttcatggaaggggctcgctgggacacccagactggagtcatcgctgaagcgcggctgaaagagctgaccccggccatgcctgtcatcttcatcaaggccattcctgtggaccgcatggagaccaagaacatctatgagtgtcccgtgtacaaaacacgcatccgcggccccacctatgtctggacctttaacttgaagaccaaagagaaggcagcgaagtggatcctggcagccgtggcgctgctcctacaggtttagctcgctcctgcctcacagcccacactccctggggctggaccacaactcagcccttcacctgtgcacctgtgacttattctttacaggaactggtggtggtttttcgttctcttaaataatcaggtgctttgtaaccaagcacatcggaaccagagggtggaggttggtgtggaagaggtggggcagattaaagccagtggagccactcaaaaaaaaaa

SEQ ID NO: 61685 - DNA, 2578 bp, Homo sapiens
taacattgtctttaacataaaagtgtacctatttgcagtcactacctctatcaccaccaccagcagagcctgagctgaggaaaccacggttctcaatacccagcacacccacttccaactatctgttaaaacatggtggattactatgaagttctaggactgcaaagatatgcttcacctgaggacattaaaaaagcttatcataaagtggcacttaaatggcaccctgataaaaatccagaaaataaagaagaagcagagagaaaattcaaagaagtagctgaggcatacgaggtattatcaaatgatgagaaacgggacatttatgataaatatggcacagaaggattaaacggaggtggaagtcattttgatgatgaatgtgagtacggcttcacattccataagccagatgatgtttttaaagaaatttttcatgaaagggatccattttcttttcacttctttgaagactcgcttgaggacctgttaaatcgtccaggaagctcctatggaaacagaaacagagatgcaggatactttttctccactgccagtgaatatccaatttttgagaaattttcttcatatgatacaggatatacatcacagggttcattggggcatgaaggccttacttctttctcttccctggcttttgataatagtgggatggacaactacatatctgttacaacttcagacaaaatcgttaatggcagaaatattaatacaaagaaaattattgaaagtgatcaagaaagagaagctgaagataatggagagttgacattttttcttgtaaatagtgtggccaatgaagagggctttgcaaaagaatgcagctggagaacacagtcattcaacaactattcaccaaattctcacagctccaaacatgtatctcaatatactttcgtggacaatgatgagggaggtatatcttgggttaccagcaacagagatccccctattttctcagcaggagtcaaagagggtggtaagaggaaaaaaaagaagcgtaaagaggtgcaaaagaagtctaccaaaaggaattgttaaattgactcttcaaatatataacatttgaacacaattgtgtgtgttttggttaatcacaaattttgtagataacacttaatactatactaagagcttttcaacacttttagcaggattgtggacatttggttagtagtttttttgaatgggtatgtcagaaaaggatgagtttgtggtgacagttggtgctaataagaatttgcctgggcagtatagtgagatcttttctctacaaaaaatttaaaaattagccaagtgtggtggtgtgcacctgtagtcccagctactcgggaagctggtagaaagactgcttgagcctggaagacataggttgcagtgtaatgggatcacgccactgcactccagcttgggtgacaaagtaagaccctgtcttaaaaaaaaaaaaaaggaatttggaaaactgcaatgagttttttacttttgaatttttctttagtagagtttatagcctatttttcttttttctaattaaaaccactatacaaacttacgaaacatgcatagcattagaagacaagaatgtatcaagacacacaggttcagactacacaattattcatgaaatggctgttttccaatggaggaacagcatttgatgcattataacttaaaggtactacaaattaaaaattaaagtataaagtattttaagttagaaatagacttagctgggtgcagtggctcacacctgtaatcctagcatcttgggaggcccaggcaggagggttgaagtcagaatttcacgacagtccgggtaacataatgagacctgtcctctatgaaaaaacttttttaaaaatttagctgggtgtggtggtacgtgcctgtaggcctagctacttaggaggctgaggtgggaggattgcttgagcccaggagtttgaggttgtagggagctatgatcttgccattgcactccagctgagagtgtgaccctgtctctaaagaaaaactatagaaaatttaaaaaattaaaaaacgggtaacatggtaaattttatgtagtatattttaccacattttttttaaaggccagtcttatcctgaattcctcagagcagtctgtatggtaggccatcagtgaatcactccagacaggaaattttctatttttgtttagagtttgtacacaaaatctacaaatacattactctaaaatagcacctatagccattttaatttagtcatgttgggagaaaaatagatgggttacaaatacatcagatatcgagcaaatggtttgagttacatctagcagcactaaaacttattcaactttggccaaatacaaatgcgaaattagaaaaaaattataatatctgctatttttaaaagacagctatagtcaagagcttgtgttttgtatcggtatttgatttttagtgggcagatgggagaaggaaaggttatttattctatagaagagactgcggacaattagtattcaaagtttattttcagaaaataaaataataaaagcccagggtattttaaa

SEQ ID NO: 61686 - DNA, 2479 bp, Homo sapiens
acaccgcctttgccatcaccaccgtcattgccccctctactaccaccaccatcaccaccaccgggtctgcctcagccagacccaccactgcctctaattagactgccaccatcatcactgccaccaccactgcccctccaatgccttcctgatgtcaccatctgctttctctctgctatcctcacacccaactccatcacaaccaccaccttcatctgagccgccatcaccctcacagtacacagccctcaaatgtgtaccaaggaggaggacatttactacacgctgcaccctgaacagtctgggaccagcggtcagggaacaaggaatcgagatgctcacctgcagctcccaggtgagcggctctctagagcttgcctgggagctgctgaggagctcacggtattccaggaagctccccatccatgcctcagcctgtggctcagaagcagggtcttcgcagaagattgccccgagctgttgcaaagctcaccattgtcacctgcctgcaacggcctctcttttccactctccaaatcccttgtattggcaggctctagtctggaattataccggtgatgggattctggaaaatccctcagatttctccaggatgcaaggagaccatggaagaggaacaagcctgcaagggacagcaggtgctaactgctaaccgagacatagtgacaaaaatccagccacagagataaagaatcaggttcatctgtagctacatccagtggagaagttctgctcttcaactcctctgctaagccacatgtgtcagcaggtgtagaattgagtggaacacttctttggatttgctgtccgctgcagccttggccctggtttcacatcccctccctcactgactcgctgtgtgaccttgagcactgtgtgtctctgagcctggttcatccaagagtttaccgacggccctcgtgtgccagccactgtcctagacagggacagactttcccgcctttgtggagcttaccccggaagacctggccagataatgggcacaaaaaaagcaggctcttgtccccaccccagcctgcctgaaccccaccttggcctcctcttgcctcagctgctgcccagccatcggccgagtggacatacccaggacgcccttgcccgcctcccccaccacggccacagacctttgtcactcaccaaggctggaatcccgtggctgatcctgcctctgccctttggctcccgggactcagcccacaccacctgggtcacagagcatcccattcccacacaccgttgtggccacctcaccagcaggggcaggcccatatgcccaggtttgcctggtgaggagctgggggcgggggtatgccccgccccgggagctgacgtcataaaaggagctctggagggcagcccactctggcctggccccacagcggcagtgtccctcccctccccccactcctctcagtgggggcccctccagtccctgagaattggtactacgaaaaggtgaactcctgggcagaatcttgcctagagcttgcggagtccagccaggcccctgctgaagggccccagaccaccggccacttctcccccgtccatctgaccagctgggcccctgcgcccacctggcctccacgttccctctcctctcacccacacccctggccatggctaactactacgaagtgctgggcgtgcaggccagcgcttccccggaggacatcaagaaagcctaccgcaagctggcccttcgttggcaccccgacaagaaccctgacaataaggaggaggcggagaagaagttcaagctggtgtctgaggcctatgaggttctgtctgactccaagaaacgctccctgtatgaccgtgctggctgtgacagctggcgggctggtggcggggccagcacgccctaccacagccccttcgacaccggctacaccttccgtaaccctgaggacatcttccgggagtttttcggtggcctggaccctttctcctttgagttctgggacagcccattcaatagtgaccgtggtggccggggccatggcctgaggggggccttctcggcaggctttggagaatttccggccttcatggaggccttctcatccttcaacatgctgggctgcagcgggggcagccacaccaccttctcatccacctccttcgggggctccagttctggcagctcggggttcaagtcggtgatgtcgtccaccgagatgatcaatggccacaaggtcaccaccaagcgcatcgtggagaacgggcaggagcgcgtggaggtggaggaagacgggcagctcaagtcggtgactgtgaacggcaaggagcagctcaaatggatggacagcaagtaggcgctggccacccggccctgccttcccaccaccaccaccgtgcatggggcagcaaacacgtggggccgcagacatagcctgatggttaataaatgtgccaagtgagttaaaaaaaaaaa

SEQ ID NO: 61687 - DNA, 3606 bp, Homo sapiens
ccgatatggcggcgactctgggcagcggggagcgctggacggaagcttacattgacgcagttagaagaaacaaatacccagaagacacacctcctgagagtcatgacccctgtggctgctgtaactgcatgaaggcacaaaaggaaaagaagtctgagaatgagtggactcagacccggcagggtgaggggaactccacgtacagtgaggaacagctgcttggggtacaaaggatcaagaaatgcagaaattactatgaaattctgggagtttctcgagatgctagtgacgaagagcttaagaaagcttacagaaaactcgccctgaaatttcaccctgacaagaactgtgctcctggagcaacagatgctttcaaagcaataggaaatgcatttgcagtcctgagcaatcctgataagagacttcgctatgatgaatacggagatgaacaggtgactttcactgcccctcgagccagaccttataattattacagggattttgaagctgacatcactccagaagagctgttcaacgtcttctttggaggacattttcctacaggaaatattcatatgttttcaaatgtgacagatgacacttactattaccgtcgacggcaccgacatgagaggacacagactcagaaggaggaggaagaagagaaacctcagactacatattctgcatttattcagctacttccagttcttgtgattgtgattatatctgtcattactcagctgctggctactaatcccccatatagtctgttctataaatcgaccttgggctacaccatttctagagaaactcagaacctgcaggtgccttactttgtggataaaaactttgacaaggcctacagaggagcttctctgcatgacttggagaaaacaatagagaaggattacattgattatatccagactagttgttggaaggagaaacaacaaaagtcagagctgacaaatttggcaggattatacagagatgaacgattgaaacagaaagcagagtcgctgaaacttgaaaactgtgagaaactttccaaactcattggcctacgcagaggtggctgagaggataatggtcctacgcagggctggggttttgctacttgttcctatttatgttcctgattccattttataatacaaaactaggtaatgatgaacactttactatttgctaacttcgttggttgggcagagtggcaggagcatgggcacgagagccagatgtgtcttcacaggatccttcctggggagtggctccagggaccaggagtagttcatctaagttaaattaatggcaaggcattggattccgtctccctgctccatgcctaccctgcctatgtgaatggagttcagggcatcccagagcagatccatgctttcttccttcttcccttcttcagtgaagtcttaagaaccaggcattcctaggcttagccaaagcttaatattagttatttacactgtctaccaagaattatacctctcccttcattagagtcatcatctccgccaagatttagcctttggaacatgttcctgcccagctttccattttctaggggaatatggagaaatttaaactattgtagtcaatagttttctattattccaatctctgctcagttagtagcattagcaaactgcctaatttgagattcctttatttccttaaccctctctcctttagagagtccagaaattaaaactactgagcagcatctggaggcgggggccagggcgaaggtataatgcaagaccgagcctcatctcctccacgaagcctccctactccatcatagaacccagagaatgtcccttcggtcatttcccctcagtatcatcattggtgtcatcgcacttaggctgagttcctacatcccacagaggcagatggtcagacccaggaggaggcattgccagctctccaggctgtttgctcaagcctagagatagaggagacagatcctctctccttggatatgggggtctagctttggccccagcagccactttgtttaacccagtatcctatagtttgtgatttgagatgatttttcattcattcaacatttattgagtgcctactataaaagcaggggctctcacacatattttcttacttaaacctcctcacaactctgaagtagatgtattatccctggttctatgaatgagaacattggcccagagaggatgacccaggtcttgtagtggcagagcaagacggtaggctgagtgtcaagtagaaagtgggagagcatcctcatgtctcaggtgattctagccagactggcaaagcagaacctttcccgaggatgcctccgtcctccccaaccccatgacccctcatcttttctgtggcaatcttgcatctgttcaggacaacatccctgctgctctttaggaagcaggaccctgtctaacataaattctgtacacaaaataagaggtccctcacaggcaggcagccctccactggtgactaggaagaattcagtcactgcctgggctgtgtggttctgggccttcctgtggagctgagctgcctgaattatcatgactctgaacttggaaggatcattaagtgactgtagcctacactccatgcttccttcatattggaagaaaagtttctggtagagagtcggccgggtgcactggctcaagcctgtaatcccagcactttgggaggctgtggcaggtggatcacctgaggtcaggagttcaagaccagcctggccaacacagtgaaaccccatctctactaataatacaaaaattagccaggtgtggtggcacatgcctgtagtcccagctactcgggaggctgaggcatgagaatcgctgcaacttgcaaggtggaggttacagtgagctgaaatcacgccactgcactccactccatctcaaaaaaaaaaagagtctacattaaacagattccaaagtaaagtttcttcatcccaatgcatggccatgatttacacagacgtgcctagcatggctcatcaacatctgaacggttgttccctaccatgcctctgcaggcattccacagagtcaggagatgggttcacaggtaaagattgggggctttagtggcttgtaggggacaactgctcagttgcagggagagggagcatttctagaaatagccagattttgctgcccaactagatctgtcctcctggttttagggggcccttcttgatcccctctgagtgactgagggaggttacattgtaaaatatgtccatgagccaaacaggcttatggaaagttcttctacacacaaaaaaatcaaagctctcctctccccatccccaaccactgctagaaaattggccataatgaaactgacttgacaggttaaaagaccctgtcctagatgcccaggaatcaggtagtcacacattttatggacttcatggcagcgatgagtaatctgtgatgatactaaatagaagcaataataactaactccattaaatgtcacgctgattgtctgtttttatagcaaaaaaaaaaaaaaaaaaaaaaaaaaaaaaaaaaaaaaaaaaaaaaaaaaaaaaaaaaaaaaaaaaaa

SEQ ID NO: 61688 - DNA, 1012 bp, Homo sapiens
ggcagttactgatatagccaaggtgggacactactggagggagctagaagggatcagccagccatgcctccagttcaggtacttggcattgctaagctcagaacaggacttgccagtgtctagatgaaaaagaggagagatctcaagagggataaccaattggctggcaaagtaacaaatgaaaagtaacctgactctattgacctgcttaaccctgcatgggggggaaggatggaaaggagcagctgtttgctttgaaacggtggaacagttttgcagccttagaaaatggcatgtaacatacctaaccaaagacagcggactctgtcaacaacaggagaagctctatacgaaattcttggtctgcataagggagcatcaaatgaagaaattaagaaaacctacagaaaattggccctgaaacaccatccagacaagaatccagatgatccagctgctactgagaagtttaaagaaatcaacaacgcccacgcaatacttaccgacatttcaaagagaagcatatacgacaagtacggatcgctgggactctacgtggccgagcagtttggagacgaaaacgttaacacctacttcatgctgtcgagctggtgggcaaaggccctgtttgtcatcgttggcctcttgacgggctgctacttttgctgctgcctgtgctgctgctgcaactgctgctgtggacactgccggcccgagtcatcagtgccagaagaggacttctatgtgtccccagaggatctggaggagcagatcaagtctgacatggaaaaagatgtggactttccagtttttctccagcctacaaatgcaaatgagaaaacacagctaatcaaagaaggatctcgaagttattgcacagactcttgatattgagccctcagagagtccacagtccctcctctcagttcagtcttgtctccagatggtcgtaggggagcgtgtggggcataaagtgctgtgaacttttaaaaaaaagaaaaaaaaaaaaaaa

SEQ ID NO: 61689 - DNA, 2006 bp, Homo sapiens
aaaaaacgacctgcccagaccctcagcgtcgacgctgcgcacaagcgcagtcaactgctggacccggccggtgtgaagtttcacacccaaaaggatgaagggcacccacctggcttaagagaacgactcccagaaaattagccgggcgtggtggcgtgcacctgtaatctcagctactcgggaggctgaggcaggaaaatcgcttgcacccaggaggtggaggttgcagtgagccgagatcgcgccattacacttcagcctgggcaacaagagcaaaaaactccgtcaaaaaaaaaaaaaagaagaagaagttgtggagctgtctgattcctgatcctgtccgttcaggctggggccgccctggtctttcaaacccagcagtgagcttggacagacccagaggtgtttactccagatcatgtctactgtgaaggaagcagcacaccggctgtccaaaagtgagatgagcctctatgcagtgctggatcttaagaagggcgcctcacctgaagacttcaaaaaatcctacagccattccgcattgcttccccaccctccttttgagtatcacctgggtaggaaactggccttgcggtatcatcccgacaagaatccagggaatgctcaagcagcagaaatattcaaagagatcaacgcagctcatgccatactgagcgactctaagaagcggaaaatttacgaccagcatggctcattgggaatatatctgtatgatcactttggtgaagaaggcgtcagatactattttattctgaatagttgttggttcaagacacttgtcatcctgtgtactctgctcacttgttgctgtttttgttgttgctgctgtttttgctgtggagcacttaaaccaccacctgagcaggatagtgggagaaaatatcagcagaatgtccagagtcagcctccaaggtcaggagccaaatgtgattttagaagcgaggaaaatagcgaagatgatttttaagagatgaagaaggatgaggtgctgacccagtgagggtgccttctgctgcccagtcccctggacacattgaagagaggagcaagtagccctgtcctgacattgaccctgatttgacccctcttcttataaggatctcaagaatctcttcagaagcactgatgacgttgatcccagtaaggacatcacctctacccttggtaccacaactctgtatggggttgcccagctactcttcctttcagttgcagtcccaattttactccgtcagaaagcagccctcccctccctccccttatgaggtctcaggcagtggtggcagatttttcctgaagagtctttttcctgtgtctgccttgttattggaaccaatgccagctggtaggatccctgagccccttgcgatatcaccaccaagagcctgataactgagcagggtggatcctgtccctggagctgctgcacccattaattctcccttgttgcaactctgtgtaccaagaacccctagcatcagcctcattcctaagccaataacgcctgtatggagttggtttcatcttctggtgcccacggccattggcattgccagcctcattccatgccactatgagtcaactcaggaaaactgcgagtgcatttgaggcttaggggtagtcattccatctttagattatccttggacttcagctaccagcacagcgtgcattagccttggtcctgtaggttaactgaagttcaaacatcagtgccagcttgcctccatccttttcacatattatgcaggccaattgacatataatttgttcttaaaaataggggcatgaaatatgtgatctggaaaagattgtactttctggactcttttcccactcttgcctctttgtgctgctgtttcgtatcctcctcacaccgtgtatttcccacccactcagggtcacagcctactaattcctcaaacttctctccctggactaggagaaaggctaaagaatgtcagtaaataaaagagctttcatcc

SEQ ID NO: 61690 - DNA, 1670 bp, Homo sapiens
gggtcgtcatgatccggaccccattgtcggcctctgcccatcgcctgctcctcccaggctcccgcggccgacccccgcgcaacatgcagcccacgggccgcgagggttcccgcgcgctcagccggcggtatctgcggcgtctgctgctcctgctactgctgctgctgctgcggcagcccgtaacccgcgcggagaccacgccgggcgcccccagagccctctccacgctgggctcccccagcctcttcaccacgccgggtgtccccagcgccctcactaccccaggcctcactacgccaggcacccccaaaaccctggaccttcggggtcgcgcgcaggccctgatgcggagtttcccactcgtggacggccacaatgacctgccccaggtcctgagacagcgttacaagaatgtgcttcaggatgttaacctgcgaaatttcagccatggtcagaccagcctggacaggcttagagacggcctcgtgggtgcccagttctggtcagcctccgtctcatgccagtcccaggaccagactgccgtgcgcctcgccctggagcagattgacctcattcaccgcatgtgtgcctcctactctgaactcgagcttgtgacctcagctgaaggtctgaacagctctcaaaagctggcctgcctcattggcgtggagggtggtcactcactggacagcagcctctctgtgctgcgcagtttctatgtgctgggggtgcgctacctgacacttaccttcacctgcagtacaccatgggcagagagttccaccaagttcagacaccacatgtacaccaacgtcagcggattgacaagctttggtgagaaagtagtagaggagttgaaccgcctgggcatgatgatagatttgtcctatgcatcggacaccttgataagaagggtcctggaagtgtctcaggctcctgtgatcttctcccactcagctgccagagctgtgtgtgacaatttgttgaatgttcccgatgatatcctgcagcttctgaagaagaacggtggcatcgtgatggtgacactgtccatgggggtgctgcagtgcaacctgcttgctaacgtgtccactgtggcagatcactttgaccacatcagggcagtcattggatctgagttcatcgggattggtggaaattatgacgggactggccggttccctcaggggctggaggatgtgtccacatacccagtcctgatagaggagttgctgagtcgtagctggagcgaggaagagcttcaaggtgtccttcgtggaaacctgctgcgggtcttcagacaagtggaaaaggtgagagaggagagcagggcgcagagccccgtggaggctgagtttccatatgggcaactgagcacatcctgccactcccacctcgtgcctcagaatggacaccaggctactcatctggaggtgaccaagcagccaaccaatcgggtcccctggaggtcctcaaatgcctccccataccttgttccaggccttgtggctgctgccaccatcccaaccttcacccagtggctctgctgacacagtcggtccccgcagaggtcactgtggcaaagcctcacaaagccccctctcctagttcattcacaagcatatgctgagaataaacatgttacacatggaaaaaaaaaaaaaaaaaaa

SEQ ID NO: 61691 - DNA, 1212 bp, Homo sapiens
cctcggctctctccggggctgtttctccatcctgtcccgcctctgcctgtcattgcctttctgcctccccagccccagaatttccatccctgcaccctgcaagtctacctctctcctctcctctcctcctaagacctgccttcctcctctcccctctcatacccaagctggcctcccttggttccctcggtacttcctggactctacctcggaaacttcattgatgccaaagacctggatcagctgggccgaaataagatcacacacatcatctctatccatgagtcaccccagcctctgctgcaggatatcacctaccttcgcatcccggtcgctgatacccctgaggtacccatcaaaaagcacttcaaagaatgtatcaacttcatccactgctgccgccttaatggggggaactgccttgtgcactgctttgcaggcatctctcgcagcaccacgattgtgacagcgtatgtgatgactgtgacggggctaggctggcgggacgtgcttgaagccatcaaggccaccaggcccatcgccaaccccaacccaggctttaggcagcagcttgaagagtttggctgggccagttcccagaagcttcgccggcagctggaggagcgcttcggcgagagccccttccgcgacgaggaggagttgcgcgcgctgctgccgctgtgcaagcgctgccggcagggctccgcgacctcggcctcctccgccgggccgcactcagcagcctccgagggaaccgtgcagcgcctggtgccgcgcacgccccgggaagcccaccggccgctgccgctgctggcgcgcgtcaagcagactttctcttgcctcccccggtgtctgtcccgcaagggcggcaagtgaggatgcagtccagccgtggctccccacttccgactggctcccttcgggggctgtctgcgccttccacgccccccaggacgggcccagaggctgggggagccccgcggcggcctgaaccctgcctcccgcgcccgccctgctcgtccgcgtctgcagtcagcgtccccaacctgtgcgtctctgtgtccgggccggcctgctgcagccacctggtgccttagtccttgggctgggggagggggcccacccttaaaggcggcgggaggggagggagggagagtggagggtttgacgggcctggagggtattaaagagacacagaagaagctgcctgtc

SEQ ID NO: 61692 - DNA, 1383 bp, Homo sapiens
caacaaactgccgttgtcccgcgggccgtgggcccggcacactggggctttgtccggccccccgccgcgacccgaggcgggggccccacatgaccgaaggggtaggaggagcctgcggcggcggcggtggcagcggcggctccaccaccatttccctcccgggccgggggtcggcgggcggtggcggtggctgggcagggctgggcagggccgcggacgccaggccccccgttccccgccaggctgcaggcgtcgggcctgggccgtcagggcagctgtgaccggatcgcttcccgggcggcgagctgggggtgcacccggaccgccgcccccgggatcatgggcaatggcatgaccaaggtacttcctggactctacctcggaaacttcattgatgccaaagacctggatcagctgggccgaaataagatcacacacatcatctctatccatgagtcaccccagcctctgctgcaggatatcacctaccttcgcatcccggtcgctgatacccctgaggtacccatcaaaaagcacttcaaagaatgtatcaacttcatccactgctgccgccttaatggggggaactgccttgtgcactgctttgcaggcatctctcgcagcaccacgattgtgacagcgtatgtgatgactgtgacggggctaggctggcgggacgtgcttgaagccatcaaggccaccaggcccatcgccaaccccaacccaggctttaggcagcagcttgaagagtttggctgggccagttcccagaagcttcgccggcagctggaggagcgcttcggcgagagccccttccgcgacgaggaggagttgcgcgcgctgctgccgctgtgcaagcgctgccggcagggctccgcgacctcggcctcctccgccgggccgcactcagcagcctccgagggaaccgtgcagcgcctggtgccgcgcacgccccgggaagcccaccggccgctgccgctgctggcgcgcgtcaagcagactttctcttgcctcccccggtgtctgtcccgcaagggcggcaagtgaggatgcagtccagccgtggctccccacttccgactggctcccttcgggggctgtctgcgccttccacgccccccaggacgggcccagaggctgggggagccccgcggcggcctgaaccctgcctcccgcgcccgccctgctcgtccgcgtctgcagtcagcgtccccaacctgtgcgtctctgtgtccgggccggcctgctgcagccacctggtgccttagtccttgggctgggggagggggcccacccttaaaggcggcgggaggggagggagggagagtggagggtttgacgggcctggagggtattaaagagacacagaagaagctgcctgtc

SEQ ID NO: 61693 - DNA, 1184 bp, Homo sapiens
cgtgcggcggcatctccgtgtccctgtgactcgagaccgcggctgtcgggtctccccctctctgaccctgcgtctctgtccccgctgtgtccgccctctctccgtgactctgtgtgtctctcgctgtcttgctgtggctgtcactcccaggctgtctcccagtacttcctggactctacctcggaaacttcattgatgccaaagacctggatcagctgggccgaaataagatcacacacatcatctctatccatgagtcaccccagcctctgctgcaggatatcacctaccttcgcatcccggtcgctgatacccctgaggtacccatcaaaaagcacttcaaagaatgtatcaacttcatccactgctgccgccttaatggggggaactgccttgtgcactgctttgcaggcatctctcgcagcaccacgattgtgacagcgtatgtgatgactgtgacggggctaggctggcgggacgtgcttgaagccatcaaggccaccaggcccatcgccaaccccaacccaggctttaggcagcagcttgaagagtttggctgggccagttcccagaagcttcgccggcagctggaggagcgcttcggcgagagccccttccgcgacgaggaggagttgcgcgcgctgctgccgctgtgcaagcgctgccggcagggctccgcgacctcggcctcctccgccgggccgcactcagcagcctccgagggaaccgtgcagcgcctggtgccgcgcacgccccgggaagcccaccggccgctgccgctgctggcgcgcgtcaagcagactttctcttgcctcccccggtgtctgtcccgcaagggcggcaagtgaggatgcagtccagccgtggctccccacttccgactggctcccttcgggggctgtctgcgccttccacgccccccaggacgggcccagaggctgggggagccccgcggcggcctgaaccctgcctcccgcgcccgccctgctcgtccgcgtctgcagtcagcgtccccaacctgtgcgtctctgtgtccgggccggcctgctgcagccacctggtgccttagtccttgggctgggggagggggcccacccttaaaggcggcgggaggggagggagggagagtggagggtttgacgggcctggagggtattaaagagacacagaagaagctgcctgtc

SEQ ID NO: 61694 - DNA, 735 bp, Homo sapiens
gctgtgaggcgccagtgcggagcgggcgggcgggcgggcgggcgggcggcgcgaggcggagcgcgggcggccggcgaaactccaagggcggaccgcggcagggagcgatcggcctcgggctgcgggagccggagaccgcggcggcggcggctgctgcagctgcaggaggagcccagggaacaccgcccctgcctgtgctctgcctcgggccatcgctcctccccagggcccagtgcggactcgcctccgtgaagtgtcacaccatgtctgaccggaaggcagtgatcaagaacgcagacatgtctgaggacatgcaacaggatgccgttgactgcgccacgcaggccatggagaagtacaatatagagaaggacattgctgcctatatcaagaaggaatttgacaagaaatataaccctacctggcattgtatcgtgggccgaaattttggcagctacgtcacacacgagacaaagcacttcatctatttttacttgggtcaagttgcaatcctcctcttcaagtcaggctaggtggccatggtgaaggtgtcagtggcggcggcagcgatggcaagcaggcggcgttgctgggactgttttgcactggagccagcatcaggatgtcctctccaatggctgtgctactgcatggactgtatactcgatttcatgtgtatgtcgcagtaaacaaaaccaaacctcaaaaaaaaaaaaaaaaaaaaaaaaaaaaaaa

SEQ ID NO: 61695 - DNA, 4705 bp, Homo sapiens
catcagttcctaaattcacctgcagggctagggccaggcgcactcaccccacagccagccccactgggcctcggaggcagaatacgggaagaaccgcgaaacaaccctaaaccaattctgaggaccacgaattcggattatccgggagttcttttgccatggcaccgcccccgccacttccgctaggaacccggaagttcctacccgacgccggaagtcccacggccttgcctcctcagattcctctctcacccccacgcagaggagagaacttgcttctggacccgggtgggtgccggctcggctctccttgtcttccagagcggtggcccggaagcacagtcctcccagacgccagcgccagaagctcggatcgcggctgcaccgggagagcgccgatctgggtgcgaggcaggtgcggggccatgaatgggaccgcaaacccgctgctggaccgcgaggaacattgcctgaggctcggggagagcttcgagaagcggccgcgggcctccttccacactattcgttatgattttaaaccagcatctatagacacttcctgtgaaggagagcttcaagttggcaaaggagatgaagtcacaattacactgccacatatccctggatccacaccacccatgactgtgttcaaggggaacaaacggccttaccagaaagactgtgtgcttattattaatcatgacactggtgaatatgtgctggaaaaactcagtagcagcattcaggtgaagaaaacaagagctgagggcagcagtaaaatccaggcccgaatggaacagcagcccactcgtcctccacagacgtcacagccaccaccacctccaccacctatgccattcagagctccaacgaagcctccagttggacccaaaacttctcccttgaaagataacccctcacctgaacctcagttggatgacatcaaaagagagctgagggctgaagttgacattattgaacaaatgagcagcagcagtgggagcagctcttcagactctgagagctcttcgggaagtgatgacgatagctccagcagtggaggcgaggacaatggcccagcctctcctccgcagccttcacaccagcagccctacaacagtaggcctgccgttgccaatggaaccagccggccacaaggaagcaaccagctcatgaacaccctcagaaatgacttgcagttgagtgagtctggcagtgacagtgatgactagtgctggatctttcgaaacctactttttggtgcacaaacatgccgcaagactgagctactttggcgtggagtccattgcaagaggaaaatgttatggatcagtgactgtagtaggagtttgaggctctggaactctcacatattcaagtctttaacttagtggtgatgggtgattttctcgtgtcatttttgaacaatctcatctttcaaagtttaagtagacctgtagaagagctaacagaattatatttctatttagttaaaattgttaatgaaaaacagataaatgtgccctggtctaagttactcaaaggccatatcttcaccaggccagagattcagttttaaacctcagcagccatcagtttggccaagtggttggtaccagtggaatgaagtctttgatgggtaggagagagagggaaaacctcaaactacatcatagaagtatgttaaaaccactttaaattgttgacacaaagtggtaaggaagttttgtctgactcagcctgacaagcctggatagaaatggacctcagaatacagaatggagtccttgagtgtcagttggtgaggaccatggagtcctgccagctcaacctgtcatttacagactaagaaagggaagtacacacctggcttgtggccagtctcctgccccctctctgggctttcctcactgttctctcccttgaatctcatttgtaggaatcaagagattcctatacatgggacttttagatgtacattggcacttggattagattccaaaagacaaaagtgttgggtgcttctagcttgaattcagtccctaaatacatgaggctgggtgagcagatgaaaccggtagccactgtgctgatgcatgtgactccattcagttggggattttggttccatgtggatccatactaagtattcttcagtcagtggattttagcaaggggaggtaggagtggaagagaggtgtgaagaaacctctccgaacaaatgaaccagcagtaagtttctaaaaatcagaatctagatagaagttctgcaatatgaaatgagcacattctttgataaggcgtatctattcatgcttttgtaccactgttttgtacctgactccctgaccgatttgtattttttatatacaactagaaggaagtcacaagattgccttctacagtgtgccatttccaaatggatctgttgttggaggaaactggttgctagtcaatgttctatatttaatgaatgtgtgataaatcatcctgtaatcagtatggagtaacctgtttttgtagtttggatgaatatgtcctgagaaatttccatccactttggttcagcggacatcaaggtagtaataataatttttcctccacaggtccctccactcatatggcctctccctccccagctagtggaggggaagcagtctggacttagaaaggaaataggtggtctgtcataggggctttcattagagttaaacttcatagagtcaactgtttcatcatcatagtgagcccagagagccactgcccagcagcatgctcacaccacctaccctagtgtaggtaataggtctacgctaggaccccgtgctgggctctcagcccatcatgagattttggtggatttaatggcaggtaggaacttatttatagtggattgataattgctttataattccttggtaatgacagctcagggaaggtttcacaaggtcatgatcaggagacttgaattgttactggatgtaggaattgtttcactgctcttaacttgctcaaactggggcaggttccaggaacttgaactaaaaatatctatttaagcctctctctctttctctcctccccaacttttttctgaaagccttgatttctgtagacagaactatggtttttggcatgttgggtcaagacgtgtttctataggaaatgcttgcacgtggcactggcttggtgagtcaagcttcctgagcttcagaccgtttgtcctgtcatctgtcctgcccaacactgtatggtttttctctagcacggcttcaattttgttctctgcacaaagcctttggtggttctgccctctgccctccagctttacccaccagagtaagcaatcttttctttttagaaatcaagaatttggcttcacagatggcttctcacagatgccctcctgccagccaaaccggacttgttcttcctgcctctgtgccttctctcattctccttctctccctccataccccacttttgaggttctgtgggtaccatctttgtggactcttgtcttttttttcaacccacatggagtgccctgtgtgtacatactgaccttttttttttttttttttttttgcttgaactctggtcggtatgagctccttaaaagcaggtactgggctggctgtggtgactcatgcctgtaatcccagcactttgggaggctgaggtgggaggattgcttgagtccaggagtttgagaccagcctgggcaacatggcgagaccctgtttctacaaaaagaaaaagggaaaaaaaaagcagggactgtcattctcatctcctccctggggtatccacaggaatggacattcaaatggttgtagcctggtggggtagaaggcagagaagactacccagccagtgaagtgcagaggatagacataggaaaacattccaggcatttggagacagctgaaagtatccatgctgactttcatgatttagaagtctttaactgaattattaaaattgccttttttttgtgctgtacaatgtctactgtactgtgggtcatttagatgagatgaaaaacttaattaaatctgaagtgtcagaggcgcttagtaagccttagtaaagttgtgattgaagaaacttaatacaaatgaactagaggtttgtaatcatgccactcactaacgattttatttctgtagcagaatcattttttctatgtaaggtgttaatgtgtgtgtatgtgctttggttgtaggaaaacttgaaaattccaaaatccttattttcctatttgagaggctggttcagcagggtgtgtgtgtgtgtgtgtgtgtgtgtgtatgaatggtatatttattacattattttgaaagagaattagtgtgttatgtggataatgttatatacagccaaagtggatgtttctatttggcaaggaaggtaggatttctgaaactcaggccttaaccaataggttggaagacaagaccaattgaagagttaggaaatgtgagtttttgttacttctgttattccagtcttggtttcattgtctcattctttatttttaaaatcttgtgcctaaaagtttttttgcttaattatgaagtagacatgcatgtttacatttatgtaaaatatttgctgtgtaaagtattttttgtttattctcttaaaagatcactatatttaaataaaagtgaaggtcagcaacacaaaaaaaaaaaaaaaa

SEQ ID NO: 61696 - DNA, 1154 bp, Homo sapiens
gacgccaaggcccctccggccagggccgggagccgggccggcctagccagttctgaaagccccatggccccagcaggcctctgagccccaccatgggcagcttgtactcggagtacctgaaccccaacaaggtccaggaacactataattataccaaggagacgctggaaacgcaggagacgacctcccgccaggtggcctcggccttcatcgtcatcctctgttgcgccattgtggtggaaaaccttctggtgctcattgcggtggcccgaaacagcaagttccactcggcaatgtacctgtttctgggcaacctggccgcctccgatctactggcaggcgtggccttcgtagccaataccttgctctctggctctgtcacgctgaggctgacgcctgtgcagtggtttgcccgggagggctctgccttcatcacgctctcggcctctgtcttcagcctcctggccatcgccattgagcgccacgtggccattgccaaggtcaagctgtatggcagcgacaagagctgccgcatgcttctgctcatcggggcctcgtggctcatctcgctggtcctcggtggcctgcccatccttggctggaactgcctgggccacctcgaggcctgctccactgtcctgcctctctacgccaagcattatgtgctgtgcgtggtgaccatcttctccatcatcctgttggccatcgtggccctgtacgtgcgcatctactgcgtggtccgctcaagccacgctgacatggccgccccgcagacgctagccctgctcaagacggtcaccatcgtgctaggcgtctttatcgtctgctggctgcccgccttcagcatcctccttctggactatgcctgtcccgtccactcctgcccgatcctctacaaagcccactactttttcgccgtctccaccctgaattccctgctcaaccccgtcatctacacgtggcgcagccgggacctgcggcgggaggtgcttcggccgctgcagtgctggcggccgggggtgggggtgcaaggacggaggcgggtcgggaccccgggccaccacctcctgccactccgcagctccagctccctggagaggggcatgcacatgcccacgtcacccacgtttctggagggcaacacggtggtctga

SEQ ID NO: 61697 - DNA, 2493 bp, Homo sapiens
cggggcccggagtggcttccctggctggcatctggacttaggctatttccgtgcacgtaaaagcggaatattggaacggttgcacagaacttccaaataatttttaccgccacgcaagatttagccctgaggtcttaatctcaggatttgggacagtaaaagctgtcgtccctccccctcgtccagccggtggcaagcgggtactgcgggcggttccgtccgtcccctttcgcagaaatggcaacgaatgaccaccagcattagctgagccaggggacgtgggagggttgattgcctaaacgactctgcatcgccgcctctttttgaaactaagagaaaatggtgggagatcaaaagaaaactaaataaacacacaggcaacttgtcctgggacctcaactaagcaaatgaagccttattgtgtgtgctgagcctgcagttcccaaccttccggggaagatgggaggacagggcgacaaagggcacagtaggcttgcctggcagtaagtgtgaccgcagctatccaggcggaagagcagaggactgaaaccaccctccagcaagcgagtgtccgccgcgttgagaaccgcgcaccctacccatcggccacgtgaccagtcctttttaaaaaaaatttctttaccttaaaaaaaaaaaaaaaaaaaaaaggtgggggagagactccacttcccagaagcctctcgttactcacgcagccgcagtcttgcgcaggtgccgccagggccaaacggacatatccgtcacgtggccagaagctggccaatccggtttgaatctcatttttttcctcttacccccccttctggagcggttgtgcgatcagatcgatctaagatggcgactgtcgaaccggaaaccacccctactcctaatcccccgactacagaagaggagaaaacggaatctaatcaggaggttgctaacccagaacactatattaaacatcccctacagaacagatgggcactctggttttttaaaaatgataaaagcaaaacttggcaagcaaacctgcggctgatctccaagtttgatactgttgaagacttttgggctctgtacaaccatatccagttgtctagtaatttaatgcctggctgtgactactcactttttaaggatggtattgagcctatgtgggaagatgagaaaaacaaacggggaggacgatggctaattacattgaacaaacagcagagacgaagtgacctcgatcgcttttggctagagacacttctgtgccttattggagaatcttttgatgactacagtgatgatgtatgtggcgctgttgttaatgttagagctaaaggtgataagatagcaatatggactactgaatgtgaaaacagagaagctgttacacatatagggagggtatacaaggaaaggttaggacttcctccaaagatagtgattggttatcagtcccacgcagacacagctactaagagcggctccaccactaaaaataggtttgttgtttaagaagacaccttctgagtattctcataggagactgcgtcaagcaatcgagatttgggagctgaaccaaagcctcttcaaaaagcagagtggactgcatttaaatttgatttccatcttaatgttactcagatataagagaagtctcattcgcctttgtcttgtacttctgtgttcatttttttttttttttttggctagagtttccactatcccaatcaaagaattacagtacacatccccagaatccataaatgtgttcctggcccactctgtaatagttcagtagaattaccattaattacatacagattttacctatccacaatagtcagaaaacaacttggcatttctatactttacaggaaaaaaaattctgttgttccattttatgcagaagcatattttgctggtttgaaagattatgatgcatacagttttctagcaattttctttgtttctttttacagcattgtctttgctgtactcttgctgatggctgctagattttaatttatttgtttccctacttgataatattagtgattctgatttcagtttttcatttgttttgcttttgtttttttcctcatgtaacattggtgaaggatccaggaatatgacacaaaggtggaataaacattaattttgtgcattctttggtaattttttttgttttttgtaactacaaagctttgctacaaatttatgcatttcattcaaatcagtgatctatgtttgtgtgatttcctaaacataattgtggattataaaaaatgtaacatcataattacattcctaactagaattagtatgtctgtttttgtatctttatgctgtattttaacactttgtattacttaggttattttgctttggttaaaaatggctcaagtagaaaagcagtcccattcatattaagacagtgtacaaaactgtaaataaaatgtgtacagtgaattgtcttttaaaaaaaaaaaaaaaaaa

SEQ ID NO: 61698 - DNA, 5880 bp, Homo sapiens
caatcccacagagtattgatgaggaaactgaagtttggagcgatcacatcattttcccaaggtaacacaagtggcaagacagccgggaacccctaccccatccccttattcagcacatgaaataaacaaggggcatccaaatcttgcggcaacgcccccgggacatgcatcgtcccctggactctctcaaaccccttatccctctggacagaatgcaggtccaaccacgctggtataccctcaaacccctcagacaatgaattcacaacctcaaacccgttctccgtttttccagaggcctcaaatacagcctcctagagctaccatcccgaacagcagtccttccattcgtcctggtgcacagacacccactgcagtgtaccaggctaatcagcacatcatgatggttaaccatctgcccatgccgtacccagtgccccaggggcctcagtactgtataccacagtaccgtcatagtggccctccttatgttgggcccccccaacaatatccagttcaaccaccggggccaggtcctttttatcctggaccaggacctggggacttccccaatgcttatggaacgcctttttacccaagtcagccggtgtatcagtcagcacctatcatagtgcctacgcagcaacagccgcctccagccaagagagagaaaaaaactataagaattcgggatccaaaccagggaggtaaagacataacagaggagattatgtctggaggtggcagcagaaatcctactccacccataggaagacccacgtccacacctactcctcctcagcagctgcccagccaggtccccgagcacagccctgtggtttatgggactgtggagagcgctcatcttgctgccagcacccctgtcactgcagctagcgaccagaagcaagaggagaagccaaaaccagatccagtgttaaagtctccttccccagtccttaggctagtcctcagtggagagaagaaagaacaagaaggccagacatctgaaactactgcaatagtatccatagcagagcttcctctgcctccatcacctaccactgtttcttctgttgctcgaagtacaattgcagcccccacctcttctgctcttagtagccaaccaatattcaccactgctatagatgacagatgtgaactctcatccccaagagaagacacaattcctatacccagcctcacatcttgcacagaaacatcagaccctttaccaacaaatgaaaatgatgatgatatatgcaagaaaccctgtagtgtagcacctaatgatattccactggtttctagtactaacctaattaatgaaataaatggagttagcgaaaaattatcagccacggagagcattgtggaaatagtaaaacaggaagtattgccattgactcttgaattggagattctcgaaaatcccccagaagaaatgaaactggagtgtatcccagctcccatcaccccttccacagttccttcctttcctccaactcctccaactcctccagcttctcctcctcacactccagtcattgttcctgctgctgccactactgttagttctccgagtgctgccatcacagtccagagagtcctagaggaggacgagagcataagaacttgccttagtgaagatgcaaaagagattcagaacaaaatagaggtagaagcagatgggcaaacagaagagattttggattctcaaaacttaaattcaagaaggagccctgtcccagctcaaatagctataactgtaccaaagacatggaagaaaccaaaagatcggacccgaaccactgaagagatgttagaggcagaattggagcttaaagctgaagaggagctttccattgacaaagtacttgaatctgaacaagataaaatgagccaggggtttcatcctgaaagagacccctctgacctaaaaaaagtgaaagctgtggaagaaaatggagaagaagctgagccagtacgtaatggtgctgagagtgtttctgagggtgaaggaatagatgctaattcaggctccacagatagttctggtgatggggttacatttccatttaaaccagaatcctggaagcctactgatactgaaggtaagaagcagtatgacagggagtttctgctggacttccagttcatgcctgcctgtatacaaaaaccagagggcctgcctcctatcagtgatgtggttcttgacaagatcaaccaacccaaattgccaatgcgaactctggatcctcgaattttgcctcgaggaccagactttacaccagcctttgctgattttggaaggcagacacctggtggaagaggcgtacctttgttgaatgttgggtcacgaagatctcaacctggccaaagaagagaacccagaaagatcatcacagtttctgtaaaagaagatgtacacctgaaaaaggcagaaaatgcctggaagccaagccaaaaacgagacagccaagccgatgatcccgaaaacattaaaacccaggagctttttagaaaagttcgaagtatcttaaataaattgacaccacagatgttcaatcaactgatgaagcaagtgtcaggacttactgttgacacagaggagcggctgaaaggagttattgacctggtctttgagaaggctattgatgaacccagtttctctgtggcttacgcaaacatgtgtcgatgtctagtaacgctgaaagtacccatggcagacaagcctggtaacacagtgaatttccggaagctgctactgaaccgttgccagaaggagtttgaaaaagataaagcagatgatgatgtctttgagaagaagcagaaagaacttgaggctgccagtgctccagaggagaggacaaggcttcatgatgaactggaagaagccaaggacaaagcccggcggagatccattggcaacatcaagtttattggagaactctttaaactcaaaatgctgactgaagccatcatgcatgactgtgtggtgaagctgctaaagaaccatgatgaagaatccctggagtgcctgtgtcgcctgctcaccaccattggcaaagacttggactttgaaaaagcaaagccacgtatggaccagtactttaatcagatggagaaaattgtgaaagaaagaaaaacctcatctaggattcggttcatgcttcaagatgttatagacctaaggctgtgcaattgggtatctcgaagagcagatcaagggcctaaaactatcgaacagattcacaaagaggctaaaatagaagaacaagaagagcaaaggaaggtccagcaactcatgaccaaagagaagagaagaccaggtgtccagagagtggacgaaggtgggtggaacactgtacaaggggccaagaacagtcgggtactggacccctcaaaattcctaaaaatcactaagcctacaattgatgaaaaaattcagctggtacctaaagcacagctaggcagctggggaaaaggcagcagtggtggagcaaaggcaagtgagactgatgccttacggtcaagtgcttccagtttaaacagattctctgccctgcaacctccagcaccctcagggtccacgccatccacgcctgtagagtttgattcccgaaggaccttaactagtcgtggaagtatgggcagggagaagaatgacaagccccttccatctgcaacagctcggccaaatactttcatgaggggtggcagcagtaaagacctgctagacaatcagtctcaagaagagcagcggagagagatgctggagaccgtgaagcagctcacaggaggtgtggatgtggagaggaacagcactgaggctgagcgaaataaaacaagggagtcagcaaaaccagaaatttcagcaatgtcagctcatgacaaggctgcattatcagaagaggaactggagaggaagtcgaaatctatcattgatgaatttctacacattaatgattttaaggaagccatgcagtgtgtggaagagctgaatgcccagggcctactacatgtttttgtgagagtgggagtggagtccaccctggaaaggagccagatcaccagggatcacatgggccaactactctatcagctggtacagtcagaaaaactcagcaaacaggactttttcaaaggtttttcagaaactttggaattggcagatgacatggccattgatattccccatatttggttgtaccttgctgaactggtgacccccatgttaaaagaaggtggaatctccatgagagaacttaccatagaatttagcaaacctttacttcctgttggaagagctggggtcttgctatctgaaatattgcacctactatgcaaacaaatgagccataagaaagtgggagccttatggagggaggctgacctcagctggaaggactttttaccagaaggagaagatgtacataattttcttttggagcagaagttggacttcatagagtctgacagtccctgttcctctgaagcactttcaaagaaagaactgtctgccgaagagctgtataagcgactcgagaaactcattattgaggacaaagcgaatgatgaacagatctttgactgggtagaggctaatctagacgaaatccagatgagttcacctacattccttagagctttaatgactgctgtttgtaaagcagctattatagccgactcttctaccttcagagtggacactgctgttatcaagcagagagtgccgatcttactcaagtacctagactcagatacagagaaggaactgcaagcactttatgcactacaagcatcgatagtaaaacttgatcaacctgccaatttgctgcggatgttttttgattgtctatatgacgaggaggtgatctccgaggatgccttctacaaatgggagagcagcaaggaccctgcagagcagaatgggaagggcgtggctctgaaatctgtcacggcattcttcacgtggctgcgggaagcagaagaggagtctgaggataactaaaacttcaaatacacaaaatgaaacaaaagaaacaatttaagtatttttttaaaaagtttcacgtcttcgccaatcacagtgcagcaaggccaattctcgcagaaaccccacgtgtgcacgagtgggagaggggaaagagaaaaaaaggtgtacatggaggaaaaaggtactggataaaagtaaacttcaaaccttagggcgggagcactaaaaccaaaatacatgtattatttatagaaaatattttctgttttaatcttttctttttaaacaaggactcatacttaaaaaaatgtttagcaaaaaaaaaaaaaagttgagaacttttaatttattttaaggactgcaaatgccagtgtaattttttaatttgcagtttctgtaaacaactgtataatagaaaagcagagaaataaatttccctccccttcaagatgcacctcatgtttgttttaaggtatagcatttagtccagatttgagaaagtttggggtgaacaaggtaagaaagatttttttttttttggcatcaaatctttctgcctgcctctcagcttgcttcagaaaatttaaaaaatcacaatagtaatcaaaacatacataacattgaaacagaaggaaatgctgtggaccacagaactccaagaattgtttaaaaaaaaaaaagtgctaccctgagaaaagtactcttaatatctcttgaaatctttagagcaactttaaggcttgtaaatacatagaacaaatatttaaaaaaacaaaaagaaattgactcagtactatttcttttcactttgaaaatataaagaacaaaataaagacaaacattgcaagtttaaaaaaaaaaaaaaaaaaaaaaaaaaaaaa

SEQ ID NO: 61699 - DNA, 2743 bp, Homo sapiens
agtttaagctaatttttttcttatttctaaagcaaaacaaaacccaaactcattgtaatcctctttggaattgcattacatgtatatgttcagttgtgaaggcatgacattttatgatagtaaatcttattctggaacatggtatgttgcttcattttattcgtgtttttttgagacggagttttgcttttattgcccaggctggagtgtagtggcgcaatcttggatcaccacaacctccgtctcccaggttcaagcgattctcccgcctcagcctcctgagtagcaattacagggagcatttcctgaagacgtagtcatgcagcacgtcagcagctcccagagcagccagcgccatgtccagtggcctggggcctgccccggcgcgggcgaggagcagccagcgtgctcccagccgtccctgcccctcacactgccatcccccagccaccaactacagcagctgatgcaggtccagacccagagtcccacgcagcccagtccggggccggggcaggccttgcagaatgtgcgtgcaggtgcccctggccctgggctgggcctctgcagcagcagccctacaggggacttcgtggatgccagcgtgctggtgaggcagatcagcttgagcccctccagtggtggacactttgtgtttcaggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccggcccaagccacatcaccacggctaacttgccaccgcagatcagcagcatcatccagggccagctggttcagcagcagcaggtgctgcaggggccgccgctgccccggcccctgggcttcgagaggacgcccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcatcaccaggagatgcaggctctgaaggaggtcttcaaggagtatttgattgaactgtttttcttgcaacactttcaagggaacatgatggatttcttagctttcaaggagagactgtatggaccattacaagcatatcttaggcagaatgatttggacattgaagaagaggaagaggagcactttgaagtcattaatgatgaggtaaaggttgtggccagaaagcacgggcagcctgggactcctgttgccatagcaacccagctaccgccgtggacttctgcggcttttccagcccagcagcagccgctccagcccctggcacccaccactgtactgtctgtctctgcggattggaatgcacttctccagcgacctaacaaatacatatggggactccagtacctggagatgtgaattccataaaaatggaagcatctaagaggcaatgaacactggcgcccacaggagaaccaggtgcatcagcgcattgcggagctgaggaaagcaggtctgtggtcccagaggcgtctgctgaagctgcaggaggcccacgacccaagtcccactgggactatctgctggaggagatgcagtggatggccacagactttgcccaggagaggtggaaggtggcctctgtgaagaagatggtcagagctgtggcccggcagctgcaggacaggacgcgcagggaggccggggccaggagggaggagccgagcaggctgaggcagacgtcacctgtactaccagagaaatcgagcgtccctggtctagtactgcgcaggtaaagattccagcatcttggaagcaagtgctccactggaaaataaaagccacgtggagcacttgattagactccagaaacagaaactgcagctgctcccaccacccccaccaccacaggccctgcccggggcacagccaaccacacaagtgcaagtgcagccgtcacccgcctaccacagcagagcccccagctcaccacagtcacggccccgagacccagagccctgttgatgggcaccaccatggccaacctccaggtagcccggcttactcgagtttccacctcccacctgcaaggcccaagactgacgtcagcgctgacgtaccagatggcccaggttgctgtggccacgccccctgtggtgtctgtcctggcagttgtggtgctgtcagccagggtcacagtgcttccatcaacgcaacgggatcagtgttgtgataaggcagctgcaaaaagcggcaggtaggcagccaccttcgcctcaccaaactcgaaacaactcacttgagtgagttgcatcaaacctttctaaatttctcattctagaagttgctgagttgttctgccatgtgttaacttttttttcttatcagtaaaatcttttatttggtttatatttcaaatgtaatttaaaaagtctataagacaggaaattcgataatatgaaagcagggagaaactaagtcgcaccatttagctaagctcagggacaacgttcatttataataaatcaaacatttgatttttttcatgcc

SEQ ID NO: 61700 - DNA, 2943 bp, Homo sapiens
gtgctgcctggcgctggctaggaggcaaacgcacgcgggaagagctgctacccattccagggaccctgccgctgcccctctgaggggtctgcacctcctgggagcaggtgggtctctgggacgagggtccatggtggatggctctggagacgctcccgaggctgtgccgtcccgctgctgcacaggtcggagggtcaccgcagaggctactcgggctggggctggggccgagggagcccgcactggagccccatgtggaacccaaggatgcagctgctctgctaacacggcagcccatccttcgagactgtgacctcgccacagtggccctcagccctccacctccggcgggggcgagggccacccacctccaagtctccagccatgacgacctccgcactccggcgccaggtgaagaacatcgtgcacaactactccgaggcagaaatcaaggtgcgcgaggccaccagcaatgacccctggggcccccctagttcgctcatgtccgagatcgctgacctgaccttcaacacagtggccttcaccgaagtcatgggcatgctgtggcggcggctcaatgacagcggcaagaactggcggcacgtgtacaaggctctaacattgctggactacctgctcaagacgggctccgagcgggtggcccaccagtgccgcgagaacctctacaccatccagacactcaaggacttccagtacatcgaccgcgacggcaaggaccagggcgtcaacgtgcgcgagaaggtcaagcaggtgatggccctgctcaaggatgaggagcggctgcggcaggagcgaacccacgccctcaagaccaaggagcgcatggcactggagggcatcggcattggcagtgggcagctgggcttcagccgccgctacggcgaggactacagccgctcccggggctccccgtcctcctacaactcctcctcttcgtcaccccgctatacctccgacctggagcaggcccggcctcagacgtcaggggaagaggaactgcagctgcagctggccctcgccatgagccgtgaggaggcagagaagcctgtccccccagcctcccacagggacgaggacctgcagctgcagctggctctgcgcctgagccggcaggagcacgagaaggaggtgaggtcctggcagggtgatggctcccccatggccaatggtgcaggggccgtggtccaccatcagcgggacagagagcctgagagagaggagagaaaggaggaggagaagctaaaaaccagccagtcctccatcctggacttggctgacatcttcgtacctgccctggccccgccctccacacactgctctgctgacccatgggacatcccaggttttaggccgaacacagaggccagtggatcctcctgggggccttctgcagacccctggtctccgatcccctcaggaaccgtcctgtcccgaagccagccctgggatctgactcccatgctctcctcctctgagccctggggcaggaccccagtgctgcctgctgggccccccaccacagacccctgggccctgaactctccccactacaaactccccagcactggggctgacccttggggagcctccctggagacctccgacacacctggtggtgcctcgacctttgacccatttgccaaacctccagaatccacagagaccaaggaggggctggagcaggccctgccctctgggaagcccagcagccctgtggagctggacctgtttggagaccccagccccagttccaagcaaaatggcacgaaggagccagatgccctggacctgggcatactaggggaagcactaacccagccaagcaaagaggcccgagcttgccggactcccgagtccttcctgggtccctcagcttcctccttggtcaaccttgactcgttggtcaaggcaccccaggttgcaaagacccggaaccccttcctgacaggtctcagcgctccgtcccccaccaacccgttcggcgcgggcgagacgggcaggccgacgctaaaccagatgcgcaccggctcgccggcgctgggcctggcaggcgggcctgtgggggcgcccctgggctccatgacctacagcgcctctctgcccctcccgctcagcagcgtgccagctggcttgaccctccccgcctcggttagcgtcttcccgcaggccggagccttcgcaccgcagccgctgctgcccacgccgagctcagccgggccgcggcccccgcccccgcagaccggcaccaaccccttcctctgagccccgccccgtcccataccggcctgcgcctgcgccggacgctccgcggccccgcctccggacccggggctgggcggggcgccggtgctagtggaacgccgtgccagtggcggctggtatcccgcggcggctctggaagctggacgcggaccacggcccgggagctagaaactgaacgcccgcataataaagactggaacccacgttctcagctctcaccaagtggactttttgcggggtgtggcggccgggtctcgaccacagcgtggatcaccggctgtttaggaaactgcagctgcacaacgtggggtgcaaaactgccccgcttcctttacagctcttctcaaccctcacctccatcccccgtcacccaggcaccttcgcttccagatgctgccaggctgtcactcaattcggtcatttcattcatttatcacacatgggcactggggttgggctaacagcaagagacaataggcctttgttcctatttattgggtactgcttacgtgctaagcagatcagtttatttaatgcttgcaacgactctctgaggtagaaaatattgttaattccgttcaggatcccggctacataatctgtggggctcaatacaaaataaaaatgtaggggctccttgttcaaaaaaaaaaaaaaaaa

SEQ ID NO: 61701 - DNA, 3044 bp, Homo sapiens
ctttcacttaggcatcgatagcacccatcagatggccaaatcattatttactggaccaggccttttcaaaactatcaagcagatagtcagggcctgtgaagtgtgccagagaaataatcccctgccttatcgccaagctccttcaggagaacaaagaacaggccattaccctggagaagactggcaactgattttacccacaagcccaaacctcagggatttcagtatctactagtctgggtagatactttcacgggttgggcagaggccttcccctgtaggacagaaaaggcccaagaggtaataaaggcactagttcatgaaataattcccagattcggacttccccgaggcttacagagtgacaatagccctgctttccaggccacagtaacccagggagtatcccaggcgttaggtatacgatatcacttacactgcgcctgaaggccacagtcctcagggaaggtcgagaaaatgaatgaaacactcaaaggacatctaaaaaagcaaacccaggaaacccacctcacatggcctgctctgttgcctatagccttaaaaagaatctgcaactttccccaaaaagcaggacttagcccatacgaaatgctgtatggaaggcccttcataaccaatgaccttgtgcttgacccaagacagccaacttagttgcagacatcacctccttagccaaatatcaacaagttcttaaaacattacaaggaacctatccctgagaagagggaaaagaactattccacccttgtgacatggtattagtcaagtcccttccctctaattccccatccctagatacatcctgggaaggaccctacccagtcattttatctaccccaactgcggttaaagtggctggagtggagtcttggatacatcacacttgagtcaaatcctggatactgccaaaggaacctgaaaatccaggagacaacgctagctattcctgtgaacctctagaggatttgcgcctgctcttcaaacaacaaccaggaggaaagtaactaaaatcataaatccccatggccctcccttatcatatttttctctttactgttcttttaccctctttcactctcactgcaccccctccatgccgctgtatgaccagtagctccccttaccaagagtttctatggagaatgcagcgtcccggaaatattgatgccccatcgtataggagtctttctaagggaacccccaccttcactgcccacacccatatgccccgcaactgctatcactctgccactctttgcatgcatgcaaatactcattattggacaggaaaaatgattaatcctagttgtcctggaggacttggagtcactgtctgttggacttacttcacccaaactggtatgtctgatgggggtggagttcaagatcaggcaagagaaaaacatgtaaaagaagtaatctcccaactcacccgggtacatggcacctctagcccctacaaaggactagatctctcaaaactacatgaaaccctccgtacccatactcgcctggtaagcctatttaataccaccctcactgggctccatgaggtctcggcccaaaaccctactaactgttggatatgcctccccctgaacttcaggccatatgtttcaatccctgtacctgaacaatggaacaacttcagcacagaaataaacaccacttccgttttagtaggacctcttgtttccaatctggaaataacccatacctcaaacctcacctgtgtaaaatttagcaatactacatacacaaccaactcccaatgcatcaggtgggtaactcctcccacacaaatagtctgcctaccctcaggaatattttttgtctgtggtacctcagcctatcgttgtttgaatggctcttcagaatctatgtgcttcctctcattcttagtgccccctatgaccatctacactgaacaagatttatacagttatgtcatatctaagccccgcaacaaaagagtacccattcttccttttgttataggagcaggagtgctaggtgcactaggtactggcattggcggtatcacaacctctactcagttctactacaaactatctcaagaactaaatggggacatggaacgggtcgccgactccctggtcaccttgcaagatcaacttaactccctagcagcagtagtccttcaaaatcgaagagctttagacttgctaaccgctgaaagagggggaacctgtttatttttaggggaagaatgctgttattatgttaatcaatccggaatcgtcactgagaaagttaaagaaattcgagatcgaatacaacgtagagcagaggagcttcgaaacactggaccctggggcctcctcagccaatggatgccctggattctccccttcttaggacctctagcagctataatattgctactcctctttggaccctgtatctttaacctccttgttaactttgtctcttccagaatcgaagctgtaaaactacaaatggagcccaagatgcagtccaagactaagatctaccgcagacccctggaccggcctgctagcccacgatctgatgttaatgacatcaaaggcacccctcctgaggaaatctcagctgcacaacctctactacgccccaattcagcaggaagcagttagagcggtcgtcggccaacctccccaacagcacttaggttttcctgttgagatgggggactgagagacaggactagctggatttcctaggctgactaagaatccctaagcctagctgggaaggtgaccacatccacctttaaacacggggcttgcaacttagctcacacctgaccaatcagagagctcactaaaatgctaattaggcaaagacaggaggtaaagaaatagccaatcatctattgcctgagagcacagcaggagggacaatgatcgggatataaacccaagtcttcgagccggcaacggcaaccccctttgggtcccctccctttgtatgggagctctgttttcatgctatttcactctattaaatcttgcaactgc

SEQ ID NO: 61702 - DNA, 3542 bp, Homo sapiens
agcggagcgccaggcagcgcggagcggaggtcgggcccacagccgctccgcctcccggcccgcagatccccgacggccgcaccgcgggctcctctggcccgcaagaacacgtgcatggcgtcctggggaaggcgctgagtgcggagtcgcggcgccgcacgcggcaccatggccctggagcaggcgctgcaggcggcgcggcagggcgagctggacgtgctgaggtcgctgcacgccgcaggcctcctggggccctcgctgcgcgacccgctggacgcgctgcccgtgcaccacgcggcccgcgctgggaagctgcactgtctgcgcttcctggtggaggaagccgccctccccgccgcggcccgcgcccgcaacggcgccacaccggcccacgacgcctccgccaccggccacctcgcctgcctgcagtggctgctgtcgcagggcggctgcagagtgcaggacaaagacaattctggtgccacagtcttgcatctggctgcccgcttcggccaccccgaggtggtgaactggctcttgcatcatggcggtggggaccccaccgcggccacagacatgggcgccctgcctatccactacgctgccgccaaaggagacttcccctccctgaggcttctcgtcgagcactaccctgagggagtgaatgcccaaaccaagaacggtgccacgcccctgtacctggcgtgccaggagggccacctggaggtgacccagtacctggtgcaggaatgcggcgcagacccgcacgcgcgcgcccacgacggcatgaccccgctgcacgccgcggcgcagatgggccacagcccagtcatcgtgtggttggtgagctgcaccgacgtgagcctgtccgagcaggacaaagacggcgccaccgccatgcacttcgcggcgagccgcggccacaccaaggtgctcagctggctgctgctgcacggcggggagatctcggctgacctgtggggcgggaccccgctgcacgacgccgccgagaacggggagctagagtgctgccagatcctggtagtgaacggcgcggagctggacgtccgcgaccgggacgggtacacggccgccgacctgtcggacttcaacggccacagccactgcacccgctacctgcgcacggtggagaacctgagcgtggagcaccgcgtgctttcccgggatccatccgcagagctggaggctaagcagccggattcaggcatgtcctcacccaataccacggtgtcggtccagccgctgaactttgacctcagctcgcctaccagcaccctctccaactacgactcctgctcctccagccactccagcatcaagggccagcaccctccatgtgggctttccagcgctagagctgcagacatacagagctacatggacatgctgaacccggagctgggcctgcctcggggcacgattgggaagcccacacccccaccacccccacccagcttccccccgccacccccgcccccaggcacccaactgcccccacccccacctggctacccagctcccaagcctcctgtaggaccacaggcagctgacatctacatgcagaccaagaacaaactccgccacgtggagacagaggccctcaagaaggagctgagctcctgtgacggccacgacgggctgcggaggcaggactccagccgcaagccccgcgccttcagcaagcagcccagcacgggggactactaccggcagctgggccgctgccccggcgagacgctggccgcacgcccgggcatggcgcacagcgaggaggtgcgtgcccgccagcccgcgcgcgccggctgcccgcgcctcggccctgccgcccgcggctcactcgaaggcccctccgctcccccgcaggcggcgctgcttcctgggaaccatgttcctaacggctgcgccgcggaccccaaggcgtccagggagctgccactgccgcccccaccgccgccgccgcccctgccggaggccgcgagttcgccaccgccggccccgcctctgcccctcgagagcgctggccctggctgcgggcagcgccgctcctcctcgtccaccggcagcaccaagtctttcaacatgatgtccccgacgggcgacaactcggagctactggctgagattaaggcaggcaagagcctgaagccgacgccccagagcaaggggctgaccacagtgttctcaggcatcgggcagccggccttccagcccgattcgccgctgccttctgtgtcacctgcactgtcaccagtccggagccccacaccgccagctgcggggtttcagccgctgctcaatggaagcttggttcccgtgccgcccactactcctgcgccgggagtgcagctggacgtggaggctctcatccccacgcacgatgagcagggccggcccatccccgagtggaagcgccaggtgatggtgcgcaagatgcagctgaagatgcaggaggaggaggagcagaggcggaaggaggaggaggaggaggcccggctggccagcatgcccgcctggaggcgggacctcctgcggaagaagctggaagaagagagggagcagaagcggaaagaggaggagcgacagaagcaggaggagctgcggcgggagaaggaacagtcagagaagctgcggacgctgggctacgatgagagcaagctggcgccctggcagcgacaggtcatcctgaagaagggggacatcgctaagtactagaggccgcagactcctgtccgcagcctcgcagctccgtggggccctccgccccagccccagccagccaggccctggtggaaaggctgggagccgcacagccctcccctcctgcgctggaaaccctccctgacccccaccctggccccccgtatccccagcccttggcaacactggagtgcacacgccgccacggttgcccagaaaaagtgcccaagctgctgacgcaaacaacaacaaatgctgcttatttgcatgccgacttacatatatttgcatgttcgttgactatcaaagagtgcagagctctccccagccccgtgggtggtgactttgttttcctgcggggctcagccccctccaggatgcagccccctcccccgcaccccggaaccggcgtcgctggcgcatcctgggtggaggcaggccccgagctcggggaaggggttttcccttcctctctgccccagatctgcgcgcggcctagcccgggcctcatttcttatccccgccaagggtttcctctcagtcatttgtttaccagaaacatgaaaactgcctgtctggccgggccgcacttgtggcccccgggaccccacctctggccccacctccctcaagtctgcgccccgtccccagccagacccactcgctgccgggaccctttcactgccccggtggagtgaatagaggatgaggggccctgaccctgtgtctccaactgctgcaccccatcccgaccctgtctccgccacctcgcagccccattaaagcgctctcatctggaaaaaaaaaaaaaaaaaaaaaaaaaa

SEQ ID NO: 61703 - DNA, 1580 bp, Homo sapiens
cgcggaaccacgcacagagtctgcagaagtgcacagctttatcgacagcgcttgaagcatggagtctcttcgcgggtacacccacagtgatattggctaccgcagcctggcagtcggcgaggacatcgaggaagtgaatgatgagaaacttaccgtgacctcgctgatggcaaggggaggagaggacgaggagaatacacggtccaaacctgagtacggaacagaagcggaaaacaacgttggcacggaagggtccgtcccctcggacgaccaagaccgtgagggtggcggcggccacgagccggagcaacagcaggaggagccgcccctgaccaagccggagcaacagcaggaggagccgcccctgctcgagctgaagcaagagcaggaggagccgccccagacgaccgtggaggggccacagccggcggaggggccacaaaccgctgagggaccacagcccccagagaggaaacgccgccgccgcaccgcgttcacgcagtttcagctgcaggagctagagaactttttcgatgaatctcaatatcccgacgttgtggcgcgagagagacttgcagcacgcctgaatttgactgaagacagagtgcaggtttggtttcagaacagaagagccaagtggaaacgaaatcagagggtgctaatgttgagaaacactgctactgctgacctggcccaccctttggacatgttcttgggtggggcctattatgctgctcctgctctggatcctgctttgtgtgttcatctggtgccacaactacctagaccacctgtgctgcctgtgccacctatgccacccaggccacccatggtccctatgccacccaggccacccatagcacctatgccacccatggcgcctgtgccacccggctcacgcatggcgcctgtgccacccgggccacgcatggcgcctgtgccaccctggccgcccatggcgcctgtgccaccctggccgcccatggcgcctgtgccaaccgggccgcccatggcgcctgtgccacccgggccgcccatggcgcgtgtgccacccgggccgcccatggcgcgtgtgccacccgggccgcccatggcgcctctgccacccgggccgcccatggcgcctctgccacccgggccgcccatggcgcctctgccacccgggccgcccatggcgcctctgccacccaggtcacatgtgcctcacactggcctggctcctgtacacatcacatgggcccctgtcatcaacagttattatgcatgtccctttttctaaagtaaggtattcataacagtttttccaaagttctttcctgccagatagaaattgtgcacagcacagcatcaagtaattcgttagatgcttgttaaatgaagtgggtaggtgaacaaagttaacgaatgccctgttatttttgtaggccacataattgtagtattttcaataaagatgtgacttaatagtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 61704 - DNA, 1559 bp, Homo sapiens
agcttagcccagctgaccccagaccctctcccctcactccccccatgtcgcaggatcgagaccctgaggcagacagcccgttcaccaagccccccgccccgcccccatcaccccgtaaacttctcccagcctccgccctgccctcacccagcccgctgttccccaagcctcgctccaagcccacgccacccctgcagcagggcagccccagaggccagcacctatccccgaggctggggtcgaggctcggccccgcccctgcctctgcaacttgagcctggctgcgacccctgctctgacgtctcggaaaattcccccttgcccaggcccttgggggagggggtgcatggtatgaaatggggctgagacccccggctgggggcagaggaacccgccagagaacattcagaaggccttcatcgcatccatggacctgtggaactgggatgaggcatccccacaggaagtgcctccagggaacaagctggcagggcttggtaggctgccgaggctgccacaacgtgtgtggggagggtgtccaggtggggcctctgctgaccctaatcccttatcgcctgcagaaggagccaaattaggcttctgtttccctgatctggcactccaaggggacacgccgacagcgacagcagagacatgctggaaaggtacaagctcatccctggcaagcttcccacagctggactggggctccgcgttactgcacccagaagttccatggggggcggagcccgactctcaggctcttccgtggtccgggaactggacagacatggcgtgcacagcctgggactcttggagcggcgcctcgcagaccctgggccccgcccctctcggcccgggccccatccccgccgccggctccgaaggcgccgcgggccagaactgcgtccccgtggcgggagaggccacctcgtggtcgcgcgcccaggccgccgggagcaacaccagctgggactgttctgtggggcccgacggcgatacctactggggcagtggcctgggcggggagccgcgcacggactgtaccatttcgtggggcgggcccgcgggcccggactgtaccacctcctggaacccggggctgcatgcgggtggcaccacctctttgaagcggtaccagagctcagctctcaccgtttgctccgaaccgagcccgcagtcggaccgtgccagtttggctcgatgccccaaaactaaccaccgaggtcccattcagctgtggcagttcctcctggagctgctccacgacggggcgcgtagcagctgcatccgttggactggcaacagccgcgagttccagctgtgcgaccccaaagaggtggctcggctgtggggcgagcgcaagagaaagccgggcatgaattacgagaagctgagccggggccttcgctactactatcgccgcgacatcgtgcgcaagagcggggggcgaaagtacacgtaccgcttcgggggccgcgtgcccagcctagcctatccggactgtgcgggaggcggacggggggcagagacacaataaaaattcccggtcaaacctc

SEQ ID NO: 61705 - DNA, 2949 bp, Homo sapiens
gcgtacctttctccaggttttcagcctgtgatttgataaccgccgccgggtggcgtggagcgtcccgagacttcttccttcattgcagcccctcttcttttagttctagactgaagttcgaggaacgcaccacttggctgaaattaggatccagatttcccaaacttccttcggaggaaaaagccctaacgatggaggacagtgaattcctagcttatgtggaactactagatgaagtggaacaaggctcagtgagagcaaaagcatcttctgttagtctacatgcagaaagaacctggatggagaaaatgaaagttgaagacctaaatgtatgtgagcctgcttctcctgcccctgaagcaccagctacctctctgctgaatgacctcaagtacagcccatcagaggaagaggaggtgacatacacagtcattaatcaattccagcagaagtttggtgctgcgatactccatatcaagaagcagaatgtcctgagtgtggcagcagaaggagcgaatgtatgtcgccatggcaaactgtgctggctgcaggtggccacaaattgccgagtttacttatttgacattttccttctgggaagtcgagctttccacaatggacttcagatgatactagaagacaagagaattttgaaggttatccatgattgtcgttggctttctgattgcctctctcatcagtatggaattttgctgaataatgtctttgacacacaggtagcagatgtacttcagttttccatggaaacgggtggctatcttccaaactgcatcactactttgcaggagagtttaatcaaacaccttcaagtagcccctaaatatctctcctttctagaaaagagacaaaaactaattcaggaaaatccagaagtatggttcatccgacctgtttcaccctctttactgaaaattttggccctggaagctacctacctgttaccccttcgcttggcactcctagatgagatgatgtctgacctaaccaccctggtggatggttacctaaacacgtatcgcgaagggtctgcagaccggcttggaggcactgagcctacatgtatggagctgccagaggaactgcttcaactcaaggacttccagaagcagcgcagggagaaagctgcaagagaatatagggtgaatgcacagggactcctgataaggacagtgctacagccaaagaaattagtgacagagacagcagggaaagaggagaaagtcaaaggcttcttatttggtaaaaattttaggatagataaagctccaagttttacatctcaagactttcacggggatgtgaatttactgaaagaagaatctttgaataaacaagctacaaatcctcaacatctacctcccacggaggaaggggaaactagtgaggattccagtaacaaactcatttgcacaaagtcaaaggggtcagaggaccagagaataactcagaaagaacactttatgacacccaaacatgagtttcaggcaagtttatctttgaaagaggagacagaacagttattgatggtggaaaacaaggaagatttaaaatgcacaaaacaggctgtttcaatgtcttcctttcctcaggaaaccagagtgtctccaagtgacactttttatcctatcagaaagactgtggtttccacactccctccctgtccagccttggagaagatcgattcctggataagtccttttctaaatctgccctagagatgggcagtttgttcttaaggccatgcagatggcttatttcctttgccatcagggctttccacagtgcccaggtttctcatgttgtaaatgtagtaatgcttcagtcacaggggaaaattatatcctcttgcttactcctgtgttcctggtatgcggagaatgagaatgaataagttaaataatggaagaagtataatttctgattatgtcactgtgtagaaatgttctcagtgaccagagtgcattatttttcataatttgggtttagaggatttgaagaaaggaagaatcttgggcttagtatcaggaagactccatcattttcaaattttgttttgcttcttgacttttggattcctttgaagagacctggtaaaactattaacaattcatttaaaaaattggtacctgataactttaccagtacttttttcctttttatttatttgttttatttatttttttttaccgctccttgtggagcagggctacaccataggcagtgtgcccagagtaaccacttttttcctttttaaaatataatattaactttatgtttgaatgttgaatgttttgtctgtctcttaggcaaataatgttataggaatcaataatttaatttttgttttatttgttttttgatggagtctcactctgtcacccaggctggagtgtagtggtgtaatctctgctcactgcaacctccgcctcccgggttcaagcaattctcctgcctcagcctcctgagtagctgggattacaggtgcgtgccaccacgcccggctaatttttgtatttttagtagagatggggtttcaccatgttggccaggctggtctcgaactcctgactgaccttgtggtccacctgccttggccttccaaagtgctgggattacaggtgtgaggcacggtgcccagccaatatctttattttaatttgtttttatttcctttatttttagctggttttgtccattttcctaacaaagcagggaccctgggtttctttttagtctgtctgttatataaacttgaagcctgactccattctatttgcctggagttagtatactttcttagggtgaaaggaaggcagcttgtattgagccttttaaagtattgaatgcttgcaaattgctaacattcttttgtgtaaaataaccaataaacctgttttgtcatactctacttaaaaaaaaaaaaaaaaa

SEQ ID NO: 61706 - DNA, 1144 bp, Homo sapiens
acttgtccaggtggagtgagtctgaggacagcagatgaacagacagaaactgaaagatccccaaaaaggatgagtgagagggtcgagcggaactggagcacgggcggctggctgctggcactgtgcctggcctggctgtggacccacctgaccttggctgccttgcagcctcccactgccacagtgcttgtgcagcagggcacctgcgaggtgattgcggctcaccgctgctgcaaccggaaccgcatcgaggagcgctcccagacggtgaaatgctcctgtttttctggccaggtggccggcaccacgcgggcaaagccctcctgcgtggacgacctgctcttggctgcccactgtgctcgtagagaccctagagctgcactccgcctcctgctcccacagcctccatcgtcctgcagagatggtggtgtcagatggagccctgcctgccgggggaggagtgtaaggtgctcccggacctgtcgggatggagctgcagcagtggacacaaagtcaaaaccaccaaggtcacacgatagctcttgggggtcacggcctggacaagaaaggcttgactgagccgtgaactgaagaatggtatccagtcatcagccaggaaagatggggattcacttacatgcctcatgtcaaatgcagcatcagtctttccggggcatttcagttaagctgctcagcagatatggatggatctgcaatcacatacctaatgtggagctgggcttttctggagacacgaaggtcaacacacaattcctgcccttaaggaatgtccagttgaattggagagttgatgacagacaatttagataatttaggttaaagtacttgataccagactgcggcttctgggccacatgctatggcatgatgggggtttgggaatgagattcccacagttcttcagataccctgtggccacagggcatagaaacaagaggtcacattcagcacccaccacctccctctttcgcatcagttctgaatccccagcaagctgttaacatgttgcaggaaaacactctccccttatgccagaccagcagtatctcatttggatgggattggattgacttgcggaaggaaagtaaaaataaagccaaataacttcccaaaaaaaaaaaaa

SEQ ID NO: 61707 - DNA, 1077 bp, Homo sapiens
acttgtccaggtggagtgagtctgaggacagcagatgaacagacagaaactgaaagatccccaaaaaggatgagtgagagggtcgagcggaactggagcacgggcggctggctgctggcactgtgcctggcctggctgtggacccacctgaccttggctgccttgcagcctcccactgccacagtgcttgtgcagcagggcacctgcgaggtgattgcggctcaccgctgctgcaaccggaaccgcatcgaggagcgctcccagacggtgaaatgctcctgtttttctggccaggtggccggcaccacgcgggcaaagccctcctgcgtggacgcctccatcgtcctgcagagatggtggtgtcagatggagccctgcctgccgggggaggagtgtaaggtgctcccggacctgtcgggatggagctgcagcagtggacacaaagtcaaaaccaccaaggtcacacgatagctcttgggggtcacggcctggacaagaaaggcttgactgagccgtgaactgaagaatggtatccagtcatcagccaggaaagatggggattcacttacatgcctcatgtcaaatgcagcatcagtctttccggggcatttcagttaagctgctcagcagatatggatggatctgcaatcacatacctaatgtggagctgggcttttctggagacacgaaggtcaacacacaattcctgcccttaaggaatgtccagttgaattggagagttgatgacagacaatttagataatttaggttaaagtacttgataccagactgcggcttctgggccacatgctatggcatgatgggggtttgggaatgagattcccacagttcttcagataccctgtggccacagggcatagaaacaagaggtcacattcagcacccaccacctccctctttcgcatcagttctgaatccccagcaagctgttaacatgttgcaggaaaacactctccccttatgccagaccagcagtatctcatttggatgggattggattgacttgcggaaggaaagtaaaaataaagccaaataacttcccaaaaaaaaaaaaaa

SEQ ID NO: 61708 - DNA, 596 bp, Homo sapiens
tccctctttctcagattacaggtttgagaagttccaaatatccgatgccctagaggtttttttcccttaattttattgttacaattggccttcatctagctctggatggttgaactgtagcatggcaaagatgtttgatctcaggacgaagatcatgatcggcatcggaagcagcttactggttgccgcgatggtgctcctaagtgttgtgttctgtctttacttcaaagtagctaaggcactaaaagctgcaaaggaccctgatgctgtggctgtaaaaaatcacaacccagacaaggtgtgttgggccacgaacagccaggccaaagccaccaccatggagtcttgtccatctctccagtgctgtgaaggttgtagaatgcatgccagttctgattccctgccaccttgctgttgtgacataaatgagggcctctgacttgggaaagctgggcacaaaaatcttcatgagcaatatttctttcttaatagaatgttttattattcaagtcaagttctagagtgtttacatactattatataatgtacagtgttattttctgtacttctgaataaatgtgcaatattggaaataa

SEQ ID NO: 61709 - DNA, 3028 bp, Homo sapiens
gaatgtgtggagatcaggtgatgcagaactctggtaaaggatgttagtcttcagagtaagactgttaaattcagcaaagtctactatcagaagacacgtttttctggttggtgtattactttattcagtgataatatgaaaattactatcttcactgaaggatctactgaataatcattttaactcaactatattgcattcttgaaagcaatcctttcaattgatctactgacttcacaatgtctgaaatcagattcaccaatctcacttgggatcaagttataacactggatcaagtgttagatgaagtaattccaattcatggaaaggggaatttccccacaatggaggtaaaaccaaaagacatcattcatgttgtgaaagatcaactcatagggcaaggaattattgttaaagatgccagattgaatggttccgtagcaagttacatacttgcaagccacaatggaatcagctataaggatctggacgttatttttggtgttgagcttccaggtaacgaagaatttcaggttgttaaagatgcagttctagactgtctacttgactttttaccaaaagatgtaaagaaggaaaagctctccccagatatcatgaaagacgcttacgtacagaaattggtcaaggtttgcaatgggcatgattgttggagtcttatctccctttcaaataacactgggaagaatttagaactaaaatttgtgagttcactcagacggcagtttgaatttagtgtagattcctttcaaattgttttggatcccatgttagacttctacagtgacaaaaatgccaagctaaccaaagaatcctatcctgttgtggtagctgaaagcatgtatggagacttccaggaagcaatgacacatttgcaacacaagctcatatgtaccaggaaacctgaagagattagaggtggtggccttctgaagtactgcagcttgctggttcatggcttcaagccagcctgtatgtcagaaatcaaaaacctagaacgttatatgtgctctagattctttattgattttcctcatatagaagaacagcaaaagaaaattgaatcatacctccacaaccatttcataggtgaaggaatgaccaagtatgactaccttatgaccttgcatggagttgtgaatgaaagcactgtttgcctcatgagttatgaaagaagacagattctccacctgatcaccatgatggctttgaaagtacttggagaactaaatattctacccaatacacaaaaggtaacttgcttttatcagcctgctccgtactttgcagctgaggcaaggtaccctatttatgtaatacctgagccaccccccgttagcttccagccataccacccactgcactttcgtggatcaaatggtatgagttaaaaaatacacatgcaaccatagaaactttgatttaattaaacaccatttaaaagcaagtttccaaatgtaaaattcaagatctgtttttatttttgtacagttaccaattattttcaattacagttgatggaatagtagttaccaactatttttgatcaattaagccatcatagtaaatacaatatctataaaccaaccactttaaatgtttttcaaacgttattgactagctataataactttcaaatgttgtgttccccttgaagtgattttcaaatcttttgactacttgtgactttcaaatttactgtgacaaatatattagagatgcctgcatctttgactataacataaaaggacagattcatgttttaaaattaagatgtacagtgaagtatcaaattttttatattcagtcagttcctttgttacatttagttctttttttctattgaacaataccatcaataaatgttcagtacttaacagaaatgcctaatttcaaaagcaacagattcagaagacattaaaaccctggacttttcaagcatttttttttgacaattaaattgggttggatacaaaaatcctactatagtttaaaggaatactggaaaaaaatggttctggaaagccctggacattagtaatttgtcatctatataataaaacatttagttaatttgtggatttgaataacaataccatacagctgtgcaactactactgagatcagatacagggttttttgcccctcaaaataagttaaaacgaatgaaaatgaccagctctgaatgtgaaagctttctatcatcatctactacaaagagactctaaatggcaaacaggaaaaaaacaggcagaggtttatagccatagcatttaccattttatggcttatttgaaaaacatctttatgttgagaaacattccatttcagtaagttaaaatattttcattgtaactaaatgaagcaggtttttcattttgcctttaccaaagatcattttctaacatgccactcaagtgcctcttcgtgtgaatttttgcgtaacactataatttattcaacaactgtatacctttacagtatatctaaatatatacttactacatcgagtatactgctagaaaaatctaccagtgggattaaaaatgtattttcttcccataatgaaaataattcatgaccaatattacctgaagtgtcagaagaggagctgtcttaaattaatatggatcaggccattggaaaacttcagtatttccacttggttatgattttttgtgagtttccatttcagtttttattgaccatcacgttttctatcacaacatgacctgacagttgtatcccgataatttgccagttatagactgtgcttatcttcactgtattacaatattggacagaagtacaccaaatacggcattttcaaataaccaatatttctgagatgttttataccacagcacaagtggccatcagtatatttttaaagaattatatatcacagaaccctgaggctttaaaacactatggacttaccactttcttgacaaagaatttgtaattacaataaaatatttagaaatgaaaggcaaaaaaaaaaaaaaaa

SEQ ID NO: 61710 - DNA, 2104 bp, Homo sapiens
acaacagagagggccaccatgggggaccggaggccacaggaccggccaaggtcccaaggcatggactccaagccctggtactgtgacaaaccgccttccaagtacttcgcgaagcgcaagcacaggcgcctgaggttcccgcctgtggacacccagaactgggtatttgtgacggagggcatggacgacttccgctacgcctgtcagtctcctgaagatacgcttgtttgtcgccgtgacgagtttttactccccaaaatatctctcagaggtccccaagctgaccgcaaaagcaggaagaaaaagctgctcaagaaagcggccctattttccgagctctcgccagtacagccagcacggaaggcgttcgtagaggaagtggaagcccagctgatgaccaagcatcccttggccatgtaccccaatctgggaaaagatatgcctccagatctcctactacaggtgctgaaacagctggatcccgagaggaagctggaggacgcttgggctcgttgtgaggcccgggagaagacaaccgaggtacccaccgagtctggtaaatatccctgtggggaatcctgcccgcggcctcccgagactccggtgtcccgtctccgtcctcagcttcccaagactccggtgtccagtcgccgcccagagcctcccaagactcgggcgcccagtctccgcccagagcctcccaagactcgggtgtccagtctccacccggaacctccagagactcgcgcatctcatctccgcgtggatcctcccgagactggagtgtcccatctctgcccagagcctcccaagactctggtgtccagtgtccacccagagcctcctgatactggagcgtcccatctctgcccggagcctcccgagactcgcgtatctcatctccacccggagtctcctgagactggagtgtcccatctccgcccagagccttccaagactcaggtgtccagtctctgcccggagcctcccgaggctggagtgtcccatctctgcctggaacctcccaacactcatcgggtgtccagtttcctactacaggtgctgaaactggattctgagaagaagctggaagacgcacgggctcgttgtgagggccaggagatgacaaccgaggaactcaccaagcctggtaaataccatttttgggaatcctgtccgcggccttttgagagtcggatgccccatctccgcctggtgcttcccataactcgtcgaatggccagtctctgcctgaagcctcccaagactcgtcgggtgtccagtctctgcccggagcctaccaagaccggagcgtcccatctaaaagaactgtttcaggaagatacaccaagcacaatggagtgtgtttctgactctcttcaacgtagacacacatcgagaaaactccgtgacttcaagtgggctggagacctaggagttaatgaagaatccatcagcagtctgtttgactttacccctgagtgcagaacaaccgatcaagaccaaaagattaagaaggcaaacgagtgtgcttcaaggctgatgtacggcatggagctagacgacatggatgaggtcgaattcttacggataaaatactgggacaggagacgccgggcggcaccgcattcttatagtgcacagcgtgggaggataaggtatggaccatggtacttcgagcctaagttggggaaaaagctaagaagtgatgaacctttgattgaccccaagcccgtacttgaaaagcctgatgaacccgacattcttgacggtctttatggaccaattgcctttaaggatttcattctaagcaagggctacagaatgcctggcgtcattgaaaagctgtttgccaagaagggatggacttacgactctgttaagactcctattcaacgtgcagtgcaagtttacaagtacaaagaagacgtcacagatgcatcaaaagaagattagatggttttcaatttactgcttacttgggtatttcttgctctcattctaaacatcaatcagaatttatgatgactggccccgtgaatgtacaactttggcaacatctgtaaattcaatacccaatgcttataaatatgtcttaatgacc

SEQ ID NO: 61711 - DNA, 4135 bp, Homo sapiens
ccgcggccctgggagctggaggaaccgcgactcagcaggcatgactggagagggaagtcccaatggtgctagaatggtgctgcagtggcagaagacggctcacaagtgaggtctggaagaacaacagggaagacatccatcatttgctccaaagtgtgcaagtcaaatcctggggagaatcatgataaccctgatcactgagcagctacagaagcagactctggatgagctgaaatgcacacgcttcagcatcagtctgcctttgcctgatcatgcagacatctccaactgtgggaactctttccagcttgtgtctgaaggtgcttcctggaggggcctgccccactgttcctgtgctgagttccaggacagcctcaacttcagctaccatccctcaggcctgagcctgcacctcagaccacccagtcggggaaactcccccaaggagcagcccttctcccaagtcctaagacctgagcccccagatccagagaagcttcctgtgccccctgcccctccatccaagaggcactgccgctcactctcagtgcccgtggacctgtctcgctggcagccggtgtggcggcccgccccctccaagctgtggactcccataaagcaccggggcagtggtggagggggtgggccgcaggtgcctcaccagagccccccaaagcgggtctccagcctcaggttcctccaagctcccagtgcctcttctcaatgtgccccagctcacagaccctacagccctcctttcttcagcctggccctggcccaagattcctctcgaccctgcgccgcctcccctcaaagtggctcctgggagagtgatgctgagtccttgtcaccttgcccacctcagcgccgcttctccctgtcacccagtctgggcccgcaggcaagccgcttcttgccctctgcccggagctctcccgcatcctccccagagctgccctggcgacctcgaggtctccgcaaccttccccgaagccgctcacagccttgtgatctggatgcccgcaaaactggggtcaagcggcgccacgaggaagacccccggcgtctgcggccttcgttggactttgacaagatgaatcagaaaccatactcaggaggtctttgtctccaagaaacagcccgggaaggcagcagcatctctccaccatggttcatggcctgtagccccccacccctctctgcttcctgcagccccactgggggttcctcccaggtgctgagtgaaagcgaagaggaggaggagggggctgtgcggtggggtcggcaggcgctgagcaagcggacactgtgccagcgggactttggggacctggacttgaatttgattgaggaaaactaaaactgagaggctacttcctggggccacacagactgactctctcatggctactaacaagtgtcgagtccccaaggctgggggccgagcctgggaatgggggtgagtggagggctccgactcagggcagctggaaatcttctcgctccagcaagctcgaccatgccaagagactggccgggacaagataaacggagctggtggcgggagggacagccccagagcagacccttcctatggcggccctgagtgtgagtatccctgccaccaagagagcaatgggcagggaaggaaggggtctgccgaccccagctcggggaatttcactagcccctttgcttcaaagggcacttgtgtcttagaatttggccagggtggggggttgagtcagcctcctcagagaaactgcgtgagagtgtgtgcgtgcatgggagtgtacttgtggaaaggtgtgtttgcgtagccttagggaaggaaggcaattgctccttaacagcagagtatcatgatacccccaggatcttgagttttttacaggatgttgggtttgctcaaggagtcaagaggagggcaccaagttttccttttttctaaatagctctggaaccaggcttgtaatccatagcatcaccgactctgcaaaggatttcattttggggtacagcagggtgttttaagtgctgtgacttcagctaatgatcttttcttcagccccaccccctccccactagctcgatctagtatattggggaatgcaggtggggggtgtcaccatattttttctgagctggcctttttttctcatcagattgtccaggctatattccacctgcctcttttgccctcttgagtagagttgcacacagcacatgggcaactgaagcagggttgaggggctctatctctctctctcctctgctgatgggacccttttcccctcaccctctgcccttctaagtcatagactaggtaggaaggccctatattggtccccagcatctactgaggcagacctgcaacagaagtggcattcagtccccagcagacatgggtgagctcaccccagcactgctgttgggaaggtgactgcaggaaaccaattcttacaagatccaggcccagcctttttgacctgcttgagagggaagaaggggtgtttagcatttaatagtttgcttgtcttccactcctgccaggaagtgtttatttgcctctaattgggcctgagagaccatagggaggttggggctcactgagggattggctgaggatgtataaagcaaaggctgtgagaagcagttgggagtttggttgtcattggattgaatttacttttttgtttctcacccgcaacttgagccaggacagctggtccaagtggccacagtgatgggtttaagtaccttggtagggctggcaccagtggaaacacatactgaagctgccaccacaatagcttgtgaggttttatccagctttggttagaccctgcatgaccaaatttgacctgcccttgtttatggcaagaagggcatttttctcttcaatttccagggtttcctaggacccagttcctcatgtaagggaggaagaccaaggtctttgtgttttcttcctcatggaattgaacctgacattttctggatctcctgcatgtcaggagcatcagtgaggcttcagcctccttgtctccactccagagaggaggtggctatgtcttcttaagcctctggccctcagaggctcctccctatctcctggctagttaccactaggctaccaggtctctaggggcctgagagaggccctctagagaatccagggaaactgtgagcccaggagttgcccatctatggtttcattcctcccctggctcttctccctcttcaggccataatttccctggtgccaatttcttttcctcctggggcatcctcatcccagggctctctgctgtagattggctgtgccagcttccaacaggttactggcaatgccagtgagtttctgtaggccctaagctgaagaagtgaggcagtgattctgcctccatcctggtttccccaaagccccagggcaccatccttaagggagaaggtctacagttatcattattttaattccattactttcagtctggaaaactaagctagtcagaactgtcatcttgcttcccaatctaagaacctgtggccctggaacacttttcaagaattggttcattttgctttacacagtagatctgttccaacagttctgtgtaaaccaaatgctatttttcaatgcatttggactgctgaccatttaaaagcagcctatgattgcttctttttgtaaagcaagcaacctccctccactttagctgttttgactatttgaattttcacatattgggcttacccagagtggagcacacctccagggcatgtggctgacactgggtcaatgtctgcatctgtgctgtgtgtgtagtgtggttggccagtaggtgagtatccctgtgtgtgtgagtgaagccactccccaggctggtgctctcctcctgtgcccagtgactgcccagtggcagctcagctgcccttcactcccacctgctgccaaagtccctgtgctaatgggattacaaatacaaaaagtggaaaaaaattttcgtaaactttgttttatattaaaagaaaaatccataagtctgtgtgtgttaaacatgaggttctgcctctgtggctgtgtttgaaaaaataaagttttattagaataatccattttcccaagcaaaaa

SEQ ID NO: 61712 - DNA, 1661 bp, Homo sapiens
cggcctccctgccccttcacggcccgcctgcctccctgcccaagtcctgagccaccatgctgaccccgatggtggccgggggggtggtgttccccggactcttcctcctctccaagaacacgctccagcggctgccccagctacgctgggaggaggccgacgcagtcattgtctcagccaggctggtgtcctctgtccaggccatcatggcctccactgccggctacatcgtctccacctcctgcaagcacatcattgatgaccaacactggctgtcctctgcctacacgcaatttgctgtgccctacttcatctacgacatctacgccatgttcctctgtcactggcacaagcaccaggtcaaagggcatggaggggacgacggagcggccagagccccgggcagcacgtgggccatagcgcgtggctacctgcacaaggagttcctcatggtgctccaccatgccgccatggtgctggtgtgcttcccactctcagtggtgtggcgacagggtaagggagacttctttctgggttgcatgttgatggcagaggtcagcacgcccttcgtctgccttggcaagatcctcatccagtacaagcagcagcacacactgctgcacaaggtgaacggggccctgatgctgctcagcttcctctgctgccgggtgctgctctttccctacctgtactgggcctacgggcgccatgccggcctgcccctgctggccgtgcccctggccatccctgcccacgtcaacctgggcgctgcgctgctcctggcccctcagctctactggttcttcctcatctgccgtggggcctgccgcctcttctggccccgctcccggccgcccccggcctgccaggcccaggactgaggccgggggccgggaccctccccctccccacccccacccccgtggagacagggctctggggctgatggctggggttgggagccagggtcctcttgcccggacaaccccaggactgacgatgaccccgaaagggaagaggccccatctctcggggactgagggggtggagagaggggacctcttccccctactctgcccccttcctgcacacccttgcgctggaggaggggagggggcaccgcctcccacccactgagggcaggagggcttgtggggagggacaccaacagggtttcaaggggaccaggagtcagaatgtggggagacgcctctgccaaggccatcccagcccctatgctgccatcccccagggctccccatcacccgagaggagaggacgccccaactaacccccgctggccctcgggcctcccgagtggccggctgcaaccacggctcctctccagggtaggccagcttgaggaatcttatttattttatttatttacccaaatttgaactagtctgttgggttgggggaaggaggtggctgctacccccaagccttcccagtgctgacaaccccgggggcaggcgagggcgcccagtccctcaccatcggctgcacatcgcgccctcgggccctgccatgtccctggtgctactgacctctcaaggcttcctccaatctggggtcgggggaccctgggaggtgctttacagaccgctaataaaagacgatctgcgtgaacgccaaaaaaaaaaaaaaaaaaaaaaaaa

SEQ ID NO: 61713 - DNA, 2321 bp, Homo sapiens
agagagagggtcgtcacttcctgtcactaggactacagtttgtagtctctctcagggagagagactacaaactgtagttaaaaaaatcagaggtggaggtcagggggttaggtccagaagaaaacctctctggagcccaccctgcatctctacgtcttggaagagtctggagtccaggcaccctacagcaccccccacagcaatcatccgtgctcccacccccaccccggcctctgggaggctctgaggcaacagtgggggcctgtggggtggggtgggattgagagaccagctgcagagacatctttgtgacccaggagcaccactggtccctcatctgccaccgaggccaaggaagacccagagacctgcctcaccagtgctgccgttgtgctgaaagacaaccatgaatgctgattttctgctgccgtattatacggcccagagtggctccagcatgagcatgttcgacaccaccatggggaaactgcagcgacaactgtacaagggggagtacgatatattcaagtatgcaccgatatttgagagcgactttatccagatcaccaaaaggggagaagtgattgatgtgcacaaccgtgtccgtatggtgaccatgggcattgcacgtaccagccccatcctcccactcccagatgtcatgctactggcacgaccggccaccggctgcgaagagtatgctggacatggccaggccaccaagagaaaaaaacgcaaggcagcaaagaacttagagctcaccaggcttctgcccctgaggtttgtacggatctctgttcaagaccatgagaaacaacagctgcgcctgaagttcgccactggcagatcttgctatctgcaattgtgtcccgctcttgacacacgggatgacctctttgcctattgggaaaaactaatttacctcttgcggccacccatggagagtaacagcagtacctgtggcattccagctgaagacatgatgtggatgcctgtgtttcaggaagacaggaggagcctgggagccgtgaaccttcaaggaaagggggatcaggaccaggtcagcatccaaagcctccacatggtctctgaggtgtgtggggccacctctgctgcttatgctggaggggagggactccaaaatgactttaacaaacccactaatgtgctcaatgcatccatccccaaaacatctacagaacttgctgaggagccagcaacaggggggattaaagaggcagcagcagcaggggcagctgcaggggcagcaacaggcaccgtagcaggtgccttgagtgtggcagcagccaattctgcccctggacaggtgagcgcagccatagctggggcggccaccatcgatgcaggaggaaacaaaggcaacatggcccttgcaggcactgccagcatggctccaaacagcacgaaggtggctgtggcaggggctgcaggcaagtcctcagagcatgtttccagcgcatccatgagcctttcccgagagggcagtgtgagcctggccattgcaggagtagtactgaccagcaggacagctgcagaagcagacatggatgcagcagcgggacctcccgtctccacccggcagagcaagagcagcctgagtggacagcatggaagggagcgaacccaggccagcgctgaaggctgcaaggaggggagggaaagaagggaaaaggacagggctctcggaaggagttcccatcgccgcaggacaggtgaaagccgccacaaaacaaggggagacaagattgcccaaaagtcctccagcaggtcctcattcagccacagagccaatagagatgacaaaaaggagaaaggctgtggcaacccggggagcagcaggcacagggactcgcataaaggtgtcagccacacgcccatctcaaaggagtccaggacctctcacaaatctgggaggagcttatggaccaccagttccggttccagcaagggacttggcagggtcagctctttcctgaggaacgtcagagccaaccttactacaaaagtagtgggcacaccacatggcagagatgtggacgtcatggctaagatggcggagaggagcaccaacgtggccatcgccgagacagcagagggtggccaggggctggagatggttggttctatgacaccggacatcatggagacagtgacctttgaagcccattaaataagacccagagctggaagctgcaaaggagcccagagctcatgggagtgtccctggaaagcctattccagcgttctttactgccgtttaaataaagaatcatacatctgaaaacaaaaaaaaaaaaaaa

SEQ ID NO: 61714 - DNA, 1812 bp, Homo sapiens
agtggtggatggttcaggttgggaagaagagcagtgggattgccagttaaggttgtggaatcaaagagcaaaggctgttgtgaagtggaatatcaggctcatatggaggtccctcccgaatgagcactgacacctgtgtgcccggacatccacgagggccccaacacctgtgctcctgacagctccatgcactaagcagggcacagtctggatccaggggactgactgtctctggcattgagcggttggtaatcaataccccaccatccctgttctcagtcacttggggacaaaaaagaaagcctgcagaacacgactgctggcccacctgccagagtagccaaggaaacaggatgcccgctaaagcatgttaaggaaggtgtggagcagctgctgggaactgtcttgatttaaaggaagacatggaggactgctgtatgctaccgtattacacggcccaaagcagccccgcaatgggcatgtttaacacctccatggggaagctgcagcggcaactgtacaaaggcgagtatactatattcaggtatgcacccatgtttgagagcgactttatccagatcagcaaaagaggagaagtgattgacgtgcacaaccgtgcccgaatggtaacaatgggcatcgttcgcaccagcccctgcctcacactacctgatgtcatgctgctggcccgaccagctgctgtctgtgacaatgccaggtgtggtcctgccacccagaaaagagaaagtccgcctgcagagatcttagaactaaccaggctgcttcccttgatgtttgtgaaaataaccatccacaacagcgtaaaaaaacagctccacctgaagcttgccacgggccgctctttttatcttcagctgtgtcctccatcggatgcaagtgaagacctttttgttcactgggaaaaccttgtttacatcctgagaccaccagtggaggcttacagtgataccagggctatcctagctgggaacacattggactcatctgtgttggaggaagtgcagaggagcccagtgggatatgccatgaagttttgtgaagagaaggagcaattcagaatcagtagacttcacatgaatgctgaaatgtttgggtccacctattgtgattatacaatagagatatgaatccaacatacctcccacatatactacgttcaagagttcacacacccctgcagtcataaaacctatagtgcctgatgaaggggcagggtagcaacagcagtagtgatgacagtaagcaccaccacaggtaccatggatgtggctgcaaccaagtctgcagactcaggagagaaacacagcactggcaaaagcagccttcagaggtccaggaggaagtatagccagcatggctattagtgggtgcttccatgtcttaatcttgttatagcaagggctgcatgcacattcttgtcctaaaagggtacttcaagcatatcagtaagtgctactggcctctccctagagggcagtatgaatgtggtggctacaggagcagagagatactgagaaggctgttgcattgacagtatctctctgctactcaaaggctgactctctgctactcagcattgggagtcagttatctcagctctgcaggatgaggccacatgcgtgaatgggatggaagccagagggtctctacctagctggattgactctgcagtaataacctcaaagcccagtactacacatggtgcagaggtggacatctcacctaagactgtggaggggaacaatgtgattcaccataataaaatccatcaactcaaaaaaaaaaaaaaaa

SEQ ID NO: 61715 - DNA, 3951 bp, Homo sapiens
cgcctgcttcctccgaagacttcagggagagtctgcgagctgccgtccccgcgtgtgaggcacagaagggctggatgtcagaaccgcataattattcattaaactacaaactttttttaacccaaagaatatcggtgatttttgtccactgcgaggagaagaagagagagcccagggctcatgaaatgcagcagaatccttatttataaacaggccgcggtagtgatatatgcaaccccagtctactcagtgagttttctatcctatggatatcggtcttgagagttgagattggagagcagcgccgtctgtactgggtcctgcagcctctgtcctttcaatgcctggttttttctgtgactgctggccttccctggagatcagagcgctcctgtatgccatgggctgtattcagagcatcggaggcaaagccagagtcttccgggaagggatcacggtgattgatgtgaaagcctccatcgaccccgtccccactagcatcgatgagtcctccagcgtggtgctccgctaccggacaccccacttccgggcctcggcccaggtggtcatgccgcccatccccaagaaggagacttgggtagttggctggatccaggcgtgcagccacatggagttctacaaccagtacggcgagcagggcatgtccagctgggagctccccgacctccaggagggcaagatccaagccatcagcgactcggacggggtgaactacccctggtacggcaacaccacagagacctgcaccatcgtgggccccaccaagagggactccaagttcatcatcagcatgaatgacaacttctaccccagcgtcacatgggccgtgcccgtcagcgagagcaacgtggccaagctcaccaacatctaccgggaccagagcttcaccacctggctggtggccaccaacacctccaccaacgacatgatcatcctgcagacgctgcactggcgcatgcagctcagcatcgaggtgaaccccaaccggcccctgggccagcgcgcccggctgcgggagcccatcgcccaggaccagcccaaaatcctgagcaagaatgagcccatcccgcccagcgccctggtcaagcccaatgccaacgatgcccaggtcctcatgtggcggcccaagtacgggcagccgctggtggtgatcccgcccaagcaccggtgacagccaggaccacccgctaggttagactcacaaataataataccgctgaaaacaaaactcagactcactcttcagtcattcagcaagatacaaccattctaccctctccagcgggcggatctcactgtgctgatgcccccgggaaggcctccccggctctcggcacctgcttcctttcagggagaggggagatctaagcaggacagacagaccccacgtgcgccctcagggtgacctctggtctccttgcctctcctttttctcagtttcagtcgctcacttgtaacagattccctgaaacactgctttttccgttttttaaaaaaactcctcttttgggggctcaggggcaggaggagggggagctgattaggagggaagctccagcccccgatcaaagagacagatccacactgctgccgatttgtggcgctggccggccttccccccaggtccctccgccctctgtcatgcggccttatgtagacttgctttgccaaacttttgccttaagctgaattgaaaggaagaaaaccaatcggagaaagaaagcaggatctcttttctaccggacttttcctcttctgccagaggtggagggagggttggggtcgcccgcgagagtctcttgagcccttcttcccggttgtcttgggagaagggtgaggatgggcatttagacccgaaaccagctgctcactctttctttttggcagaaataaaaccacaggtagattctgcctgaacagccccttctctccctccacccccaggtcgtatccctgcacctgcggagaggggctgtgagctctggcggggggtggctccaccagtcgcctggcctcttctcccctctcttcccagcagccttaacttcccttgggcggctctaggaggagagaggcaggctcctgtgagcccagggaattttcaccctctcagtcctcaggacccacccccagttgagtccctggcccttcctccaggtgtgtggctttttccttctccatccacactggtcccaaatgcctgggggccggccacctggaccgccgacacacagcctcaatgttagtctcaaaggtaaggaaggcattcacgtcccttcttgcagggcattttaagacttgaatcgggtgggccccggcccctgtggctggctggcccctggtgtactgtaaaagggccaagacagggctcgttctcaggggcgcccctcccaggccctcagggcagcgggacggtgcagtcaggctctgggtgccacagtgatggaggtggaaggcacccaagctctagggaagtcttgggaggcagtcggccgagcccctgcttcctgtcctcaaataagtgaatccaggccaagggctgggagggctgggtgggcttatcgtcgagagggttcagagccactctggaggctgggctggcacagtggagagcgacaggtgaggacagacgtctggaagcccatccctgggacctgccctcccttggtcccaggtcactggagctccagggcttacttagtcctgacccattgtgccagggttctgagcagtgtcggccttgtggccacttgcaggggctattaggggacatcccgctgaagccacgctccttccagcttgccaaacccacagctacccgcccgggacccacactcagcctaataattatcaagcacagaaaaccgtccatttagaaaaataatccatttctgctgcagatgagccacttgtaagagtctccgtgacagcgtgggacggtgtgggaaccaaagtccctgccctgctcctttgtccacgggctattgcgtttattcaaggggtgcttaatgaccgtttagccactgccgtcggtctccgggcccagctcgtgccaggaggctgtcctgggacacactgggctggagctgccggctggcacggtgctcagggggcccctgatgggggccaggacctccccgcagaaactgcaggttctcttgtgaggatggaggccgtgccaccccgaaaggcagtagccttaggggaacagtgggtcccagctgcatgtctgaggatgggtggggacagggctgggactcagctttcattcactggagacttctccactcaggtctttgttgcactaaagcagggacaggaccctgggggttcaggaagcgggtctcaggccgctggtttattcctggaggtggggctggagaccagaatggaaaggggcttcctgagctgctagggggtgaaggacccccgaacccgcatttcttgagtgagagcaaacactcgaggcaggagccagcacccctcccactgcatgcccggcccccagcccaccttgccccctgacccaccttcacccgtgccccttctttctgcccttcctcaccgaagaagggctaggaacaccctggagaggctgcaggtccggccacggacgctcagctgagccccggtctgctccttcagcctccttgctcttgttggagcacaggccccaggcttcctgccagggccccgattcttcttatgtcctccagccccgccctggcgtggacatccactcactccttccagcaataagaaccgtccttggtcgtggagagtactgtgaaacaaaccaatgcacttaccaggaggcacaagactcttgaagaagatgtaaaatgaaccttttttttttttacaaaaaacaaaaagcaaatattcataaagagaaataaaatgtaattttaaagtaaaaaaaaaaaaaaa

SEQ ID NO: 61716 - DNA, 1645 bp, Homo sapiens
gtcacccttgggaagaggccccagaaacaggaagaccttagttaggatgcaattacaattccttggtacattggcttcctcagaaaaaagaaaaaaatcacagagattgtttttcaaaaatatcaaatctacaaaaaataaagctggaaaagcaagcatcatgagttcagatacaaatgtaaacaaaagtgcctctccaactgcgactgcagaggaacagccagttgaacctgatggcccccttcctggctcagacaataaccaagaaaagaaagtaagattatctccagccaaaatgtcaaccaagaattctacagatctagttgaatatgttgacaagagtcatgcttttctccccatcattccaaacacccagagaggtcagctagaagacagactgaacaaccaggcgcgtaccatagctttccttcttgaacaagccttccgcatcaaggaggacatctctgcttgcctgcaggggacccatggctttcgaaaagaggaatcgctcgccaggaagttactggaaagccacatccagaccatcaccagcatcgtcaaaaaactcagccaaaatattgagattttagaagaccaaataagagctcgagatcaggcggccacaggaactaactttgcagtacacgagataaacatcaaacacctacaaggagttggagatcttcgaggaagagtagccagatgtgattcaagcattgtgaagctttctggagacattcacttattcaggcaagagcaccggcaaattgagaaagccattcaagaattcgtgcccgccctggaaactctttccaagaacttggacatgaaggtgatgcagctcttaggaaagattgaaactgccagttctgagcaaacctcgaatttaaagatggtccagggggattatcgccacgaaatgaaccttttggaattcaaatttcattcactttcaagtaatctgtacgaagaagttgagaataataaaaaatggacagaaaaccaatttctcaaatatagaaaagaccacctgggccatataaatgaatgtctgaaggtcctacaggagaaactggaaaagtctgaaaataaaatggaagaaaaactgctgcagctttcaagcaaagtagagaatttcattaacacacagaaacaggaaacacaactaagtaaagtaaagcatatggaaaataaattgtccaaaaagatggaacaaatggaaaagcagatctggggtgaattagagacaatgcagaatgaatatcaatcaggatttaaatcaattcatgactctctcagctccctccaacaaatacagaaaacaaagatggatttagagaaatataaagtacagaaagacctaaagaaattacagcgcaagatagtggaactccaggaagtataaaccttttcagtcatcttctttttcatcagccaatggagtgatttgttggaaaaagttctgaagaagaaagttactatctctgggatgtttactgcttctaatgtctccttttaaggagacgaatgtaccagaaaaataataaagcaaagaagcttaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 61717 - DNA, 1339 bp, Homo sapiens
aggaagtcctgccagcagctctcacgagaactgaggacccgttttctttacttttctttttttttgtttttttgttttgtttttttgggacggagtctggctcttgctgcctaggctgcagtgcagtggtgtgatctgggctcactgcaacctccgcctcctgggttcaagcaattctcctgcctcagcttcctgagaggacccgttttctaagaggtcctagtggtgccgctgcctgcaggttctttgagggcgccacatcaggggtccctcaggttcggggatcgcctctagcttcccaggacaaccagccacggatcctgtgggcaggagggctgccaaggcccagttggaggctcaatttatggcggcctgggggaagaagcatgcaggaaaggatccagtccgtgatgaatgtgaggaaagaaaccgttttacagaaacaagggaggaagatgtaactgatgagcatggggaaagagaaccttttgctgaaacagatgaacacacgggggctaataccaagaagccagaagatactgcagaggatcttactgcaaaaagaaaaaggatgaaaatggataaaacttgcagcaaaacaaagaacaaaagtaaacatgctttgagaaaaaagcaacttaaaaggcagaaacgtgattatatacattctctgaagttgctaaatgtccttgaagaatacatcacagacgagcagaaagaggaagaagaagaagagggagaagaggaagaactaattagaatatttcaagaacaacagaagaagtggcaacaatatagaagtgttaggagagagaggctgaaagagatgaagctgctacgtgaccaattcgtaaaggctcttgaggactttgaagacctttgtgacagagttttttccgatgaagacagtgaacttgataactagacatgtttttaaataaaatcatgtcagaactcttttggaaaagttggcacttacccagttgtctcttcaacctctgttattctgatgactgaagaaagaacttgaacctatgttatatgatacaagcacaacttgagctacagtaaactacatgacagtgttttgataattgttgtataaatcggtatagctcctctgtcactcgtctgttaaatgccagacctcgtttctatgatctgttgaatgaatcctagacacttctgtgagaaagcagggattgcatagttatgtacacggtcaattaaattttaacattaaagataatttagatttcgatttggcctctgtggatttgtatcagttccaaaaatgtagaaagcacaggcatagaaaagtacatttttctttaataaa

SEQ ID NO: 61718 - DNA, 1395 bp, Homo sapiens
catttcgcctccgggttgtcagggcaaccgtagcgacgccggccctggctgagaggcgttaggagtccgggggttcgcccgcggaggccggggagcagccgaccatggagccccagagaatcatgccaccctcaaagcctcatccacctgtcgtgggcaaagtgactcatcacagcattgaattatactgggatctggaaaagaaagccaaacgccaaggacctcaagagcagtggttcaggttctcgattgaagaagaagaccccaaaatgcacacttatggtatcatttatacgggatatgcaacgaagcatgttgttgaaggtctggaaccaaggacgctgtacagatttcgcctgaaggtcaccagcccctctggggagtgtgagtacagcccactcgtctcagtgtctacaaccagagagcccataagtagtgagcacttgcaccgggctgtcagtgtgaatgatgaagatttgctggtccgaatacttcaaggaggccgtgttaaggttgatgttcccaataagtttggctttaccgctctgatggttgctgcccagaaaggatacaccaggcttgtgaaaatcctagtttctaatggcacagacgtgaatctgaagaatggaagtggcaaggacagtctaatgctggcgtgctatgcgggacacctagatgttgtgaaatatctccgaagacatggcgcttcttggcaggctagagacctgggaggctgtacagctctgcactgggctgcagatggaggccactgcagtgtgattgagtggatgataaaggatggctgtgaggtagacgtcgtggacactggttcaggatggaccccactcatgagagtctctgcggtgtcgggaaatcagagggtggcctctcttctaattgatgctggggccaatgtgaatgtgaaggacagaaatggaaagacgccccttatggtggctgtgttaaataatcatgaagagttagttcagttacttcttgacaaaggggcagatgcaagtgtaaaaaatgagttcggcaaaggtgtcctagaaatggccagagtttttgacagacagagtgtagtctccttattagaagaaaggaaaaaaaagcagaggccaaagaagtcttgtgtctgctgatgagagcaccactcatctgcgaaacgcacgtaaaacaaagtgaaccgtgactgttaaactagggatgggaaattctgcatcttggggggctgtacatttatttatttagttgaagattcactgatcccactttgaaatacatctttttacctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 61719 - DNA, 1071 bp, Homo sapiens
gaggtgattttctgagtgtgactcctctgttcctggcaccctgtgcatccttagccatagcttacaagagaacagctggttgtgatggcaggaggccctcccaacaccaaggcggagatggaaatgtccctggcagaagaactgaatcatggacgccaaggggaaaaccaagagcacctggtgatagcagaaatgatggagcttggatctcggtcccggggtgcctcccagaagaagcagaagttggaacaaaaagctgctggctctgcttcagccaaacgagtttggaatatgactgccacccgacccaagaaaatggggtcccagctgccaaagcccagaatgctgagagaatcaggccatggggatgcccatctccaggagtacgctggcaatttccaaggcatacgtttccattatgatcgcaacccagggacagatgcagtggcgcagactagcctggaagagttcaatgtactggagatggaagtcatgagaagacagctgtatgcagtcaaccggcgtctgcgcgccctggaggaacagggcgccacctggcgccacagggagaccctgatcatcgccgtgctggtgtcggccagcattgccaacctgtggctgtggatgaaccagtgatcgccccagcgcggcctccgtattggagccctccctgcttccccttctttctttcctctttccccaggccgccactgcccttgcccctttcatctcccagcagccctcaggagcgtcaggatcattttcaactctggttaggcctcctacctggggaggccaggtcactgcactgggaggtcctggctgctgcgaagctggaggaggactgcgtgggctgagatgccaccctttgaagggtgaacagcatggcggcatctgggccccacagtaacacctagtggcaaccttgccttcctgacctcagcggcccttctgttccatcctctgtgggcaggggtgtggctttgttttcctccctcgtttgcttccacctcgtgcacagcgctctgcacagacaacacgctcaataaaagttcagccatagcagcaaaa

SEQ ID NO: 61720 - DNA, 2094 bp, Homo sapiens
acaatgctcagatcgggaggtggagccaatcaggtccaaccaagaggaggggacaccggcactccactagcaggaaaacgggccgagggaccgcaagcagggggtgcctagtcctcgtcccccaaagaccaatcgtaagccagatacaggcgagtgactgtcaagaaggccaattagagcctccgaagggaatctggacctgcctcttctctgagggacggctctacctaccaatagcatgggcgagaaggcggtccctttgctaaggaggaggcgggtgaagagaagctgcccttcttgtggctcggagcttggggttgaagagaagagggggaaaggaaatccgatttccatccagttgttccccccagagctggtggagcatatcatctcattcctcccagtcagagaccttgttgccctcggccagacctgccgctacttccacgaagtgtgcgatggggaaggcgtgtggagacgcatctgtcgcagactcagtccgcgcctccaagatcaggacacgaagggcctgtatttccaggcatttggaggccgccgccgatgtctcagcaagagcgtggcccccttgctagcccacggctaccgccgcttcttgcccaccaaggatcacgtcttcattcttgactacgtggggaccctcttcttcctcaaaaatgccctggtctccaccctcggccagatgcagtggaagcgggcctgtcgctatgttgtgttgtgtcgtggagccaaggattttgcctcggacccaaggtgtgacacagtttaccgtaaatacctctacgtcttggccactcgggagccgcaggaagtggtgggtaccaccagcagccgggcctgtgactgtgttgaggtctatctgcagtctagtgggcagcgggtcttcaagatgacattccaccactcaatgaccttcaagcagatcgtgctggttggtcaggagacccagcgggctctactgctcctcacagaggaaggaaagatctactctttggtagtgaatgagacccagcttgaccagccacgctcctacacggttcagctggccctgaggaaggtgtcccactacctgcctcacctgcgcgtggcctgcatgacttccaaccagagcagcaccctctacgtcacagatcctattctgtgctcttggctacaaccaccttggcctggtggatgaatttggccgaatcttcatgcaaggaaataacagatacgggcagctaggaacaggggacaaaatggaccgaggggaacccacacagggaccctggccgtgtgtccccaggtttgttacctgcagcggcccatcaccctgtggtgcggcctcaaccactccctggtgctgagccagagctcagagttcagcaaggagctgctgggctgcggctgtggggctgggggccgcctcccaggctggcccaaggggagtgcctccttcgtcaagctccaagtcaaggtccctctgtgtgcctgtgccctctgtgccaccagggagtgcctatacatcctgtccagccacgacattgagcagcacgccccctatcgccacctgccagccagcagggtggtggggactcctgagcccagcctgggggccagagcaccccaggaccccggggggatggcccaggcctgcgaggagtacctcagccagatccacagttgccaaacgttgcaggaccgcacggagaagatgaaggagatcgtagggtggatgcccctgatggccgcacagaaggacttcttctgggaggccctggacatgctgcagagggctgaaggaggcgggggtggtgtagggcccccagcccctgagacctaatccccctcatgctagcctagtccctggaggagggagtccggccccaggccagggactaaggagcaatgaccattgtgcacatgcgtgtgggaaggggttgctagggggtggggacggctaaccagggtaagaatgttcagggggctgcccaggaggggcccccaacctgactatcatggacaagagatttgatggatagaataaaaggctgcagcgaaaaaaaaaaaaaaaaaaaaaaaaaaaaaaaaaaaaaa

SEQ ID NO: 61721 - DNA, 2235 bp, Homo sapiens
acaatgctcagatcgggaggtggagccaatcaggtccaaccaagaggaggggacaccggcactccactagcaggaaaacgggccgagggaccgcaagcagggggtgcctagtcctcgtcccccaaagaccaatcgtaagccagatacaggcgagtgactgtcaagaaggccaattagagcctccgaagggaatctggacctgcctcttctctgagggacggctctacctaccaatagcatgggcgagaaggcggtccctttgctaaggaggaggcgggtgaagagaagctgcccttcttgtggctcggagcttggggttgaagagaagagggggaaaggaaatccgatttccatccagttgttccccccagagctggtggagcatatcatctcattcctcccagtcagagaccttgttgccctcggccagacctgccgctacttccacgaagtgtgcgatggggaaggcgtgtggagacgcatctgtcgcagactcagtccgcgcctccaagatcagggttctggagtccggccctggaagagagctgccattctgaactacacgaagggcctgtatttccaggcatttggaggccgccgccgatgtctcagcaagagcgtggcccccttgctagcccacggctaccgccgcttcttgcccaccaaggatcacgtcttcattcttgactacgtggggaccctcttcttcctcaaaaatgccctggtctccaccctcggccagatgcagtggaagcgggcctgtcgctatgttgtgttgtgtcgtggagccaaggattttgcctcggacccaaggtgtgacacagtttaccgtaaatacctctacgtcttggccactcgggagccgcaggaagtggtgggtaccaccagcagccgggcctgtgactgtgttgaggtctatctgcagtctagtgggcagcgggtcttcaagatgacattccaccactcaatgaccttcaagcagatcgtgctggttggtcaggagacccagcgggctctactgctcctcacagaggaaggaaagatctactctttggtagtgaatgagacccagcttgaccagccacgctcctacacggttcagctggccctgaggaaggtgtcccactacctgcctcacctgcgcgtggcctgcatgacttccaaccagagcagcaccctctacgtcacagaccaggggggagtgtattttgaggtgcataccccaggggtgtatcgcgatctctttgggacccttcaagcctttgaccccctggaccagcagatgccgcttgctctctcactgcctgccaagatcctattctgtgctcttggctacaaccaccttggcctggtggatgaatttggccgaatcttcatgcaaggaaataacagatacgggcagctaggaacaggggacaaaatggaccgaggggaacccacacaggtttgttacctgcagcggcccatcaccctgtggtgcggcctcaaccactccctggtgctgagccagagctcagagttcagcaaggagctgctgggctgcggctgtggggctgggggccgcctcccaggctggcccaaggggagtgcctccttcgtcaagctccaagtcaaggtccctctgtgtgcctgtgccctctgtgccaccagggagtgcctatacatcctgtccagccacgacattgagcagcacgccccctatcgccacctgccagccagcagggtggtggggactcctgagcccagcctgggggccagagcaccccaggaccccggggggatggcccaggcctgcgaggagtacctcagccagatccacagttgccaaacgttgcaggaccgcacggagaagatgaaggagatcgtagggtggatgcccctgatggccgcacagaaggacttcttctgggaggccctggacatgctgcagagggctgaaggaggcgggggtggtgtagggcccccagcccctgagacctaatccccctcatgctagcctagtccctggaggagggagtccggccccaggccagggactaaggagcaatgaccattgtgcacatgcgtgtgggaaggggttgctagggggtggggacggctaaccagggtaagaatgttcagggggctgcccaggaggggcccccaacctgactatcatggacaagagatttgatggatagaataaaaggctgcagcgaaaaaaaaaaaaaaaaaaaaaaaaaaaaaaaaaaaaaa

SEQ ID NO: 61722 - DNA, 1732 bp, Homo sapiens
cagctgcgcgggcggagcagaaagcaagtgattgctttcctttcctcatttttggaagccctgcctaacacacagctgcactgtacatcccagttcctggatggacgaagaaagtgaactgatccagccccaagaccagagctgctgggcctttctgcccgatttgtgtctgtgccgtgttttctggtggctaggagacagggacaggtccagggctgctcttgtctgcagaaagtggaaccagatgatgtattctgctgagctctggcggtacagaaccatcaccttcagcgggagaccttccagggtacatgcatctgaagttgagtcagctgtttggtatgttaagaagtttggtcgttatctggagcacctggaggtcaaattcatgaatccttacaatgctgtcttgaccaagaagttccaggtcaccatgcggggcctcctgtcttgtctgagtaagagcaacaaccgtctgaaatctctttccatccaatacctggagctggaccgcctggtatggaggaacagcatcaggagctcattcatcagcagcttgagcttcttcttaaagaagatgggcaaacgcctggattatctcaacctaaaaggggccaggctgaccgtggagcaaggctgccaaattctcgactccctcagctacatgaggaatgagaatgtgatctcagagctcaacatcgaggactatttcagccatcaccttgctgtctacaacagcccccagttcaaaaagaccatgtccacattccacaatcttgtgtccctgaacctcaactacaactgtatctccgacgagctgcttgagaacttgtgtgagaatgccagcaccctccggaccatcaacatcaaatgccacgttcatgacccccacggacaggtcatctggggtatgtcctgggccaagctggccaggcaggccaccaatctgaaggtgaacttcttctttgaacggatcatgaagtacgaacgcttggcccgaatcctcttgcaggagatcccgatcaggagcatcagtctgagaagctgctatttcagtgacccagactgttcaatgagacccactctgatagatctcctgcccaccttccggcacactctgcagaaattaacttgtgaattcaacaacaaccatgagtcactcgacgaggagctgcacctcctcattatatcctgcaggaagttgttttacttcaaaatctgggctttccttgatgttagttttgtggagcggatcctgaagagtcagaaagaacggcagtgtgccctgcgtgtattcaaggcgagaatttatacaaacagatatgagacgaatgaagaggacaagaccctgcaggaaatttacaggaagtacagaaagctgatcgaatcagagcttagctattttgtcatcgtttactctgtgatgtaatgagcactctacagatgaagaaagctgggagcactttgaacttgaaaatcatttctcttagaactacacttgggcactgccagcccttttgctcctctctctccccccgcttttttttcttttgtcagctccatgacaacatgaccagctcagcaaaggctgagactgcccatgacctgaaggctccaggtggctttaaagcgctatgtttaccaactaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 61723 - DNA, 7349 bp, Homo sapiens
gctgcagcctgctgttgagtgagaaaacaaaattatcttcctttccaaatccaaaaagatgaaaacgactgagatactttcaaaagacaaccaagtgagcagcacagactaatgagtagaatcaataagaacgtggttttggcccttttaacgctgacaagttctgcatttctgctgtttcagttgtactactacaagcactatttatcaacaaagaatggagctggtttgtcaaaatccaaaggaagccgaattggatttgatagcacacagtggcgtgcagttaaaaaatttattatgttaacatccaaccaaaatgtaccagtgtttcttattgatcctttgatactggaattgattaataagaactttgaacaagtcaaaaatacttctcatggctctacttcacaatgcaagtttttctgtgttccaagagactttactgcatttgcactgcagtatcacctatggaagaatgaggaaggctggtttcggatagctgagaatatgggatttcagtgcctaaagattgagagtaaagatccccggctagacgggatagactcactctctggaactgaaatccccctgcactatatctgcaaactggccactcatgcgatccacttggtagtctttcatgagaggagtggcaactacctctggcacggccacttgagacttaaagaacacattgacaggaaatttgttcccttccaaaagttacagtttggtcgttatccaggagcttttgacaggccagagttacagcaagttactgttgatggactggaagttctcattccaaaggatccaatgcactttgtagaagaagtaccacactctaggtttattgagtgtaggtataaagaagctcgagcattctttcagcagtaccttgatgataacactgtggaagctgtggcctttcggaagagtgcaaaggaattactgcaactagcagcgaaaacattaaacaaattgggagtaccattctggctgagcagtggaacttgtctaggatggtatcgacaatgcaacattattccttatagcaaagatgttgacctaggaatttttatacaagattacaaatctgatattattttagcatttcaggatgcaggacttccgctcaaacacaaatttgggaaggtagaagacagcttggaactatccttccagggaaaagatgatgtaaaacttgatgtttttttcttctatgaagaaactgatcacatgtggaatggaggcactcaggccaaaacaggaaaaaaattcaaatacctgtttccgaagtttacactgtgctggactgagtttgtagacatgaaggtccatgtaccctgtgaaaccctcgaatacattgaagccaactatggtaagacctggaagattcctgtaaagacgtgggactggaagcgctctcctcccaatgtgcaacccaatggaatctggcctatttctgagtgggatgaggttatccagttatattgagatagtaggttgaaatgggagaatttctcttttggaaaaaaaggtagataactgtttaaaaaatacatgtctatttgtcaaacataagtgggaaccaaagaaaaaatgtgacaagtttgaagacacagaaagagtcatctgatgtaattctctcacttagtactgaggaattttcatgtgccacatacaatgctaggttacagtggagaagccaagatgaatgagacaaatacctacttcttttattcctccttttggtaaacaactcaattttcctttgagggaaccctcccccaccctttgaagagttcaagttctgtacaggtttttaaaacgtgaagtaatgtttgaactggaagatgagctcaccaggcaaagctaaggaaggatatactagttgaaaagaataacccactcctcttctgggcatttaagctggtatgttagtgctacttttaagattgtggagtctgagttaatattcaagtgatcagactttgagtgacatcaagaaaagatgatatcaggttcatttttcaactaatcttatgtggaattgaattagagaacaaggcattattcttttagggaaggtgagagcttatttgtatcagagcttattacttgtcaggataagtaaatttctgtacatgtactgttttcatatgtgaagtgagaagaaactttatgcttgtttaatgcttaaatttccatccattgtgagaatattttcactgacctctgatggcacttgttgacaaatcattcaagtgagaccatgttactagacatgatcttgaaagaggccatgatttcacaaaactcatttttattttattctcagacagtctgttaggtaaaaatatgagaaattcatgtacattttatattttctgaatttataatctgtgcactcccaattttaatgacactaaaatattaatagaattttttaaatatactctaatttttaaaacatactctttattatcttcatttatcaattacagcttcgtatctctaatttatggtctatataccaatttaaatggcatgtaaacctgcctgtttcttctcctcttctaatatatcagatctccaaaatggaagctaaatggtggacttgacaactattcaccctacctcagatcatagagtttgtaaagtttgtgtccctccccagtttttcagtctgttgaatgtcgatggggcaagaactcagacttctactttaccaagtaccacacactctggaatgctttagtttccttttcccctcaagatgtctgagtcagctaggatgctgtttaccccatctctctcttatatcacttgaatgatatattgtaagtgagaggtaaaggaaaatgtaggcacaataagcactgctatttttctctttgtctaggaaaggaagctgaatcttatatcttatctatgctatttaggactactttctggagcttggcagattttcctctgacaccagagaacaatagtagtctcaagaatggaaacctgaatgtctgagggaatgggctggtagactttttcgaaaacaaattagagaaagtaacttacaaccacccattccggatttgtaaagcaacatgaaaacctttgataaatgataaccaacagtcttctgtcctaatttgcattctcaatgcagaattattgggtctttcataaacaacatgagtggtttctggagacatttaagattgtcagcaaacttgtcccaaaatggcacatcatcataatccattttctctttgctagaaaatcagcccatagagtgcattcccaaattctaaatagctgaccctaaattcatttttcatgcttaaaaataatagaacaaataataatactatttttgggcaaaatccaccctacttgatgaggaccatttgcttgtgctcagtatttagaaatgcatacactccacatttctccccatttccaattgggactcccattctttgccaggagatcttacccatcccttttcagattaatcttttatcctttcctgaagtacaaagtcttaagagtgtctgaaatccaagacatcttggcccaattgacacaggttctatattcttccctacatagaccactggctgctgaaatacttttcttgtcttctggtttcacaggcttcagctcatgggttccaccctaacttggggaaacaaaagccttctctagaatctgaaggccaggcttacctctgattctgattcatccatacttcatcttatgtattttaacagttgggttctgtggagtgtccagagaccttgggttaggtatatccatcttcagtacctcattggatcacttttctttcatcacttgagtattctagcagtcattctcctaatctgaccactttcaggtttagtttacctggcttaccaggggaagttgacaacttgttggtagttaggcacccatgaatgtctccagagacatcctgagaggcaagattcctcttaattgataaccaggacaaccaggtagtcacccagtcctctctaagcagggagcacttgtccttctctcctctgctgcagctactgatatctggcccctggaataaaaccatagttcctaaaattgagcatccctaagagtagctgcttggtgggacagctgatttctttgattccctagctgcaaaacctgaaattgaccactaggtgacagaatgtttgccagtatccccacaaaacaagttaaaacttaagtgaaaatcattctgcttttgaatcttaaaagctagaaaaaccataatgtaatattctttttaaaccctcttattttataactaaataaataatcacagaaaagaatgatctgaacaagaacagctgaggctaaaacccaagactgccgtgactcctagtccaatgtctgtttcgcatcacaacacagtatctttaacagtgcttgagatgcttaacagagaaggcatccagtgcttcattgaggctaagtctcagggtgtttctgccgcttagtatctttttgttcagattgagaacctaaggcgacagagaggtcaaggggaagtattttctagttcagaattcagaattcttaggcaaccttcatacctttatctggaaaatgccttctctccagacaataagacagttcacatctggagacatcagcctttggtacctaattctctaagctcaagatgcatcccattgccactttaccattctatttcccaagggaaccatcagcaccaacctgctaaatgcctgtatttgaagtctctccccttcctgaagtgaccttttatgaggctctttccttcctaagggacctttccctggtagtagtggtctcattcacaaaaaagaataatagatgtaactggagtcactttgcagttttcaagattttttttttatctgcttggctggaaaggagactagagtatctagtttttagtatttaaactacttttaattatttatattgatactctctgataaatgcaggtagttaagaatagattgtactcattcctttttgagtttgtgacctcaaaccattgtttttattcttacacgactacagtacttcaaatggcacatagataggcaggatattacataggtaagcaggaatttatacattgggtaccagagctaaatctggaaaacacatttggaatgagcttccacacttcagtctaaaatctcacccaaacttatggctacatatttttctaagtttcccccctagtttcactttctggaaagtgaacagttttttaaatcctaaatgttataaatccttaggagaaatattccctcaaaacctagtcaagaaagtgccacattcccaccttctaacaggtaattattagttgtaatagctttaatgcatggaaaaacttcagttactgaccagtcaagagaatttctcaagaaaaatcccagcaacgttccctctttcctccttgtcttccactatcattaagacctgggctagatcacctctaacatctcactcagggaaggcaatgtgttgccataaaaagaccacaagcttttgagttaggcctgaatttgaatttcagcttaatcatgtgggatttatggtgggggccctttcagtctcaatttccacattagtgaactggggaaatgatacatacttctaagggtttttagggggattaaatgaagtatacagttcttagcctcaggcctaggattaagtaagtactcaagaaatgtgcaattttctagttccatgtttcttttctaatcttcaaatggaattatagaaaccatgggtcagaacatattcctttactcaaaagattgcatgactgaatttgcttaagaaaaaaaaaattgtatcaagtcattaatacaattatacattaattatattacattaatacaatatatggtttgtgaattcagagacattaccagtttgcctccttctctcaatagaacttgtattttcattttcttggttaagcagttgtctcctaatattatcccatatgctacctagtttgctggtcccaagcagtttactgtacttcactagatttggtacctgctctcccctggacttctttttcaatattctagcctttcctagatgtaaatctttacctccttgttagtgaaattagatataagccatgatttggagagggaagaaatctggaatacttaatttcatttaattatctatgctgatgaatgcctgtatcattgttaataaaggagaattgaaaatactcatttctactttctgccctcaaatttctgtttctatctcaactaggcaagaatcagcagggtgcatgatgccattttaagctgcttcacatcagactgaaatcctaattacagttcataagtgaaacagactaattcaatggcaataccttttgtataggtcctgtgcttaaaggaggcaagtataaattttctaataagaaatccctgcttcttttgggtgcagtggctcacacctgtaataccagcagtttgagaagctaaggcaggtggatcacttgaggccaggagttcgagaccagcctggccaacatagtgaaaccccgtctcttctaaaaatacaaaaaaattagctgggcatggtggtgcacgcctatagtcccagctacacaggaggctgaggcaggagaatcacttgaacccgggaagcagagtctgcagtgagccaagatcgcggcattgcacttcagcctgggcgatagagcaagactctgtctcagaaaaaaaaaaaaggaaagaaagaaatctctgcttccgtactatcaaaacttctaccctagaataccccctggcaccttctaacccaacctaatacagagattttgtagggacccattaacaagctcctatataattataagcagctctcacagtagggttgaaagagaatataaggaaaattagaagtactgtatttttgctattggaaatgaaatattgtttcatgcacctttgaaaaaaataacaggattttacagccttctgatgattcattcaaagcatggggaatagttcatatgtttgttaaatgaaaatcttatgtagcaatttgtgtgtccctcccacttcataactacaaaaacatatatatgaatttctaaacaaagtgatattttaaagatgaattgattcaatgtgtacttaccagtttactgtgtggttttatcttcaggtacagatagtttgtggtactacttgaaaatacctttaatattattttcatcagaatttgtaatatataatccagtttgggatgatgaataaaatttttctaatctcttg

SEQ ID NO: 61724 - DNA, 2412 bp, Homo sapiens
gagctggagactccgcgggagcgcggccgggaggcttcgccccggagctggcccgacgcctcccgagctggcagggctctcggcggaggtcggagcgtgggcttcctcctcccgccagggaaaacagagaggatgaaggcctatctaaagagcgcagaaggcttttttgtcctaaataaaagtaccacaattggaaggcatgaaaattcagaccttgttttacagtctcctgacatcgacaaccaccatgcactcattgaatataacgaggcggagtgcagctttgttctccaggacttcaattcccgcaacggcacgtttgtcaacgagtgccacattcaaaacgtggctgtgaagctcatccctggagacatcctgagatttgggtctgcagggctgacctatgaactggtcattgaaaatccacctccggtctctttcccatggatgaggggcccagcaccatggccagggccacagccacctcgtgccacacagcagccaaaccaggcccccccaccatcacatatccccttccaccaaggtgtccagccagcaccgatgcaaaggagctggtcccaggcctttcccagacccaccgtggtcctgccggcctcccacaggcggcctgtgagcgccaacaaggagatgttctcgttcgtggtggacgacgcccgcaagccacccgtcatcaagcaaggcctcagggaaactcatgatgtcttttgtgctctctgctgatctcacgccttagtgtggaccaatgccatgaaactgtcagaaaaatcagtggccgaggggattcctggggcagttccccctgcggagatttatgtggaggaggacttggcccagcaggacaagatcagtgccctacagaaaggctacagcaaggtgctgtgccagaccctgtcagagcggaactcagaaatcacatccctgaagaatgagggcgagaacttaaagagagacaacgctatcacatcagggatggtgtcatctttgcaaaaagacatattagcaaaggatgagcaagttcaacaactaaaggaagaggtcagtcacctaaaaagtcagaacaaggacaaggaccaccagctggaagcccttggctctagatgctcggtgctaaaggaagagttaaaacaggaagatgctcacagggagctcagggaagcccaggagaaagagttaaaactctgcaaaacccaaatccaagacatggagaaagaaatgaagaagcttagggcagagctgaggaagagttgtactgaacaaagcgtgatctctaggactctgagagaaaaaagcaagctggagcacttcagaagtcaagtcatcaaggccacctatggacgggcgaagccgttccgggacaagcccgtcaccgaccaacagttaatagagaaaattacccaggtcactgaggacaacatcaattttcagcagaaaaagtggaccctccagaaagagacccagctgagcaactccaagcaggaggagaccaccgagaacatcgagaagctgaggacgtcgctggacagctgccaggcttgcatgaaaatatcctgttgcagccatgacctgaagaaggaggtcgaccttcttcagcacctccaggtgagcccacctgtctcggggctccagaaggtggtgctggacgtcctgaggcacgcgctgtcctggctggaggaggtggagcagctcctccgggacctcgggatcctgccctccagccccaacaaagggttctctttgtatctgatatatcttctggaacattataaaaaacttatgagccaggcccaggaacttcagatcaagttcaacagttctcaggaaactcagcagtctttactgcaggaaaagctgcgggagcatctggcagagaaggagaagctgaacgaggagaggctagagcaagaggagaagctcaaagccaaaatcaggcaactgacggaagagaaggcggctttggaggagtacattactcaagagagaaacagagcgaaagagactttagaggaagaacggaagagaatgcaagaactggagagcctcctggcccagcagaagaaggctttggcgaaaagcattacccagtggaaagtactagagaaacctcgtcccaccaggcctcatgtgatcctctaccagaagctggagcagccaccttggggatcagcagacaccagcagcaggccaaaggatagtggagtggagggacaagaaggcctgggtgagccttctctgagaatcactgagctctgaaccatgaatgaactgcctacctctgtacttcctgttgtataggacaaagaaatccctatctatttaaaccactgtagtcaggtctatgtatttgtgctgtggaacaaaccacccaaactgagtgacttaaaatgacaaata

SEQ ID NO: 61725 - DNA, 3981 bp, Homo sapiens
ccatgtaagaagtgcttttcgcctcccaccatgattctgaggcctccccggccatgtggaactatcagtgccctacagaaaggctacagcaaggtgctgtgccagaccctgtcagagcggaactcagaaatcacatccctgaagaatgagggcgagaacttaaagagagacaacgctatcacatcagggatggtgtcatctttgcaaaaagacatattagcaaaggatgagcaagttcaacaactaaaggaagaggtcagtcacctaaaaagtcagaacaaggacaaggaccaccagctggaagcccttggctctagatgctcggtgctaaaggaagagttaaaacaggaagatgctcacagggagctcagggaagcccaggagaaagagttaaaactctgcaaaacccaaatccaagacatggagaaagaaatgaagaagcttagggcagagctgaggaagagttgtactgaacaaagcgtgatctctaggactctgagagaaaaaagcaaggttgaagagaagcttcaggaggattccagaaggaaattgcttcagctgcaagaaatggggaacagagagagcgtcattaaaatcaatttggagagggcagtaggtcagctggagcacttcagaagtcaagtcatcaaggccacctatggacgggcgaagccgttccgggacaagcccgtcaccgaccaacagttaatagagaaaattacccaggtcactgaggacaacatcaattttcagcagaaaaagtggaccctccagaaagagacccagctgagcaactccaagcaggaggagaccaccgagaacatcgagaagctgaggacgtcgctggacagctgccaggcttgcatgaaaatatcctgttgcagccatgacctgaagaaggaggtcgaccttcttcagcacctccaggtgagcccacctgtctcggggctccagaaggtggtgctggacgtcctgaggcacgcgctgtcctggctggaggaggtggagcagctcctccgggacctcgggatcctgccctccagccccaacaaagggttctctttgtatctgatatatcttctggaacattataaaaaacttatgagccaggcccaggaacttcagatcaagttcaacagttctcaggaaactcagcagtctttactgcaggaaaagctgcgggagcatctggcagagaaggagaagctgaacgaggagaggctagagcaagaggagaagctcaaagccaaaatcaggcaactgacggaagagaaggcggctttggaggagtacattactcaagagagaaacagagcgaaagagactttagaggaagaacggaagagaatgcaagaactggagagcctcctggcccagcagaagaaggctttggcgaaaagcattacccaggagaagaacagagtgaaggaagcattagaggaagagcagacaagagtccaagagctggaggaacgcttggcccgccagaaggagatctcagagagcaacattgcgtacgagaaacgcaaagcaaaggaggccatggagaaggaaaagaaaaaggtgcaagacctggagaatcgcttaaccaagcagaaagaggaattagaattaaaagagcaaaaagaggacgttttaaataataaattaagtgacgcactggccatggttgaagagactcagaaaacaaaggcaactgaaagtctaaaagcagagagcctcgccttgaaattaaatgaaacattagccgaactggaaactaccaagacaaaaatgatcatggtggaagagcggctaatcctgcagcagaagatggtaaaggccctccaggatgagcaggaatcacagagacacgggtttgaagaagagatcatggaatataaggagcaaatcaaacagcacgcccagacaattgtgagcctcgaagagaaactccagaaagtcactcagcaccataaaaaaatagaaggcgagattgcaacattgaaggacaatgacccagccccaaaggaggaaaggccgcaagaccctctggtggctcccatgacagagagcagtgccaaagacatggcgtacgaacatctgatagatgacttattggctgctcagaaggaaattctgtctcagcaggaagtcatcatgaagttaaggaaagaccttaccgaagcccacagcagaatgtcggatttgagaggggagctaaacgagaagcagaagatggaactggagcagaacgtggtgctggtccagcagcagagcaaggagctgagtgtgctcaaggagaagatggcccagatgagcagcctggtagaaaagaaagatcgggagctgaaggcccttgaggaggcactcagggcttcccaagagaaacacagactccagctgaacacagagaaggaacagaagccccggaagaagacccagacgtgtgacacctctgtgcagatagaacccgtccacactgaggccttctccagcagccaagagcagcaatccttcagcgatctaggggtcaggtgcaaagggtcccggcacgaggaggtcattcagcgtcagaaaaaggccttatctgaacttcgagcgcgaattaaagaactcgagaaggcgcgctcaccagatcataaagaccaccagaatgaatcatttctagatttaaagaacctcagaatggaaaacaatgtccagaaaatactactggatgcaaaaccggatttgccaactctctcaagaatagagatcctagcgcctcagaatggcctttgcaacgcaaggttcggctcagccatggagaagtcagggaagatggatgtggctgaggctttagagctcagtgaaaagctgtacctggatatgagcaaaaccctcggaagtctcatgaacatcaagaatatgtcaggccacgtgtccatgaaatacctctcccgccaggagagggagaaggtcaaccagcttcgacaaagggacctcgacctggtgtttgataagatcacccaactcaagaaccagctggggaggaaagaggagctgttgagaggatatgaaaaggacgttgaacagctcaggcggagcaaagtgtccattgagatgtaccagtcgcaggtggcaaagctggaggatgatatctacaaagaggccgaagagaaggccctgctgaaggaggccctggagcgcatggagcaccagctgtgccaggagaagaggatcaacagggccatccggcagcagaaggaaagtgtagaggagcacgaactgagaaacgcaaaagaatcgacaccttgcaactgtgccttcaaagagaaagacaggcaggccctgccccacctgcctgcagtttgaacggatgacctaagagacaagcacgcgtccagccccgtctgtccattaagagtcttgctctattgcccaggctagagtgcagtggtgcaatttcggctcactgcaacctccacctcccaggttcaagcgattctcctgcctcagcctcccgagtagctgggactacaggttggaaccagaaaagcctccctaaagatggaccaagaaagagagatgctgaggaaagagacctccagcaagtccagccagagccttttgcattctaagcccagtggaaagtactagagaaacctcgtcccaccaggcctcatgtgatcctctctaggacgggccatgttggaccaatctggctaatgacatataaggaaaagctcctgtggagggcttcccttccagcttctctaggtgaaagcattcacccttggtacctttgtcttgtctcctttctcactcctggagctcagaccagaagctggagcagccaccttggggatcagcagacaccagcagcaggccaaaggatagtggagtggagggacaagaaggcctgggtgagccttctctgagaatcactgagctctgaaccatgaatgaactgcctacctctgtacttcctgttgtataggacaaagaaatccctatcta

SEQ ID NO: 61726 - DNA, 2412 bp, Homo sapiens
gggctggagactccgcgggagcgcggccgggaggcttcgccccggagctggcccgacgcctcccgagctggcagggctctcggcggaggtcggagcgtgggcttcctcctcccgccagggaaaacagagaggatgaaggcctatctaaagagcgcagaaggcttttttgtcctaaataaaagtaccacaattggaaggcatgaaaattcagaccttgttttacagtctcctgacatcgacaaccaccatgcactcattgaatataacgaggcggagtgcagctttgttctccaggacttcaattcccgcaacggcacgtttgtcaacgagtgccacattcaaaacgtggctgtgaagctcatccctggagacatcctgagatttgggtctgcagggctgacctatgaactggtcattgaaaatccacctccggtctctttcccatggatgaggggcccagcaccatggccagggccacagccacctcgtgccacacagcagccaaaccaggcccccccaccatcacatatccccttccaccaaggtgtccagccagcaccgatgcaaaggagctggtcccaggcctttcccagacccaccgtggtcctgccggcctcccacaggcggcctgtgagcgccaacaaggagatgttctcgttcgtggtggacgacgcccgcaagccacccgtcatcaagcaaggcctcagggaaactcatgatgtcttttgtgctctctgctgatctcacgccttagtgtggaccaatgccatgaaactgtcagaaaaatcagtggccgaggggattcctggggcagttccccctgcggagatttatgtggaggaggacttggcccagcaggacaagatcagtgccctacagaaaggctacagcaaggtgctgtgccagaccctgtcagagcggaactcagaaatcacatccctgaagaatgagggcgagaacttaaagagagacaacgctatcacatcagggatggtgtcatctttgcaaaaagacatattagcaaaggatgagcaagttcaacaactaaaggaagaggtcagtcacctaaaaagtcagaacaaggacaaggaccaccagctggaagcccttggctctagatgctcggtgctaaaggaagagttaaaacaggaagatgctcacagggagctcagggaagcccaggagaaagagttaaaactctgcaaaacccaaatccaagacatggagaaagaaatgaagaagcttagggcagagctgaggaagagttgtactgaacaaagcgtgatctctaggactctgagagaaaaaagcaagctggagcatttcagaagtcaagtcatcaaggccacctatggacgggcgaagccgttccgggacaagcccgtcaccgaccaacagttaatagagaaaattacccaggtcactgaggacaacatcaattttcagcagaaaaagtggaccctccagaaagagacccagctgagcaactccaagcaggaggagaccaccgagaacatcgagaagctgaggacgtcgctggacagctgccaggcttgcatgaaaatatcctgttgcagccatgacctgaagaaggaggtcgaccttcttcagcacctccaggtgagcccacctgtctcggggctccagaaggtggtgctggacgtcctgaggcacgcgctgtcctggctggaggaggtggagcagctcctccgggacctcgggatcctgccctccagccccaacaaagggttctctttgtatctgatatatcttctggaacattataaaaaacttatgagccaggcccaggaacttcagatcaagttcaacagttctcaggaaactcagcagtctttactgcaagaaaagctgcgggagcatctggcagagaaggagaagctgaacgaggagaggctagagcaagaggagaagctcaaagccaaaatcaggcaactgacggaagagaaggcggctttggaggagtacattactcaagagagaaacagagcgaaagagactttagaggaagaacggaagagaatgcaagaactggagagcctcctggcccagcagaagaaggctttggcgaaaagcattacccagtggaaagtactagagaaacctcgtcccaccaggcctcatgtgatcctctaccagaagctggagcagccaccttggggatcagcagacaccagcagcaggccaaaggatagtggagtggagggacaagaaggcctgggtgagccttctctgagaatcactgagctctgaaccatgaatgaactgcctacctctgtacttcctgttgtataggacaaagaaatccctatctatttaaaccactgtagtcaggtctatgtatttgtgctgtggaacaaaccacccaaactgagtgacttaaaatgacaaata

SEQ ID NO: 61727 - DNA, 3981 bp, Homo sapiens
ccatgtaagaagtgcttttcgcctcccaccatgattctgaggcctccccggccatgtggaactatcagtgccctacagaaaggctacagcaaggtgctgtgccagaccctgtcagagcggaactcagaaatcacatccctgaagaatgagggcgagaacttaaagagagacaacgctatcacatcagggatggtgtcatctttgcaaaaagacatattagcaaaggatgagcaagttcaacaactaaaggaagaggtcagtcacctaaaaagtcagaacaaggacaaggaccaccagctggaagcccttggctctagatgctcggtgctaaaggaagagttaaaacaggaagatgctcacagggagctcagggaagcccaggagaaagagttaaaactctgcaaaacccaaatccaagacatggagaaagaaatgaagaagcttagggcagagctgaggaagagttgtactgaacaaagcgtgatctctaggactctgagagaaaaaagcaaggttgaagagaagcttcaggaggattccagaaggaaattgcttcagctgcaagaaatggggaacagagagagcgtcattaaaatcaatttggagagggcagtaggtcagctggagcatttcagaagtcaagtcatcaaggccacctatggacgggcgaagccgttccgggacaagcccgtcaccgaccaacagttaatagagaaaattacccaggtcactgaggacaacatcaattttcagcagaaaaagtggaccctccagaaagagacccagctgagcaactccaagcaggaggagaccaccgagaacatcgagaagctgaggacgtcgctggacagctgccaggcttgcatgaaaatatcctgttgcagccatgacctgaagaaggaggtcgaccttcttcagcacctccaggtgagcccacctgtctcggggctccagaaggtggtgctggacgtcctgaggcacgcgctgtcctggctggaggaggtggagcagctcctccgggacctcgggatcctgccctccagccccaacaaagggttctctttgtatctgatatatcttctggaacattataaaaaacttatgagccaggcccaggaacttcagatcaagttcaacagttctcaggaaactcagcagtctttactgcaagaaaagctgcgggagcatctggcagagaaggagaagctgaacgaggagaggctagagcaagaggagaagctcaaagccaaaatcaggcaactgacggaagagaaggcggctttggaggagtacattactcaagagagaaacagagcgaaagagactttagaggaagaacggaagagaatgcaagaactggagagcctcctggcccagcagaagaaggctttggcgaaaagcattacccaggagaagaacagagtgaaggaagcattagaggaagagcagacaagagtccaagagctggaggaacgcttggcccgccagaaggagatctcagagagcaacattgcgtacgagaaacgcaaagcaaaggaggccatggagaaggaaaagaaaaaggtgcaagacctggagaatcgcttaaccaagcagaaagaggaattagaattaaaagagcaaaaagaggacgttttaaataataaattaagtgacgcactggccatggttgaagagactcagaaaacaaaggcaactgaaagtctaaaagcagagagcctcgccttgaaattaaatgaaacattagccgaactggaaactaccaagacaaaaatgatcatggtggaagagcggctaatcctgcagcagaagatggtaaaggccctccaggatgagcaggaatcacagagacacgggtttgaagaagagatcatggaatataaggagcaaatcaaacagcacgcccagacaattgtgagcctcgaagagaaactccagaaagtcactcagcaccataaaaaaatagaaggcgagattgcaacattgaaggacaatgacccagccccaaaggaggaaaggccgcaagaccctctggtggctcccatgacagagagcagtgccaaagacatggcgtacgaacatctgatagatgacttattggctgctcagaaggaaattctgtctcagcaggaagtcatcatgaagttaaggaaagaccttaccgaagcccacagcagaatgtcggatttgagaggggagctaaacgagaagcagaagatggaactggagcagaacgtggtgctggtccagcagcagagcaaggagctgagtgtgctcaaggagaagatggcccagatgagcagcctggtagaaaagaaagatcgggagctgaaggcccttgaggaggcactcagggcttcccaagagaaacacagactccagctgaacacagagaaggaacagaagccccggaagaagacccagacgtgtgacacctctgtgcagatagaacccgtccacactgaggccttctccagcagccaagagcagcaatccttcagcgatctaggggtcaggtgcaaagggtcccggcacgaggaggtcattcagcgtcagaaaaaggccttatctgaacttcgagcgcgaattaaagaactcgagaaggcgcgctcaccagatcataaagaccaccagaatgaatcatttctagatttaaagaacctcagaatggaaaacaatgtccagaaaatactactggatgcaaaaccggatttgccaactctctcaagaatagagatcctagcgcctcagaatggcctttgcaacgcaaggttcggctcagccatggagaagtcagggaagatggatgtggctgaggctttagagctcagtgaaaagctgtacctggatatgagcaaaaccctcggaagtctcatgaacatcaagaatatgtcaggccacgtgtccatgaaatacctctcccgccaggagagggagaaggtcaaccagcttcgacaaagggacctcgacctggtgtttgataagatcacccaactcaagaaccagctggggaggaaagaggagctgttgagaggatatgaaaaggacgttgaacagctcaggcggagcaaagtgtccgttgagatgtaccagtcgcaggtggcaaagctggaggatgatatctacaaagaggccgaagagaaggccctgctgaaggaggccctggagcgcatggagcaccagctgtgccaggagaagaggatcaacagggccatccggcagcagaaggaaagtgtagaggagcacgaactgagaaacgcaaaagaatcgacaccttgcaactgtgccttcaaagagaaagacaggcagcccctgccccacctgcctgcagtttgaacggatgacctaagagacaagcacgcgtccagccccgtctgtccattaagagtcttgctctattgcccaggctagagtgcagtggtgcaatttcggctcactgcaacctccacctcccaggttcaagcgattctcctgcctcagcctcccgagtagctgggactacaggttggaaccagaaaagcctccctaaagatggaccaagaaagagagatgctgaggaaagagacctccagcaagtccagccagagccttttgcattctaagcccagtggaaagtactagagaaacctcgtcccaccaggcctcatgtgatcctctctaggacgggccatgttggaccaatctggctaatgacatataaggaaaagctcctgtggagggcttcccttccagcttctctaggtgaaagcattcacccttggtacctttgtcttgtctcctttctcactcctggagctcagaccagaagctggagcagccaccttggggatcagcagacaccagcagcaggccaaaggatagtggagtggagggacaagaaggcctgggtgagccttctctgagaatcactgagctctgaaccatgaatgaactgcctacctctgtacttcctgttgtataggacaaagaaatccctatcta

SEQ ID NO: 61728 - DNA, 2161 bp, Homo sapiens
agatgattccctgattctccagagagattacacacttcgtttgtggctaaggtgacccaatgaaagaagaaaatgaaagccataaagaaaagtcttacagaagaagaatacctgtacctggacttttctcaccaaacagaaggatgcatctttcctcttcatacatctgtaactttatttctgttatcttactgtgactgtaaaatctttaaaatttgcttagttgtcaccaaagaggtgagtagagatagttcactactaagagatgacctgatccaggatgttgaaatacagattatttcaaggcaggagctcccaccaatagtccaaaattgctgtttgcctgcagtagtagaacgatcagacaatttttgtagagcaggacttgctgttgtattgagacacataatccagaaatcctatgaagcagaccccttaaagaaggaacttttggaacttctgggctttaaaaagacttgcttgaaagcctgtgctgaagttagtcagtggaccaggctatgtgaactcaccatccctttggctattgagaattttctcagagaatcttctgaccagcccccaactatacctgtagaaatactacagctagagaaaaagcttagtgagcctgttagagtgcataatgatgataaactccgcaggcagaagctcaagcaacagaaggctgatggagttgggcctccccttactaagggaaaggcaaagagcaaggtccacacacaggaaacatctgaagggttggattcttcatccaagagtctggaactgaaagtggcattctcaaagctcacagtacaggaagaaccagctactaccaacagagagccttctcacatcagaaaagcaaaagcctccgaccttccacctctggagcatgtgtttgcagaagggctttacttcactctggcagatattgtgctcttgccctgtatccatcatttcttggtaattatcagcaggaaattttctgagaagctggtagaatttccattgctagcctcttggtaccagaggattcaggaagtgccaggagtaaaaacagcttctaagtgtgggatccaatttctccatttaccaaagttgttgacaacctcaactgaacagcatccaaacttatgtgaagtcccaggtgtagaagagcaaagcgatcctttatttataggaggaccaagaccaaccatggccaagttaatggaaaagggcattgaagtgatgttttctccccacccttgccctacttggactcttgattggaatgttctccctgcagcagtcagcccaaaggaaggtaaaatgtccagtgatcgagctttgaggaagcagcaacagttgaacaaccttgtctatgtggtaacaaatcaggccaaacctggtgacagaattgtggatttctgcagcggtgggggccatgttggaattgtccttgctcacatgctgccatcatgtcaggttacattaatagaaaacaaggaattatcattaattcgtgctaagaagagaagtgatgaactgggtttaagcaacatttggttcattcaagcaaatatggaatattttactgggatgtttaatattggagtagcattgcatgcttgtggagtggcaacagacatggtgattgagcactgtatcaaaacacgggcttccttcgtcacatgcccttgctgttatggtttcattcagaacacctcaaagttcaattttccaaaaagtgaacaattcaagaaaactttatcatacaaggaacacatgattctgtgcagatttgcagaccagacagctgtccagctcccaccccaacgaaggctcataggaaaacagtgcatgtgcttggtggatctggatcgagcaagagctgcagaagaatgtggatactccgttcaagtgatatccatggagccagagagctgctctcccaaaaataacatgattgtgggagtccccatttaaaatgagatattcacatttgatattttgccatccgtcttcacgttggatgcccagtggcattcaggaggttcttggcataactaggaaacagcattagccatcttgaacctattgtgctcaggaaggaaagcaacagggaaatcttggaagtaaaggctccctgcaaagcatcacaaaaaaaaaaaaaaaa

SEQ ID NO: 61729 - DNA, 2346 bp, Homo sapiens
atgcatgatgaatgtactccacagcagacaatgtcctccattcaagataccaaagcagcagacattgctgcaagaggggaactaaatgtcatagaaacagctactgtttctcccacaaatggagaggaaagtcattacacaaaccaggtccagttagaaaaaaataaaacacatatgagttcagcattagtggaaaaagaaaacaatacatcactgaatggacgtgtactggggcaagaagagtcacagaataaaatgttcccagataatgcagaaaatgaagatgataaacaaatagaacacatgactgttgagaacataaatggcaacagggaagagactcatggcataattcagacaacagagacagaaattcaagagacttcagaaagcccaagagaagagatgaccacatcctcaataatatgtgatatctccaagaaatatataaatagtactcttcccaatgattcagagaatataaagcacaagaataacataatggaaaaggagtatcttgatgtgctgagtgatgttactggcccccaagtgtcttgttatattacagcaccatcatatgttctacaacaactagaatgccggataataaatcacatgagttctttaatagtgggtgataatgaagagttagttagcaacgtcataactattgaatgctcagataaggaaaagagagttccatttccaataggcattgcaattccatttactgcacgttacagaggaaattacagagatatcatggtgaaagtgtgtgacataaaccttcaatcaagttacctaaacccaaattcactagaaggaatgaagggaggttataaggggacctgtgcttcagtaaaagtttacaaattgggtatcttttctgttgtgtcttgtttaaagaaagagtcgttcacagtaacaaagaaaggcctcgctcttaagtcaagcatggattcccgaatatccttaaattaccctccaggagtttttacctctccagtgctggtgcagttaaagatccaaccagttgacccagctctggtggcacatttaaaagcacagcaagatactttctactcagtccaatccacaagccctctgattcacattcagcacccatcaacttatccttttcagaagccagtcactttgtttttaccttgttctccataccttgataaaaacaaccttggttctgagatagatcataaaagaagagcaagtgccacaataaataggattacaccttcgtatttcaaccggacaaaaattgcctccataagaaaacctaggaaaaatgccagtgaatgtttgaaattactgggattcagaagccaagacagtggttggtgtgggcttgatgatgttgtgaaaaccatacagagcggcttggtatcagttgaattgtatgaacatttggagaggtttattgtacttcacctctcttccaccatggacaatagtcatttggttacttttgtgaaatctttagaggaagccatgctcagcaccactgcctgcatagtactgtctcaccagaaggacaatccacatagaatagctgttttagtggtgccttccaaagatttaagccaggtgcttaaggacctgcacttggaagggtttggaggacctccagagccatctcgtcatttccaagttcgagaaggagaacaacttcttttaagatttactggaaacatatttgcttcaagcaacgggaaggattatggaaaagactacacacttatttttcacttgcaaagaaaacctaggctggaactccaaatcaaagaagtggacgaatttggaaactatagttgccctcattacaaaggcaccattgtcgtttataaagtacctaaaggaaagatagtccccaacttgaatcaatctctcgtaattaatgaaaaccattctcagttgccaatttgcaaattaccattgaaattgccaaagcataagaaattaatcaaccgtccacagagtaccaaaagagtttctaaggatcctgtagaagccctttgggataacttgctccattggctggctgaggagctctcagaagaaaatgctgagtctctttcctcaactctccctctgcgccgtagcaccattcagctcatcaaactcaagaaccctgatgatctcacagaacagatccacgagtttctttgcttctggaaaaaatcgcttccaactttcaccgacaaacttcgcctcctggctcgacatctccgcaagattggcaggagtgatcttgcagaagagctcaaattcaagtgggaaaataaagtgttcactgaaccacagcagtgttttgatgtagcccctgagtaa

SEQ ID NO: 61730 - DNA, 2346 bp, Homo sapiens
atgcatgatgaatgtactccacagcagacaatgtcctccattcaagataccaaagcagcagacattgctgcaagaggggaactaaatgtcatagaaacagctactgtttctcccacaaatggagaggaaagtcattacacaaaccaggtccagttagaaaaaaataaaacacatatgagttcagcattagtggaaaaagaaaacaatacatcactgaatggacgtgtcctggggcaagaagagtcacagaataaaatgttcccagataatgcagaaaatgaagatgataaacaaatagaacacatgactgttgagaacataaatggcaacagggaagagactcatggcataattcagacaacagagacagaaattcaagagacttcagaaagcccaagagaagagatgaccacatcctcaataatatgtgatatctccaagaaatatataaatagtactcttcccaatgattcagagaatataaagcacaagaataacataatggaaaaggagtatcttgatgtgctgagtgatgatactggcccccaagtgtcttgttatattacagcaccatcatatgttctacaacaactagaatgccggataataaatcacatgagttctttaatagtgggtgataatgaagagttagttagcaacgtcataactattgaatgctcagataaggaaaagagagttccatttccaataggcattgcaattccatttactgcacgttacagaggaaattacagagatatcatggtgaaagtgtgtgacataaaccttcaatcaagttacctaaacccaaattcactagaaggaatgaagggaggttataaggggacctgtgcttcagtaaaagtttacaaattgggtatcttttctgttgtgtcttgtttaaagaaagagtcgttcacagtaacaaagaaaggcctcgctcttaagtcaagcatggattcccgaatatccttaaattaccctccaggagtttttacctctccagtgctggtgcagttaaagatccaaccagttgacccagctctggtggcacatttaaaagcacagcaagatactttctactcagtccaatccacaagccctctgattcacattcagcacccatcaacttatccttttcagaagccagtcactttgtttttaccttgttctccataccttgataaaaacaaccttggttctgagatagatcataaaagaagagcaagtgccacaataaataggattacaccttcgtatttcaaccggacaaaaattgcctccataagaaaacctaggaaaaatgccagtgaatgtttgaaattactgggattcagaagccaagacagtggttggtgtgggcttgatgatgttgtgaaaaccatacagagcggcttggtatcagttgaattgtatgaacatttggagaggtttattgtacttcacctctcttccaccatggacaatagtcatttggttacttttgtgaaatctttagaggaagccatgctcagcaccactgcctgcatagtactgtctcaccagaaggacaatccacatagaatagctgttttagtggtgccttccaaagatttaagccaggtgcttaaggacctgcacttggaagggtttggaggacctccagagccatctcgtcatttccaagttcgagaaggagaacaacttcttttaagatttactggaaacatatttgcttcaagcaacgggaaggattatggaaaagactacacacttatttttcacttgcaaagaaaacctaggctggaactccaaatcaaagaagtggacgaatttggaaactatagctgccctcattacaaaggcaccattgtcgtttataaagtacctaaaggaaagatagtccccaacttgaatcaatctctcgtaattaatgaaaaccattctcagttgccaatttgcaaattaccattgaaattgccaaagcataagaaattaatcaaccgtccacagagtaccaaaagagtttctaaggatcctgtagaagccctttgggataacttgctccattggctggctgaggagctctcagaagaaaatgctgagtctctttcctcaactctccctctgcgccgtagcaccattcagctcatcaaactcaagaaccctgatgatctcacagaacagatccacgagtttctttgcttctggaaaaaatcgcttccaactttcaccgacaaacttcgcctcctggctcgacatctccgcaagattggcaggagtgatcttgcagaagagctcaaattcaagtgggaaaataaagtgttcactgaaccacagcagtgttttgatgtagcccctgagtaa

SEQ ID NO: 61731 - DNA, 4152 bp, Homo sapiens
cccttttgaagattgtagggcaggtattctgtaggctgtccttcagattgtgtttttgatgtttttctcatgattagattgaggttaggcatttggggcaggagcactgctgaagcaatgtgtcctcgttgcaccgtatcaggaggcatatggtgttgatacgtttcattattgtgatgttaactttgatcattgggtgaaggtggtacgtgcaatgtttcttccctgctattaaggtactgtttttccctttgtaattgataagtatcttatgaggatatacttttgagatccaatttttttaacttagaatttattcaaaagtcaagaatcttaaatctctgaaatggcgtgggaagaaaaagtgctagatacacagagatctttcttgagtcatgtgaaggagcagtgcccaagcccagcaaacccacagcaaattcccttggcttccagaagagatggagaaagcagtgcccccagtggagggtcaaaggcctctgtgcagggtgttgtgggcctggagagctggcctggccatgtctttacctcctctgggcatctccccaccccaacaccctttctgtggcctggtggctgagttgcagccgacacccagaggcaggtgagttgacagcttggaagaggctgcagggtggatctgctgcatgagcaggcctgagcccagccttacctccccacagtggtcctgtgtgccctccggctgcctaatgcatgttggcacttgctgtacgagcacccgcttcttcacctcgcatgctgtttgtgtcctgcactccttccttaaccccatcgtccttctgctgtgtttgcagcccctatctaccctggtgggagtggccaaaaatatttaggaggggatcaccagtttgtagtggcctcagaggatgtgtggtcccccttatgcctcagccactcatcagcctagcccctgcccatcatctggcattgcacttgtggaaggaaagaaggggagggctgggtggtgggtggagaacacgtcagtccaccaggcgggccctgcttgctgtgttcctccacgctgctgtccacccacaccccagcagtcctctgagggacctcccgggggtgacctgggccacaacagactgcccactcagaccccatcttacccatgccgtggacaccccgcccccccccccgccactgctatgctatagctgggggtgtctatgtgagctgtacagcccagcaccacgctgacgatgttcttcatccccttctccctgcagggcatcgagcgcctcaaacgaaagaaccagcccagggagcacatggggagctggcagtcagtaaaggagacctttggtggggacttctccctgaactggttcaaccccttctccagaccgtgtcagccagagatccccagtgacaaagacatggtgcggcaggtgacatcgctgtcagacaccgaaacaatggaggatccatcagaggagacaaaggacgaggactctgtggaggtgacagatgaatagatgctgctgtggggagagaagcaaacactaaaaagtgctgtcaaccttcatcctggggttttggctaaaggggcttatgggcatggtgcgctcccagcacccccagtgcttcccttagccactcgcttggccttgccatttcccctccttcttctctccatgttgggccaggtctgggggtcgggagtaggctggggacatcagaggaggatgggggctttctcagagttcatctaagaagagtctgcactgagacggctcatcaagaaccgttctccaagactgggtggctttcacattctccgcccagcaaagggagcttttgaacagggcatcccaggggcagaaaagagcttgcctttggctttccccaggatttctgtcttctcttgggaaggctgggcccctggctcctggctttgagaagtaaggttgtgacagaaggaccgggcagggcttgccttggggacctgggttgggacactgacatcaggggagactagcctggaaagactgcagagctgccagctactccctggaaagggcttccccatgctgcctgccgaaattaggaggtagaggtggctgccacatctacctgcaagggccaggcatggttcaaagaggaccctgcattaagctctacacacacatgtgcaggacatgtccagcatggacagagccagagttaagacagtagcaccgaaaatgagcccccattccacagacactggagtcttcactgagcgagacagctgggagctgtcctgcctgtggctacatatctagccattcacagatgtggatatgggaaggacctctttggagctactggggactccctaaccactcgcatgagaacttaattgaatgttacctcttggagggagtctaataacacatgtaggtagaactgaccataaaccctgcctgtgtgtttgaaaaggccagttctcccaaattggtgcccatcttgtctctgaaaagatgggtgatggccagggtctgctgattgatgaatcagatgaatcaggaagatagacaaacacacacacacacacacacaccccaccaggatgagtctgccctctattcaccccatttgaagcctgtggtgtctgtgaccactgctgaaggtctgagcagcgttctggtgctcctaaaccccattccagtggttgctgaagcagcatcttctgcacaaagcccaacagaagggttcttatccccgtttggtataagaagtggattcaccacccactccctccacgtgcctttgttcctctctttggcccatttccccagcgtctactggcgtcaggattggcaggagcacaggcactcagcagagcatgcccctgcaagacctcagtgttagggccccccttccagctccaggcaaaagggcatgagtcctggccccaaggggcctgtggctgcagttcagaggagaagaaggtcagtgtttggaggtgcagcctcaggatgctgagaaaggaaactggcgaccgtgagaaagaaaagagccaagcagcatcctggttcttggacagcatctttggacactctgtgaagggcaacgatcctgccagagaccgtctctctacaactgatgacccactagggcctggggttaattgctcaaagggcccagtgttcacaaagccacctctgccctaacccttgccagagctctccaactatgacccacgagaggggtgatggtgggattctaacatcaacagagcaaccagaaagacattgggcctcccacactcaggctgcaggcccactttcttggtccttatcagctttaatatttattaatgacgacataggagcccgagtcagctgtaaaggccattaacttgcaatctggacaggaagttgacgctcaccactttgggtaagagctgctctgactgtagggccccctatttgttgtcctaacccagaagcagctctgggctgccaggatggtggatggaataccagagagttcacactagggaggaagcaatgcctgccccctggagtctcctagggggcagcagttagaataagggaagaggatttgctggtcactgtttgctgacatgggtttccatggtgagttcaggcctgaggacagcagtgtctgcaaaaccacatggcccttgagaaatgtccttgcacattgggcttcaaactcctcttctagggaatccatcttggcctgaaagcagaggtacaacaccagccccaaaggcaattctgttttcagattggttgctctggaaaggaaggctggggtgagggggcattttacttgcacagaggctgaccctgcctcccctcttcactgaccccatctccaaggtagacctcagccatgtcagtccctgttctgggaggtgctgggctgggccacagccagggttatgtaggtaattaacctgtccaaccctgagcctcgcctccccacaccagcaacacagtggtctctctgtggtgaccattcacagcataacattctgcttagcctcagactgaaagcattgcaactgatgtcaaaaccagatgagatcttacagggagagagattgggtgcaatttgcctctttctttgaataaaaagctctttgctcaccct

SEQ ID NO: 61732 - DNA, 4152 bp, Homo sapiens
cccttttgaagattgtagggcaggtattctgtaggctgtccttcagattgtgtttttgatgtttttctcatgattagattgaggttaggcatttggggcaggagcactgctgaagcaatgtgtcctcgttgcaccgtatcaggaggcatatggtgttgatacgtttcattattgtgatgttaactttgatcattgggtgaaggtggtacgtgcaatgtttcttccctgctattaaggtactgtttttccctttgtaattgataagtatcttatgaggatatacttttgagatccaatttttttaacttagaatttattcaaaagtcaagaatcttaaatctctgaaatggcgtgggaagaaaaagtgctagatacacagagatctttcttgagtcatgtgaaggagcagtgcccaagcccagcaaacccacagcaaattcccttggcttccagaagagatggagaaagcagtgcccccagtggagggtcaaaggcctctgtgcagggtgttgtgggcctggagagctggcctggccatgtctttacctcctctgggcatctccccaccccaacaccctttctgtggcctggtggctgagttgcagccgacacccagaggcaggtgagttgacagcttggaagaggctgcagggtggatctgctgcatgagcaggcctgagcccagccttacctccccacagtggtcctgtgtgccctccggctgcctaatgcatgttggcacttgctgtacgagcacccgcttcttcacctcgcatgctgtttgtgtcctgcactccttccttaaccccatcgtccttctgctgtgtttgcagcccctatctaccctggtgggagtggccaaaaatatttaggaggggatcaccagtttgtagtggcctcagaggatgtgtggtcccccttatgcctcagccactcatcagcctagcccctgcccatcatctggcattgcacttgtggaaggaaagaaggggagggctgggtggtgggtggagaacacgtcagtccaccaggcgggccctgcttgctgtgttcctccacgctgctgtccacccacaccccagcagtcctctgagggacctcccgggggtgacctgggccacaacagactgcccactcagaccccatcttacccatgccgtggacaccccgcccccccccccgccactgctatgctatagctgggggtgtctatgtgagctgtacagcccagcaccacgctgacgatgttcttcatccccttctccctgcagggcatcgagcgcctcaaacgaaagaaccagcccagggagcacatggggagctggcagtcagtaaaggagacctttggtggggacttctccctgaactggttcaaccccttctccagaccgtgtcagccagagatccccagtgacaaagacatggtgcggcaggtgacatcgctgtcagacaccgaaacaatggaggatccatcagaggagacaaaggacgaggactctgtggaggtgacagatgaatagatgctgctgtggggagagaagcaaacactaaaaagtgctgtcaaccttcatcctggggttttggctaaaggggcttatgggcatggtgcgctcccagcacccccagtgcttcccttagccactcgcttggccttgccatttcccctccttcttctctccatgttgggccaggtctgggggtcgggagtaggctggggacatcagaggaggatgggggctttctcagagttcatctaagaagagtctgcactgagacggctcatcaagaaccgttctccaagactgggtggctttcacattctccgcccagcaaagggagcttttgaacagggcatcccaggggcagaaaagagcttgcctttggctttccccaggatttctgtcttctcttgggaaggctgggcccctggctcctggctttgagaagtaaggttgtgacagaaggaccgggcagggcttgccttggggacctgggttgggacactgacatcaggggagactagcctggaaagactgcagagctgccagctactccctggaaagggcttccccatgctgcctgccgaaattaggaggtagaggtggctgccacatctacctgcaagggccaggcatggttcaaagaggaccctgcattaagctctacacacacatgtgcaggacatgtccagcatggacagagccagagttaagacagtagcaccgaaaatgagcccccattccacagacactggagtcttcactgagcgagacagctgggagctgtcctgcctgtggctacatatctagccattcacagatgtggatatgggaaggacctctttggagctactggggactccctaaccactcgcatgagaacttaattgaatgttacctcttggagggagtctaataacacatgtaggtagaactgaccataaaccctgcctgtgtgtttgaaaaggccagttctcccaaattggtgcccatcttgtctctgaaaagatgggtgatggccagggtctgctgattgatgaatcagatgaatcaggaagatagacaaacacacacacacacacacacaccccaccaggatgagtctgccctctattcaccccatttgaagcctgtggtgtctgtgaccactgctgaaggtctgagcagcgttctggtgctcctaaaccccattccagtggttgctgaagcagcatcttctgcacaaagcccaacagaagggttcttatccccgtttggtataagaagtggattcaccacccactccctccacgtgcctttgttcctctctttggcccatttccccagcgtctactggcgtcaggattggcaggagcacaggcactcagcagagcatgcccctgcaagacctcagtgttagggccccccttccagctccaggcaaaagggcatgagtcctggccccaaggggcctgtggctgcagttcagaggagaagaaggtcagtgtttggaggtgcagcctcaggatgctgagaaaggaaactggcgaccgtgagaaagaaaagagccaagcagcatcctggttcttggacagcatctttggacactctgtgaagggcaacgatcctgccagagaccgtctctctacaactgatgacccactagggcctggggttaattgctcaaagggcccagtgttcacaaagccacctctgccctaacccttgccagagctctccaactatgacccacgagaggggtgatggtgggattctaacatcaacagagcaaccagaaagacattgggcctcccacactcaggctgcaggcccactttcttggtccttatcagctttaatatttattaatgacgacataggagcccgagtcagctgtaaaggccattaacttgcaatctggacaggaagttgacgctcaccactttgggtaagagctgctctgactgtagggccccctatttgttgtcctaacccagaagcagctctgggctgccaggatggtggatggaataccagagagttcacactagggaggaagcaatgcctgccccctggagtctcctagggggcagcagttagaataagggaagaggatttgctggtcactgtttgctgacatgggtttccatggtgagttcaggcctgaggacagcagtgtctgcaaaaccacatggcccttgagaaatgtccttgcacattgggcttcaaactcctcttctagggaatccatcttggcctgaaagcagaggtacaacaccagccccaaaggcaattctgttttcagattggttgctctggaaaggaaggctggggtgagggggcattttacttgcacagaggctgaccctgcctcccctcttcactgaccccatctccaaggtagacctcagccatgtcagtccctgttctgggaggtgctgggctgggccacagccagggttatgtaggtaattaacctgtccaaccctgagcctcgcctccccacaccagcaacacagtggtctctctgtggtgaccattcacagcataacattctgcttagcctcaaactgaaagcattgcaactgatgtcaaaaccagatgagatcttacagggagagagattgggtgcaatttgcctctttctttgaataaaaagctctttgctcaccct

SEQ ID NO: 61733 - DNA, 4817 bp, Homo sapiens
gaccccgcggcttggggtccgcgcacgcgggtgccggcccagctaggcggagaatcgaggaggggttcccgggctcatcgcagaggattggaagggcctagattactgcccaatgacaaaagtgtgggcttaatgtcctcactcttcagggagagaatgtggactttagcatttgaactgaatatttgagattgaagatttctgaataggatttaatgtgcaaaatggcgattataccagactggcttaggtcgcatcctcacacacgaaaatttacacattcaagaccccattcttcaccgtgtagagtatattcaaggaatggttccccaaataagttcagatcttcttcaaccacagctgttgcaaatccaacactgtcctccttagatgttaaacggattttatttcaaaaaattaccgacagaggggatgagttgcaaaaagcctttcagctgctggatactggtcagaacttgactgtgtcaaaaagtgaactgagaagaatcatcacagacttcctgatgccgctcacacgagaacagtttcaggacgtgttggctcagatcccccttagcacctctggtactgtaccgtaccttgcctttctgtccaggtttggtggaattgacctatatataaatggtataaagaggggaggtgggaatgaaatgaattgctgccgcacattaagagaacttgaaatccaagtgggagaaaaggttttcaaaaacattaagactgttatgaaagcctttgagctcattgatgttaacaagactggactggttcgaccgcaggagctaagaagggttctggagaccttctgtatgaagttaagagacgaggaatacgaaaagttttcgaaacactacaacatccacaaggatactgcagtagattacaacgtgtttttgaagaatctcagcataaataacgacttgaaccttagatattgtatgggaaatcaagaggtctcattggagaatcaacaagccaaaaattccaaaaaggaacgtttgctaggttctgcatcatctgaagatatctggagaaactactccttggatgaaattgagaggaacttttgtctacaactttcgaagtcttatgaaaaggttgaaaaggccctcagtgcaggggacccctgtaaaggtggctacgtgtcttttaattatctaaagattgtcctcgacacttttgtataccaaataccaagaagaatttttatccagttaatgaaaagatttggacttaaagccaccactaaaatcaattggaagcaatttctaacatcatttcatgagcctcaggggttgcaagttagcagtaaaggtcccctgacaaaaagaaatagcatcaactctagaaatgaatctcacaaggaaaacatcatcacaaagttatttagacacactgaagatcactctgcgtcactgaagaaagcattactgataatcaacactaaacccgatggaccgataacaagagaagaatttcgatatattctaaattgcatggctgtaaaactaagcgattcagaattcaaagaactaatgcaaatgcttgaccctggggacactggagtggtcaacaccagcatgtttattgatctgattgaagagaactgtaggatgagaaagacatctccctgtacagatgctaagacacctttcctcctggcctgggattcagtggaagaaattgttcatgatacaattactaggaacctacaagctttttataacatgctacgctcatatgaccttggagacacagggcgcattggccgaaataatttcaagaaaatcatgcacgtcttctgtccatttttaacgaatgcacatttcataaaactctgcagtaagattcaggacattggttcaggaagaatcctttacaagaaacttttggcatgcataggaattgatggcccacccactgtctctccagttcttgttccaaaggatcagctgttaagtgaacatttacaaaaagatgaacagcagcagccagatctttctgagagaaccaagctcacggaggataaaaccaccctgaccaagaagatgaccacagaagaagtgattgaaaaattcaaaaagtgtatacagcagcaggacccggcattcaaaaaacgatttcttgacttcagcaaggagcctaatggaaaaattaacgtgcatgactttaagaaggtactggaagacactgggatgcccatggacgatgatcagtatgccctgctgaccactaaaataggcttcgagaaggaagggatgagctatcttgattttgcagcaggatttgaagatcctccaatgagagggccggaaaccactccgccgcagcctccaactccttcaaaaagttacgtgaacagccactttatcaccgcagaagaatgcctgaagcttttccctaggaggctgaaggagtcattccgggacccctactctgccttctttaaaacagatgctgacagggatggcataatcaacatgcatgaccttcacagactgctcctgcatctactgcttaatctcaaagacgacgagtttgagcgcttccttggccttcttggcttgagacttagtgtcactttaaattttcgggaatttcaaaatttgtgtgagaagagaccatggagaacagatgaagcgcctcaaagactcattagaccaaaacagaaggttgcggattcagaactagcttgtgagcaggctcatcagtatcttgttaccaaagcaaaaaacagatggtcagacttgtctaagaattttctagaaaccgataatgagggcaatggcattcttcgacgccgggacataaagaacgcactgtacggttttgatattcccctcacaccaagagagtttgaaaagctttgggcaagatacgacaccgagggaaaagggcacattacttaccaggaatttttacagaaattgggtattaactattcgcctgctgtccatcggccctgtgcagaggattatttcaacttcatgggtcattttacaaagccacagcagctacaggaagagatgaaggagctgcagcagagcacagagaaggctgtggcagccagggataagcttatggaccgccatcaagatatcagcaaagcattcaccaaaactgatcaatccaaaaccaactacatatccatatgcaagatgcaggaagtgctggaagaatgtggatgttctcttaccgaaggggagctgacccatctgctaaacagttggggagtcagccggcatgataatgctatcaattacctcgacttcctgagagcagtggagaacagcaagtcaacaggagctcagcccaaggaaaaagaagagagcatgccaatcaattttgcaacgctgaatccacaggaggctgtgaggaagatccaggaagtagttgagtcctcccagctggctttgtccacggcattttctgcattggataaagaggatacaggatttgtaaaggctacagaattcggacaagttcttaaggatttctgttacaaactaacggacaatcagtatcattattttttgaggaaactaagaattcatctaaccccctatataaattggaaatattttctccagaactttagctgtttccttgaggagacagctgatgagtgggctgagaaaatgcccaaaggcccgccgcctacctctcccaaggccacagccgacagagacatcctggctcgcctccacaaagcagtgacttcccattaccatgccatcacccaggagtttgagaattttgacaccatgaaaacgaacaccatctccagagaggagtttagggccatttgtaatcgccgcgtccaaatcctgacggacgaacagtttgacagactctggaacgagatgccagtcaatgccaaggggaggctgaaatacccggacttcctgagcaggttcagttccgagacagcagccacaccaatggccactggtgactcggccgtggcccagagagggagcagtgtccctgacgtctcggaaggcaccagatctgccctctcattgcccactcaggagctgagaccagggtcaaagtcgcagagccacccctgtactccagcgagcaccaccgtgatcccgggcactccacccttgcagaactgtgatcccatagagagcaggctccggaagagaatccagggctgctggcgccagctcctgaaagaatgcaaggagaaggacgtggccagacagggggacatcaacgcctccgatttcctggctcttgtggagaaattcaacctggacataagcaaagaggagtgtcagcagctcattataaaatacgacttaaagagcaacgggaaatttgcatactgtgacttcattcagagctgtgtcctcctgctaaaagcaaaggaaagctcactgatgcacaggatgaagatccagaatgcacacaagatgaaagaagccggcgcggagacgccatctttttactctgctctgctgcgtattcagcccaaaattgtgcactgctggaggccaatgcggcgcacgttcaaaagctatgatgaggctggaacagggctgctaagcgtcgcagatttcaggacggtcctgagacagtacagcatcaacctctctgaggaagagttcttccatattctggagtattacgataagacgctgtcttcaaaaatctcctacaacgacttcctccgggcattcctccagtagacacccctgctgtgtgcccagcgggacgacagccacagggcctgtttcaaggctaataaaatcctataatttgggggttaaaaaaaaaaaaaaaaa

SEQ ID NO: 61734 - DNA, 4459 bp, Homo sapiens
gaccccgcggcttggggtccgcgcacgcgggtgccggcccagctaggcggagaatcgaggaggggttcccgggctcatcgcagaggattggaagggcctagattactgcccaatgacaaaagtgtgggcttaatgtcctcactcttcagggagagaatgtggactttagcatttgaactgaatatttgagattgaagatttctgaataatcccccttagcacctctggtactgtaccgtaccttgcctttctgtccaggtttggtggaattgacctatatataaatggtataaagaggggaggtgggaatgaaatgaattgctgccgcacattaagagaacttgaaatccaagtgggagaaaaggttttcaaaaacattaagactgttatgaaagcctttgagctcattgatgttaacaagactggactggttcgaccgcaggagctaagaagggttctggagaccttctgtatgaagttaagagacgaggaatacgaaaagttttcgaaacactacaacatccacaaggatactgcagtagattacaacgtgtttttgaagaatctcagcataaataacgacttgaaccttagatattgtatgggaaatcaagaggtctcattggagaatcaacaagccaaaaattccaaaaaggaacgtttgctaggttctgcatcatctgaagatatctggagaaactactccttggatgaaattgagaggaacttttgtctacaactttcgaagtcttatgaaaaggttgaaaaggccctcagtgcaggggacccctgtaaaggtggctacgtgtcttttaattatctaaagattgtcctcgacacttttgtataccaaataccaagaagaatttttatccagttaatgaaaagatttggacttaaagccaccactaaaatcaattggaagcaatttctaacatcatttcatgagcctcaggggttgcaagttagcagtaaaggtcccctgacaaaaagaaatagcatcaactctagaaatgaatctcacaaggaaaacatcatcacaaagttatttagacacactgaagatcactctgcgtcactgaagaaagcattactgataatcaacactaaacccgatggaccgataacaagagaagaatttcgatatattctaaattgcatggctgtaaaactaagcgattcagaattcaaagaactaatgcaaatgcttgaccctggggacactggagtggtcaacaccagcatgtttattgatctgattgaagagaactgtaggatgagaaagacatctccctgtacagatgctaagacacctttcctcctggcctgggattcagtggaagaaattgttcatgatacaattactaggaacctacaagctttttataacatgctacgctcatatgaccttggagacacagggcgcattggccgaaataatttcaagaaaatcatgcacgtcttctgtccatttttaacgaatgcacatttcataaaactctgcagtaagattcaggacattggttcaggaagaatcctttacaagaaacttttggcatgcataggaattgatggcccacccactgtctctccagttcttgttccaaaggatcagctgttaagtgaacatttacaaaaagatgaacagcagcagccagatctttctgagagaaccaagctcacggaggataaaaccaccctgaccaagaagatgaccacagaagaagtgattgaaaaattcaaaaagtgtatacagcagcaggacccggcattcaaaaaacgatttcttgacttcagcaaggagcctaatggaaaaattaacgtgcatgactttaagaaggtactggaagacactgggatgcccatggacgatgatcagtatgccctgctgaccactaaaataggcttcgagaaggaagggatgagctatcttgattttgcagcaggatttgaagatcctccaatgagagggccggaaaccactccgccgcagcctccaactccttcaaaaagttacgtgaacagccactttatcaccgcagaagaatgcctgaagcttttccctaggaggctgaaggagtcattccgggacccctactctgccttctttaaaacagatgctgacagggatggcataatcaacatgcatgaccttcacagactgctcctgcatctactgcttaatctcaaagacgacgagtttgagcgcttccttggccttcttggcttgagacttagtgtcactttaaattttcgggaatttcaaaatttgtgtgagaagagaccatggagaacagatgaagcgcctcaaagactcattagaccaaaacagaaggttgcggattcagaactagcttgtgagcaggctcatcagtatcttgttaccaaagcaaaaaacagatggtcagacttgtctaagaattttctagaaaccgataatgagggcaatggcattcttcgacgccgggacataaagaacgcactgtacggttttgatattcccctcacaccaagagagtttgaaaagctttgggcaagatacgacaccgagggaaaagggcacattacttaccaggaatttttacagaaattgggtattaactattcgcctgctgtccatcggccctgtgcagaggattatttcaacttcatgggtcattttacaaagccacagcagctacaggaagagatgaaggagctgcagcagagcacagagaaggctgtggcagccagggataagcttatggaccgccatcaagatatcagcaaagcattcaccaaaactgatcaatccaaaaccaactacatatccatatgcaagatgcaggaagtgctggaagaatgtggatgttctcttaccgaaggggagctgacccatctgctaaacagttggggagtcagccggcatgataatgctatcaattacctcgacttcctgagagcagtggagaacagcaagtcaacaggagctcagcccaaggaaaaagaagagagcatgccaatcaattttgcaacgctgaatccacaggaggctgtgaggaagatccaggaagtagttgagtcctcccagctggctttgtccacggcattttctgcattggataaagaggatacaggatttgtaaaggctacagaattcggacaagttcttaaggatttctgttacaaactaacggacaatcagtatcattattttttgaggaaactaagaattcatctaaccccctatataaattggaaatattttctccagaactttagctgtttccttgaggagacagctgatgagtgggctgagaaaatgcccaaaggcccgccgcctacctctcccaaggccacagccgacagagacatcctggctcgcctccacaaagcagtgacttcccattaccatgccatcacccaggagtttgagaattttgacaccatgaaaacgaacaccatctccagagaggagtttagggccatttgtaatcgccgcgtccaaatcctgacggacgaacagtttgacagactctggaacgagatgccagtcaatgccaaggggaggctgaaatacccggacttcctgagcaggttcagttccgagacagcagccacaccaatggccactggtgactcggccgtggcccagagagggagcagtgtccctgacgtctcggaaggcaccagatctgccctctcattgcccactcaggagctgagaccagggtcaaagtcgcagagccacccctgtactccagcgagcaccaccgtgatcccgggcactccacccttgcagaactgtgatcccatagagagcaggctccggaagagaatccagggctgctggcgccagctcctgaaagaatgcaaggagaaggacgtggccagacagggggacatcaacgcctccgatttcctggctcttgtggagaaattcaacctggacataagcaaagaggagtgtcagcagctcattataaaatacgacttaaagagcaacgggaaatttgcatactgtgacttcattcagagctgtgtcctcctgctaaaagcaaaggaaagctcactgatgcacaggatgaagatccagaatgcacacaagatgaaagaagccggcgcggagacgccatctttttactctgctctgctgcgtattcagcccaaaattgtgcactgctggaggccaatgcggcgcacgttcaaaagctatgatgaggctggaacagggctgctaagcgtcgcagatttcaggacggtcctgagacagtacagcatcaacctctctgaggaagagttcttccatattctggagtattacgataagacgctgtcttcaaaaatctcctacaacgacttcctccgggcattcctccagtagacacccctgctgtgtgcccagcgggacgacagccacagggcctgtttcaaggctaataaaatcctataatttgggggttaaaaaaaaaaaaaaaaa

SEQ ID NO: 61735 - DNA, 1291 bp, Homo sapiens
acacacacaccaggccctgccaggacaaggcagctcctggaagctccaccaggacccacgtccaccaggcatctcgaacccttggcccccatggaccccctgaggcgctccccctctccctgcctgtcctcgcagccctccagccccagcaccccaccctgcgagatgcttggtcctgtgggcattgaggctgtgctggaccagctgaagatcaaggctatgaagatggggtttgagttcaacatcatggtggtggggcaaagcgggctgggcaagtccacgatggtgaacacgctgttcaagtccaaagtgtggaagtcaaacccaccgggcttgggggtgcccacaccccagacgctgcagctgcattcactgacccatgtcatagaggagaagggtgtgaagctgaagctgacggtgacggacacgcccggcttcggggaccagatcaacaatgacaactgctgggaccccatcctgggctacatcaacgagcaatacgagcagtacctgcaggaggagatcctcatcacccgccagcgccacatcccagacacccgggtgcactgctgcgtgtactttgtaccacccactgggcactgcctgcggcccctggacattgagttcctgcagcggctgtgccggactgtgaatgtggtgcccgtgattgccagggccgacagcctgaccatggaggagcgagaggccttcaggcgcaggatccagcagaacctgaggacccactgcatcgacgtctacccccagatgtgctttgacgaggacatcaatgacaaaatcctcaacagcaagttacgggaccgaatcccttttgccgtggtaggggctgaccaagagcacctgatgaacgggaggtgtgtcctgggccggaagaccaagtggggcatcattgaagtggagaacatggcgcactgtgaatttcctctcctgagagacctgcttatccgctcccacctccaagacctgaaggacataacccacaacatccactatgagaactaccgcgtcatcagactcaatgaaagccacctactgccccgcgggcccggctgggtgaacctggccccggcctccccaggacagctgaccaccccccggaccttcaaggtctgcaggggggcccatgacgattctgatgatgagttctgaccaccggcggatcccggggctgctgggcttcctgagtccccagcggctctcaacacacacctatgtaccagagcatctattaaatgtgagccttgctttttatgaaaagctgtgctttgaaaac

SEQ ID NO: 61736 - DNA, 1626 bp, Homo sapiens
agctttcgcgaggcaccgctttggcgcccggaccgaggtgcgccagggtcaggaggccgacgcagcgggaggaagccgcgccgtcgggctcagggagctgggaggctggttccggggcgtggtttctccgccttgagccaggaagaagatgcaagccagccccatccgtatcccaactgttagcaatgacatcgactgggatttctgcttccgtatgtcacagcaaaccgagatcccagctcaccagcaaacagatgagttgtatcccactggtgggtgtggagagagtgaagaggaaactagctaaagagaaggagaaggccatagactgtatgtctcatcccaaagagaaattagcccaatcccagaagaaagtagctcagctgattaaggaaaaaatgaatactcaagcaaacaaggagctgattcgatgtgtcatcctttctcggattatttttggggaccatcactggaaatgtgcacgagctctggccaacctagcttatggctacttgacactgagaggcctcccagttcaggccaagaaacatgctacatcagccaagaatacactgttgacctggaaggcaaatacgacctcaaataaggagaaagaggaaatcctggaagctctggtcaagctgtactacactctggccgtggcctggctcctgcagaaccgtggcagagaagcctatttcaacctgcagaaggcagagagaaacatgaaggagctgaaagaattatataaaggaggtgtttgtgaattacaagtctctgagaacgacctaacacttgctttgggcagagcctccttggccatccacagactgaacctagctctggcatactttgaaaaggcaattggcgatgttattgctgccaagggtgataggacgtcagatctgatcagcctgtacgaggaagctgctcagatagagcagctgaggaggaaccacaaccaggccatccagtacttgcagcaggctcattctgtctgtgttcctttgttcactgaagtcagccccaaaactgcagaaatgagtgcgttactggccaaagcttatgccatgtctggagaggcccagcacagggatgctgttgagatatatttcataagaagtatcaatgcatatcgagcaacattgggctcagaggattttgaaacactgagcaccactgaagaattttgcaaatggcttgtccaaaatggagaaaaacagatattccaaaaaaggagatataaacatgaccataaaagacatgaaaagatgtttaaccccattagtcatcgtggaaatgcaaatgaaaaccaccatacagacactagagtggtttaaatttgaatgacttccaacaccaaatgccagacaggacatagagcaactggatgtctcatgctcacaggcagaagggaaaactactgtgtgtgacaggaagatggacttacccaaccttcagcattctcaatctcttgtctattaacatgtgtttgaaacattatgcattcaaagcaaacatctgggaggaagatgggagaagccttcttgcccctgttctacagaagtaattgaagttcatgacattcaagctcattcaccagtaaatgaatttgggtcatgcttt

SEQ ID NO: 61737 - DNA, 1179 bp, Homo sapiens
aatgttcggggtggcaccagcccactgccacagccccagtccaccatgccacccatgctgtggctgctgctccactttgctgccccggcactggggttctacttttccatcagctgccccagtggtaagcagtgccaacaggccctactctcaggcaatgatattctcctgtattgcaactcctcgggggcgcactggtactatttattcacacaaggcaagaagggcaggctcaccagcctcaccaatatttccaatatggaaataatgcccgagggcagccttctcattaaagatccattgccctcccagacgggcctctaccactgctggaacaagaatggccgccaagtggtgcagtatgaaattgactttcaggatgtcaccaccctgcatataacacacaaggacctgggtcagaggcccctgcagaacgagaccctgcatttgggcagcaaacagctcatttttacctggtgggagccctggcaggactgcaaccgctgtgaggagccgggcgagtgtaaacgcctggggtaccgctacattgaggagcctctggaggaagccatgccctgctggctctatctgggagaggtgctggtgtggtctagccgcttgcggcctgagctgcaggtggaagcctgccacgtccagtgcaccaataacacacagttaagggtggattacgtcatttttgacaacttcaggctcgatgagaagacagaatttgtgtggctcgactgtcccttaggatccatgtacaggcccgtcaactggcgtgccaacgacacccccctgacgtgggagagccagctctccggccaggacttcaccacctttctggacccctccaccggcggcaggcagctgcaggttttccagccggccgtctacaagtgcttcgtgcagcaggagctcgtggcccagttcaaacccgccgccagtctggagacgctggaggctcagtggagagagaacgatgcccagtggcgggaggcaaggaaggccctgcggggcagggcggactccgtgctcaaggggctgaagctggtgctgctcgtggtcaccgtcctggccctgctgggggcgctgctcaagtgcatccacccttccccgggcaggagaagcacacaggtgctggtggtgaaataaagcgagcccccggtgcacaagcgg

SEQ ID NO: 61738 - DNA, 1295 bp, Homo sapiens
atcagttcctaccagagccgctgcgggtgccattccacccatggccggacacaggccctcaaaccacttctgcccccttccaggcagtggtgggggcggccccagagggccgatgcccctgcgggttgacactctgacctggttgagcacccaggcggcccctggcagggtgatggtctggccggcagtcaggccagggatctgcccaggccctgacgtgtggaggattcccctgggtcccctgccacacgaattccggggctggatagcaccctgcaggccccgtcttggagctagtgaggcaggggactggttgcgacgcccctccgaaggcgccctcccggggccctacattgccctgcggagcattccgaagttgccgccgccagaggacatctcgggcatactgaaagagttgcagcaattggccaaggagttgaggcagaagaggttgagcctagggtactcgcaggccgatgtggggatcgctgtgggagctctgtttgggaaggtgcttagccagacgaccatctgccgcttcgaggcccagcagctaagcgtcgccaacatgtggaagctgcgaccactgctgaaaaagtggctgaaggaagtggaagcagagaaccttctgggcttatgcaaaatggagatgatcctgcaacagtctgggaagtggagacgggcaagcagagagcgacgaatcggaaacagcctggagaaattcttccagcggtgccctaagcccacaccccagcaaatcagccacattgctgggtgcctccagctgcagaaggatgtggttcgagtttggttctataaccgcagcaagatgggcagtcgaccaaccaatgatgcttccccacgggagattgtggggacagccgggcctccttgcccaggagcaccagtgtgctttcacctgggactggggctcccagtggatatcccccactatacacgtctctactctgcaggggtagcccactcctctgccccagccaccactctgggcctcctcagattttagggctgaggggcttgcccttcacggcacggttggagaggggagaagaagggaaaacccaggaaatgtccctagggttcatttgagggcttttagtattaatttctcattcactgtctaaagaagttaaggatacatagtagggaatgggggtgggaattgttcaagaaaaacctgggagagaagatgaagtttattgcagttttgtgttttccctttgtttttccctagcattggtttaaaggtacattacagtatatagatggtttcg

SEQ ID NO: 61739 - DNA, 459 bp, Homo sapiens
attgctgtcaggaatggcttcagggaaagatacttgtcctactttgcctaaactcactaacaactgctctgatgagagtctctataaatctgctaataagtatgaagagattcatttgccacgattttcattaaagcaagggatgatcccaagacgttatgtcatgccttggaaagaaaacatgatattcaggaatgtgaatctgaagcaagcagaagtgtgtgggatccatactggccctttagaagactctctgtttttgaatcacagtgaaaggctttgccatggggaagatcgtaaagttgtcttccaaaaaggcccaccagaaataaaaattgcagatatgcctttgcattcgcctctctccagataccaaagcactgtgatttcccatggcttcaggaggcgactagtctaatgaaagaagaataaaataataaagtgtttcaatctctgctc

SEQ ID NO: 61740 - DNA, 2270 bp, Homo sapiens
aaaatgtagacagtgatgatctggtaactggcacacttcccaagctcaagagctcaaaagaatggttggagcccaagcccctttgttttatggaggttttagctaaagaagatactgaggcagctattcaatcaatattatacaaagaaaattctgtaattaagggaaatgcatttatagaacattatgatccaaaagagtatgatcccttttatatgagcaagaaggaccccaattttctgaaggttaccatcccaccatttcatgaccctttgaaaaaagcacaatatgacaaggataatgaaaaaagaactcttcttcagtgtgagactggcaaaatatattcaataaaggaattcaaagaagttgagaaggttcagctgcattccagattcccacaaatttctaattcaaggcactttataactccaaacgagtggctgaaactgcctacaagatacatagaaagtgaattttgtagaaggagaagaaacaaagggtcatcctttctagaaagagaaccgctgtgctatcaggagggaaataatccaagtgccaaagaggccatctctgaagggtatttttcttccttgagcctcagccaggaacgggaggaagaccaggatgggtcttgttctgtctcccagctggagtggatacaagcatggcttgcttcagcctcaacctcccggactcaagcgatcctcccgcctcagcttcctgagtggctgggactgcgggtgcctgccaccatgcccggctgatttttaaacgttttgtagagacgcggtcccattgtgttgcccaggctggtcttgaacacctggcctcaggtgatcctcctacctcggcctcccaaagtgctgggattacatgcatgagccaccatgactggcctagactttttgatttaaagagactttttggatagaaatgcttttctctattacagttataaatgactaaaaatactagctatgccaaaatggcaaccagaggccgactgcaaagcttcaaaaggcttgatgctctcctggtagacaagtcttcagtctcttaaatgtttttttcatatgttgacattgaaatttcattttgtgtagatgttgggattatgtctcattcatttatttattcatcattcacttagtaagtatttaagtgcctgtttttcccaggtgctctgccaggttctggggatataaggatgagccaacataggctctctgccctaaagttagtgggagaaacagtaacaaaagattttaatactatgagattaactgacttagttgtggtatgtagaaagagacacagagcctgcagcaagagcctaggtgaagactcagtgaagcactacctattgaaaggagaatctttcaaatccttaacagttattttcaccatgtaaaaaaggcgacattgccagggaacatcaagtaaagggacaaatgctcagtcagagttttcgcattttcctgattggcccaaatgttttgaagtcggtttcttcacatcagaatccaaaccaggtccacctgtggcaccttcacccttcggagccggacgcgtcacttaaaaccattcctcttacgttgtcgccctcaatcttacagggattctcctgtccatggctgccaccaaaactgcgagttatgatgaacatttcaggccagaaaagttaagagaatggccggagcccgagtccgtttctttaatggaggattgtgacagtgcctgctttaaagcaggcgttgaaggggaatgttcgggctcagatttggccgagagtgtggccaagagtgtttccagtcgccagcctgggggctggcgcaccgacgggggcgggcagccgggcgggtgaaggcagccaccccagctccccggcagaagccaggtctgggcttgccagtcaattctgcatacttcagcgtctggtattagctagagaagacattgatgaagcagtatgtgcaatattatttaaagaaaattccattgtgaaggttacagtcccaccatttgttgatcctctgtttcaaagacagcaagaggtggatgaagagaggagaactggtcttcagtgtgagacaggaaaacgacattccataaaagaacttgaagaaatagagaaggccaggctgcatgccagctcgccctacttcactttcacttcacactgtgtgattccaaaagagtggcataaagcctctgcaagagccaggagtaaaacttacaaatacagtcctgaaaagctcatctgtgcagac

SEQ ID NO: 61741 - DNA, 1531 bp, Homo sapiens
gtttctcctgcttggcctcctccaggagggctggcttctctgcagagctctgcttcctgcagcctctccccgacctcagagcctctgcagaggaaaggccccctggggccctgccccacagcatcatgatggggaaactccccctgggggtcgtctccccttatgtgaagatgagttcggggggctacacggaccccctgaaattctacgccaccagctactgcacagcctacggtcgggaggatttcaagccccgtgtgggcagtcacgtaggcaccggctacaaatcaaatttccagcccgtggtctcatgccaagccagtctggaggccttagacaacccggccaggggggaacaagcccaggaccatttccagtctgtggccagccagagctaccgccccctggaggtgcctgacggcaagcatcccctgccctggagcatgcgccagaccagctcaggctatgggcgggagaagcccagtgcgggtccccccaccaaggaggtccggaaggtccatttcgacacccaggagcacgggcctcaggccatcacggggctggagcccagggaagtgcctctgctccgccagcagcagggccaggacccgctggagcgggagaacttccgacatggcccacgcttcatgacgtcggagtacaattccaagtatctcagggaccctctagaccagccagatttcttgcagaagaaatcgatcggcgcaaaggaggggagtggcttcaccaaacagtcccaccagagccccattgtcttccaaccgccctcacaggccctccctggggaccctgccctcctcccaggccagagtgtcaccaagtcagacttcctccccaagactcacctacatggagatgagttcctacctgtgttggccagaggctccaagcgggaaacagccttcagccgagggaatgaaaggattctgaaccccagagtgccccctccctgcccagaacccagcagcgtgagtcaccagcagtttcagccacttcatcggatgcaacagacaaacgttgccctgcttggccgggagactgtggggaaaaaggagcccacagggttcagccttaacaaccccatgtatgtccggagcccctgtgatcctgacagggatcagcgatacctgaccacctacaaccaagggtactttgagaacatccccaagggtctagaccaggaaggctggactcgaggtggcatccagccccagatgccaggaggctacgccctcagccagccggtcagctgcatggaggccacccccaaccccatggagagcctgcggcacctgcatccccacgtgggaagaaccctgacctcagctgaccccttctaccagaacacacctcacagcagccgctgcgtggcacacagctgagccctgagcccttggtttgtcaatcctaggggacaggagccaggctactgtctgtacccccactccatcccccaggggaacacccctgcccagctactttcctaatgaaataaagagcattgaagcag

SEQ ID NO: 61742 - DNA, 1609 bp, Homo sapiens
actttcacctttcctggtgatgcctttggctccttgagctgagttttgcccgagtggggctcatgagggaggatggagtttcttgggactactcagaccgccagttactgtggtcccaagaaatgctgtggcttgacctcactgccagctgtacaggcgccagtgatccaggaatgctatcagccctactacctgcccgggtaccgctacctcaattcatggaggcctagcctcttctacaagatagccaacgtccagacctgcccggacgagagcaccagtaccctgcggccgcccaccatcctgcccacactgcgctccgcactcttctctcgctatagcccccacgactgggaccagtccaaccagctgcaggtgcgtggggccgaggcctcccggctgtgggccagccggctgacggatgactccatgaggctcttgcaggacaaggaccagctgacgcaccagatgcaggagggcacctgccggaacctgggccagaggctgtcggacattggcttctggaagtcagagctgagctatgagctggacaggcttctgactgagaaccagaacttggagacggtcaagaggcggctggagtgcgcggccaatgaggtgaactgcccattgcaggtggccttggagtgtctgtaccatcgagagaagaggattgggattgatttggtccatgacaacgtggagaaaaaccttatccgggaagtggatttgctaaaatgttgccaagaacagatgagaaaattagctcaaagaattgatatccagatgcgggataaccgggatgctcagcacgtgctggagagggacctcgaagacaaaagctcggcccagtgtatcgatgagaagtgctttaacctgagaaatacgtcagactgcatcagcttcttccacggcatggagaaaattgacggcacgatctccgtacctgagacctgggccaagttcagtaacgacaacatcaaacactctcagaacatgcgggccaactccatccagctgcgggaggaggcggagcacctctttgagaccttgtcggatcagatgtggaggcagttcacagacaccaacctggccttcaacgcccgcatctctgaggtgacggatgtgaagaataagctgcagacgcagctggcgaagacgctgcaggagatcttccaggccgagaacaccatcatgctgctggaaaggtccatcatggccaaggagggcccgctgaaggtggcccagacaaggctggagtgccggacccggcgccccaacatggagctgtgcagggacatcccgcagttgaagctggtgaacgaggtgttcaccatcgacgacaccctgcagaccctcaagctgcggctgcgggagacacaggacacgctgcagctgctggtcatgaccaagtgccggctggagcacgagctcgccatcaaggccaacaccctctgcatcgacaaggagaagtgcatgggcatgcgtaagaccttcccctgcaccccgcgcctggtgggccacacctgagcaccgccctggcgcctcattccgcgctggcgtaaaattggaaaaggctgagaaacaaagtaaaacagtattttgtttg

SEQ ID NO: 61743 - DNA, 1907 bp, Homo sapiens
cttttttccctgggtgcccacatgaacagagacaccaggatgctctcctgagaccacagcaactgcagaagctgaagacatttccagaagttcaagcttccaccctctgcaggtccccactgagctgggacccaggtcatccaccccaccccaaatccctggataggaaacccctttctcctcctgctccttgtccccttcatccctgccgcccagcatcctactggcctcagcacctgtggccagaccgtccaagatcctctgaaggcccagctcttgctgtccaccccggcagtaggcaggcagcctggccatgtgccctccggtcagcatgcggtatgaggaagagggcatgtcctacctgtacgcctcctggatgtatcagcttcaacatggagatcagctaagcatttgcttcacctgcttcaaggctgcctttctagactttaaagacttgctggagtcagaggactgggaggaagacaactgggaccctgagctgatggagcacactgaggcagagtcagagcaggaggggtcctcagggatggagctgagctgggggcagagcccaggacagcctgtgcaggggggctctgaggcatgggggccagggaccctggcagcagccccagaagggttggaagatgcaggtctggacccccactttgtccccactgaactatggcctcaggaggctgtgcccctgggcctgggccttgaggatgctgactggacccagggtcttccctggagatttgaggagcttcttacctgctcacactggccaagcttctttccttcatagcaggggtttctcaaagtggacctgcccccaggggagcccatggtgttgaagctgggcattacctgggcagtggaccctgccgaggctgaggcctagttactggccctgcagcttgtctccatggtgggctgctatgataccatctacctacagaagatgaccccagacagggccctgaggaccccagggcagcactggaaattgctgctggagcctggtgaagtgtgggtggtgagactccaagatgcaccccaagagcaggacctgcactggtggatgctgagcattctagaaacatcgttaacaggacacagggcagagctggtccctgcagcctcagccctgcagaagaggattcaccatagtctcttattcaccctggaccaacagggagagcaagaagggagactcagcctgtaagccacagtcctccagccaagaacaggatctcagcacccctgagacacagagcaggggtcctgaggaaagcctggctgttgcaggagcctcggccatgggggagctgccctgtttccagcctcagtccagggccccagaactgagagactaaggctcatgtagctgccattgtcctgggcacaccaggacatcagagactgggaagggccagcaattgctgttccacaacagccaggggagcagttggcaaaggaaacatggggagcaactttaggggctgggagatagggcctgttgtggcctcagagggaagcattacaaatattcataacctggaaacaagttcttaccagttgattgtcacatagttctggatgtgttggcctgaatggctgttgtgctgcttgtgacatggggggcagggcacagaacttgtgcctatttcaccttggccatggggagggacattgcttgtaaaacacatgctctgcagaacacaccaggatctgtggtgacctggatgtgttctcgactttgccaggacaatctcaggggtgccacaagaccctgtcagcagcactaggatctctggtctacagtggagggagagctggttttaaatgttggccgttgatgcaatttaaccatttaattcctgttgctctatatgttgttttta

SEQ ID NO: 61744 - DNA, 2151 bp, Homo sapiens
gatcgcggcgccgccccagaccgggggcgcagtcccactcgctccgagccccggtcccccaagcctccctcccgggtacctggggccgcgcccgccctgcgcccagctccgccctccgtcggcccaggcctgacagagcccggcagccatgagtgccaacccccggtgggacatcagcagggcgctgggggtggccaagctcttccacctggtgtgcggggtgcgggaagcctgcgtgaccccgttcctgaccctttacctgaggcagctgggcttggccgcgccctgggtgggcaccctaatgggaaccaagcacctaatcgctgccttctgggctcccgtctgtgccttcctggccaaaagctaccggaaaaggagagcgcttctgatcggctccctgctcggctcggtgggggccagcctgctgatggtcctggtcccaccggtagacaaaaatcgggtgcacttcccttgtaatggaagcagcggcctgaccagcacagacgcactcccgggggtcacgctacctgtgaacatcacctcggcccaagagtctgcctccagccacccagccaagaggactgcagaggtggaaatgcctggcttcagaaacccacctggtgaaagtgaccgagaaactttccgtgatctgcacgtctacttagcgccctccgttgaaggagctaggaccacatcccaagctctcctccatcctgtcacttcggggctgaaagatcatccctgggaagttacttttgaggtggtcaagacagccctccccttgcttactggggggaaagggcccgggaatccagccaatttgtcagggaccaaggggaaagcctgggcttttgacctgtccttggaggcgttgcggcggacttttatcctctccttggggtccgtggcgttctgggagctgctgacagcgcctctggagcaggtggcagatgacagcctttatgagttcctggattttgtggatgccactgaccgatacagaagcctgtgggtctggaggttgctgggcatgtcggcaggcgtgtgtggcatcacagccttggtggggcagctggactgcttcctgatgaccagtggcccccgaggtgtggtccacttctatgggtactcggtggtcagcaccctggccttactggtgagcattgcctttcccattcccatctgtcagcagtgggagcccagctacaaaagggtcaaagcactgtccattgtggggggtgacccccacctcattctcctcgcctccaccactgttttggtaggagccatcgtcagtactgtccagaactttctgttctggcacatgaaggaccatgggagcggcgagctggtcatgggtttctcggtcgccctcagcttgctgggggaaattctgcttcatccgttcaaagctacattgcttaggaaactgtccaggacgggcctggtggggctggggctgagctgcctcgctgggcagctgctgtactactctttcctctggagctggtggtccgtcctccccattcagatcttgagtgccattagcaacagagctttgtggtgggctgtgggggcctcagtagaggacctggccactccccgcatggagagggctctgagtgccttgttccgaggccacttttacgggagtggctgtagcctgggcagctttgtcgggggcttcgtggtgatgcgcttcagcctggctgtgctctaccaggcctgctgtgtggccctgttgctctggttggccttgctcctgtccatacagcggaggctgccccgagagcggaaaatcaagtactcgaagctgctgtccatggaggtgagtgacaccagtgactctgagcaggggacagaacaggactggcttgtgaaggccatgagggaggaacactcagactgaaagggctgagaaatccagagtgtgctgatccagcaaggaacgaatggactgaacaaaactcagcctgctgaggacagaaacctgccctggactgctgggagccggggaagagaggatgggtctgtgctgaaggcccaacaggatcatctcattgcatgattttctttacttttgaagtaaaaggagatttaacttttaaaaaaaaaaaaaaaaaaaaaaaaaaaagaaaaaaaaaaaaaaaa

SEQ ID NO: 61745 - DNA, 1669 bp, Homo sapiens
ccagggacagagggagacccaaagatctggtctgtagctaagtgaattttctaaaactcattgattcacacgccatcccttgaggtggctggtgtcccgcgatggccacaggcgccctcctgccgtgctcgcgcccgtgcccgatgtcccggctggacttcctcaaggcctcgcacttctcgctggggcctgacctgcggctgcacgagggcaccatgcgcaccacgtcgcaccgggactttgcctacccggctgccacccgggagccgccgagcctgcagccgccgcccgcgctgcttttcccaatggacccgcgctgggaccgggaagagcgcgtgtcggaggcgcaccgcgcgttcccgccgccatccacgccgccgtgggagctgctgcaagcgcaggcgcgggaacgcacgctcgccatgcaggccggcaacctgcacctgcacgaggacgcgcacgccgggatcggcctctccaacgcgcacgccgcctacggctggcccgagctgccggcgcgcacccgagagcggatccgcggcgcgcgcctcatcttcgaccgcgactccctgcctcctggcgaccgcgacaagttgcgcatcccgcccaccacgcaccaggcgctctttccaccccacgacgcgcgcccgcagcctcgcgcgcccagttgccacctcgggggccccaacaccctcaagtgggactacacgagacaagatgggacttcctaccaaagacagttccaggccctgccaggcccacctgccttgaggtgtaagagggcctcctccggagtggagctgggagactgcaagatcagctatggatcaacgtgttcggagcagaaacaggcctacaggccccaggatctgcctgaagataggtatgacaaggcccaggccacagcccacatccactgtgtaaatatccgtcctggtgacggcctcttccgcgacaggaccaccaaggccgagcacttctatgccagggagccagagccttttgttcttcaccacgatcagactccggagtcgcacatcctgaaaggaaattggtgccccggccccggcagtctggacaccttcatgcagtacttctacggccagccgccacccccgacccagccacccagccgccacgtgcctcatgagaaattgcagagtcatgtgaccctaggggagccaaagctactcaaacgcttcttcaagaccaccatgggctcggactactgcccttcagagtggagacaggtgcagaaagcgcccaacctccacttgcagcaaagctacctgccgcggggcacgggcgaattcgattttttaaccatgaaccagaagatgctgaagccacacagaacacctccggccccggtgactgaagagatgctacagcggtgcaagtacagccacatggagccccctctgggtggactgcgcttcttctcaacacaatacaaggacgagtttcctttcaagtaccagggcccagcagccctgagactgaaaaatcctcaggagggcttcgtgcccctgggcacgcctcaccagcgcggctgcagggagaagatagaccctctggtcccccagccccctatgtacctgtgccccagccagcaataaatgccatcttggcaacattcaaaaaaaaaaaaaaaaaaaaaaaaaaaaaa

SEQ ID NO: 61746 - DNA, 2252 bp, Homo sapiens
ctggcctgtgcggagcaaggcggtgtttctgagaggaatgcgcagctgaagagagaggtgggcagcaggcccggtcacctgccaggtgaccacatggccaggtgccgccaccactcgggttacctggccgatgacgaggccagccactccatgtgcagtgcacgggtgcagctgcccaagaagccactggtcccagaaatgcggccagcctgcaagccgggccgtgtgccacacccaccatccacatgtggcagctcagcactccagggccaacgccgaaacaagaggcaccctcagccctttggccactttctggatttcctaactgagagccaggtcctggacagcctggagacagtggtggagaaggcgactgagcgcatggctgccatgaagacggaggctggggtgccgcttgtggaggtgcaggacccagtggaggtgccaagtggtggacggcgggcacatgcccggcccagcctcagcaccgtacaccggcaccgtgtacggccgaccctctgcactggacaccccaacaactacccatccagctccagctccatgtccaactgccatagcagcctcatggccggctgtctgggctcccacagccgggacagtgacctaggtgcccaaggctcattgccacctgtgagggacaaactcctgctggagaagaacctcaagcggctgctacagctggagagggaagggaaaggcctcagtcagtcctgctcccagagggactccctgctgtgggattcgctgggtagccagaccagctttcagtggacacaggagcagcccttgtcctggttctcagggctgctgggctcaagctctggcgtgcctgaagcatcagagccgaggcctggagaacaggagccaatcttccgcaagcgagagttcaataaggagatcaagtcattactgagccagctggagtccctcgacctgcctggctactgtccgctccgtgagccccatcgcacgctgaacttcctggctgaccaccgcctcttccctgccctgcaaagcgtggtcagccaggctgtggataagctccgtggcgcccactgccgcgacggccgtcctctgttccccaccagcttggagcccacctcagatctgccgcctctgggctctgagccagctaaacccaccaatggcgggcagccctatgcttccccccgccccacagtctccagccccaagatgcttcagagaaaacgcaaggacagaggaggctccccctccatgtctagtgcccaggtggccaccagattcaaactcaagagcccctgcagcagcagcaggttcacgaagaagaagccgctgccctccatctcgtcgaagtccagcatgtctcacttctccaaccgcctttatgaggagctcgccgacttcctgacccagcaggcagcctccttggtcatccgcaagtacgagttcgaaaaggacctcagtaagcagctgggcttcttctccttccccatcacccacgtgctcagggacctttccctgggcttaaagaaggtaaaaggctcccgcatccacctgtcctcggagacccaccggagctgcctgctgcgtaaactggaggagtccaaaagggcccggcaggcctcccggctcagcacctcccactgcagcacagagacaccctctgtgcagcaggaaccagccacccacactgcccaggaccaggccacagagccctgccgctccctctacaccaacttgccagccagccggcagctcagccctttggagcccaagctctacatgtctgcctgcaccggcatgggttccagtccccccaagtccaaggacatggacaatgagggccgtgataaagccgagattgaagatgaagatgaggatgagttcaaggatgaagaccaggatgaggacaaggatgaggatggagtctagagcctcccagagcctggagaggaggcctcggtcagccactccgtggacgtgggccacggtgacccaccatgaagtccccactagccactcgattccctgctctgtcagagttgctgcacatcacaccagcccctgccaagagcaggagtcaccacaggctgaatgcccacgaggagctctgctgagactctcaagggagccagtgaaagaaatagaaataaagcctgtgttgctgggacacaggtttgctgtcctgaaaaaaaaaaaaaaaaaaaaaaaaaaaaaaaaaaaaaaaaaaaaaaaaaaaaaaaaaaaaa

SEQ ID NO: 61747 - DNA, 2556 bp, Homo sapiens
ctcttcactctgaaagcagagaaacacattttcaatatattttccattacggctccttctagaacactgtgttgtttctcctagtaaaggggctattccttgaaaaataactctaggtttagctgattttattgtttttattaataattgacgatgcctctaagaaaaaggaaatccccagagaggactgcatcttcaaaatcccccgaaatctctaggtcccatgtaaacagtataaaggaaagaacgtcatcagttggtttgcctagtgttattccaaactctacacgccgtgtgagctttgcacctaacctgccttctatgaaaacatctcaggatattggagactctaggatctctctaaagactcttttgaatgctattaaaaccatggagggaagactggaaggcaaaatagagattctagcctcaagacctttaataaatgatgaatcaccaaattttcttaaacaggactcggtgaaatctattcttgaaagaagtaaagaggagctgtcccgaacagtgaagtgtcgtaatgcggccctgaaagagagtcagaagttgaaagaagacctcgaggctgtggaggacagggaaaacaagaaggtgggaaactttcagcgacaattggcagaagctaaagaagacaactgcaaagtcacaatcatgttggagaatgtgctggcttctcacagtaagatgcaaggtgctctggagaaagtacaaatagagcttgggcggagggattcagagattgcaggcctcaagaaagaaagggatctcaatcaacagagggtgcagaagctggaagctgaagtggaccagtggcaggccaggatgcttgtcatggaggaccagcacaacagtgagattgaatctctacaaaaagctctaggtgtagctagagaagacaacaggaaacttgctatgagtctggaacaagctctccagacaaataatcatctgcaaacaaagctagatcacattcaagagcaattggaaagcaaagaacttgagcgacagaatttggaaaccttcaaagaccggatgactgaagagtccaaagtggaagcagaattgcatgctgaacgcatagaagctctaagaaagcagtttcaaaccgagagagaaactacaaagaaagtggcacaacgggaagtggctgagctgaagaaagcccttgatgaagctaacttcagatcagtggaagtgtcccggaccaaccgagagctgcgacagaaacttgcagagctagaaaaaatactagaaagtaacaaggagaaaataaagaatcaaaagacccaaattaagctccacttgtcagctaaggcgaataatgctcagaatatagaaaggatgaaggttgtatgggaaacctcttctcacttcctggataccctgtgaggatgtagtcagtcaatggtgtctagggaagacaggttttagaaccctagcagccccatgtattctctgggaattatagccagttgtctttggggagactttttcagtggagtcactgctgtgtaaatgtttgatttctcatttgctgccagtgtcacattccggctccctatctgtcccttccgtgttgattgtactggactttgctcttttgggatcagtgggctagatgggaaagaaagctcagcaggaactggtaactttgggtctcatattggattctttctgtcatcctataggcaaaaagagcaagccagtttttccactgatcatctttttatgttattttccaattacttttagcaaatagaaaaagaattgaagcaaatggagctaattaaggatcaatatcagaaaaagaactatgaacagtctttgagtatccagagatttgtgtgtgaaatgactaacctgcagaaagagatgcagatgttggctaagagccaatatgatgcctcagtgcggaataaacagcaagagctgcacctagaagcagagcggaaaataaggcaggagctagagaatcggtgccaggaattggaagaaactgtcagacacctgaagaaatgtaaagaggcaacagagaatacgctgaaagaagccagtgtggaatcagaacagataacagctaatctggaagaagctcatcgctggtttaagcacaggtttgatggtctacaacttgagctgacaaaaaaccggttgcagaggccttctggggaagacaggtggcaggaaaaggaccaagatgtaaaacatgatgtcatgtccaaccaatctgttctgcatcgatgggagagaaaacagaatcttaggcccatgcccaagaagtatcattctgaggtacagaggaagtgatgtccttgacaagggagcttctttatgtgtagctacactccatgattccaagagcccagcagccggggctggcctgtttctagagtcataagaacatgaagtctttgatgtgggctgaagattttggacctgagtttatcactttatgaactcttatatcagtacaaaactacccctttttttgtcccttttcacattttccacccaataaatttgtgttaatttgttgta

SEQ ID NO: 61748 - DNA, 1706 bp, Homo sapiens
agataatgttaacaatgtgatttagagtggaagcaataccagatagtctaacaatgtgatttagaataggggctttggatcaaatggtatcagctcaacttcaggaggagctggatgctaagatccaccatgagggaagtcaccatgttacacgatggaggcccaataaaaacactggacacaaggcttgggtgaacaggccttcacgatgaccagagacagaagcccctgacttggctaaagatacttctgctctccctatccccacatcctctttcagttacgcatcacctcactccttctgaaccatatggttctgatgtcagagccagtgtagtaaagagcttctgctgttcctgagaactgttgctgctggaagtgatgcttccactgctacagctggtacctgctaagctgctcaactcctcttgctccttggagaagacactgcagtgcagctgttccttccatgggattcccacaccctctgtgcagtggtggatgggaggagtccccgtgggtgtggatggcatggatggcagcctccaagtgacttccaccatgcttggcccctgggctaacagcaccatcagcctaactgaagagccagaaatgggcatgagacttctctgtgaggggaagaaccaaaacggaacccatgctttgagcatcctactgatgtcaagaaagagttctttggctgcccaggccttcgtgaaagggctgatccagggtgctatctatgcgggaattgtaattgcgctgctcttcctctgcctcctccctctcatagtgaaacatatcagaaagaagcaggcgaagaaagctgcagcgatcagagcaaaaaagagctctaaagtcagagcaagccaagaacttgagatgtctctgaagcctgaggaaccaggaaaacccgtagtcgccacattttctgagagccggatattggaaaagcaagataaacgagccagctaagcctgtggaacatgcctcatacctggagtcgccattatccctggaattacaaagatctgcaaaatttatagcgctcacagaaaccctggaggctgtaataaacctggagccccctggactctcctcagctcacaaaaccctctcaattcctacacatcccttgacactcattctccattgaataggtggttactcttagacctagtcttagaacctctgaagacacactttgtaatttgttgtttggctaaatgagaagaaatctgtgccaccctgggaaggtgtcaaaagaaggaaaaatacatgtgacaatatgaatcaagtccatcagcaagttacttttgagcgcctactgtgtgtcagtgcctgagatacacctacaagagcgccaggctttcaagccttcatatctggatagaatcccaacttcagtgcttggtggctgtctatctttggacaagatctttcattccccatcctttgaacatcacatgacccatatctgggtggagaatgggtgaaaagtactgttcagagatgcaggtgagaaaaaacatgacgatgggccctgaatgccaagattcattggagctttggagctttatcttgtaggaccttatcctgactcccttagaatgtaagttccaagagaacagggactttgtctgccttgttttctacttttatcaccagcacccagaatgatgcctaaaatacaataagatctcaag

SEQ ID NO: 61749 - DNA, 558 bp, Homo sapiens
atgtgtgaagaacaagaaagttcttgggaaaagggtagctccctgtcatcatctgtgcagaatagaagtcgagttacaatggagcttgggaaagctcagcacaacccagaagtgcaggtcagagcagagcctttccagggctatccccgcaactacacagctccctcccgcaaagtgacatgtaccaaatcttgcagccaacaagctatctttgttggacagaattatcctacaaggattagacagatcatagacaaggacagacagccccaggaagttgaggcatttaaggggaagatattgtatcaaaggcatccccaatccatgccccacagggatcctgtgccacatctaaaccccacttgtcagcgtcaagtcaccctggtgtgtccagctgtcccaattagtggcaaaagcactgtgttcagtgatgtgcctttactaactggacacaaaatgcattggaagtaccaccaccttgaggattaccagggcactgaagagctgacagatgccattttggcagaagtgtacatggggctgttctttaaggagtaa

SEQ ID NO: 61750 - DNA, 3073 bp, Homo sapiens
tttctaaaaatgatttacagacgtttaagaataagataatgagtgaattgattagcaatggcatccagatatatcagctcccaacagatgaagaaactgctgctcaagcgaactcctcagttagtgggctgttaccctttgctgtggtagggagtacagatgaagtgaaagttggaaaaaggatggtcagaggccgtcactacccttggggagttttgcaagtggaaaatgaaaatcactgtgacttcgttaagctccgagatatgcttctttgtaccaatatggaaaatctaaaagaaaaaacccacactcagcactatgaatgttataggtaccaaaaactgcagaaaatgggctttacagatgtgggtccaaacaaccagccagttagttttcaagaaatctttgaagccaaaagacaagagttctatgatcaatgtcagagggaagaagaagagttgaaacagagatttatgcagcgagtcaaggagaaagaagcaacatttaaagaagctgaaaaagagctgcaggacaagttcgagcatcttaaaatgattcaacaggaggagataaggaagctcgaggaagagaaaaaacaactggaaggagaaatcatagatttttataaaatgaaagctgcctccgaagcactgcagactcagctgagcaccgatacaaagaaagacaaacatcgtaagaaataatagtttctcttactattctgagagccctatcattctacatcgcaacttcctgtgagattgtctttgtagcatttaactctgaagttctcattttaaaaattggcttgcttattgtatattttccccaactaaagtgtgaactcctagcggggtgtggtggctcatgcctgtaatcccggcactttgggaggctgaggcgggtggaccacctgaggtcaggagttcaaaaccagcctgaccaaaatgatgaaaccctgcctctactaaaaatacaaaaattagctgggtttggtggccagtacctgtaatcccagccacttgggaggctgaggcaggagaagcacttgaaccccggaggtggaggttgcagtgagccaagatctcaccattgtactccagcctgggtgacaagagcaaaactccgcctcaaaaaaaaaaaaaaaaaaaaaagtatgaactcccagaaggcagatcctgtgtccatcttttcagattctgtatcttggcatttaggacgtacactaacacaaatatgactttcaatcaatatttgccaaaatgaaaaaacaaaagaaacacgtagcatcatgtaaaaggagctggttaggtggagaaatttatttaccatagtcctgcttttggatccagtagtgacttttaacttttatatccaaatagaagctggaggctttgttggggactcataggcataaaatgttaagttatacaaatctaattaataggcctattttcctttttaagttctactactgataatttcttgacagtttttatgataaaaggttggaatttgataagaactcccatgcttttgtgtcagacttaaaactgatattagaataaagaattcaaaagctagagaaagagttgcatttgaatgataatattatgtgttacagatttggggtatatgccaaagttatcaaagttgtagaaaataaggccaggtgtggtggctcacacctgtaatcccagcactttgggaggccgaggtgggcggatcacttgcggtcaggagcttgagaacagcccggccaacatgacgaaaccccatctctactaataatacaaaagttagccgggtgtggtgttgtgcacctgtagtccctgctactcggaaagctgaggcaggagaatcgcttgtagccaggaggcagaggttgtagtgagcagagattgcgccactgcactccagcctgggtgacagagcgctgagtcaccacacctggtataagccactgtgcctgacccacaatgacttttatacatattgttaaatcatcttacagattttataatttgggggaagaaaaattttactaaatgatcttttaatggaaactctacaagaaccagaatctttgctttgttcacttatgtatccattcctaggcctagaaaaatgtctgacgcatagcagcaattattcattgaataaatggacccagcaatagtacattagctatgccatatgcatacattaaaaatgtagattattgactttcaaaagataattaatgtaacttcttactgcttctgaacatgtttgtgagttatattgctgagggacctttatcttctcattctttcatcttaatccaatgttattaaaactgaaactgaaatcaccaatattattccatatttaaaaataacatctaccttataaaaattatcattgtgctgcatttgagaatagactttttaggtaataatggtataatccatagggtttttgagggcacagaaggattcatgctaacagaacattttattttctattttccaagagctataaaacatgatattatatgatactataaggcatatttttattttccataattttttctaaaaaaaattagtgttggttttccatataacttttaactttataagtaaatatttgtctctttcagctccagtttcatgtgaaatagagtttccagatttatgtagcatggaaagttttaatacgtcagttactgatttttgccagtcattttctcaattatttacttcttttatctttagttgattttttttgtagtgacaagttttgtttctattctcatttccttttgtgtatattctatgtagatttcgtttttggttactatgaaaattacatataacatcctggagttataacattctgatttgaatttatttcaacttaacttcaatcacataccaaaattctactgctatataggtctactctttttaggttattgatgtaacaaattgtatctttattcattgtacaccacctaacagatttataattacattttatgcatttgtcttttaaatcctgtagaaaataaaaagcggagttacaaacc

SEQ ID NO: 61751 - DNA, 3186 bp, Homo sapiens
atccccggggatgatcgagttcatcaaagtggaaaacttaaggcggtcttcgtcgggctgatacttcctgctttattgaatgttgatattaaatgcttacctccggaattattttttgaggtatcgactttagattaaaagcctaacaattcttacctttcccgtgggctgcctggctccccgcgcggttcaacgcgagcagcgccagtgaggggacctgtcgcgtgtcctgctcagcgcggtgtcccacgggcgcgtccacagcccggggcgtccaggggctacagcggtgcgagctgctctagagacggagggcccggccggagaccaggggccggcggtttcatcctgcgctgacccttgccaacgacgtggctggtcctggggatcacagggcttcgctcatcccatcttcctccatatccccaaggtggaaacaagggggcgagatgtccacaaactgaggaacagacaaaatgctggctgtccatgcagtggagtgtgagtcagtcatcaagaagagtgaagttcagacccatgccacaacatgggtgaaccttggaaacatactaagtaaagcaagccaatcgcaaaaggacaaaacctgtgcgactccatgctatggaccgagttctgtccccctaacatttgtatgtgaagccttaatccccaatgtgactgtgtttgcagaaagggcctttagagaagtaattaaggttaaatgagattataagggtggggtcctgatctgataggattagtgtccttggaagaggtaccacaggcctggcactgtggctcacacctgtaatcctagcactttgggagtccaaggtgggaggaccacctcctccaggagtttgagaccagcctgggcaacagagcaagacccctgtctctacaaaaaaattaacagggcaccgtggtgcgtgcctgtagtcccagcaacttgttatggttacgtaagaggaatgtgaattcaaccctggtgattttgggtcgtgtcaggagcagccctgcgacaccagttggcaccttctgcagactctatgtgtcgataagacaaggtcccacccagcaagtgcccttttctcagctgatgaacataagcctgcatggacgttactgtccatggaaaggagcggccggcaccggctgtgacagacacgtgcctgtctgcgatctgagtttcatgaacagtaaactctgttggtcacagcctctttggaaaacaatgttagttaaaagaagtgccctgtgaccagcagtgccaccctcgacagggttctccaagtgggacccgggcaagcagcctcagtatcactaggggttgttagcaatgtgccttcctgggctctgccccagagtggccgcaccagtgactgggagtgaggtcccagggccctgtggtccatgaagagctctcaggggattctgatgcccagtggtacaggtgggccaccggactggggtgtcatctgcccgtgggcacgagacatgaacaaggacatagcaggtctgttagtagtcataactaaaagaacaaaggagccgggcgcggtggctcatgcctgtggtcccagggtgttgggattgcaggcgtgagccactgcgcccggtccacgtttctatcaaattgaaatcatgagcggttttgctgagggtgtggggcacccagagcctgcggcctgtgctcgagtgaaaatggtggccccgctccagaagcctgcgacggcgctcacggaaccgcagccttcgtgcggcggcacctgggccgtgctactcctctgtgacttcccggaagagatgagctgctacgtccagcaaaaggcacatccaagatcgttcaccccagcatgactcgttacactccggactagaaggaaccccaaggtgcttcagtgacagaacgatgaaccagctggggtgtaacccccatgcaatggaatatcgtacaggaacgaaaaggacacgctacccctacaagcaacatggatctcagaggcaggatgttgcgcagaagaaaccagacacaaatgcttcggctcgtgttgctgcgactcattacaggcagccgaatctgcggtgatgggggccccaggagcagtgaccaggaggcagtgccacggagcctgcggtgggggctgatagtcagtagcgtgacctggttgggatgttctgtttttaagctggagtccatcatgtttgtttatttgttcatttcgtagaggtgggggtcttgtagaggtgggggtctcgctctgttgcccgggctggtctcaaactctgggcctcgggcgatcctcccgccttggccttccagggtgctgggattgcaggtgtgagccactgcataaggccgttattgttattagtgcttaaaaatatttagtaaacattttatttagcctaaaaaccattcagagagcagaggctggacggaacaaggcgtgccaggcggtgagagcacagaccctcctcttccagagcaggaagtgggtaaatgacttttaagcctcatttctggggtggcaaaactcttctgtatgaagaagtacaaatatgtaatgtcccataatggcagctatgggacgttacgtatttgccaaaacccacataacgcacaacgccaagagtgaactgtaatgtaaactgtggacttaagtcaatgatcgtgtcccgatacgggctggttggttgtgatgcagggcaggtgaggcccaaagtggagcttagcctgccagcgttcttggctttgcccaagaaagaattcaaggacaagccggaggtagaagagaacaacttgattgaagaggcagtgtggcagacctcactgaagatccccctaccccaggctcaagtcagagagagaggaggtggcagtgccggaatttcagctgcgcatccgtcccagctctgcactgcgggcgtccgtcccagctctgcactgcgtgcgtcccgccctggctggagcttgcagacggcagccctgcaggaacccaccggggctgactccttcctccccagatcccacaaaacagcagtggatctccactcggcacgcattcccctctacattcacacgaagtgtcttttaatggaaagtgtataaactcgttaattttggttactgcactgaagttaggcaagcttctgcagctttattaaatgaccaatgctgtccct

SEQ ID NO: 61752 - DNA, 1344 bp, Homo sapiens
ttcctttgattctagtctaccagttgccacttctggtccatttgcatataacactggagaagtgttcctttatctttgtgaagcccttaacattcaaggagccactactgcttctatgctgctgaaaaatacaagacactgcctctacctctgcatctgtcctttgctttttgcttggaaactatcacatcaaatcacactgagatcagttcctactgagctctcactggcaaactatcagtagaagaagcctggacaaaactgagttcaatgcttcacaattgctgcgctcttcttctccccagtggaaaaaaaaatgctctctgcaccacatggccgctggccgctgccagaggatggaggaaggggtgatgttggtcattcaagactgtttttcctacctcttcagtgcctctttcaactgtatgaagttaaaaccagcttggcaggctctagagagactgacctctgcagatggtttaaagggagaagctcaagggtccacagttcacagggctgccaatcaggcctgtgcagaaaactcaacagtctaaaagaatatatgaagacagaacctcaacctagaagaaatggacaaattcccagacacatcaaggaattcctagacaaactatcaaaactgaatcatgattagatagaaaatctgaacagatcaatataagtaaagagattaaagcagtaataaactctcccatcaaagaaaagctcaggacctgatggcttcactgctgaattctaccaaacgtttaaagaactaacaccaatgattctcaaactctttttaaaaattgaagatgagagaacacttccaaattcatatcacgaggccagcattaccctgataccaacgccagacaaagacactataagaaaaggcaattatggaccaatatccctgataaacatggatgtaaaaatcctcatcaaaatactagcaaatgaaattcaaccacaaatttaaaaaagcattcaccatgatcgagtgggatttatccctgggatgcaggaagtttcaacatacacaaatccataaacatgatacaccacatcaacaagatgaaggacaaaatctttataatctcaatagatgcaggaaaagcatttaacagaattcagcaccctttcatgatttaaaaaaactcaacaaaatatagaaggactgtaccccaacacaataaagaccagatatgacaaacccacagctaacattctcaacagtgaaaagttaaaagcttttcttctgagatcaggaacaagacaataatgctcactctctcgacttctgttcatcgtaacgttggaagttctagacagagcaattag

SEQ ID NO: 61753 - DNA, 1344 bp, Homo sapiens; identical to SEQ ID NO: 61752

SEQ ID NO: 61754 - DNA, 3590 bp, Homo sapiens
ctaggaaagagagaaaagagggtttgggttcacacggatgctgttttgttctctctatcgtgttccaacaaggaatccaattccaggtccagatgatgcgcagaataagcagtgagctcttcagggccactgagttttatgaaatgttttggtgaaagtggattttactattcccgggttgaagattgtcttggtggccttcaactgtgagtgacggtgaatcaagctgtggacgtggcatgcaggttttacatggccatcagttttcaaatcagtgggatcagtctctgagaatcttctgggacatgtggcacgagtccaccgagtttcgtgcagagccgcccaacgggttcccaaaggggctgtgccctgtcgcattcccacctggcagggacaaaggtccccgggaccgcacatcgtctcggcatttggtgtcgtcagtgtggcttgggaaggctcccgagcccctcatcctgccgccctcccgtaggttactgaactttccaccatttctcatgattttgttcattgctctctgtctcctcgggagccacctgggctccggccccacatatcccagccaggcccagggcttgcaaccaggaaggcactcagtctattgtgctagctgctccctgggcctggaaagcttttggtagctctgtcacccctcctgggtgacccctgcctctgctctggtgaagctcccatccctctggttcacgccatctccccagggctctccagccctgcaagccttaattgacactgcattgtggccaaaacatcatgtggtttcttagtgtatggctgacatccaggttgatctggtggaagttccaggggggacctctttcccctcatcttcatgacctccagggcagggccaggaagaggaagcagcctctgaacagagagaagactggctgccccacacggcagtcgtccacaggcagcccggaaggaaaggaaaggaaagaaggaaaggaaaaaggaaaggaaaggacaggaggaaggaaggaaggaaggaaggttggtttccttctgcagaaagctcctcctctggcttggttccttacaatccaactagtcctggagctcagctcacctttggtgctggcatcaccgtctctgcccaggatgtccgcctgaccatgccccctccaccttcaacccaggctctgcgttccctccagctggaggcttgggctctcaacacagcctggcctgtttgtcctcctctggctgacttcggaagggtcatacctcgtatttccaccagttctcggccttcaccttctcgacatccaggaagtgtgaccacacttggccccacatctatggagaatgcctttatacacgctgtctatcaacttgggacagaacactctgaagaaacagggtctggggcagccccagggaggatcggagcctgaggattctggaagtctccagtctctgacttgttggtttttcaggggatgtgcggtttacctaggaccaggcctccctcccacgattcagagttatgaattctcatcttgacctattccttccttcggtttgccagggggtgtccctatccctgagatagtcctggctcatgccctggcatcacactgtctccagcaagttgaggtttgcagggacaaacaggaaagctggtgaccagacctgctgtccagggtgaggacagtgtgtcacccaccctctgagaggcaggcagtgccaggacccagccatgggagcccatccccctgactctgtagagagcggtcacgggggccctccctccccatgtcacctccttgccactcctatatccctgcccgtcttgaagcatctggagccatttctctgtgcctctcatctcctgacgtctttgctgtcaactatgaccagaagttagcggagctaccaaggcttcctgaagcagcctttggatgctgtatcctgggctccgaggccctgacgggactgaaccacaaaaagaaccaggaaagggcaggccccggggactgagaccctctgactgaacaggcgtctgtgacctggcctcacgacctgggacatgccgtcctcaggccacagacactggactttggtcaagtactagcctccaggtggggtcctggtgcaagcagacagcaacccccgagccgtgactgcggttctcagtttggagtttggtcaaacaaccaatggggacagagtcttggggtcaggtccagcaggaactgccacccctcccagggacagcctgtctctcccactcaccatcgctggtgcccacgggctgctgaccacctgccaagtcctcctgtccctggaccagcctctcaggcagcaggtcttacctttgcctccagggcactgatcgatggcagctttgtctcactgtaaggcaacccagacagagctgagggcctgtgctgggccgggagctgtcctcctccttccctagcagtcctagggaaggaccagccgtgtctctccccaccccacccctggtcttagcccaggagacacacagggaaggtaggaagagggtctccctgtgggctgacgcctgtgaagggacaggacctgggagaagaggggtgtgtgggtggggcagggaccactagggccctgtagagcatgggcttgggctacacaacagggctgcccctcctgggctagaggcagtgccctctgcaggagctgagaatgtccagtcctgagaaaggacgtgtatggcccagggtgggtgactgggccccaaaagcagtcctcgagggagtgaccacattaccaggccaggatcctgagacctgcccagtgcactgagggtgcacctggggcctgtcccacctgatgtccccaagtgccccgcaaggtctgatctctcagcctccatctacctcccccggggggtgggggcttgctttgagctgtccccacctttctggatagaactaatgtacttcttacatatattgattgatgtctcatgtctccttaaaatgtataaaagcaagctgtgggccaggcgcagtggctcacgcctgtaatcccagcactgtgggaggccgaggctggtggatcacgaggtcaggagatcgagaccatcctggctaacacatagaaactccatctctactaaaaagtacaaaaaattagccaggcgtggtggcgggcgcctgtagtcccagctacctgggaggctgaggcaggacaatggtgtgaacccgggaggtggagcttgcagtgagccgagatcgcaccactgcactccagcctgggcgacagagcgagacgccgtctcaaaaaaaaaaaaaaaaaaattatctgggcatggtggtgggtgcctgtaatcccagcctttcaggaggctgaggcatgacaattgcttgagtctgggaggcagaggttgcagtgaactgagatcgcgccactgcactccagcccgggtgatagtgtgagacgccgtctcaaaaaaaaaaaaaaaaagcaagctgtgtcccaaccaccttgggcacatgtcgtcaggacttcctgagaccatcacgggtgcatcctcaaccttggcaaaataaactttctaaatt

SEQ ID NO: 61755 - DNA, 3985 bp, Homo sapiens
aagaagaaggttttgacagaagctgatactccaagcaagtttgacccaattaattatttgggggaatatttaataagaaacaatcctaattatatcaaagacccaggaatgtctggttaccagaggttgatgaaagaagtcacagaagacctgaagatatatgttcctgacactatctgcaacagagtatccaagatgaaggagaatgttaaacagaatagaaaacaaagagaaagcatagacaaaatcaaagtcaaggtggccaacacacggaaacaggctctgcaggagcaattcgatgaatggattctagaccctaaaggaatgattcctaagtcagtgattcagaatgttcttcaagaattctttcaaaatccagatttcaagcttggatcacactgcaaacaactggatattactgactcaacagaaccaagattgaacaaaatggaatttacagaatacatctcttcacatattaaagacttgaagagtgaaatgtttgaggaacttcttaagcacctttgccactctgcagatgaatttcgggaggtcataaaagctgacatgcggaggcagatgttcgctgaactcttcctacattgtgaccacgggaaggtagggtttttggatcggcagaggacattggccctgctggaattgttctatgaccatagttcacaaatgcttaggagtttacttcaaaacccacgacaatggccattcattgaatttgaagagataaacttgactgagttgtggggagacatggataatcagaaacacatttatgaaggttttgacaaagtgctcttggagatgaatacattactttctgcaaatcatgctagcaaaacccaaagtaaattattagaaagtccagatcaacctaaacttaacgaacagagaacatcaacaccatcaccaaacccgccagaacagcagagaggagtaactgcagaacaaggaccacaaagaatttcaattgaagaacaacaacaaggcaaaaagccaactgcagagcaagaactgtacatagaatcagtaatagaaccaggaacacacacagagtcaactctagaacaagggtcaagtagaaggttactgacagaacaagaaacacacagagagtcaactacagaacaaggacagcacaaagggtcaatagaaggacaaggaccacgcagagtgtcagtttcagaacaaggatcaagcagagagtcagttgcagaacaagggtcacgcagagagtctattgcagaacaagatcgacacaaagggtcagtagcagaacaaggatcacgcagaatgtcagctgcagaacagggatcactcagagagtcagtaatagaagaaccataccaaaaatcagaacaaggaccttatggagagataatttcagaagagcaagaagacataggctcaacttcacaatcaagaaaagatagtatcttaaaaagtacaaaatatggggaacctataacctctgagtacattgaagtccctctacaggaaaagaggtcttgggaacaaacatatgaagaggaaatattcctgagttctgaactgcaagaggaagttccaacgttaagcagaaaagatcactttccagaaactacaaaaaaggaagttcagaaagacaagccctgtgaacccaagtcccaaaaaatagaaggaaagtcatggtcaggtgaattttttacttgtaactggaaaatgaagtatgtcacatttgaagatgaggaacaggcaaacttaatctatggtaactccaggttcacagctaaactacacatccaatttccaaagccacaccctggtcacgaagtgagattgtcttcaaaacaatttcagaattacatagaattggttgtgtctgaactcaggggcaatgaagaccaagttctggaaagtgttgtggaatttctgattaatgctttagagaggagccacattgagagtctgaggaattctgccaggcggaaatggctgcaccaaatccaatgtgctgcagagacaagtggggtgtccctagagccggtgtatagtgagacctttaaggccctcatgcaggatgctgaagcccatggaaataaaaagatcagtgctcacatttccctcttagaagaaaacctactactgcctgagaaagggaatgttctattgaggaatgtggcttgtaccttagatgatgctcaatttgtactgaacagagtgctctacagggacatgaaaggaatcagctttacagtagtggatgaagggaagccaatccatgttccccaagttcagtaccatgggaacatcttcttctggaaccagtcccgtaataagcatgattataatgggtcattcctggctctgcctcttcaagatgcatatatgaggatctttggggtcttggctgttgatacccttagagatccccacgaaataaacatctttctacctcatgagatcagattctatcagggtgttgctaatgtctttagcactgcctatcactacgtccacagccgggagcacattctgcatattgtgatcactggcataggctggctttatgacgtcacatccagcatcacctccatcactacgtactttgtagagcctagcccagcccaggattcagactatgttttacgcaacatgatggttacagggcagctgggtctaacagaaatccacaaaaatcctcctaccatccacaggaagtcatgcatcttcagagatttcctctttaaatgtactgacagttcagaagttgttctggcttctgcctgtggagaaacgcatatagtagttccacttcgtgagagaacaggagaggctctgggagtcctcgattttaacatcggccaaaataggatgttgttgtgtcaagaatataaagatctacagaaaatgatgaaagtggtccaagtggcctgctatgaaatacttggcgagttctctggagagataaagaaaaaatatatcttagagattgaaaatgtcagggaagtccagcgggcaggaattctcttcttccgaatcatgctgctcgagctacaggaaagcatccaactactcaattccatggaatttgtgtcactgttgctctatgaccatactcttgtaacagagccaaattctcctcaagacagcaaatctatggagttggaagccaacgtgaaactagtgcgtgacatcctgaaggcggttatcttgttctttcatccagagttggaattttcaagtgactttggaagttgggataagtgtaaattttatgttaacaaatatttagtcaacaatatttgtgcctttgatccaactgccaagcatgtggaagttaatgtacagcttattgatgaatatatcagagatcattcccgaactgaagtatggaaatttggtaatgttgtcattgaacatctataccactggatacacatctgttcagctctcatgaagataaccaaacaactaaatagtggtattacacctccgttgccctccaagactgacaattatatgtatgcaaaaatgccaggggaaggtttgcaagagaagtgataatggatgataatggaattgatactgtatttaggatcctttgtttgttatcagttttgtttgttaactataaaatattttccattggaaaggggtacctataaatgtcttctgctgctaatatttatctcagcactttctaaacccaaaagtgctacctaagaagaaatttagccaaaaaatacccagctaaggtagccatagccaagtgtatttaagtatgttatagaatatatttgaaagcttcctttcagtttgagctttgtatctgctgtggaactgttatggttgattgggtagttatttttcattcttataaggttcaaagtaacagctgaggatttagaaaacaagaataccaaatagaatacgaaataataaagataaaccaaaagaataccaaataataaagatttttaagaaatgg

SEQ ID NO: 61756 - DNA, 4828 bp, Homo sapiens
ggcaccctcagtgctcagttgcttcaggcagctgagctattcagaccatggagaatatcctctgttttctgaacagctatactgagacagggctgagccctgactcacattggttggatatcgaccccaacttcatctgcttgagtgggttggggttgtttatactgtacttgttctacgtggtattgaccctgtattcgtcacccaccgaaaaaaataatgacatccaaaagcatcagggcagagccaagaggagaaggaaaggtgggacattcaaaggtttcccagactggaaaagtttccagagagaagaggaagaggaaaggaagctgctttctcttctgaaaagctttggacctcctgtttcctgcagtcctcggggccagcatcatgataccaaccactttcgtcgactgttatgcccagaccccgtctgtcgggtgtgtaagagagcaactgctgatatccagcaactgctgtcttgggagtccctgaaagatgctgctccctctgtgtcccctttggcttcttcggcttctgcgactgagtcatcgttcactctggcttccaccccctcagcaacccctccagaagacctaatactgtcccctcggcctaaggcctctccaccaccccccttaattctctcacctgacctgatcaccaccttagctgacttattttcaccctcaccactgagggaccctctgccaccacagcctgtttctcccttggattccaagttccccatagaccattccccaccccaacagcttccctttccccttctcccaccacatcacattgagagagtggagtccagcctccaacctgaagccagtttgtctctgaacaccatcttttcatttggctccaccctatgccaagatatttcgcaggccatgaatcccattgattcttgtgctcgtcatcacggaccaccaatcccatctgctttaccaccggaagattgcactgtgactcagtctaaatcaagtctcaccatcttgaagacttttccggaaatgttatctctaggtggctctggtgggtcatccacctctgccccaacaatcaaaggcattgaccattcacaccttgcatcttcagaattcacctggtggcagcctcatgccaaggactctttttcctctaattttgtgccatctgatttcatggaggagcttcttacccttcattcttctgaggcctttttaggggggcactctgtggccaacctcatagagcctgttaacatctcatttctcagccatgacattctggcactcctggagagacaagtcaaaaaaaggggtgatttcctgatgtggaaagaaaatggaaagaaaccaggatcattcccaaaacaacttaggccaaactaccaactaaattcctcacggaatatgttaacctcaattgctgttaagcatgacttggcagaatcctttcctttttgggccagtaaaggcaaactagaatggcagcacatccatcagcagcctccacactctaaatgctttgaagaccatttagagcaaaaatatgtccagctcttctggggtctcccatctttgcacagcgagtctctgcatcctactgttcttgtccaacgtggccattcctccatgtttgtattcttcaatggcattacaaatacgtctatatcccatgaatccccagtacttccccctccccaacctctgtccttgcctagtacccaaccactacccttgcctcaaaccctgccccaaggtcagtccccacatctcactcaggtgaagtccctggctcaacctcaatctccattccgagccctactacctagtcctctattcctgattaggatctgtggagtgtgttttcatagaccccagaacgaggcacggtctcttttgccatctgaaattaaccatctggagtggaacgtgttgcagaaagtgcaggaaagtttgtggggcttaccctctgtggttcaaaaatcccaggaagacttttgtcctccagctcccaatcctgaattggtcagaaagtccttcaaggtccatgttccgatctccatcattcctggagattttccactcagctctgaggtaaggaagaaactagagcaacacattcgaaggaggctcatccagcgcagatggggcctgccccgcagaatccatgagtctctgtcattgctacgtcctcagagcaaaatttcagagctatctgtgtcagagagaattcatggaccgttaaatatctctttggttgagggtcagaggtgcaatgttctaaagaagtccgcatcaagcttccctagaagcttccacgagaggagctcaaatatgctttccatggagaatgtggggaattatcagggatacagccaggagactgtcccaaaagatcacctgttgcatggtccggagacatcttcagacaaggatctgaggtctaactctgagagagacctagaaactcatatgatgcatctgtcagggaatgactcaggggtgagactaggtcagaaacaacttgaaaatgccctgacagtacgtttgagcaagaaatttgaggaaatcaatgagggtcgaatgcctgggactgtgcatagttcatggcactcagtcaagcagacaatgtctcttcctgagaaatcccacagccaaattaaacatcgaaatctggtaacattggtgagtgaggaccactgcgttgatacttcccaggaaatttccttccttagttccaacaaacaaaagatgttggaagcccatattaaaactttccgtatgaggatgctgtggggccttcccctcaaggtccttgaatccatagaaatcttcaaatcgaaagcggacctttccacttccttttcccatttcgaccttccctcctcagccaccttcatctctcagggagattccaaagatggggtctctaagtcccgtagtcgaagcacttttcaaggagaaaagttgggaacaacaagctcagtccccatccttgatcgtcctcaccctgtctcctcacctgtcgtccaagaagggcaggggaccctgagaagacaattttctgatactgaccatgaccttatagagacagattccaaagacggggcctccacatcccttagaagaggtactacagattttcaaagcgaaaaattagattcaacaagctcattccccatcctcggtcattcttaccttgtcacttcacctgtcaaccaagaaaagcaggggaccctgagaagagaattctctgatactgacaatgatcttacagaaagtgtccggacaacagaggatggcagacagacttttctgcccccgccacacagcatcgtagacgaagtcagtcagaaacagactgtactggccagtagatgcagcgcagagctgcccataatgcaagctggagctggctgtgagtcatgggataagagaaagagttcctttcataatgtagacaggcttcagggcagtagaaagacctttcctgtcaccaatgctcttcaatcacaaactaggaacaacttgacaaccagcaagtcaggaagctgctcactgacaaatgtgaaagcaagcacttccaatgaaactgaaattttcccaccaagaatatcagttcctcaagatcctaaatcatcataccttaaaaatcagatgttgagccagttaaagttggtccagaggaagcatagccaacctcagagccatttcactgacatgtcttttgccttagataacttgagttccaaggacttactgactaattcccagggcatctcgagtggggacatgggaacttcccaggtggtgcatgtccacttggaggacagcggaatccgtgtggcacagaagcaggagcccagggtccctacctgtgtcttacagaagtgtcaagttacgaatttcccaccagctgtaaacagagtgagtcctgtgagacccaaaggaggagagcttgatggaggggatgcagggctggggacatcccaacgcaggagaaagagcctccctgttcataacaagacatcaggggaggtgcttgggagcaaatcttccccaaccttgaaaacacagcctcctcctgaaaaccttttcagaaaatggatgaagacctctttgcagtggtttaataaacccagcatatcatatgaagaacaagaaagttcctgggaaaagggtagctccctgtcatcatgtgtgcagaatattggtcgagttataagagctgcctttactgggactactgaagctcagaaaattaggaaagacactagggagttcctagaagagaagctggggcataggcatgggatagatatcacctgtccccaagagcccctttccttcccagtggggcttgggaaagctcagcacaacccagaagtgcatgtcagagcagagcctgtccagggctgtccctgcaactacagggctccctcctgcaaagtgacacgtaccaaatcttgcagccaacaagctatctttgttggccagaattatcctacaaggattagacagatcatagacaaggacagacagccccagaaagttgaggcatttaaggggaagatactgtgtcaaagccatccccaatccatgccccacaggaagcctgtgccacatccaaaccccacttgccggcgtcaggtcagcctggtgtgtccagccgtcccaaccagtgctaaaagccctgtgtttagtgatgtgcctttcctaactggacagaaaatgcttccaaagcatttacagggaggaaaatttccccccacaaaataattcactccttgttgagaatcttgattctccccaataaatgttccaataag

SEQ ID NO: 61757 - DNA, 2463 bp, Homo sapiens
atccttatcttctcgtctagttctccgaggttgaaggctcggcctgctcagagaaggaaactgaggtccaccgagttggagaaacctactcaacaccaggactaacttcttcagtgcttagagtgtgagaaaaatggcaaatatgaatagtgattctaggcatcttggcacctctgaggtagatcatgaaagagatcctggacctatgaatatccagtttgagccatcggatctaagatccaaaaggcctttctgtatagagcccacaaacatcgtgaatgtgaatcatgtcattcagagggttagtgaccatgcctctgccatgaacaagagaattcattactacagccggctcaccactcctgcagacaaggcactgattgccccagaccatgtagttccagctccagaagagtgctatgtgtatagtccattgggctctgcttataaacttcaaagttacactgaaggatacggtaaaaacaccagtttagtaaccatttttatgatttggaataccatgatgggaacatctatactaagcattccttggggcataaaacaggctggatttactactggaatgtgtgtcatcatactgatgggccttttaacactttattgctgctacagagtagtgaaatcacggactatgatgttttcattggataccactacctgggaatatccagatgtctgcagacattatttcggctcctttgggcagtggtcgagtctcctcttctccttggtgtctctcattggagcaatgatagtttattgggtgcttatgtcaaattttctttttaatactggaaagtttatttttaattttattcatcacattaatgacacagacactatactgagtaccaataatagcaaccctgtgatttgtccaagtgccgggagtggaggccatcctgacaacagctctatgattttctatgccaatgacacaggagcccaacagtttgaaaagtggtgggataagtccaggacagtccccttttatcttgtagggctcctcctcccactgctcaatttcaagtctccttcatttttttcaaaatttaatatcctaggcacagtgtctgtcctttatttgattttccttgtcacctttaaggctgttcgcttgggatttcatttggaatttcattggtttataccaacagaattttttgtaccagagataagatttcagtttccacagctgactggagtgcttacccttgctttttttattcataattgtatcatcacactcttgaagaacaacaagaaacaagaaaacaatgtgagggacttgtgcattgcttatatgctggtgacattaacttatctctatattggagtcctggtttttgcttcatttccttcaccaccattatccaaagattgtattgagcagaattttttagacaacttccctagcagtgacaccctgtccttcattgcaaggatattcctgctgttccagatgatgactgtatacccactcttaggctacctggctcgtgtccagcttttgggccatatcttcggtgacatttatcctagcattttccatgtgctgattcttaatctaattattgtgggagctggagtgatcatggcctgtttctacccaaacataggagggatcataagatattcaggagcagcatgtggactggcctttgtattcatatacccatctctcatctatataatttccctccaccaagaagagcgtctgacatggcctaaattaatcttccacgttttcatcatcattttgggcgtggctaacctgattgttcagttttttatgtgaaatacctcaactgtttttttcaagagctctcatgatattttgagccttgacaacagttctatataaattcacttgtaaatgctgctgttgtgtaattctaaatattttctaagataatttgaaagcaagggaaatagtggccccttaatgagtatttttttattggggtggggaaaggggcaaaaagaatgatcttagtgtctttacctttctcatattaactcacctctttattctgtggtcttttctgaatagaaatgtatgccctaggaagaaatcatgctgggttttgcttttagagataaaaggtggtggatttattttgcctgcagtaaagattctcagggtgtcagagcagcatattgtcaaatcctgcttctgttttatgtttcagtgtattcactttcattttcttacttactagaccatttctgcagtttgcccaaacctctactgtttgggacagtaagccaaatacctcatttttaaaaagaagttttcatggcatcagtgttaataaagtacatttttaactgagtcttaatctctatttgaagaaaaagtagagacaaaagtaatgtcaatgtaatccccaggatcatgaaatgtatacaaaataaataaagtaggagagtttgttgctg

SEQ ID NO: 61758 - DNA, 1369 bp, Homo sapiens
gccactgcccccacagtttctctctgcttctggtcagctgggttgtcctgcatggtgacgggtgtcatcccgaacaaatcagatggcatcagaggcactccatcaagtgggagatggggaggaggctgtactgaagaaagaaaacttcaacatgatgaatgcccttgaccaactgccaaaacccttttcaaaccccaagtctatgaaccggaccgtcactaccaaaggactcccactagcctcaaagggcaatttggtcaacttcttggaggatgataccatcaacctactgaagccgctgccagtagaggattcagactgcagctctgatgagaccagcatctctgccttctcatccaccttgctgaaccccatcaaattagctgtgacccagcccaacagcagcttctttgcagggatgctggagggggagctgaacaaactcagcttctccccaatggccaagaatgcagaaaatgaggacctggcgctcggcccctgcccatgcccatcgaagtcccagatggccacaaggggcctgctggaccttgacaaccctgagctggagacagaaacctcctcaacgcactcagaatcttctgtggttgtggacctgccggacacccccttcatctttgagcacaccgtcaacaattccacagctgtgatttcctggacctacgccttgggcaagcagccggtcagtttctaccagctcctgttacaggaggtggccaagacacaggagaatgagttgcccgaggcaaagaatcgtccatggatcttcaacaagattttgggcactactgtcaagctgatggagctaaagcctaacacgtgttactgcctcagtgtccgtgcagccaacacagctggggtggggaagtggtgcaagccctacaaatttgcaaccctggccactgacttcagcagctttcctgagaactaccccatccagatcaccgtgcggcgcaaggaaccccggcaaaagatcgtgtccatcgggccggaggagatgcggaggctggaggatctggaatacctatttccctgttaagggggagggccccaggacacccctcacctactttcagcttcaaccccaggccctcagaaaccagagccatgagacctaccataccaccagcaccctgcgggcccggggtctggcagagtggtatgggcaccccacccctgggctggggccaaggctacataggggccccattcacctggaggcatctcaggccaggccatgccaggctcagccactgcccacagctgctagactccctcctcctccaaatctgggctgggtctaggtccctcattaaagaactgcaggtcatccagcaaaaaaaaaaaaaaa

SEQ ID NO: 61759 - DNA, 11191 bp, Homo sapiens
ccgcgcgaacatggccgaagtcggcgaggacagcggcgcccgcgccctgctcgcgctgcgctcggcgccctgcagcccagtgctgtgcgccgcagccgccgccgccgccttccccgcggccgcacccccgccggcccccgcgcagccccagcctccgcccgggccgccgccgccgccgccaccgccgctgcctccgggcgcgatcgcgggcgcgggctcctccgggggctcctccggggtatccggggactccgcggtcgcgggcgcggcgccggccctggtggccgcggcggccgcctcggtacggcagagcccggggccggcgctggcgcggctggagggccgcgagttcgagttcctcatgcgccagcccagcgtcaccatcggccgcaactcgtcgcagggctcggtggacttgagcatgggcctgtccagcttcatctcgcggcgccacctgcagctcagcttccaggagccgcacttctacctgcgctgcctcggcaagaacggcgtcttcgtggacggggccttccagagacgcggcgcgcccgccctgcagctgcccaagcagtgtaccttccggtttcccagcacggccatcaagatccagttcacgtcgctctatcacaaagaagaggccccagcctccccgctgcggccactgtacccccagatctcccctctgaagatccacatcccggagccggacctccggagcatggtcagccccgtcccctccccgacgggcaccatcagtgtccccaactcctgcccagccagtccacgcggtgccggctcctccagttaccgctttgtgcagaacgtgacctcggacctgcagctggcagcagagtttgcagcaaaggccgcgtcggagcagcaggcagacacgtctggaggagacagccccaaggatgagtcaaagccgccgttctcctacgcgcagctgatcgtgcaggccatctcctccgcccaggaccggcagctgaccctgagcgggatctacgcccacatcaccaagcattacccctactaccggacggccgacaaaggctggcagaattctatccggcacaacctctctttgaaccgttactttatcaaagtcccacgttcccaggaggagcctgggaaggggtccttttggcgaatagaccctgcctctgaagccaagctcgtggaacaggcattccggaaacggaggcagaggggtgtctcctgcttccgcacccccttcgggcctctgtcctcaaggagcgctccagcttcgcccacacaccccgggctgatgtcccctcgctccggcggcctgcagaccccagagtgcctgtctcgggagggctcccccattccacacgaccctgagtttgggtccaagttagcttctgtcccagagtaccggtattcccaaagcgcacccggctcccccgtcagcgcccagccagtgatcatggccgtgcctccccgaccgtccagcctcgtggccaagcccgtggcctacatgcccgcctccatcgtaacctcacagcagcccgcgggccacgccatccacgtcgtgcagcaggcccccaccgtcaccatggtcagggtggtcaccacatctgccaactcggccaacggatacatcctcaccagccagggcgcggcggggggctcccatgatgcggcgggcgcagccgtgctggacctgggcagcgaggccagaggcctggaggagaaacccaccattgcgtttgccacaatccccgcggctggtggagtcatccagacggtggccagccagatggcccccggggtccccggacacacggtcaccatcctgcagcccgccacacccgtgaccctcgggcagcaccaccttccagtccgggccgtgacccagaacggaaagcatgcggttcccacgaacagtttagccggcaacgcttacgccctcaccagccctttgcagctccttgcgacccaagcgagttcatccgcgccggtggtggtcacccgggtgtgcgaggtggggcccaaggagccagcagcagccgtcgcggccacggccaccaccaccccagccactgccaccaccgcctctgcctccgcctcttccactggagagcccgaggtcaaaaggtcccgggtggaggagcccagtggggctgtaaccacaccggctggagtgatcgcagctgccggcccccaggggccaggcaccggggagtgaggtcacctgcaacgcgggggagtgggactcacccagcggcgaccccgaagctggacccggcagctcaggcggccgcacccacagacggaggagaacagcccgcggcggcctgtgggcatcggcggcacctggacacacccagccctttccatttgatcgcctgccttcccgtggtttaagacaaaaacacataaacaagttcagacaactgattgtatgattctgggaattctttgctttcctttccttctccctcggcaccacctcctctccccaggcctccctgtcgggcatggggaggaggttggagctcagcatcttgaggaatgtgtcaagacagcccctccgctccgcgctgcacggccagccgcctttgtccgggaggacagacagaaacgcagcaaggcacacaccaaggctgccggggaggcccgggcaccggacagatgcctgttgggaagccaggagctgccgagccacggaccacctaacagcctctccgcccggaacgtgacatagagagtgttggcattaactcggggggtgtccgatttcacttcagaccccaagtttttctttgtttgtttaaacatggaattcagacttcattgtacacctgagacagacacaaaagggatcatgtatttttgaggattttacctgttgacgtctgatgaccggccgtaggtccagggttcccgctgggtttaatcccctcgaagagtaaacctgccgctctgtctgataacttcaagtaagagcagcggcttcctgggttggcgttcgcggtggaaggttcctaggatgaaaggtgagcctggatccgccggccgcagacatcgcgctgctggggacgattggggccgctgctctgcagaccagaccttcccgaattatccgtggctccgatgtcccggtgctgacggccacatggggacctaacagtgccaaacgccatctgctccagctgctttttcacccagttgcagagtcctcaccactcccacattgatctgctgttttcaattggaaccatttctcctgcctgaaactccagggcccctccctgggctgtccgtgagcaggagaccccaccccagcagcagtggtgagcaggcctgtgcctccacgcccagcccccgccaacgcgactggttttgtttgccacacggtgagaaccggaggacgggatgctccagccagttgggtggttctggggtccctgaggaagccccctcctgcacttccattaagacagccagtggttcctggatctttgtcaccaagcagcgttgagccagagctgtctaatgctgagcccagctcaggaaggagagaggagtccttcagtgtgtcttggagatgcgaagtgcgtcctcgtaaaggtcagctgtcagttttgctggccgctccggcgctggctctcctgtccgggaccacaacgagaaacagcgacagattcgacgcagagctccggaagtgcctgaggagcagtggttcttggaaatcgcccgtcctccgcatcacagcctctcaccagcaaagcagcctctgcccaggccctggcgggagagctgcagagggacccaggtgcctggagggcatttgagggaggtggctggacaggtgtctccctgaagaagaagggagaacacttttcaaagtgattccgaggcagtgcgggaggacacacgtgctgtgcagtggagtggggtcgcccgtggcccccatcagagtccccgtcccccaggacaagtgcagaacctctgtgggccccctccttccacctagatagagaaaaccccttgttcggtttccttcccgtgtcccgttgtttttctaagccccccgaattgagtcgtttctatggcactaacctttccatgggaaataagctctttgtggaagtccgtacctgttgccctgggtgaggtttcagagaaacgggggcaggatgaacacagccggctgtcctgggtgcagttacgtccgtggagggtgagagattgcgccccgttccacacttgtgtcgcctgctgttgtctgtgggccttttctttccgtggtgcctggtgtgtgcgtgcatggcgtgagagaacggggggtgggggttggaggtggctccccgacaccggtgcctgtgtggcctgagccggcgccctcccgggagcgcccgtcacggggggcctctgtgattacctgctgctgctctctcccgcgtggtgactatatgtcctcagggctgcctgtggccaccctgatgggagacctctgtttgcttctgggccactgcaggttggcctcctcaatacaagctgatgtctgcagggagcgccgcgtgctgggattgcaccacgtgttggtcacaaatcgaggtcgccttttggcctggtctgctcaggctggccctgacccacgtggtttcctggcttctgagacgcagcgcattcttcctgttagcggtagcgttctctgatttcactgcttcattgccaagggcgtggaaagggggtggtggatggagccgggaggtggcgagcacaggaccccggggctgcattctgccgtgtggggttctgcactgtctagcttctgcggggactgcaaagagggatgaagggacgtggtcctaggggtcggctcagactcggagcagggcagggagaggagggcaaggagaggaggcctgggtcctggatccactgctctgggctcataaccatgagattttgaaagagtttttggtcatctgagcaggtaccatgcctggctcatgccggaacttgtcttggaaccggtagccagaggcccaggaagggacagggcccaaaagggttgcatgtcccggccacaaagccctccctgtgtgccctgagccagcccagcaagcgcctcccagccaggcgctttcgcagaagcaagagcacaggccagggggaccgggagagcctcagcccccagcctgggcggcctgtgaccctgagccgtgtggagccaggacccaagaaccttctctaggttctcaagggtgagctgacccgggcaatgtgcaggaatgtggggagcaaaagtagctgattccagccccgttctggggtcactggggaggcagaggctgagggcctgttctctggtcaccagggactgggggcacggtccacagcggatgagaacagcaggtcacagtagtggctttgggaagggcccctcctgctttgccctgttcggaaaggggctccctcagagcccctgggcccagtaacccgcttctgtctcctgactcctgctggataaattgccaggtttatcaaatacaagaaaacacctgctttggctaggaggtaagtcccaaaaagaacgtcttaagtagagcaaaggcatccaccgaggccatttggtggcccctgggaagtggggaagcagggcctgagcgtccccaggctgctagggcagcagctggctcagggcacactctctcgtgccagcttctgccaccagcccagtgtccacggagccgcggggccagaggagctcagggagacctggctgtctagggcatggtacccagtatcccggtgtgtgcccatcctcagccacttgtgtctttctttccatgtgggagttctcccggtgacacctgccctccgttgagggtggaatctgtcactcatgcctttgagggacccagatggaccatccctcttctgcttgctttctacattcctaaaaacctcaacgttaatccctcaccagtcgggccgagtgtggcctcatggttctgccgcggcccagtcttctcccactggcttcacgctagagggcgccatgcgctctgggtgaaatgagacgctggtgtggggtccccatgtagagaccctcaggtccctatccagagaccctccaggcagtgctgggaagacactggtggcggggaccatgaccaggcgggtggagccatgtgtgtctcacacctgccgcccctcactttccttcccgaggtctggtaggtcctctttgggatttgctgtttatttgtatctcccttttctttgatttaagaacaatgccaagtgaaaaagctgggaatgaatttctgagttgctgagtgttccctgctcctaggtaccacgctctgtgcttctcaggcagggaggagatggattcggtggagttgggccaggacgggggcttcaccctgccccctccagactgccgaagcccccaagaagttttgagcccagctgggcctcgcctccccggctcctgggtccattttctgtactggtttgagatcacaggcatcattcagcgaatgctcttgtgtcctctgcataaagagggccctccctggagcacccccggggagctgggactctccagaaagccccgggtgagggctccgtcttgagagagagagaaatcccttctttgggcgattcagtgagttcaggaggaggaggaagcttttccttggctttgaaatcagtgtttttatggagacaaagaacagacctcagtgggaaaaatgaaaacgtaatggaacacggggaggtgtcggagaagaaaggattttccccttcgctttcagagccggcgggagtgcaggtctgttttgcttcagaagcctcacattctgctttgcccttgagtgacttcatgcgggatgaggaactgttgacccctctagagaggacaccccaagtccatcctgggctcctcctcacccctctgagaaagcccccctaaaaaaaggcttcagagtcaccggcatgccgcctcacgttgcaggacggaatcgcgcgctcctcacgctggagtaagttacgaaacatgatcgtcaggctctttgcaaacgcagagccccagaacgctggatggaggcctcctcggccctgcgggcggcctggctgcggtaggtctgctgcaaggagccaccacggggactgcgccacactcctgatgaaaacgtgtttacccacagcctcgcctcgagcctccttgacaataccgctgcttcaaagcaatattatttaatgagaatactttacattgctcacatgtgctgctatgaagacaggattagtctgtagacgggactcagctccagaggttcctgggtaatgtattgtggctcttggaaatgagggtagaatttgaaatataacaaatggtctctcgcccggttctgtcccttatttttagattgttttcctgcatcttacaatttccttttcttttcaaagttcctttctccaggcctgtttttcagtgctcaggacacggttttcatcacatacttactgtttttttggttgggttttgatacgaaaagctgctacgtttggtgaccagagggagggtttggaatctgtgctttgcaggggatctcggtgggtaccgcggcccctcgcagggtggcgagtggggtccgtgcctcgagaagggggcccttacccacaccgtgcggcttgaattctgtcggagttgaatctgtggaaaggattgtcccattagagctgctgcgtcctttcctctgtcctccctgtcacccaaaccccgaagtcacagctgcttagaagaatgggattttggggatacaaccacacacatttccctctggactgaaattttaaaaacagacccatttcactgacttctttttttttttttttttttttttttttttgagacggagtctcgctctgtcgcccaggctggagtgcagtggcgtgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcccactgacttctttagggaaaatagtttcagtcttgggttgtcttgtgagcccacgggcatgggaccctgtctctgctgggcttttccggccccgtcccagctcctcctcaggcagaggctgcagccctcagctctgctgctggatggaacatttcaaccccctccgggaaggtgggcagggtggagggcccagggctaggcctgccatgcaccatgagcaggggtgctacctgggtgtgtgaagttgggctggcttttcctggaggtgggtgagaaggctctccgggcaaatcagaaggccacgagagagagaggagcggggagagtggtgaggaggattcgtctctgactgatgaacctcgccgtgcctgtctgtcacatccaagtctgtgccagctgctgggaggtcagactcctgccctgagaaacagcccagtccttggagaatgaaaccctgagggtcagtgagtggaggccttccctcggggccagccattcccgggaggcctgagtgtgacctggaagctctgtgggtcaccaagactggcattttccttgtatttttgtgcagggctgaagtgagcgttcctcctctgaattggtgaggctttggaaattttttgtttcttctactcatcctaatggctggttttggctgcccggagtatcagagaatatcactaagagggcagtcagtttatttttaggcatctttctttctgtccagggagaaacccctcggaagaatcttagtcactctttgcacctgccctgtcattctcgccatggggaaaatgcgttgaaaagaaaaataccggggccagggagaagccgtgaatgtatttatttgctttggtgaagctgctgaacactggctgcggagggccccccgcccccatcccgcttcaggccccagtgacccagttgcgtcttaagttccatcgtccagatttcaggccaccagaggctgccaaaggtgactgaagcggtctccaagtcactctgtcaccactttttttttttttgagatggagtctcgctctatcgcccaggctggagtgcagtggcccaatctcggctcactgcaacctccgcctcccaggttcgagcgaattctcctgcctcaacctcccaagtagctgggattacaggcacctgccaccacacccggctaatttttgtatttctaatagagatgagagtgttaccatgttggtcaggctggtcttgaactcctgacctcaggtgatctgcccacctcaacctcccaaagtgctgggattataggcatgagccaccgcgcctggcctctgtcactttttttgctccttacccagtttttgttttttgttgttttgttttgttttagcgtgatactacaatggaaagactcctagttggttattctttatctcggattcttttttctggaattgtttgctcatttgagtggttggtggtttgccctgtgtcagacacggtgaaaagagtgcaggaaagctggggccaggggaagcgaagtggcttcaatccgggctgacagccaagaagagttttcctcccttcggtgacagggcctgcccctccgagtctagaggtaaaagcagcttctagaactggcccctaagtctccaaatgtgttggctaagctgaaatgagagactctgaattagagtttttgtttgtttgtttgttctctgcatgaagttcacaggcctgtatggatgttaaattgtgtctatagcctctaaatctccaggttaactggtccagattttttttttttaatcagtaacaatgggaatttaaaatcaaatatttggccaggtgcggtggctcatgcccgtaatcccagcactttgggaggccgaggcaggcgcatcacctgaggagtttgagaccagcctgaccaacatggtgaaatcctgtctctactaaaaatacaaaaaattagccaggcgtggtggcgtgtgcctgtaatcccagctaccagggaggctgaggcatgagaatcgcttgaacctgggagatggaggttgcagtgagccgagatcatgccactgcactccagcctgggcaacagagggagactctgtctcaaaaataataatcaaatcaagtattttaagtttggctcttctttttttcaagaaaggctttttggatacctagaataccttcatgtatgtggcttgatttctgtttcaggaaaaggggggcgggaggagagacaacagccgtgttccagagtctgtcctgagatgtcgctgagtccagacacttgggctgcacgtgccctgcagatgacaaaggccggcagctcagcacacgtgcaggaggggttaaagccaatattgagtttttgttcttgttgttttaatctgaacgattattctcctgtaaaaataatttgggaggggcgggtgttgttcggtgtgtgtgtgtgtgtgtgtgtgtgtgtgtgtgtgtgtatttttttttttacagtggcgcctgtctaaagtatttttcacaacatgtttgataatcagtgctttaaaaagcagcagtgtcctatgaagtggaaatgtcagttctagagcattggatgtgaagttctggtcatgtcaccttgcgtgtctcaccctggaggagtgaaggtgggcgcccggcgggggggtgtggctgcaccccagcaccgggagggggcacgcacgacaccagaggaagggacagccccacccatgtcaacagcaggcaacctgtgttttcatttcaagtgggatacagtatttttttaataaggagccatacttttttttaagagtttgagatctgaatgtgatttctaattgtatcagacgttaatgttttaaagctataacaaagtttaaaatttctactttttgtttttcatttattttaactgttcttttatctattaaattgttgtatgtggatggggaagttttgtttctcctcttagcatttgtttctataaccagaaataaaattctatattaaagaaatgac

SEQ ID NO: 61760 - DNA, 2958 bp, Homo sapiens
aaattgcggaacgcgaggggcgagcgcgagggagcccccctccggaacccctgcccacccccggagcgccggcagcggcggccccgcgaggatcggctccaggagatgatagaaagtgacacctcatccataatgtcaggaattattcgaaactcagggcaaaatcaccacccctctccacaggaatacagggtcaagcagggcaggcttcctggcagaggcggcattgggctgtcagcctgagaccctttcatgcctggcctgccctgtcctgccctgccctgccctgccccacctcctgcccccagctgtctgatcgccatggccctgaagaacagcaagacaggcagcctgcctgtgagcgagatctacagcttcatgaaggagcacttcccctacttcaagacggcccccgacgggtggaagaactcggtgcggcacaacctgtctctgaacaagtgcttcgagaaggtggagaacaagatgagcggctcctcccgcaagggctgcctgtgggctctgaacctggcccgcatcgacaagatggaggaggagatgcacaagtggaagaggaaggacctggctgccatccaccggagtatggccaaccctgaggagttggacaagctgatctccgaccggcctgaaagctgccggcgccccggcaaaccgggggaaccagaggcccccgtgctgactcacgccaccacagtggccgtggcgcatggctgcctggctgtctcccagctcccaccccagccactgatgaccctgtccctgcagtcagtccccctgcaccaccaggtccagccccaggcacatcttgctccagactctccagcaccagcccagaccccgccactgcacgccctgccggacctcagccccagcccgctcccccaccccgccatgggaagggctcctgtagacttcatcaacatcagcaccgacatgaacactgaggtggatgccctcgacccgagcatcatggacttcgctctgcaggggaacctgtgggaggagatgaaggatgagggattcagcctggacacactgggcgcctttgcagactccccgcttggctgtgacctgggggcctcaggcctaacccctgcctcgggtggcagcgaccagtccttcccagacttgcaggtgacgggtctctacacagcgtactccactccggacagtgtggctgcatcgggcaccagctcctcctcccagtaccttggtgcacaggggaacaagcctatagccctgctttgagctgtcagcctcacctgccctggaaccccggcacccggcttgggcagagaactgactagaacagggtgttcccagaaggcaggtccctcattgtccccgaagcctctcctggacctgtggcgaagttgccggctggacagggaagcggttcccctcagcagcccctctccttctcgtgcctccccctggagcttccggagcagtttctgggggctcttccaagtcagaagaatggaggaaggtggacaagcaacccagcatcccctgaccccttgacactcctccgaggcctgagccgcaatgcctgcccgtgttgagtgagacttctccatcctggatcctggctgcgtgacctcagtgacctgcaccccattttgggacaccttggtgcattaaggaaacaccctggggtgaaagcccttgaattcatcctcatgggaaatggctgagtggatcaaacctcagccgcagcctccgggggacaggcccagggcgggaaatggagccggagaagcttgagcctctctcttggacaggacaagctgaactctgaaatgggagccggtccaggtggccttcagccccacctttccgatagtctgttagaattttattagcgcagattcctgggccatgccgggtaccgtgaccttgtgtaaatttatttatatttattgtggcccatccaccccacttctgcaaacccatcccgaggcctctggaatgggactccttctccctccctacctcccagccatcctaactcctacaggccagagaatgacatctctaactggctcataatcccttggcagcctggggctactttttagaaccagcaagcactgttgatactgtgaaacatcccattttttccgtattagagaccagatatttttctacctgttcatgattcacatctcttcttgcatgtacctaagaggggcggtgccattgtttgggggcttggggggctttcaaaggggaaaatgcgatgggagagggaggaactggaggggggtgcttttgtactgggatttaagacacccctgatggaatgaaagccaactgaaccacgtaaagctcgaaccacgtggcaagtggtggacaaaacttcaacgcatgatatttattggcacttccttacctccctttgccctgcagctgtttttatgcttctttttctctccttgctaattactgactccccaagtggcaagttccgcagatagctgggttagaagagagacaggggagtgagctagtcaaatgtgaaaaatgctctcccagcaaagctgagacaaaattggagaagctgcagcctcacgcaccatccccctctttccaccagatggatgttgacttggtgtctgggagttcccgaaccctagagccaggatgttctgtttaatcaacagctcagccagctgcctgggagttttggcattaagccccgccttgaagggcgagctttaagtttttcccagttctggaactttctaccgagtatccaccacccttagacacaatcccagtgctacccgtctgacctgcactgctcatctgctttgtgtaacatgacccctgataagatgttgaaactgttattcacaaagactccgtgtttgggcaacatcaagactgtaagtgtagaattgagcaactgtcttctatcaataaaggctgaatggc

SEQ ID NO: 61761 - DNA, 2653 bp, Homo sapiens
ggattccggctcccgcggctgcaggcgcgcggctagagtgcctggcgggctccggcttccgcgtccgccccggccccggtccagacttagtcttcagctccgcgcccgctccgccgcggcccaccgcgcccgccggcagccgagcccccagcgacgcccgcacagctccgggtgcccagacagggggccatgccgtgccggagggaggaggaagaggaagccggcgaggaggcggagggggaggaagaggaggaggacagcttcctcctactgcagcagtcagtggcgctgggcagctcgggcgaggtggaccggctggtggcccagatcggcgagacgctgcagctggacgcggcgcagcacagcccggcctcgccgtgcgggcccccgggggcgccgctgcgggccccggggcccctggctgcggcggtgccggcggacaaggccaggtccccggcggtgccgctgctgctgccgcccgcgttggcggagactgtgggcccggcgccccctggggtcctgcgctgcgccctgggggaccgcggccgcgtgcggggccgcgctgcgccctactgcgtggccgagctcgccacaggccccagcgcgctgtccccactgccccctcaggccgaccttgatgggcctccgggagctggcaagcagggcatcccgcagccgctgtcgggtccgtgccggcgaggatggctccggggcgccgccgcctcccgccgcctgcagcagcgacgcgggtcccaaccagaaacccgcacaggcgacgacgacccgcaccggcttctgcagcagctagtgctctctggaaacctcatcaaggaggccgtgcgaaggcttcattcgcgacggctgcagttacgtgcaaagcttccccaacgcccgctcctgggacctctgtcggccccggtgcatgaacccccttcgcctcgcagccctcgcgcggcctgcagtgaccctggcgcctccgggagggcgcagctcagaactggcgacggcgttcttgtgcctggcagctaacacgcccggggtggccacagcgccagcctcagactggagggcaaggggttcccttgagggctgcagttctactcaggctggtggagaactctggcttttggaagcgagagtaaaaagctaatgacgaggaaccgaaaaatcgcgagtgtttcgcgggtaactggggttgagggccaaaatatttggaatgaaggacttggccctatttaaggcagattttacagagcgcacctcaaacgtacaagtcagtaggactccttatttggcgtgacccgacctggccgcggagcctgcatttcctcgcagcctctcagtgccctccagccccgcgaccatgtggccacaatccacgcttctccggatcgcggtgcgccggaaccacggaggatgatgccagttacttgctttaccttttcagggctggctcctgatccactttgggggaggagaacatgagtagataatttcagggtgcagcccaatctgccagacttaaaaaaaccatcttgtgtctttggaggtgctgcttaataccaaacatgcggtgccatgaagggaccctttgggggttgaataggagttaacccctgcgctctctttgcaactgtctctcttctcagagtggtgggggaaggctgtacgacacgggtggggaaaggaggtgggggcggggagtattgaatggtggtggaagggtagagaggcgcggagtgaaccccacgccctgtctaaagtgtattttcagagccggcccgcctctcctcggttcaaggtcactgtttcctgggcacgcactgggttgcgggacagagtagccaggttctgccggtgctcggagaagagcgcagtgttttgcaagtgctggagtctcctgaggacacgcgcgtcgccgccaccgcgggtgtgggaaagcgcggacgtgctgggcggctgtgcttcggtaggcgaccaccgcccctggccgcgctccgggctttcacggaaactcccgagaccgggccctgggttcctcctctcctactcggctctgcagtcctactcaagcgggtggctctgggatcctgggggcctgggttgggggctagggagacgccatgtgatggacactccagggacacacagcctagcacagcagcttataatgggctctccggggccatttgcaataacagctgcaattccctggatagacgagttgatttcctccctctgcccctcccccagccatgccagctggcctttgtaagtgcaggaaaccgagtagaaaatgtgaccctccaaatggagaagctgcaggctttgccattgtgaaccatggtgaagtgcttggaacatactgttcactcactctaaaggcgctgagactgtgctgttgttctcgtttttatagtcaatggcttgttcatcatccagatgtggctactgacatatctacacttcgcaccggagtgtctggaattgtggctatcctgattataggattttaacttaactgaaatgcctgctttgaataaatgtgttgggttttttgtttggttttattttatacttgccatcagtgaaaaagatgtacagaacacatttctctgatctccataaacatgaaaacacttgaaatctcaaa

SEQ ID NO: 61762 - DNA, 2203 bp, Homo sapiens
ggattccggctcccgcggctgcaggcgcgcggctagagtgcctggcgggctccggcttccgcgtccgccccggccccggtccagacttagtcttcagctccgcgcccgctccgccgcggcccaccgcgcccgccggcagccgagcccccagcgacgcccgcacagctccgggtgcccagacagggggccatgccgtgccggagggaggaggaagaggaagccggcgaggaggcggagggggaggaagaggaggaggacagcttcctcctactgcagcagtcagtggcgctgggcagctcgggcgaggtggaccggctggtggcccagatcggcgagacgctgcagctggacgcggcgcagcacagcccggcctcgccgtgcgggcccccgggggcgccgctgcgggccccggggcccctggctgcggcggtgccggcggacaaggccaggtccccggcggtgccgctgctgctgccgcccgcgttggcggagactgtgggcccggcgccccctggggtcctgcgctgcgccctgggggaccgcggccgcgtgcggggccgcgctgcgccctactgcgtggccgagctcgccacaggccccagcgcgctgtccccactgccccctcaggccgaccttgatgggcctccgggagctggcaagcagggcatcccgcagccgctgtcgggtccgtgccggcgaggatggctccggggcgccgccgcctcccgccgcctgcagcagcgacgcgggtcccaaccagaaacccgcacaggcgacgacgacccgcaccggcttctgcagcagctagtgctctctggaaacctcatcaaggaggccgtgcgaaggcttcattcgcgacggctgcagttacgtgcaaagcttccccaacgcccgctcctgggacctctgtcggccccggtgcatgaacccccttcgcctcgcagccctcgcgcggcctgcagtgaccctggcgcctccgggagggcgcagctcagaactggcgacggcgttcttgtgcctggcagctaacacgcccggggtggccacagcgccagcctcagactggagggcaaggggttcccttgagggctgcagttctactcaggctggtggagaactctggcttttggaagcgagagtaaaaagctaatgacgaggaaccgaaaaatcgcgagtgtttcgcgggtaactggggttgagggccaaaatatttggaatgaaggacttggccctatttaaggcagattttacagagcgcacctcaaacgtacaagtcagtaggactccttatttggcgtgacccgacctggccgcggagcctgcatttcctcgcagcctctcagtgccctccagccccgcgaccatgtggccacaatccacgcttctccggatcgcggtgcgccggaaccacggaggatgatgccagttacttgctttaccttttcagggctggctcctgatccactttgggggaggagaacatgagtagataatttcagggtgcagcccaatctgccagacttaaaaaaaccatcttgtgtctttggaggtgctgcttaataccaaacatgcggtgccatgaagggaccctttgggggttgaataggagttaacccctgcgctctctttgcaactgtctctcttctcagagtggtgggggaaggctgtacgacacgggtggggaaaggaggtgggggcggggagtattgaatggtggtggaagggtagagaggcgcggagtgaaccccacgccctgtctaaagtgtattttcagagccggcccgcctctcctcggttcaaggtcactgtttcctgggcacgcactgggttgcgggacagagtagccaggttctgccggtgctcggagaagagcgcagtgttttgcaagtgctggagtctcctgaggacacgcgcgtcgccgccaccgcgggtgtgggaaagcgcggacgtgctgggcggctgtgcttcgtcaatggcttgttcatcatccagatgtggctactgacatatctacacttcgcaccggagtgtctggaattgtggctatcctgattataggattttaacttaactgaaatgcctgctttgaataaatgtgttgggttttttgtttggttttattttatacttgccatcagtgaaaaagatgtacagaacacatttctctgatctccataaacatgaaaacacttgaaatctcaaa

SEQ ID NO: 61763 - DNA, 530 bp, Homo sapiens
cacacggttcgtcgtctcgggttcgagcccagtgggcttagccactcgccatggactcccagaaagaagctctacagaggatcatttcaactctggcaaataaaaatgatgaaattcagaactttattgatacactacatcatacactaaaaggagttcaggaaaattcgtccaacatactctcagagttagatgaagaatttgatagtttatactctatactggatgaagtaaaagaaagtatgattaactgtatcaagcaggaacaagctcgtaaatcccaagagttacagagtcagattagtcaatgtaataatgccctggagaactctgaagaactattagaatttgcaacaaggtcattagatataaaggaacctgaagaattttcaaaggtacacaaaaactgcattaatacacttaacaagggaagttgtatttttaaaaaggcgtttttgtttttctttagttttggatttctttactgatttctaatactaataaagccttggggtttcttgataagtaaa

SEQ ID NO: 61764 - DNA, 2630 bp, Homo sapiens
gctttctaccccgcagtcccagggtatcgcaagccgtccctcacaccccacctccagcaacgccctctcgccctgtctcccccaccttcactgtgagctgcagcccccatgtccctgccgtccccctcaccctcccgggagctgtgcccacctgacccggcatttgcgcctttgtcttcgtggcccggaagtggccccgccggcggaagcacgagaagtggccacgtgctgtacagcggctggctgaggaagtcgccccccgagaagaagctgaggctctttgcctggaggaaacgctggtttatcctgcggaggggccagactagcagtgacccagatgttctggaatactacaagaatgatggctccaagaagcccctgcgcaccatcaacctgaacctctgtgagcagctggatgttgatgtgactctgaacttcaacaagaaggagattcagaagggctatatgtttgacatcaagaccagtgagcgtaccttttacctggtggctgagaccagggaggacatgaatgagtgggtccagagcatctgtcagatctgtggcttcaggcaggaggaaagcacaggcttcctgggaaacatttcctcagccagtcacggcctctgctcttctccagctgagcccagctgctcccatcagcacctcccccaagaacaagaacccacatctgagcccccggtgtctcactgtgtgccgcccacctggcccatccctgcacctccggggtgtctccgctcgcaccagcacgccagccagagagcagaacatgcaaggagtgccagcttctcccagggttctgaggccccattcatcatgaggagaaacacagccatgcaaaatcttgcccagcacagtggatacagtgttgatggggtcagcggtcacatccatggcttccatagcctttccaagcccagccagcacaatgcagaattcagaggcagcacccacagaatcccctggagcctggcctcccatggccacaccagaggcagcctcacaggctctgaggcggataatgaggcttcctccggcaagtacacccagcatggtggagggaatgccagccggcctgctgagtccatgcatgagggagtctgttctttcctgccaggaagaacgcttgtgggcctgtcagacagcattgcttctgagggcagctgtgtgcccatgaacccaggctcccctaccctgccggctgtgaagcaagcaggcgatgattcccagggtgtctgcatccctgtgggctcatgtcttgttcgctttgacctgcttggctccccactcacagagctttctatgcaccaagacctcagccagggacatgaggtccagctgccccctgtcaaccgcagcctcaagcctaaccagaaggccaacccaacaccgcccaacctgagaaacaacagggtcatcaatgagctctccttcaagccacctgtcacagagccctggtctgggaccagccacacctttgactccagctcctcccaacaccccatctccacgcagagcatcaccaacacagactcagaagacagtggagagaggtatcttttcccgaacccggcatctgcatttcctgtttccggtggcaccagcagttcagccccgccgaggagcactggtaacatccactacgcggccctggacttccagccgagcaagccatccataggctctgtcacgtccggcaagaaggtggactatgtccaggtggatctggagaagacccaggccctgcagaagaccatgcatgaacagatgtgcctgcggcagtcctcagagcctcccaggggcgccaagctgtgactcgggccaccaaaaccagagtggggccaggacagtgcctcagagctgctccgccacactctaaagctctgtaatatcagggaccgcatcccttacatagagagcagaggcctgatcaatatacatcctttgcctgcttggggcccacctgtgcctttggctggccatggtccccaccttcacccccttgctaggagcagttgccagcaagcatcctcagtctcttcctgcccctcagacccgggctcccaacagatttccactctcacacttactcatggtcctcagcctcttccttctagcctctgggctgtttccctcaatcctggaacatgaggagctaccttgctgacccggggacccaaggcccacaggccacagtggacatggaccttttcagccctggcattttttggtcaggggagaggcaaggccatcaaacgttggaatagttgagaaggaaggttaaaggtggtcttgagaagcaaaggaattagatccttagaccagcagggcagctgatacctgcaagggctcccactttcagactgaggccagagtatggcagctgctcccgggtgggagaggcagagagggaagggcaaaaggaagggaaaacatgaagacgaacagccgaaagccacaagaagcagggctggagctccagagactggggtgacaaggaccagggtcagggccccagaaatccggagctgcaggctggctctgctgctctttgctgatgccccttggggggcccttgcctgcctaagaaggcttgatctgagctgggcaaa

SEQ ID NO: 61765 - DNA, 646 bp, Homo sapiens
ctgccgtccggactctttttcctctactgagattcatctgtgtgaaatatgagttggcgaggaagatcgacctatcggcctagaccaagacgctacgtagagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctgatagccaggaacagggtcacccacagactgggtgtgagtgtgaagatggtcctgatgggcaggagatggacccgccaaatccagaggaggtgaaaacgcctgaagaagagatgaggtctcactatgttgcccagactgggattctctggcttttaatgaacaattgcttcttaaatctttccccacggaaaccttgagtgactgaaatatcaaatggcaagagaccgtttagttcctatcatctgtggcatgtgaagggcaatcacagtgttaaaagaagacatgctgaaatgttgcaggctgctcctatgttggaaaattcttcattgaagttctcccaataaagctttacagccttctgcaaagaaaaaaaaaaaa

SEQ ID NO: 61766 - DNA, 530 bp, Homo sapiens
acgccagggagctgtgaggcagtgctgtgtggttcctgccgtccggactctttttcctctactgagattcatctgtgtgaaatatgagttggcgaggaagatcgacctatcggcctagaccaagacgctacgtagagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaagacacgttgaaatgatgcaggctgctcctatgttggaaatttgttcattaaaattctcccaataaagctttacagccttctgcaaagaaaa

SEQ ID NO: 61767 - DNA, 528 bp, Homo sapiens
cgccagggagctgtgaggcagtgctgtgtggttcctgccgtccggactctttttcctctactgagattcatctgtgtgaaatatgagttggcgaggaagatcgacctattattggcctagaccaaggcgctatgtacagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctgatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaaggcacgttgaaatgatgcaggctgctcctatgttggaaatttgttcattaaaattctcccaataaagctttacagccttctgcaaaa

SEQ ID NO: 61768 - DNA, 524 bp, Homo sapiens
agctgtgaggcagtgctgtgtggttcctgccgtccggactctttttcctctactgagattcatctgtgtgaaatatgagttggcgaggaagatcgacctattattggcctagaccaaggcgctatgtacagcctcctgaagtgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctgatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaaggcacgttgaaatgatgcaggctgctcctatgttggaaatttgttcattaaaattctcccaataaagctttacagccttctgcaaagaaaa

SEQ ID NO: 61769 - DNA, 527 bp, Homo sapiens
gccagggagctgtgaggcagtgctgtgtggttcctgccgtccggactctttttcctctactgagattcatctgtgtgaaatatgagttggcgaggaagatcgacctattattggcctagaccaaggcgctatgtacagcctcctgaagtgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctgatagccaggaacagggtcacccacagactgggtgtgagtgtgaagatggtcctgatgggcaggaggtggacccgccaaatccagaggaggtgaaaacgcctgaagaaggtgaaaagcaatcacagtgttaaaagaagacacgttgaaatgatgcaggctgctcctatgttggaaatttgttcattaaaattctcccaataaagctttacagccttctgcaaaa

SEQ ID NO: 61770 - DNA, 524 bp, Homo sapiens
cagggagctgtgaggcagtsctgtgyggttcctgccgtccggactctttttcctctactgagattcatctgtgtgaaatatgagttggcgaggaagatcgacctattattggcctagaccaaggcgctatgtacagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaaggcacgttgaaatgatgcaggctgctcctattttggaaatttgttcattaaaattctcccaataaagctttacagccttctgcaaa

SEQ ID NO: 61771 - DNA, 526 bp, Homo sapiens
tggttcctgccgtccggactctttttcctctactgagattcatctgtgtgaaatatgagttggcgaggaagatcgacctattattggcctagaccaaggcgctatgtacagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaaggcacgttgaaatgatgcaggctgctcctatgttggaaatttgttcattaaaattctcccaataaagctttacagccttctgcaaagaaaaaaaaaaaaaaaaaaaaaaaaaa

SEQ ID NO: 61772 - DNA, 528 bp, Homo sapiens
ctgtgaggcagtgctgtgtggttcctgccgtccggactctttttcctctactgagattcatctgtgtgaaatatgagttggcgaggaagatcgacctatcggcctagaccaagacgctacgtagagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctgatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaagacacgttgaaatgatgcaggctgctcctatgttggaaatttgttcattaaaattctcccaataaagctttacagccttctgcaaagaaaaaaaaaaaaa

SEQ ID NO: 61773 - DNA, 1455 bp, Homo sapiens
ggcggtccgcacgcacctcggtaacatcacagcaggtccaggccaatgataaccttataagaggccatgtcgaagcgcgacatcgtcctcaccaatgtcaccgttgtccagttgctgcgacagccgtgcccggtgaccagagcaccgcccccacctgagcctaaggctgaagtagagccccagccacaaccagagcccacaccagtcagggaggaaataaagccaccaccgccaccactgcctcctcaccccgctactcctcctcctaagatggtgtctgtggcccgggagctgactgtgggcatcaatggatttggacgcatcggtcgcctggtcctgcgcgcctgcatggagaagggtgttaaggtggtggctgtgaatgatccattcattgacccggaatacatggtgtacatgtttaagtatgactccacccacggccgatacaagggaagtgtggaattcaggaatggacaactggtcgtggacaaccatgagatctctgtctaccagtgcaaagagcccaaacagatcccctggagggctgtcgggagcccctacgtggtggagtccacaggcgtgtacctctccatacaggcagcttcggaccacatctctgcaggtgctcaacgtgtggtcatctccgcgccctcaccggatgcaccaatgttcgtcatgggtgtcaatgaaaatgactataaccctggctccatgaacattgtgagcaacgcgtcctgcaccaccaactgtttggctcccctcgccaaagtcatccacgagcgatttgggatcgtggaagggttgatgaccacagtccattcctacacggccacccagaagacagtggacgggccatcaaggaaggcctggcgagatgggcggggtgcccaccagaacatcatcccagcctccactggggctgcgaaagctgtgaccaaagtcatcccagagctcaaagggaagctgacagggatggcgttccgggtaccaaccccggatgtgtctgtcgtggacctgacctgccgcctcgcccagcctgccccctactcagccatcaaggaggctgtaaaagcagcagccaaggggcccatggctggcatccttgcctacaccgaggatgaggtcgtctctacggacttcctcggtgatacccactcgtccatcttcgatgctaaggccggcattgcgctcaatgacaatttcgtgaagctcatttcatggtacgacaacgaatatggctacagtcaccgggtggtcgacctcctccgctacatgttcagccgagacaagtgaaacgggaaggtcctttctttccttcccaggggccggggccggaacatgtgcctcccgttccagcatctggctgcccgggggaggaaggacacccggggcgggcgccccacgccgatgggtccatggtgaaataaaaaacagtgctcgaaaaaaaaaaaaaaa

SEQ ID NO: 61774 - DNA, 2545 bp, Homo sapiens
aaagggtgaatcatgtttaagaaggtcaacaggattgagcacaagaggaataagacagaaaaaccaaaaaagcttaatccatggattccacgcatcttcaaccacaaatgctttgtcaccttccttactggctgctatagttgcctctggaaattcagacaatgggaaaaaactaaagttggattttgttgctgcacttggaaagagcaattattttgccgtgcctggtaatttcatttgtcttgtctctgatgttgctgttcctgtggatagaaacatccagtgaatactttaactttgactgggtcacttttctaggaacaggatactggtttttctggtctatttttattctgagtttagctaggatcctgactgcctactcttcattgctgttgttacttggatttttgttgctttgggaaaggattgaactatacctgcacttgtgtcataagatcctgattctgctagtgattcttctgtgtgtcattttaatgttcattatatgcaaattctggaaagaaaggtggctggtagctgggctgtcaatgcagatctttgctccctacgtgcacctggtcagcataactgtgatggttatccttttctggcctgtggccttctacgtggcatgtttggaaagagaagttagaatgagaagatacaggatgacacattctgagaaaaaaagactcaagcaatgtaatgtaatcacaaggttaagaggtctacaagtgcctgttggattaccctttcttcttatccttttaggtctctatttgatgccactggggatttattctccctgcattcaggagaaggagaatttggggcccaagccaaccatctttggacatagaggtgcacccatgttggggcctgagaataccatgatgtcctttgagaaagctgttgaacatggagcccatggattggagactgatatacacttaagttatgatcatgtgcctttcctcatgcatgactttgacctgaaaagaacaaccaatattggggaagttcagccagaatctgcctgcgagaaccctgccttcttcaactgggatttcctatcgactctgaatgcaggcaaatggtttgtaaaaccagagctcaggccattttacaatatgaaacctctatcagaggcagataaagaaagagcaagaaatcagtcaattccaacactagctgatttattgacacttgcagagaaggaaagaaaatttgtgatatttgatcttcatcgccctccaccaaaacatcctctcagacacacatttgtccgccaagtagtaagcgtgatccttgcctctaaaatcgagcaacatctgattttttggttgccagctcatgataggcaatacgtcaggtccgtggctcctggttttcagcatgtgggccgtttagtatccattgaaacccttgctaaaaacaatatcagtataataaatgttgactacaagaagttgttccctaatgggttaagagattataaagcagctaacatccatatcaacgtatacaccgtcaatgagccttggcttttctcactggcctggtgctccaggattaactcagtgaccacagacaacattgggctcctgagtcagcttgatcaccctcacttcttcatgacaccaaagttctatgtgttcatgtggctccttgcagatatcatttctgtgctttttattgttgccatattttgttttcactggcggagagagactgaaaaagaaaaattgtttgaaacctccagcactcgcacagatactcagagtggaagtaagaatgaggaagatagatagatagatagatttgcacatagccatgaaacctcctgtccgagttgtggaaggtccttggactctagcagccctctacccggctctacccaagagtggaaaggaacaccaaggccatttcaattttgcagcaccatccaagaaactactacctatcaagaatgctgtcacacctttgaagcctggcaagcatgagattcaaccaccgatgcccaccgtggtctttgaactcacccaagcacccaccaggcaggctacaagtgaggctacctttcaaactacattgcccaccctgaaggtggataagccaaccatgccctccatagaggtcccctatccttaaataagagacctctaagagatccccatggctgaatactccaaataatcctatgtcacaatatattccattgcatctgacatagccttctgtgtttccaaagaagaattagccacatctcccctgcttcttcctctctctgcctaagggtggtgatggtggggagtggttgataaaggcacacagaagggccacggaggctctcaggggaaccattgtgctctcgctatcaagaatgcatctcaaggggctaggcaaggggaaaactgctgtgtgtggtcttggaactggttgctgtcaggtttatctcatcctaacacctccataatattttctgctaaaggagtgactgtgcatataagtaaaggcaacctctcaggaaaaaaaaaaaaaa

SEQ ID NO: 61775 - DNA, 2168 bp, Homo sapiens
agaaggcctgggggcgaggaacaagacctcggagtatttcaaggggagacctagttccctgccctgccccgggcccagggcgccgcggtctgaactctgctcggctggaggactcgtctccgagctccgtcagaaatggggaacttgcagtcggagccatccgcgggcgggggctcccgaaaagtgcagccctcggaccgcgcccccgactcccgccggacgtccctggtggagcccgagatgacctcccaggccatgcgcctgactcgtgggctgggtgtctggttccctggcagcgccacacccccgggactcatggtaccccgggagccccaggcctcaccctcgaccctgcccctcaccttagaacggccctctccagtgatgccccctcctgaagaggcggccgcggtctctgcaccacccccggcccccgcggggactctgctgcccggcccgtctaaatggcaaaagcccgcgggcactccagttccccggatccgccgcctgctggaggcgagccatcgcggccagggcgaccctccgagcctccgcccgctgaagccgccgccgccgccccggcaactatccgtgaaggacactgtcccgagggccccatcccaatttccgccgcccctggagacttggaagccgccaccaccattaccttctgaacggcagccggcggaccgcagaatcactcctgctctggccacacccgcctcacccccgacagaaagccaggctgggccccgcaaccagggccagacggccggcagggctcgcggaggggcgcctccccatgcgggcgaaggcgaaatggcccagcctgcggattccgagtccggtctgagcctgctgtgtaaaatcaccttcaagtcgaggccctctttggcccctccggcagcctcgagttccttagcagccaaagcttcgctggggggcggcggaggcggcggcctctttgctgcctcaggtgccatctcttacgccgaggtcctgaagcaagggcccctgcctcctggagccgctcgccccttgggagaggtttctcgaggggcacaggaagccgagggaggtgatggagacggcgaagggtgctctggtcctccctcggcgcctgcgtcccaagcccgggccctaccgccgccaccctacaccaccttcccaggctcgaagcccaaattcgactgggttagcgctcccgacggccctgaacgccacttccgcttcaacggggctggcggaggcatcggggcgccgcgacggcgtgcggccgcactctctgggccttggggctcccctccgccaccaccagagcagatacactcagctcccgggccccggaggcccgcacctgccctgctggcgccgcctacgttcatcttcccagcacccaccaatggcgagcccatgcgcccggggcctccaggcctgcaggagttaccaccgctgccaccgcccacaccgccgcccacactgcagccaccagcgctccagccaacgccgctgccggtggctcccccgctcaccccgggtctgggccacaaggagtcagccctggctcccaccgcagcccctgctctgcccccagccttagccgccgaccaggccccggccccatccccggctccagctcccaccgtggctgagccctcgccgcctgtgtccgcgcccgcacccgcggctgcgcccatcaagacccgcacgcgcaggaacaagggttcccgtgcagcccggggcgcgacccgtaaggatggcttgcatggagatggtcctcgcgaacgagctacagctaccgtgcctgacagcagtggtggagggggtggtggcagcggggcctctcagactggggcagctaacacccgcgctgcgcgccactggctgcccttccaggtgcttaactcctgtccctgcaagtgttactgccaccaccagccacgccatcgccgcctgccacgcaacgtctctgcctggctgagcacatccaccaaccacctgggcgagccaccctgggttgccaccatcaagctgtccggctctctggtggccaagctggagcactacgacttgcaggccacccattccaactgagtgtagtcggctcaacaccctccaccttcccctccatgccaataaaataaccaatccagaaaaaaaaaaaaaaa

SEQ ID NO: 61776 - DNA, 1215 bp, Homo sapiens
agaaggcctgggggcgaggaacaagacctcggagtatttcaaggggagacctagttccctgccctgccccgggcccagggcgccgcggtctgaactctgctcggctggaggactcgtctccgagctccgtcagaaatggggaacttgcagtcggagccatccgcgggcgggggctcccgaaaagtgcagccctcggaccgcgcccccgactcccgccggacgtccctggtggagcccgagatgacctcccaggccatgcgcctgactcgtgggctgggtgtctggttccctggcagcgccacacccccgggactcatggtaccccgggagccccaggcctcaccctcgaccctgcccctcaccttagaacggccctctccagtgatgccccctcctgaagaggcggccgcggtctctgcaccacccccggcccccgcggggactctgctgcccggcccgtctaaatggcaaaagcccgcgggcactccagttccccggatccgccgcctgctggaggcgagccatcgcggccagggcgaccctccgagcctccgcccgctgaagccgccgccgccgccccggcaactatccgtgaaggacactgtcccgagggccccatcccaatttccgccgcccctggagacttggaagccgccaccaccattaccttctgaacggcagccggcggaccgcagaatcactcctgctctggccacacccgcctgtgtccgcgcccgcacccgcggctgcgcccatcaagacccgcacgcgcaggaacaagggttcccgtgcagcccggggcgcgacccgtaaggatggcttgcatggagatggtcctcgcgaacgagctacagctaccgtgcctgacagcagtggtggagggggtggtggcagcggggcctctcagactggggcagctaacacccgcgctgcgcgccactggctgcccttccaggtgcttaactcctgtccctgcaagtgttactgccaccaccagccacgccatcgccgcctgccacgcaacgtctctgcctggctgagcacatccaccaaccacctgggcgagccaccctgggttgccaccatcaagctgtccggctctctggtggccaagctggagcactacgacttgcaggccacccattccaactgagtgtagtcggctcaacaccctccaccttcccctccatgccaataaaataaccaatccagaaa

SEQ ID NO: 61777 - DNA, 1170 bp, Homo sapiens
aaggctattattaccaccactgagtggcttaaataatcctgtcaacagcaatcgcccatttccaaagccatggtgaaacatctctgtgctaatttcttttgttttgtttcctaattttttttttttggcaggtggtgggaaataatctttgtcttctttggagtaaaccttcaacaccggattttttcttttaattatggatgtaaaccccaatatccccataatttacattgggtctcgaccaattgcctaattataagaggatatatttaggctcttatttcatccacacaaaaacttgtgtaacaggtagttggaaacatctgaggcaccactttgattctgttttggatggtcatgttttttctcctccgtttccccagcatgtctgccaccatcctcatgcactgcttccaagtgcctgggagcctttatgagcgtccctaaacctaaaagaatccagaggcggggctcggatgaaccctcgagataagcaagtgagccgcttctcccctctaaaggatgtttacacgtgggtggcactcgctggaatccagcgctcgggcagccctgggaggacgcgctcagctgcgaggaggatggagagcaatacatcatcatctttggagaatttagcgacggcgcctgtgaaccagatccaagaaacaatttctgataattgtgtggtgattttctcaaaaacatcctgttcttactgtacaatggcaaaaaagcttttccatgacatgaatgttaactataaagtggtggaactggacctgcttgaatatggaaaccagttccaagatgctctttacaaaatgactggtgaaagaactgttccaagaatatttgtcaatggtacttttattggaggtgcaactgacactcataggcttcacaaagaaggaaaattgctcccactagttcatcagtgttatttaaaaaaaagtaagaggaaagaatttcagtgatgtttatactaataagtttgctagtacagtgtcagttatttaaagtggtaatgcccgataatgtcttttaaatgtttgaggatgttttaaatacatgcattgtcttcacgaagaagatgtaaaaataatgaacaataaattgcggtggaaacctaaaaaaaaaaaaaaaaaaaaaaaaaaaaaaaaaaaaaaaaaa

SEQ ID NO: 61778 - DNA, 735 bp, Homo sapiens
gcggtgtccggcagtagagctcgctgcagatccgggctctgaccatgatttggcgccgcgcggcgctggcggggacgcggctggtttggagcaggagcggctcggcaggctggcttgacagggcggcgggagctgcgggagctgcggcagctgcggcctctgggatggagagcaatacatcatcatctttggagaatttagcgacggcgcctgtgaaccagatccaagaaacaatttctgataattgtgtggtgattttctcaaaaacatcctgttcttactgtacaatggcaaaaaagcttttccatgacatgaatgttaactataaagtggtggaactggacctgcttgaatatggaaaccagttccaagatgctctttacaaaatgactggtgaaagaactgttccaagaatatttgtcaatggtacttttattggaggtgcaactgacactcataggcttcacaaagaaggaaaattgctcccactagttcatcagtgttatttaaaaaaaagtaagaggaaagaatttcagtgatgtttatactaataagtttgctagtacagtgtcagttatttaaagtggtaatgcccgataatgtcttttaaatgtttgaggatgttttaaatacatgcattgtcttcacgaagaagatgtaaaaataatgaacaataaattgcggtggaaacctcaaaaaaaaaaaaaaaaaaaaaaaaaaaaaaaaaaaaaaaaa

SEQ ID NO: 61779 - DNA, 855 bp, Homo sapiens
atggagtggaagttagagcagtccatgcgggagcaggcactgctgaaagcgcagctgacacagttgaaggagtcacttaaagaagtccagctagagagggatgaatatgctgaacatctaaaaggagagagggcccggtggcagcagaggatgagaaaaatgtcgcaggaggtttgctcgttgaagaaggagaagaagcatgataaatatcgggtagagacgctggagaggagcttgtccaaactcaaacaccagatggctgaacccttgcccccagagcccccagcagtgccctctgaggtggagctgcagcacctgaggaaggaactagagagagtggcaggagcgctccaggcccagctggtggagaaagaagaacttggattcttccagtactacagagagagatgccatcagaaagtttatcaccctataacaaagccagggggcagtgccaaagatgcagcaccgggaggaggacaccatcaggctggccctggacagggaggagatgaaggtgaagctgctggagctgcaggagatggtgttgcagctggtggcgactacaagggacacagcaaattcttggtgactgcccagaaccctgctcatgagcccagtccaggagccccagccccccaggagcttggggctgcccacaagcatggtgatctttgtgaggtgagcctcactgacagcgtggagcctgtgcaaggagagaccagggagggttctccccacgacaagcctactgcacagccgatcgtgcaggaccaccaggagcacccaggcttgggcagcaactgctgtgtgccattcttttgctgggcttggccgccaagaagaaggagataa

SEQ ID NO: 61780 - DNA, 855 bp, Homo sapiens
atggagtggaagttagagcagtccatgcgggagcaggcactgctgaaagcgcagctgacacagttgaaggagtcacttaaagaagtccagctagagagggatgaatatgctgaacatctaaaaggagagagggcccggtggcagcagaggatgagaaaaatgtcgcaggaggtttgctcgttgaagaaggagaagaagcatgataaatatcgggtagagaagctggagaggagcttgtccaaactcaaaaaccagatggctgaacctctgcccccggagcccccagcagtgccctctgaggtggagctgcagcacctgaggaaggaactagagagagtggcaggagcgctccaggcccagctggtggagaaagaagaacttggattcttccagtactacagagagggatgccatcagaaagtttatcaccctataacaaagccagggggcagtgccaaagatgcagcaccgggaggaggacaccatcaggctggccctggacagggaggagatgaaggtgaagctgctggagctgcaggagatggtgttgcagctggtggcgactacaagggacacagcaaattcttggtgactgcccagaaccctgctcatgagcccagtccaggagccccagccccccaggagcttggggctgcccacaagcatggtgatctttgtgaggtgagcctcactgacagcgtggagcctgtgcaaggagaggccagggagggttctccccacgacaaccctactgcacagccgatcgtgcaggaccaccaggagcacccaggcttgggcagcaactgctgtgtgccattcttttgctgggcttggctgccaagaagaaggagataa

SEQ ID NO: 61781 - DNA, 1391 bp, Homo sapiens
ggaggcaggactgcccggcccagccttggaggaagacttctgggcagaagcggaacacaggagcagagacacatagtcttggctccagtttcgtttcagttatgcccaccctttcagtgttcatggatgtgcccctcgcccacaagctagagggcagcttgttaaagacctacaaacaagatgattacccgaacaagatattcttagcctatagagtctgcatgacaaatgaaggccatccctgggtttctctcgtggtgcagaagactcgactacagatttcacaggatccctccctgaattatgagtacttgcccaccatgggcctgaaatcattcatccaggcctctctagcactcctctttggaaagcacagccaagccattgtggagaacagggtagggggtgtacacactgttggtgacagtggtgccttccagcttggcgtccagtttctcagagcttggcataaggatgctcgtatagtttacatcatctcttctcaaaaagaactgcatggactcgtcttccaggacatgggctttacagtttatgaatactctgtctgggaccccaagaagctatgcatggaccccgacatactcctcaatgtggtggagcagatcccacatggctgtgtccttgtgatggggaacattatcgactgcaagttgacaccaagtgggtgggcaaagttgatgtccatgataaagagcaagcagatattcccattttttgatattccctgtcaaggtttatacaccagtggcttggaagaagatactagaatcttacaatactttgtgtctcaaggctttgagttcttctgcagccagtctctgtccaagaattttggcatttatgatgaaggagtggggatgctagtggtggtggcagtcaacaaccagcagctgctgtgtgtcctctcccagctggaaggattagcccaggccctgtggctaaacccccccaacacgggtgcacgtgtcatcacctccatcctctgcaaccctgctctgctgggagaatggaagcagagtctaaaagaagttgtagagaacatcatgctaaccaaggaaaaagtgaaggagaaactccagctcctgggaacccctgggtcctggggtcacatcaccgagcagagtgggacccacggctatcttggactcaactcccagcaggtggaatacctggtcaggaagaagcacatctatatccccaagaacggtcagattaacttcagctgtatcaatgccaacaacataaattacatcactgagggcatcaatgaggctgtcctcctcacagagagctcagagatgtgtcttccaaaggaaaaaaaaacactgattggaataaaactttagtctttgcaaaaaaaaaaaaaaaaa

SEQ ID NO: 61782 - DNA, 2557 bp, Homo sapiens
gccgagcccagctccccgcggcggccgctagcccccggccccgagccaccactccgacctagcggccgccgcccccggtgcgggatgaggagatccgcggccgccactgggccccatggaggagccgcagccgccccgcccaccagcgagcatggccttactgggcagccagcactccggcgccccctccgcggccggcccacctggcgggacttcctccgcggccacggcggccgtgctctccttcagcaccgtggcgaccgcggcgctggggaacctgagcgacgcaagcggaggcggcacagctgccgctcccggtggcggcggccttggcgggtccggggcagcgcgggaggcgggggcggcggtgaggcggccgctaggcccggaggcggcgccgctgctgtcgcacggagctgcagtggcggcccaggcgctcgtcctcctgctcatcttcctgctgtctagccttggcaactgcgcggtgatgggggtgattgtgaagcaccggcagctccgcaccgtcaccaacgccttcatcctgtcgctgtccctatcggatctgctcacggcgctgctctgcctgcccgccgccttcctggacctcttcactccgcccgggggttcggcgcctgccgccgccgcggggccctggcgcggcttctgcgccgccagccgcttcttcagctcgtgcttcggcatcgtgtccacgctcagcgtggcgctcatctcgttggaccgttactgcgctatcgtgcggccgccgcgggagaagatcggccgccgccgcgcgctgcagctgctggcgggcgcctggctgacggccctgggcttctccttgccctgggagctgctcggggcgccccgggaactcgcggcggcgcagagcttccacggctgcctctaccggacctccccggaccccgcgcagctgggcgcggccttcagcgtggggctggtggtggcctgctacctgctgcccttcctgctcatgtgcttctgccactaccacatctgcaagacggtgcgcctgtcggacgtgcgcgtgcggccggtgaacacctacgcgcgcgtgctgcgcttcttcagcgaggtgcgcacggccaccaccgtcctcatcatgatcgtcttcgtcatctgctgctgggggccctactgcttcctggtgctgctggccgccgcccggcaggcccagaccatgcaggccccctcgctcctcagcgtggtggccgtctggctgacctgggccaatggggccatcaaccctgtcatctacgccatccgcaatcccaacatttcgatgctcctagggcgcaaccgcgaggagggctaccggactaggaatgtggacgctttcctgcccagccagggcccgggtctgcaagccagaagccgcagtcgccttcgaaaccgctatgccaaccggctgggggcctgcaacaggatgtcctcttccaacccggccagcggagtggcaggggacgtggccatgtgggcccgcaaaaatccagttgtacttttctgccgagagggaccaccagagccggtgacggcagtgaccaaacagcctaaatccgaagctggggataccagcctctaagacggttggaatggccagcttatgaaggcaaatttccactcgcattatttaatgatggaagattctgggggagagttgtggatttcataaagccaaacatttaaagctagagacgggggaggcttaccactttccccaaacaacataaaagacaatgtcccttcttcaaaagtgccaaaaggaatgtaaaatgcaaaaattaaaacaatcttaaaccacataaccaagcattgtgaactgctatccaactatttagtggtagaactaggatttgaactgcagtctgtttggcctcagaactccatgtttgtttctctctatccccacagaagtctacagggcaacttcctgggagctaaggctactaaaaggtagaagccacagtactcatctgcagagggcttacagcctcagcaaggaccttgtggctttgtaacaacaatcagccataacaagtttacttgtggaaaagaaaaggtgtagcactttcagaagaggctatcaaagaaaagagatgaacttggaagcaagagatacgcagctcagcatgacagagactccattccaggtggaaaaagcacatggctctttcttctccgagatcccaggactatcttattttcctcagaggggcaggttacaagaacttcacatctctcaggctacatgttgcaaaggttaaattccaggttgtacgatttttcacttccaccatcaagttatgagtgtgattgtttccctgcagttttgccaatagagtgattttagactatttacatcgtgggttacaaccaatgtcagttattctggggaaacccaactgccatgttgtgaggacactcaagcagccctatggaggagcccacatggtgagtgaataactacaagctgactctaattttaaaaaataaaaattttatctctcaccaattttaaaatgacaaaaaaaaaaaaaaa

SEQ ID NO: 61783 - DNA, 2225 bp, Homo sapiens
agccgttagcgccgagcccgcccgggagcgggtcgccggccgcggcgggcgcccctgccagtgagcccctgtccgaagtgagccacggcattgactcggggctgcccgggggcagggcactgaggagggagttgcgcgcgcgaggcgagggcgatggggccaagaagaaccggggcgatagcgcggcagcggtgacagctgggacccgccgcggtcgggctgccccctcccctcgccccgaccgctcccctgctggtgagggcctgcggaggcggcggcggcggcgcccttggtggcagtggtggcggcggagcagcctcccgggatcgtgtccggagctcgaggagagggtggtgcccggcgagctatgcacgggggcggcggcgtctcctcctgttccgcctcctcagtctcctcggtctcgcagaatccgccggcggcggcggcgccaggacatggagctcgagaacatcgtggccaactcgctgctgctgaaagcgcgtcaagaaaaggattatagcagtctttgtgacaagcaaccgataggaagacgtctcttcaggcagttctgtgataccaaacccactctaaagaggcacattgaattcttggatgcagtggcagaatatgaagttgccgatgatgaggaccgaagtgattgtggactgtcaatcttagatagattcttcaatgataagttggcagcccctttaccagaaatacctccagatgttgtgacagaatgtagattgggactgaaggaggagaacccttccaaaaaagcctttgaggaatgtactagagttgcccataactacctaagaggggaaccatttgaagaataccaagaaagctcatatttttctcagtttttacaatggaaatggctggaaaggcaacccgtaacaaagaacacatttagacattacagagttctaggaaaaggcggatttggagaggtttgcgcctgtcaagtgcgagccacaggaaaaatgtatgcctgcaaaaagctacaaaaaaaaagaataaagaagaggaaaggtgaagctatggctctaaatgagaaaagaattctggagaaagtgcaaagtagattcgtagttagtttagcctacgcttatgaaaccaaagatgccttgtgcttggtgctcaccattatgaatggaggggatttgaagtttcacatttacaacctgggcaatcccggctttgatgagcagagagccgttttctatgctgcagagctgtgttgcggcttggaagatttacagagggaaagaattgtatacagagacttgaagcctgagaatattctccttgatgatcgtggacacatccggatttcagacctcggtttggccacagagatcccagaaggacagagggttcgaggaagagttggaacagtcggctacatggcacctgaagttgtcaataatgaaaagtatacgtttagtcccgattggtggggacttggctgtctgatctatgaaatgattcagggacattctccattcaaaaaatacaaagagaaagtcaaatgggaggaggtcgatcaaagaatcaagaatgataccgaggagtattctgagaagttttcagaggatgccaaatctatctgcaggatgttactcaccaagaatccaagcaagcggctgggctgcaggggcgagggagcggctggggtgaagcagcaccccgtgttcaaggacatcaacttcaggaggctggaggcaaacatgctggagccccctttctgtcctgatcctcatgccgtttactgtaaggacgtcctggatatcgagcagttctcggtggtgaaagggatctacctggacaccgcagatgaagacttctatgctcggtttgctaccgggtgtgtctccatcccctggcagaatgagatgatcgaatctgggtgtttcaaagacatcaacaaaagtgaaagtgaggaagctttgccattagatctagacaagaacatacataccccggtttccagaccaaacagaggcttcttctatagactcttcagaagagggggctgcctgaccatggtccccagtgagaaggaagtggaacccaagcaatgctgagcaccccggtgcggaccacagagcagaccctggcgccaggaaggagcatgtgttagcgtctcgtcccacctggaattgtaataaatacatctaaataaaacatgccttgggagtgtacagacaaaaaaa

SEQ ID NO: 61784 - DNA, 2183 bp, Homo sapiens
agccgttagcgccgagcccgcccgggagcgggtcgccggccgcggcgggcgcccctgccagtgagcccctgtccgaagtgagccacggcattgactcggggctgcccgggggcagggcactgaggagggagttgcgcgcgcgaggcgagggcgatggggccaagaagaaccggggcgatagcgcggcagcggtgacagctgggacccgccgcggtcgggctgccccctcccctcgccccgaccgctcccctgctggtgagggcctgcggaggcggcggcggcggcgcccttggtggcagtggtggcggcggagcagcctcccgggatcgtgtccggagctcgaggagagggtggtgcccggcgagctatgcacgggggcggcggcgtctcctcctgttccgcctcctcagtctcctcggtctcgcagaatccgccggcggcggcggcgccaggacatggagctcgagaacatcgtggccaactcgctgctgctgaaagcgcgtcaaggaggatatggcaaaaaaagtggtcgtagtaaaaaatggaaggagatactgacactgcctcctgtcagccagtgcagtgagcttagacattccattgaaaaggattatagcagtctttgtgacaagcaaccgataggaagacgtctcttcaggcagttctgtgataccaaacccactctaaagaggcacattgaattcttggatgcagtggcagaatatgaagttgccgatgatgaggaccgaagtgattgtggactgtcaatcttagatagattcttcaatgataagttggcagcccctttaccagaaatacctccagatgttgtgacagaatgtagattgggactgaaggaggagaacccttccaaaaaagcctttgaggaatgtactagagttgcccataactacctaagaggggaaccatttgaagaataccaagaaagctcatatttttctcagtttttacaatggaaatggctggaaaggcaacccgtaacaaagaacacatttagacattacagagttctaggaaaaggcggatttggagaggtttgcgcctgtcaagtgcgagccacaggaaaaatgtatgcctgcaaaaagctacaaaaaaaaagaataaagaagaggaaaggtgaagctatggctctaaatgagaaaagaattctggagaaagtgcaaagtagattcgtagttagtttagcctacgcttatgaaaccaaagatgccttgtgcttggtgctcaccattatgaatggaggggatttgaagtttcacatttacaacctgggcaatcccggctttgatgagcagagagccgttttctatgctgcagagctgtgttgcggcttggaagatttacagagggaaagaattgtatacagagacttgaagcctgagaatattctccttgatgatcgtggacacatccggatttcagacctcggtttggccacagagatcccagaaggacagagggttcgaggaagagttggaacagtcggctacatggcacctgaagttgtcaataatgaaaagtatacgtttagtcccgattggtggggacttggctgtctgatctatgaaatgattcagggacattctccattcaaaaaatacaaagagaaagtcaaatgggaggaggtcgatcaaagaatcaagaatgataccgaggagtattctgagaagttttcagaggatgccaaatctatctgcaggatgttactcaccaagaatccaagcaagcggctgggctgcaggggcgagggagcggctggggtgaagcagcaccccgtgttcaaggacatcaacttcaggaggctggaggcaaacatgctggagccccctttctgtcctgatcctcatgccgtttactgtaaggacgtcctggatatcgagcagttctcggtggtgaaagggatctacctggacaccgcagatgaagacttctatgctcggtttgctaccgggtgtgtctccatcccctggcagaatgagggctgcctgaccatggtccccagtgagaaggaagtggaacccaagcaatgctgagcaccccggtgcggaccacagagcagaccctggcgccaggaaggagcatgtgttagcgtctcgtcccacctggaattgtaataaatacatctaaataaaacatgccttgggagtgtacagacaaaaaaa

SEQ ID NO: 61785 - DNA, 2321 bp, Homo sapiens
agccgttagcgccgagcccgcccgggagcgggtcgccggccgcggcgggcgcccctgccagtgagcccctgtccgaagtgagccacggcattgactcggggctgcccgggggcagggcactgaggagggagttgcgcgcgcgaggcgagggcgatggggccaagaagaaccggggcgatagcgcggcagcggtgacagctgggacccgccgcggtcgggctgccccctcccctcgccccgaccgctcccctgctggtgagggcctgcggaggcggcggcggcggcgcccttggtggcagtggtggcggcggagcagcctcccgggatcgtgtccggagctcgaggagagggtggtgcccggcgagctatgcacgggggcggcggcgtctcctcctgttccgcctcctcagtctcctcggtctcgcagaatccgccggcggcggcggcgccaggacatggagctcgagaacatcgtggccaactcgctgctgctgaaagcgcgtcaaggaggatatggcaaaaaaagtggtcgtagtaaaaaatggaaggagatactgacactgcctcctgtcagccagtgcagtgagcttagacattccattgaaaaggattatagcagtctttgtgacaagcaaccgataggaagacgtctcttcaggcagttctgtgataccaaacccactctaaagaggcacattgaattcttggatgcagtggcagaatatgaagttgccgatgatgaggaccgaagtgattgtggactgtcaatcttagatagattcttcaatgataagttggcagcccctttaccagaaatacctccagatgttgtgacagaatgtagattgggactgaaggaggagaacccttccaaaaaagcctttgaggaatgtactagagttgcccataactacctaagaggggaaccatttgaagaataccaagaaagctcatatttttctcagtttttacaatggaaatggctggaaaggcaacccgtaacaaagaacacatttagacattacagagttctaggaaaaggcggatttggagaggtttgcgcctgtcaagtgcgagccacaggaaaaatgtatgcctgcaaaaagctacaaaaaaaaagaataaagaagaggaaaggtgaagctatggctctaaatgagaaaagaattctggagaaagtgcaaagtagattcgtagttagtttagcctacgcttatgaaaccaaagatgccttgtgcttggtgctcaccattatgaatggaggggatttgaagtttcacatttacaacctgggcaatcccggctttgatgagcagagagccgttttctatgctgcagagctgtgttgcggcttggaagatttacagagggaaagaattgtatacagagacttgaagcctgagaatattctccttgatgatcgtggacacatccggatttcagacctcggtttggccacagagatcccagaaggacagagggttcgaggaagagttggaacagtcggctacatggcacctgaagttgtcaataatgaaaagtatacgtttagtcccgattggtggggacttggctgtctgatctatgaaatgattcagggacattctccattcaaaaaatacaaagagaaagtcaaatgggaggaggtcgatcaaagaatcaagaatgataccgaggagtattctgagaagttttcagaggatgccaaatctatctgcaggatgttactcaccaagaatccaagcaagcggctgggctgcaggggcgagggagcggctggggtgaagcagcaccccgtgttcaaggacatcaacttcaggaggctggaggcaaacatgctggagccccctttctgtcctgatcctcatgccgtttactgtaaggacgtcctggatatcgagcagttctcggtggtgaaagggatctacctggacaccgcagatgaagacttctatgctcggtttgctaccgggtgtgtctccatcccctggcagaatgagatgatcgaatctgggtgtttcaaagacatcaacaaaagtgaaagtgaggaagctttgccattagatctagacaagaacatacataccccggtttccagaccaaacagaggcttcttctatagactcttcagaagagggggctgcctgaccatggtccccagtgagaaggaagtggaacccaagcaatgctgagcaccccggtgcggaccacagagcagaccctggcgccaggaaggagcatgtgttagcgtctcgtcccacctggaattgtaataaatacatctaaataaaacatgccttgggagtgtacagacaaaaaaa

SEQ ID NO: 61786 - DNA, 1342 bp, Homo sapiens
caagaatatgagatagaaggggaggggtaggaggagagggaggagggtaggaagacagtttgcattcttgcaacattaaaccaaagggacttggagtgcagatggcatccttcggttcttccagacaagctgcaagacgctgaccatggccaagatggagctctcgaaggccttctctggccagcggacactcctatctgccatcctcagcatgctatcactcagcttctccacaacatccctgctcagcaactactggtttgtgggcacacagaaggtgcccaagcccctgtgcgagaaaggtctggcagccaagtgctttgacatgccagtgtccctggatggagataccaacacatccacccaggaggtggtacaatacaactgggagactggggatgaccggttctccttccggagcttccggagtggcatgtggctatcctgtgaggaaactgtggaagaaccaggggagaggtgccgaagtttcattgaacttacaccaccagccaagagaggtgagaaaggactactggaatttgccacgttgcaaggcccatgtcaccccactctccgatttggagggaagcggttgatggagaaggcttccctcccctcccctcccttggggctttgtggcaaaaatcctatggttatccctgggaacgcagatcacctacatcggacttcaattcatcagcttcctcctgctactaacagacttgctactcactgggaaccctgcctgtgggctcaaactgagcgcctttgctgctgtttcctctgtcctgtcaggtctcctggggatggtggcccacatgatgtattcacaagtcttccaagcgactgtcaacttgggtccagaagactggagaccacatgtttggaattatggctgggccttctacatggcctggctctccttcacctgctgcatggcgtcggctgtcaccaccttcaacacgtacaccaggatggtgctggagttcaagtgcaagcatagtaagagcttcaaggaaaacccgaactgcctaccacatcaccatcagtgtttccctcggcggctgtcaagtgcagcccccaccgtgggtcctttgaccagctaccaccagtatcataatcagcccatccactctgtctctgagggagtcgacttctactccgagctgcggaacaagggatttcaaagaggggccagccaggagctgaaagaagcagttaggtcatctgtagaggaagagcagtgttaggagttaagcgggtttggggagtaggcttgagccctaccttacacgtctgctgattatcaacatgtgcttaagccaaaaaaaaaaaaaaaaaa

SEQ ID NO: 61787 - DNA, 2391 bp, Homo sapiens
aaaaccaaagggacttggagtgcagatggcatccttcggttcttccagacaagctgcaagacgctgaccatggccaagatggagctctcgaaggccttctctggccagcggacactcctatctgccatcctcagcatgctatcactcagcttctccacaacacccctgctcagcaactactggtttgtgggcacacagaaggtgcccaagcccctgtgcgagaaaggtctggcagccaagtgctttgacatgccagtgtccctggatggagataccaacacatccacccaggaggtggtacaatacaactgggagactggggatgaccggttctccttccggagcttccggagtggcatgtggctatcctgtgaggaaactgtggaagaaccaggggagaggtgccgaagtttcattgaacttacaccaccagccaagagagaaatcctatggttatccctgggaacgcagatcacctacatcggacttcaattcatcagcttcctcctgctactaacagacttgctactcactgggaaccctgcctgtgggctcaaactgagcgcctttgctgctgtttcctctgtcctgtcaggtctcctggggatggtggcccacatgatgtattcacaagtcttccaagcgactgtcaacttgggtccagaagactggagaccacatgtttggaattatggctgggccttctacatggcctggctctccttcacctgctgcatggcgtcggctgtcaccaccttcaacacgtacaccaggatggtgctggagttcaagtgcaagcatagtaagagcttcaaggaaaacccgaactgcctaccacatcaccatcagtgtttccctcggcggctgtcaagtgcagcccccaccgtgggtcctttgaccagctaccaccagtatcataatcagcccatccactctgtctctgagggagtcgacttctactccgagctgcggaacaagggatttcaaagaggggccagccaggagctgaaagaagcagttaggtcatctgtagaggaagagcagtgttaggagttaagcgggtttggggagtaggcttgagccctaccttacacgtctgctgattatcaacatgtgcttaagccaacatccgtctcttgagcatggtttttagaggctacgaataaggctatgaataagggttatctttaagtcctaagggattcctgggtgccactgctctcttttcctctacagctccatcttgtttcacccaccccacatctcacacatccagaattcccttctttactgatagtttctgtgccaggttctgggctaaaccatggagataaaaagaagagtaaaatacacttcccgaccttaaggatctgatacatctagttattggtctggaaattggagaaatggaggtgagcaaattaacggtagtgtgactgtggctcaactttccatggtacgcgcgaattgttctgggagtcacagatgggaagacagaagcgcccctgagtgctttgtcatatagcacagaagtcctccacactgcctgggacagtgtcctgcatccacacagtaggtacccagtaaaagtgttattaaatattgtcccaggagcccttaggagagtggtttaacatgagaaggcgccaacagcacacagggtcagggtcacttctagaaatagcccaccaaggctattcagattggactgtggttcccttctggacagtcacaccagggacttcccagtgaacaagggggcataggctcctctctggatcccaccttttcatcccttctgagaaatgtaccctattatttccttcataaagaatgccacccatctgattcctcaagaatctagacctagaaataccatttgacccagccatcccattactgggtagatacccaaaggattacaaatcatgctgctataaagacacatgcacacatatgtttattacggcactatttataatagcaaagacttggaaccaacccaaatgtccatcagtgatagactggattaagaaaatgtggcacatatacaccatggaatactatgcagccataaagaaggatgagtttatgccctttgtagggacatggatgaagctggaaaccatcattctgagcaaactatcgcaaggatagaaaaccaaacactgcatattctcacgcacaggtgggaattgaacaataaaaacacttggacacagggtggggaacatcacacaccgggcctgtcatggggtggggggaggggggagggatagcattaggagatatactaacgtaaatgacgagttaatgggtgcagcacaccaacatggcacatgtatacatatgtaacaaatctgcacgttgtgcacatgtaccctagaactt

SEQ ID NO: 61788 - DNA, 3948 bp, Homo sapiens
ggcaagggacggagaacggggcggaggcggagtcagggcgcccgcgcgtgggccccgcccccttatgtagggtataaagcccctcccgctcacagtttccctagtcctcgaaggctcggaagcccgtcaccatgtcgtgcgagtcgtctatggttctcgggtactgggatattcgtgggctggcgcacgccatccgcctgctcctggagttcacggatacctcttatgaggagaaacggtacacgtgcggggaagctcctgactatgatcgaagccaatggctggatgtgaaattcaagctagacctggactttcctaatctgccctacctcctggatgggaagaacaagatcacccagagcaatgccatcttgcgctacatcgctcgcaagcacaacatgtgtggtgagactgaagaagaaaagattcgagtggacatcatagagaaccaagtaatggatttccgcacacaactgataaggctctgttacagctctgaccacgaaaaactgaagcctcagtacttggaagagctacctggacaactgaaacaattctccatgtttctggggaaattctcatggtttgccggggaaaagctcacctttgtggattttctcacctatgatatcttggatcagaaccgtatatttgaccccaagtgcctggatgagttcccaaacctgaaggctttcatgtgccgttttgaggctttggagaaaatcgctgcctacttacagtctgatcagttctgcaagatgcccatcaacaacaagatggcccagtggggcaacaagcctgtatgctgagcaggaggcagacttgcagagcttgttttgtttcatcctgtccgtaaggggtcagcgctcttgctttgctcttttcaatgaatagcacttatgttactggtgtccagctgagtttctcttgggtataaaggctaaaagggaaaaaggatatgtggagaatcatcaagatatgaattgaatcgctgcgatactggcatttccctactccccaactgagttcaagggctgtaggttcatgcccaagccctgagagtgggtactagaaaaaacgagattgcacagttggagagagcaggtgtgttaaatgggactggagtccctgtgaagactgggtgaggataacacaagtaaaactgtggtactgatggacttaaccggagttcggaaaccgtcctgtgtacacatgggagtttagtgtgataaaggcagtatttcagactggtgggctagccaatagagttgggacaattgcttactcattaaaaataatagagccccacttgacactattcactaaaattaatctggaatttaaggcccaacattaaacacaaagctgttgaaatattgatgaaaatgtaagaatttttgtgaccacggggtaggagaagtttctttaaagacgtaaaaagaaaaaaaccataggctgctctgcctgtggagtagccattctttattcttttactttttaaaataataacaatcacaaaggaaagatttgccaattgaataggatcaaattctacaacttttcctaaggcacccacaaataaatgacaagtgagacaaaaagcactagtataaagattatataaagacctataaatcattaagacaactgagtttttaaaaatggacaaaatccatgaacaatttataaaatagaaatatagccaaaaatgtctaaaagatgtttatgatgtaaggaattatcaattacaacagtgagaaaccatatttccttctatccgatgagtaaaaagtttctaaagtgttggcaaggcttaggaaagtgatatgcatttcctgctggtcaagttgtaaattagtatagctactttggaggacaattgtaaaatttaaatcatatcctatgacccagcaattccatgctataaaaactcatccatggccgggcttggtggctcacgcctgtaatcccagcactttgggaggctgaggtgggcagatcacgaggtcaagagatcgagaccatcctggccaacatgatgaaaccccgtttctactaaaaatacaaaaattagctgggcatggtggcatgtgcctatagtcccagctactcaggaggctgaggcaggagaattgcttgaacctgggaggcagaggttgcagtgagccgagatcacgccactgcactccagcctggctacagggcgagactctgtctcaaaaaaaaaaaaaaaaaaaaaaaaaaaacattcaaagagacatatactaagatgttcactgtggcattgtctgtaatgacaaataagtggaaaccgtgtaaatacctgtcaatactatggagtaccatgtggcaacggaagaatgagactgaactgtgtgaactaacatgcaaagatccccaaaacaggccaggtgtggttgctcacagctgtaataacaacaccttcagaggctgaggtgagaggatcagttgaggccaggagtttaagaccagcctgggcaacatagtgagacccctgtctcccaaaaattttttttaattagctgtgcgcaattgctcatgcatagtcccagctacccaggaggctgaggtgggaggatcacttgagcccaggaatttgaagctgcagtgagctgtgttcttgccactgcactccaatctgggtgactgagcaagaccctgtctcttaaaaaaataaaaaagatctccaagcatagagaagagtctggagggaaacaccaaactcataacagtcttactgcaggcaagtgggataaaggcccagactccatggtggaagttaaagggcatttccaagttaaggctaagacttgcttttctaactaagagaatgtgctcatgcattgcttgtgtagtagaaactagtttttagaaaagaaagcaaacttaagaaacactgactcctgtggagatgacttggcaccactctcctttcacagagcagagtctgaatagtcttcagagataggcctgtgggccagattgccatcccctatggaccagaagccaaggatctctctagtgatggtcagagggcccaaatggcagggatacccagtgatgtcaggaggaatagtacagacagaaggtgctaagcagacaattcaactgccatgttttgccaccccctgtgagcagggattaggtgttcaggccagtatcttgggcatgggggagcctttggccagaagaggtataaagctcagaagtttttcagtctgataactattgatataatttccatagtgtgagggagcggtatgctctacccttgtgtatttaaggcaggacagagaaattgaggatgcccctggggctagatcgatgatatgaccagaaatcaaaaagggaatgcattatttattgctgtgtaacactgttaagagaggaggtagttaagggatggataggcacatagagagggaaggtctcaggagaagggatagaaaggaactatgttcacaagaacaacggcaagacagtgcctatactgcctctacagttaataggaaaaacggaagaagttacccttaagctaggatgttgctcagaagtgaccatcccaactttggtgcgggcacaataaatcagcctaaatgtccctaatttaacccagctcattataatgtcattaaacatgacattagcattgtggttttagcacccccatgggttttgcttaggcactcatgggtaataaccaagatggagtccctttggcaaaacttaggcatgcacagctgtagtaccccaagaagaaaatgttacttctctcatctgggcaaaacccacagaagacttcccagcttctgccacataaaagacacagaacacagacgccttactggcaacctgctttcaagacccctgtctttgctgagagctttcctttttcccaataaattctactctgccctactcactctc

SEQ ID NO: 61789 - DNA, 1532 bp, Homo sapiens
gttgcagttgggcgctcagcagctgtggcagccggttgaggtctggcagtagcgttgggctgaagcagcggagttcgccatgcgcgagtgtatctctatccacgtggggcaggcgggtgtccagatcggcaatgcctgctgggaactgtactgccttgaacatggaattcagcccgatggccaaatgccaagtgataaaaccattggtggcggggacgactccttcaacacgttcttcagtgagactggagctggcaagcacgtgcccagagcagtgtttgtggacctggagcccactgtggtcgatgaagtgcgcacagggacctacaggcagctcttccacccggagcagctgatcaccgggaaggaagatgcagccaataattacgccaggggccattacaccatcggcaaggagattgttgacctagtcctggaccggatccgcaaactggcggatctgtgcacaggactgcagggcttcctcatcttccacagctttgggggcggcactggctctgggttcgcatctctgctcatggagcggctctcagtggattacggcaagaagtccaagctagagtttgccatttacccagccccccaggtctccacagccgtggtggagccctacaactccatcctgaccacccacacgaccctggaacattctgactgtgccttcatggtcgacaatgaagccatctatgacatatgtcggcgcaacctggacattgaacgtcccacgtacaccaacctcaatcgcctgattgggcagatcgtgtcctccatcacagcctccctgcgatttgatggggccctgaatgtggacttgacggaattccagaccaacctagtgccgtacccccgcatccacttccccctggccacctatgccccagtcatctcagctgagaaggcctaccacgagcagctgtctgtggccgagatcaccaatgcctgcttcgagccagccaatcaaatggtcaagtatgaccctcgccacggcaagtacatggcctgctgcatgttgtacaggggggacgtggtccccaaagacgtcaacgcggccatcgccaccatcaagaccaagcgcaccatccagtttgtggattggtgcccgactggatttaaggtgggcattaactaccagccccccacagtggtccccgggggagacctggccaaggtgcagcgggccgtgtgcatgctgagcaacaccacggccattgcggaggcctgggcccgcctggaccataagttcgatctcatgtatgccaagcgggcctttgtgcactggtacgtgggcgaaggcatggaagagggagagttctctgaggcccgcgaggacctggcagctctagagaaggattatgaagaggtgggcgtggattccgtggaagctgaggctgaagaaggcgaagaatactgaggggagggtgtggtgggttctcccctgccacccccgggatggctgcttccaagttgtttgcaattaaaggttctgtataaaaccaaaaaaaaaaaaaaaa

SEQ ID NO: 61790 - DNA, 5065 bp, Homo sapiens
ggtcgctgggctccgctcggttgcggcgggagccccgggacgggccggacgggccggggcagaggaggcgaggcgagctcgcgggtggccagccacaaagcccgggcggcgagacagacggacagccagccctcccgcgggacgcacgcccgggacccgcgcgggccgtgcgctctgcactccggagcggttccctgagcgccgcggccgcagagcctctccggccggcgcccattgttccccgcgggggcggggcgcctggagccgggcggcgcgccgcgcccctgaacgccagagggagggagggaggcaagaagggagcgcggggtccccgcgcccagccgggcccgggaggaggtgtagcgcggcgagcccggggactcggagcgggactaggatcctccccgcggcgcgcagcctgcccaagcatgggcgcctgaggctgcccccacgccggcggcaaaggacgcgtccccacgggcggactgaccggcgggcggacctggagcccgtccgcggcgccgcgctcctgcccccggcccggtccgaccccggcccctggcgccatggacaagctgccgccgtccatgcgcaagcggctctacagcctcccgcagcaggtgggggccaaggcgtggatcatggacgaggaagaggacgccgaggaggagggggccgggggccgccaagaccccagccgcaggagcatccggctgcggccactgccctcgccctccccctcggcggccgcgggtggcacggagtcccggagctcggccctcggggcagcggacagcgaagggccggcccgcggcgcgggcaagtccagcacgaacggcgactgcaggcgcttccgcgggagcctggcctcgctgggcagccggggcggcggcagcggcggcacggggagcggcagcagtcacggacacctgcatgactccgcggaggagcggcggctcatcgccgagggcgacgcgtcccccggcgaggacaggacgcccccaggcctggcggccgagcccgagcgccccggcgcctcggcgcagcccgcagcctcgccgccgccgccccagcagccaccgcagccggcctccgcctcctgcgagcagccctcggtggacaccgctatcaaagtggagggaggcgcggctgccggcgaccagatcctcccggaggccgaggtgcgcctgggccaggccggcttcatgcagcgccagttcggggccatgctccaacccggggtcaacaaattctccctaaggatgttcggcagccagaaagccgtggagcgcgaacaggagagggtcaagtcggccggattttggattatccacccctacagtgacttcagattttactgggacctgaccatgctgctgctgatggtgggaaacctgattatcattcctgtgggcatcaccttcttcaaggatgagaacaccacaccctggattgtcttcaatgtggtgtcagacacattcttcctcatcgacttggtcctcaacttccgcacagggatcgtggtggaggacaacacagagatcatcctggacccgcagcggattaaaatgaagtacctgaaaagctggttcatggtagatttcatttcctccatccccgtggactacatcttcctcattgtggagacacgcatcgactcggaggtctacaagactgcccgggccctgcgcattgtccgcttcacgaagatcctcagcctcttacgcctgttacgcctctcccgcctcattcgatatattcaccagtgggaagagatcttccacatgacctacgacctggccagcgccgtggtgcgcatcgtgaacctcatcggcatgatgctcctgctctgccactgggacggctgcctgcagttcctggtacccatgctacaggacttccctgacgactgctgggtgtccatcaacaacatggtgaacaactcctgggggaagcagtactcctacgcgctcttcaaggccatgagccacatgctgtgcatcggctacgggcggcaggcgcccgtgggcatgtccgacgtctggctcaccatgctcagcatgatcgtgggtgccacctgctacgccatgttcattggccacgccactgccctcatccagtccctggactcctcccggcgccagtaccaggaaaagtacaagcaggtggagcagtacatgtcctttcacaagctcccgcccgacacccggcagcgcatccacgactactacgagcaccgctaccagggcaagatgttcgacgaggagagcatcctgggcgagctaagcgagcccctgcgggaggagatcatcaactttaactgtcggaagctggtggcctccatgccactgtttgccaatgcggaccccaacttcgtgacgtccatgctgaccaagctgcgtttcgaggtcttccagcctggggactacatcatccgggaaggcaccattggcaagaagatgtacttcatccagcatggcgtggtcagcgtgctcaccaagggcaacaaggagaccaagctggccgacggctcctactttggagagatctgcctgctgacccggggccggcgcacagccagcgtgagggccgacacctactgccgcctctactcgctgagcgtggacaacttcaatgaggtgctggaggagtaccccatgatgcgaagggccttcgagaccgtggcgctggaccgcctggaccgcattggcaagaagaactccatcctcctccacaaagtccagcacgacctcaactccggcgtcttcaactaccaggagaatgagatcatccagcagattgtgcagcatgaccgggagatggcccactgcgcgcaccgcgtccaggctgctgcctctgccaccccaacccccacgcccgtcatctggaccccgctgatccaggcaccactgcaggctgccgctgccaccacttctgtggccatagccctcacccaccaccctcgcctgcctgctgccatcttccgccctcccccaggatctgggctgggcaacctcggtgccgggcagacgccaaggcacctgaaacggctgcagtccctgatcccttctgcgctgggctccgcctcgcccgccagcagcccgtcccaggtggacacaccgtcttcatcctccttccacatccaacagctggctggattctctgcccccgctggactgagcccactcctgccctcatccagctcctccccaccccccggggcctgtggctccccctcggctcccacaccatcagctggcgtagccgccaccaccatagccgggtttggccacttccacaaggcgctgggtggctccctgtcctcctccgactctcccctgctcaccccgctgcagccaggcgcccgctccccgcaggctgcccagccatctcccgcgccacccggggcccggggaggcctgggactcccggagcacttcctgccacccccaccctcatccagatccccgtcatctagccccgggcagctgggccagcctcccggggagttgtccctaggtctggccactggcccactgagcacgccagagacacccccacggcagcctgagccgccgtcccttgtggcaggggcctctgggggggcttcccctgtaggctttactccccgaggaggtctcagcccccctggccacagcccaggccccccaagaaccttcccgagtgccccgccccgggcctctggctcccacggatccttgctcctgccacctgcatccagccccccaccaccccaggtcccccagcgccggggcacacccccgctcacccccggccgcctcacccaggacctcaagctcatctccgcgtctcagccagccctgcctcaggacggggcgcagactctccgcagagcctccccgcactcctcaggggagtccatggctgccttcccgctcttccccagggctgggggtggcagcgggggcagtgggagcagcgggggcctcggtccccctgggaggccctatggtgccatccccggccagcacgtcactctgcctcggaagacatcctcaggttctttgccaccccctctgtctttgtttggggcaagagccacctcttctggggggccccctctgactgctggaccccagagggaacctggggccaggcctgagccagtgcgctccaaactgccatccaatctatgagctgggcccttccttccctcttctttcttcttttctctcccttccttcttccttcaggtttaactgtgattaggagatataccaataacagtaataattatttaaaaaaccacacacaccagaaaaacaaaagacagcagaaaataaccaggtattcttagagctatagatttttggtcacttgcttttatagactattttaatactcagcactagagggagggagggggagggaggagggagcaggcaggtcccaaatgcaaaagccagagaaaggcagatggggtctccggggctgggcaggggtgggagtggccagtgttggcggttcttagagcagatgtgtcattgtgttcatttagagaaacagctgccatcagcccgttagctgtaacttggagctccactctgcccccagaaaggggctgccctggggtgtgccctggggagcctcagaagcctgcgaccttgggagaaaagggccagggccctgagggcctagcattttttctactgtaaacgtagcaagatctgtatatgaatatgtatatgtatatgtatgtaagatgtgtatatgtatagctatgtagcgctctgtagagccatgtagatagccactcacatgtgcgcacacgtgtgcggtctagtttaatcccatgttgacaggatgcccaggtcaccttacacccagcaacccgccttggcccgcaggctgtgcactgcatggtctagggacgttctctctccagtcctcagggaagaggacgccaggacttcgcagcaggccccctctctccccatctctggtctcaaagccagtcccagcctgacctctcaccacacggaagtggaagactcccctttcctagggcctcaagcacacaccg

SEQ ID NO: 61791 - DNA, 2467 bp, Homo sapiens
agagccactcaacagcgctggaacccattcggtggggcctggggcccctcatcccaagccaggagggtttctggggaggggtgcagcccctggcagactgacagtgtggcctgggggtttgggggtgccagggaagcaggggccaacctcataggaggagacacgagtgcggttctctttcccccactggggggcctgctgtgtcagcagccaggcgggaggcctgggcggcagagccagtggtacaggggcctgggcagggcggtgtctggcagcagcggcaccatgtccaccatccagtcggagactgactgctacgacatcatcgaggtcttgggcaaggggaccttcggggaggtagccaagggctggcggcggagcacgggcgagatggtggccatcaagatcctcaagaatgacgcctaccgcaaccgcatcatcaaaaacgagctgaagctgctgcactgcatgcgaggcctagaccctgaagaggcccacgtcatccgcttccttgagttcttccatgacgccctcaagttctacctggtctttgagctgctggagcaaaaccttttcgagttccagaaggagaacaacttcgcgcccctccccgcccgccacatccgtacagtcaccctgcaggtgctcacagccctggcccggctcaaggagctggctatcatccacgctgatctcaagcctgagaacatcatgctggtggaccagacccgctgccccttcagggtcaaggtgattgacttcggatccgccagcattttcagcgaggtgcgctacgtgaaggagccatacatccagtcgcgcttctaccgggcccctgagatcctgctggggctgcccttctgcgagaaggtggacgtgtggtccctgggctgcgtcatggctgagctgcacctgggctggcctctctaccccggcaacaacgagtacgaccaggtgcgctacatctgcgaaacccagggcctgcccaagccacacctgttgcacgccgcctgcaaggcccaccacttcttcaagcgcaacccccaccctgacgctgccaacccctggcagctcaagtcctcggctgactacctggccgagacgaaggtgcgcccattggagcgccgcaagtatatgctcaagtcgttggaccagattgagacagtgaatggtggcagtgtggccagtcggctaaccttccctgaccgggaggcgctggcggagcacgccgacctcaagagcatggtggagctgatcaagcgcatgctgacctgggagtcacacgaacgcatcagccccagtgctgccctgcgccaccccttcgtgtccatgcagcagctgcgcagtgcccacgagaccacccactactaccagctctcgctgcgcagctaccgcctctcgctgcaagtggaggggaagccccccacgcccgtcgtggccgcagaagatgggaccccctactactgtctggctgaggagaaggaggctgcgggtatgggcagtgtggccggcagcagccccttcttccgagaggagaaggcaccaggtatgcaaagagccatcgaccagctggatgacctgagtctgcaggaggctgggcatgggctgtggggtgagacctgcaccaatgcggtctccgacatgatggtccccctcaaggcagccatcactggccaccatgtgcccgactcgggccctgagcccatcctggccttctacagcagccgcctggcaggccgccacaaggcccgcaagccacctgcgggttccaagtccgactccaacttcagcaacctcattcggctgagccaggtctcgcctgaggatgacaggccctgccggggcagcagctgggaggaaggagagcatctcggggcctctgctgagccactggccatcctgcagcgagatgaggatgggcccaacattgacaacatgaccatggaagctgagaggccagaccctgagctcttcgaccccagcagctgtcctggagaatggctgagtgagccagactgcaccctggagagcgtcaggggcccacgggctcaggggctcccaccccgccgctcccaccagcatggtccaccccggggggccaccagcttcctccagcatgtcaccgggcaccactgatggtgattccacccctgcccatcactgggggctgcgctagctgggctggcattccctcccaacctgaactgctcctcagagccatctcctgaacccacaaattattcttacagaaagatagttatccagaaattctcattccccgtctgcggtgcggtgcgtgcctgcacacctctcctaaacacagcagggctttggagtctggcccatgctccttggccagaaggacagcaggaaagggggctgcaccccgctggccctgcgctcgcccttggccctgctgcctctgtctatttcaatatagaactgttcagcaaaaaaaaaaaaaaaa

SEQ ID NO: 61792 - DNA, 7109 bp, Homo sapiens
tggattatgatttttgtttatttttcctgtttatccatatattatttttcaacaatgagtattgattacttatataataattttaaggctgtacacattgcagacagcaccccactgtttgaaaaactcctcctcagtagaacatggcagaccttcatcttccttccctgaaccttttccaaccttaggcttgccattctccaccagtgctaatgtcatgtctcttgaaatctgtattgaagtcagtatttcattcttgccagtttccactgtgtgtttaaatttggagtctggtgtctagcattagctggggttggagcttccactcctctcagcattggtaagcctcctcacccaccccatcccatgtccaagatcacccagttacacacttaccatctacccagttcattcacatcatcagtcccagagctgcagagatgctctttttctacctcctacttctctggctcttagagaggcagcatgggataatggggcaagcgaatagggccttaaagtagagggacaagggttctcttccctatctgccacttattagctatgtgacctcgtgtaagtctcttttctttttgagacagggtctccctctgtcacctaggctggagtacagtggtatgatcatagctcactgcagcctcgaactcctgggctcaagctatccttccaccttagccttctgagcagcagggactacaggcacatgccaccatgtccggctgatttatttatttttatttgggaagatgggggtctcactatgtcgcccaggctggtcatgaactcctggtctcaagcaaccctccaaccttggactcccaaagtgctgggattacaggtgtgagccctggccttgcctcaatttcctcatctgtaaaacggggttagtgaaactcacatcctatcagtggttttgaggatgggccgactcttgtattgcctgctctagtacaatcagcagctaaggcggctcactttccggccgtgctacaataggtaagaactaggatgctttagacgtgtgactgggcagtgggagcccctcacatgatcccgagatgccagacagtgtctctccgcacagggcgtgtgctggtccagaggcccgtttttccagtcgccccacaccccgggtccgcgatcacgctccccccacccatagccgagcctgacgcggcggtggctcatgcgcctttccgtcccagcctttagccacggaccacacgtcccatctcaggcgccccgcccctcccccgccccccgcccccggcgcgcctccccaggctgccggctccggtgtctgagcggccgcgcccgcgagccgtgagcgatgattggctgcgccacggcggcgggcggtccgtgggcgcacacaccctccccgcgcagccaatgggcgtgcgcacgtcactgatccggaggcccgcgggccggcagcccctcaataagccacattgttgcatgaaactccggcgcaggagtcccgggctgccgctggcaacatcgtgtcacccagctaagaaaatccgcgggcccgagccacgcgcctgtgaatcggagaggtcccactgcccgagtggagccgggctgagattcttctcaagttgagcctcagtgatcctgtggccgaagttagcgccttgacgtgggacaaccggacacgtcgccaggagagaactgaggcgccttctagcagttgtgacgccaaaatcacgtctccggagacccgcgccctccgccagccgggcgcaccctcgccggtagccttctttgtgcgccgtccggactcccagctcccggcccggcagccgagccccagcacaaagcagtcggaccgcgccgcccgcctcccctctcgcgtctccgcctcggtttcccaactctgcgccgtcgggccgcggcaggatgattgcctcgcatctgcttgcctacttcttcacggagctcaaccatgaccaagtgcagaaggttgaccagtatctctaccacatgcgcctctctgatgagaccctcttggagatctctaagcggttccgcaaggagatggagaaagggcttggagccaccactcaccctactgcagcagtgaagatgctgcccacctttgtgaggtccactccagatgggacagaacacggagagttcctggctctggatcttggagggaccaacttccgtgtgctttgggtgaaagtaacggacaatgggctccagaaggtggagatggagaatcagatctatgccatccctgaggacatcatgcgaggcagtggcacccagctgtttgaccacattgccgaatgcctggctaacttcatggataagctacaaatcaaagacaagaagctcccactgggttttaccttctcgttcccctgccaccagactaaactagacgagagtttcctggtctcatggaccaagggattcaagtccagtggagtggaaggcagagacgttgtggctctgatccggaaggccatccagaggagaggggactttgatatcgacattgtggctgtggtgaatgacacagttgggaccatgatgacctgtggttatgatgaccacaactgtgagattggtctcattgtgggcacgggcagcaacgcctgctacatggaagagatgcgccacatcgacatggtggaaggcgatgaggggcggatgtgtatcaatatggagtggggggccttcggggacgatggctcgctcaacgacattcgcactgagtttgaccaggagattgacatgggctcactgaacccgggaaagcaactgtttgagaagatgatcagtgggatgtacatgggggagctggtgaggcttatcctggtgaagatggccaaggaggagctgctctttggggggaagctcagcccagagcttctcaacaccggtcgctttgagaccaaagacatctcagacattgaaggggagaaggatggcatccggaaggcccgtgaggtcctgatgcggttgggcctggacccgactcaggaggactgcgtggccactcaccggatctgccagatcgtgtccacacgctccgccagcctgtgcgcagccaccctggccgccgtgctgcagcgcatcaaggagaacaaaggcgaggagcggctgcgctctactattggggtcgacggttccgtctacaagaaacacccccattttgccaagcgtctacataagaccgtgcggcggctggtgcccggctgcgatgtccgcttcctccgctccgaggatggcagtggcaaaggtgcagccatggtgacagcagtggcttaccggctggccgatcaacaccgtgcccgccagaagacattagagcatctgcagctgagccatgaccagctgctggaggtcaagaggaggatgaaggtagaaatggagcgaggtctgagcaaggagactcatgccagtgcccccgtcaagatgctgcccacctacgtgtgtgctaccccggacggcacagagaaaggggacttcttggccttggaccttggaggaacaaatttccgggtcctgctggtccgtgttcggaatgggaagtggggtggagtggagatgcacaacaagatctacgccatcccgcaggaggtcatgcacggcaccggggacgagctctttgaccacattgtccagtgcatcgcggacttcctcgagtacatgggcatgaagggcgtgtccctgcctctgggttttaccttctccttcccctgccagcagaacagcctggacgagagcatcctcctcaagtggacaaaaggcttcaaggcatctggctgcgagggcgaggacgtggtgaccctgctgaaggaagcgatccaccggcgagaggagtttgacctggatgtggttgctgtggtgaacgacacagtcggaactatgatgacctgtggctttgaagaccctcactgtgaagttggcctcattgttggcacgggcagcaatgcctgctacatggaggagatgcgcaacgtggaactggtggaaggagaagaggggcggatgtgtgtgaacatggaatggggggccttcggggacaatggatgcctagatgacttccgcacagaatttgatgtggctgtggatgagctttcactcaaccccggcaagcagaggttcgagaaaatgatcagtggaatgtacctgggtgagattgtccgtaacattctcatcgatttcaccaagcgtggactactcttccgaggccgcatctcagagcggctcaagacaaggggcatctttgaaaccaagttcttgtctcagattgagagtgactgcctggccctgctgcaagtccgagccatcctgcaacacttagggcttgagagcacctgtgacgacagcatcattgttaaggaggtgtgcactgtggtggcccggcgggcagcccagctctgtggcgcaggcatggccgctgtggtggacaggatacgagaaaaccgtgggctggacgctctcaaagtgacagtgggtgtggatgggaccctctacaagctacatcctcactttgccaaagtcatgcatgagacagtgaaggacctggctccgaaatgtgatgtgtctttcctgcagtcagaggatggcagcgggaagggggcggcgctcatcactgctgtggcctgccgcatccgtgaggctggacagcgatagaacccctgaaatcggaagggacttcctctttctctccttcttccctgttttaaattataagatgtcatccccttgtgtcagagacagaccccttggcttttgcttggcagagaggaccccactggactgggttttgtctctgcatctcattgtagagcttggtggctgagcttggccctattaagataaatagagttccaaataaggatttgttcacatgcatcataaccattcccattggttctcctaaaacatgaaaattatctcccttagtaatcccccttgccaaattccatgtccctgtataattctacaggatggggacactaatgaagatacggttgcttcaccttggagcctgaacatgacatttctaagtggggtgcatcccccagcactgatgttgttactgattctcctgtcagagatctgggaggtctccactgaggatgtgagcctgattatcctataggcagacgtggggagggtggaggggtgacagtggaggaaaatccatggatatccacgcagcagcccctctttaacctcatctacaagcatttgccctgtggattccagcatttgccattcctggaatcaaggaatcctgagtctgggcaatgaaaccaaagccaggagttgacgcatcctgcagttgggccagctgtcgcatctcagcggggcgcacatgttatccacaagcaatggacctttggggaagggggagtttttagtttgttttacaaatttttcctgcaaaagtggaatcactgtattttcattttaatttatatttgaaattttatttagttcttgagtagatctgcttcttcatcttgacatgtaatgaatggtcagttgtacgtaatgtatttatatgttaatttgttatgtatatagatgtgcaagtcttgtcagaattggcctcagtgtagttaaagggcagaaggggaagatactgactagtcatagaaatacctcattcgcctgtgggaagagaagggaagcctcttcagggtgagtgaatggcaaagcggttgcttctggctcctccttcccctgtggtcttggaagtgtgtggaaggcagggacagagatggaggccgagccaatagactgaagagaccacagcaattggctcctccatctagagattttcttggcagtattccatgggatgttaagcaaaggaaaccaaaggaatcgtttcaaatggactcatggcttagaaatctttattcttagggcagtcagtagtattctaaagctttctgacaagataaaggaagtcaccaaaatttctttttttaaattgtatctaatcctcaacaacaaaccaaaacagaacaattaaacagccaaataaaacctcagggacaacatttttggtgtatttgagccctcccagcaagtttcaccttgggtttgtattttaaatgttttacaagaattgtccatgtgcttccctaggctgagctggcattggtctgctgacctgtttttgtgtttttcttttttttatacacaacatttatttcaaactattgggagggatgagagtggcttaaaaacttccatccctacttttcaagagtgcagttgattctgaatctgaaagcccgcctctgtcctaaaatacaaacaagcacagacattaaacctggatactatatgataaagagggatgtaactattgaattggatacaaggatcagaatggaaagaaactcacgatgaaattgaacctggtttttgtatatttatcaaacttgtgctgagaatagtgtctgattatacgacttttaagcaaagttgggtgtaattaggtgaaaacagcccaggtcctcccgggagcacagaggggctaggggctggtccttctcgtttgctctagtcttgctttgctgtctggtgtagctcctctgctgctcccatctgcactaattgacccaaaacgtgggtatttcctgctacacaaaagccaaaaggtttcatgtagattttagttcactaaagggtgcccacaaaatagagattaattttaacttaaattttaagcttgaagattaggtactatctgtgaagttacacttttttttttttttttaaaggtagagatgtgtgtgtgtgtaggtattaaagatgtgttgttggtttccaaaaaggaacactggaaaataaattttgaatgtttatgttctcagaatcaggttgacagtcccttgctgacatggctttgctttgtgtaaatacagtggatctcaatcttcggggtgtgatgaatagcgaatcatctcaaatccttgagcactcagtctagtgaagatgttgtcattatgtacaatacataactagtttaattaactatgtgatgttaactattattaataaattttaacattttccaaaataaaaaaaaaaaaaaaaaa

SEQ ID NO: 61793 - DNA, 3002 bp, Homo sapiens
gccagtcaccttcagtttctggagctggccgtcaacatgtcctttcctaaggcgcccttgaaacgattcaatgacccttctggttgtgcaccatctccaggtgcttatgatgttaaaactttagaagtattgaaaggaccagtatcctttcagaaatcacaaagatttaaacaacaaaaagaatctaaacaaaatcttaatgttgacaaagatactaccttgcctgcttcagctagaaaagttaagtcttcggaatcaaaggaatctcaaaagaatgataaagatttgaagatattagagaaagagattcgtgttcttctacaggaacgtggtgcccaggacagccggatccaggatctggaaactgagttggaaaagatggaagcaaggctaaatgctgcactaagggaaaaaacatctctctctgcaaataatgctacactggaaaaacaacttattgaattgaccaggactaatgaactactaaaatctaagttttctgaaaatggtaaccagaagaatttgagaattctaagcttggagttgatgaaacttagaaacaaaagagaaacaaagatgaggggtatgatggctaagcaagaaggcatggagatgaagctgcaggtcacccaaaggagtctcgaagagtctcaagggaaaatagcccaactggagggaaaacttgtttcaatagagaaagaaaagattgatgaaaaatctgaaacagaaaaactcttggaatacatcgaagaaattagttgtgcttcagatcaagtggaaaaatacaagctagatattgcccagttagaagaaaatttgaaagagaagaatgatgaaattttaagccttaagcagtctcttgaggagaatattgttatattatctaaacaagtagaagatctaaatgtgaaatgtcagctgcttgaaaaagaaaaagaagaccatgtcaacaggaatagagaacacaacgaaaatctaaatgcagagatgcaaaacttaaaacagaagtttattcttgaacaacaggaacgtgaaaagcttcaacaaaaagaattacaaattgattcacttctgcaacaagagaaagaattatcttcgagtcttcatcagaagctctgttcttttcaagaggaaatggttaaagagaagaatctgtttgaggaagaattaaagcaaacactggatgagcttgataaattacagcaaaaggaggaacaagctgaaaggctggtcaagcaattggaagaggaagcaaaatctagagctgaagaattaaaactcctagaagaaaagctgaaagggaaggaggctgaactggagaaaagtagtgctgctcatacccaggccaccctgcttttgcaggaaaagtatgacagtatggtgcaaagccttgaagatgttactgctcaatttgaaagctataaagcgttaacagccagtgagatagaagatcttaagctggagaactcatcattacaggaaaaagcggccaaggctgggaaaaatgcagaggatgttcagcatcagattttggcaactgagagctcaaatcaagaatatgtaaggatgcttctagatctgcagaccaagtcagcactaaaggaaacagaaattaaagaaatcacagtttcttttcttcaaaaaataactgatttgcagaaccaactcaagcaacaggaggaagactttagaaaacagctggaagatgaagaaggaagaaaagctgaaaaagaaaatacaacagcagaattaactgaagaaattaacaagtggcgtctcctctatgaagaactatataataaaacaaaaccttttcagctacaactagatgcttttgaagtagaaaaacaggcattgttgaatgaacatggtgcagctcaggaacagctaaataaaataagagattcatatgctaaattattgggtcatcagaatttgaaacaaaaaatcaagcatgttgtgaagttgaaagatgaaaatagccaactcaaatcggaagtatcaaaactccgctgtcagcttgctaaaaaaaaacaaagtgagacaaaacttcaagaggaattgaataaagttctaggtatcaaacactttgatccttcaaaggcttttcatcatgaaagtaaagaaaattttgccctgaagaccccattaaaagaaggcaatacaaactgttaccgagctcctatggagtgtcaagaatcatggaagtaaacatctgagaaacctgttgaagattatttcattcgtcttgttgttattgatgttgctgttattatatttgacatgggtattttataatgttgtatttaattttaactgccaatccttaaatatgtgaaaggaacattttttaccaaagtgtcttttgacattttattttttcttgcaaatacctcctccctaatgctcacctttatcacctcattctgaaccctttcgctggctttccagcttagaatgcatctcatcaacttaaaagtcagtatcatattattatcctcctgttctgaaaccttagtttcaagagtctaaaccccagattcttcagcttgatcctggaggtcttttctagtctgagcttctttagctaggctaaaacaccttggcttgttattgcctctactttgattctgataatgctcacttggtcctacctattatccttctacttgtccagttcaaataagaaataaggacaagcctaacttcatagaaacctctctatttttaatcagttgtttaataatttacaggttcttaggctccatcctgtttgtatgaaattataatctgtggattggcctttaagcctgcattcttaacaaactcttcagttaattcttagatacactaaaaatctgagaaactctacatgtaactatttcttcagagtttgtcatatactgcttgtcatctgcatgtctactcagcatttgattaacatttgtgtaatatgaaataaaattacacagtaagtcatttaaccaaaaaaaaaaaaaaaa

SEQ ID NO: 61794 - DNA, 2957 bp, Homo sapiens
gccagtcaccttcagtttctggagctggccgtcaacatgtcctttcctaaggcgcccttgaaacgattcaatgacccttctggttgtgcaccatctccaggtgcttatgatgttaaaactttagaagtattgaaaggaccagtatcctttcagaaatcacaaagatttaaacaacaaaaagaatctaaacaaaatcttaatgttgacaaagatactaccttgcctgcttcagctagaaaagttaagtcttcggaatcaaagattcgtgttcttctacaggaacgtggtgcccaggacagccggatccaggatctggaaactgagttggaaaagatggaagcaaggctaaatgctgcactaagggaaaaaacatctctctctgcaaataatgctacactggaaaaacaacttattgaattgaccaggactaatgaactactaaaatctaagttttctgaaaatggtaaccagaagaatttgagaattctaagcttggagttgatgaaacttagaaacaaaagagaaacaaagatgaggggtatgatggctaagcaagaaggcatggagatgaagctgcaggtcacccaaaggagtctcgaagagtctcaagggaaaatagcccaactggagggaaaacttgtttcaatagagaaagaaaagattgatgaaaaatctgaaacagaaaaactcttggaatacatcgaagaaattagttgtgcttcagatcaagtggaaaaatacaagctagatattgcccagttagaagaaaatttgaaagagaagaatgatgaaattttaagccttaagcagtctcttgaggagaatattgttatattatctaaacaagtagaagatctaaatgtgaaatgtcagctgcttgaaaaagaaaaagaagaccatgtcaacaggaatagagaacacaacgaaaatctaaatgcagagatgcaaaacttaaaacagaagtttattcttgaacaacaggaacgtgaaaagcttcaacaaaaagaattacaaattgattcacttctgcaacaagagaaagaattatcttcgagtcttcatcagaagctctgttcttttcaagaggaaatggttaaagagaagaatctgtttgaggaagaattaaagcaaacactggatgagcttgataaattacagcaaaaggaggaacaagctgaaaggctggtcaagcaattggaagaggaagcaaaatctagagctgaagaattaaaactcctagaagaaaagctgaaagggaaggaggctgaactggagaaaagtagtgctgctcatacccaggccaccctgcttttgcaggaaaagtatgacagtatggtgcaaagccttgaagatgttactgctcaatttgaaagctataaagcgttaacagccagtgagatagaagatcttaagctggagaactcatcattacaggaaaaagcggccaaggctgggaaaaatgcagaggatgttcagcatcagattttggcaactgagagctcaaatcaagaatatgtaaggatgcttctagatctgcagaccaagtcagcactaaaggaaacagaaattaaagaaatcacagtttcttttcttcaaaaaataactgatttgcagaaccaactcaagcaacaggaggaagactttagaaaacagctggaagatgaagaaggaagaaaagctgaaaaagaaaatacaacagcagaattaactgaagaaattaacaagtggcgtctcctctatgaagaactatataataaaacaaaaccttttcagctacaactagatgcttttgaagtagaaaaacaggcattgttgaatgaacatggtgcagctcaggaacagctaaataaaataagagattcatatgctaaattattgggtcatcagaatttgaaacaaaaaatcaagcatgttgtgaagttgaaagatgaaaatagccaactcaaatcggaagtatcaaaactccgctgtcagcttgctaaaaaaaaacaaagtgagacaaaacttcaagaggaattgaataaagttctaggtatcaaacactttgatccttcaaaggcttttcatcatgaaagtaaagaaaattttgccctgaagaccccattaaaagaaggcaatacaaactgttaccgagctcctatggagtgtcaagaatcatggaagtaaacatctgagaaacctgttgaagattatttcattcgtcttgttgttattgatgttgctgttattatatttgacatgggtattttataatgttgtatttaattttaactgccaatccttaaatatgtgaaaggaacattttttaccaaagtgtcttttgacattttattttttcttgcaaatacctcctccctaatgctcacctttatcacctcattctgaaccctttcgctggctttccagcttagaatgcatctcatcaacttaaaagtcagtatcatattattatcctcctgttctgaaaccttagtttcaagagtctaaaccccagattcttcagcttgatcctggaggtcttttctagtctgagcttctttagctaggctaaaacaccttggcttgttattgcctctactttgattctgataatgctcacttggtcctacctattatccttctacttgtccagttcaaataagaaataaggacaagcctaacttcatagaaacctctctatttttaatcagttgtttaataatttacaggttcttaggctccatcctgtttgtatgaaattataatctgtggattggcctttaagcctgcattcttaacaaactcttcagttaattcttagatacactaaaaatctgagaaactctacatgtaactatttcttcagagtttgtcatatactgcttgtcatctgcatgtctactcagcatttgattaacatttgtgtaatatgaaataaaattacacagtaagtcatttaaccaaaaaaaaaaaaaaaa

SEQ ID NO: 61795 - DNA, 1914 bp, Homo sapiens
agcggggtgggagggaagcgtcgacgagctgaggttggacttgttgaaataatcctgatacattcctacaatggccactgctcagctttctcactgcatcacaatacacaaggcttctaaggaaacagttttcccatcccaaatcactaatgagcatgagtcattgaaaatggtgaagaaactttttgctacttccatctcatgtataacatacctaaggggcctgtttccagagagctcttatggagaacgccatttggatgacctcagtttaaaaatcctccgagaagataaaaaatgtcccgggtcactgcatattatcagatggattcaaggttgttttgatgctttggaaaagagatacctacgtatggcagtactgacactttacacagatcccatgggatctgagaaggtgactgagatgtaccagttcaaattcaaatacacgaaagaaggagccactatggattttgacagtcatagcagcagtacaagctttgaaagtggaacaaacaatgaagatattaagaaagccagtgttctactgatccgtaaattgtatatactgatgcaggaccttgagccacttcctaataatgttgtacttactatgaaactccactactataatgcagtgaccccacatgattaccaacccctcggttttaaagaaggggtaaattcacacttcctgctgtttgacaaggagcctatcaacgtgcaagtgggatttgtctccactggctttcatagcatgaaagtaaaagtcatgacagaggctacaaaagtgattgatttggagaacaatctgtttcgggagaacagcactactgagatcgcccatcagggtctagactgtgatgaggaagaagaatgcaatgaccatattcaaagaatgaattttgtgtgcagtcagcaaagttctgagtgctccaggaagaagaggaaggtcagtgaaccagtgaaggtcttcatccctaacagaaaatgaaagctaaatattccttctacatttattttaaaataagtttattttgtaaaaacatgcataaactgtcttagcaggaaagtacattcctgttaccaaaacctttttctaaattttttgctcaattttttttgtcagttgctaagtgctaaattactggccaggtaggacgcgagtccactttgccataaggaaagcgggtcaatagggctgcctctggatagcattacttcaaagctgggttagagatgaggcaccttttatattatatttgtaaaagaaccacagcagctattttggaaagaagctgttgttctcaaaggaaagaaggatttttttgcataattaaactcttcagctatttagactactgtgaaatgttttgacttgttgtaacctgtatactggaatccctctctagctgtattaaaaattcccacagagttgcataggatgtgtggaggtgcttatccaggtgtgatttatgtgttaacctcagtcacgaggttgatcagctaattgtgggaccaaaatgtgccctgcctcaactctggccccaggccctgttctgttatccaatccgaaacacggaacatgctgcaattcaggagtctggctctcttcttaagacctatattaaatatttcccaagaagcacttcagtttatcagtctgtaacctgcaaatgatgctattagttccctccttattctggaagaatttggatagacttaattgatgattagtatgagatgaacaatagatgacttaaagtgttatttctattatttatataacatgagatttagtaacttataaaatgaggtttagtaatttaatttaaatggataggaccaataagttaaatattaagtgtgtgacttatggttaaataaaatgaaaatacaaaaaaaaaaaaaaaa

SEQ ID NO: 61796 - DNA, 720 bp, Homo sapiens; identical to SEQ ID NO: 27813

SEQ ID NO: 61797 - DNA, 1070 bp, Homo sapiens
aaagacaggtgactagaaatattaaaacaaaaacaaaaaaaaagagagagagagaaaaaggaaagagaaaatacatatttcttccccttactaagctagcgaaaataaaatttaaggcaactgaaatatgcacccaatcaatgtgagacgagaccccagcatccctatctatggactccgacagtccatcttattaaataccaggcttcaggactgctatgtggactcaccggctctcaccaacatctggatggccagaacatgtgcaaagcagaacattaatgccccagcaccagctaccacttcctcttgggaagttgtaaggaacccattaattgccagttccttctccctggttaagcttgtactcaggcggcaactgaagaataagtgctgcccaccaccatgcaagtttggagaaggaaaactctcgaagagattaaagcacaaggacgattcagtgatgaaagccacccagcaggccaggaaaagaaacttcatcagttccaagagcaagcagccagcagggcataggaggcctgcaggaggcatcagagagagtaaagaaagttcaaaggagaaaaaactaacagtccgccaagatcttgaggacagatatgctgaacatgtggctgccacccaagcgctaccccaggacagtgggacagcagcctggaagggccgagtgttgcttcctgaaacccaaaagagacagcagttgtcggaggacacgctaaccatccatggtctccccacagagggttaccaggctctgtaccacgctgtggtggagccaatgctgtggaatccttcagggacccccaagaggtacagcctggagctgggcaaggccattaaacaaaagctctgggaggctctttgcagtcagggtgccatctctgaaggtgctcagagggaccggttccctggcaggaagcagccaggtgtccacgaggagcctgtactcaagaaatggcccaagttaaagagcaaaaaataggaacaagaactcatgggattagagtattctctgctagagatctgaaaaataaacacaactttgcaccttc

SEQ ID NO: 61798 - DNA, 1443 bp, Homo sapiens
aaccattgtgatggtctagataagtgtacatgcttaggccttctgaagcagcatttgaagctgcagtcctgaaaaccatgcaggccggaagagtagataaagaaatatttatttgagatggcacatgtttcttcagaaactcaagatgtttcccccaaagatgaattaactgcttcagaagcctccactaggtctccattgtgtgaacacaccttccctggggactcagacttacggtcaatgattgaagaacatgcttttcaggttttgtcacaaggatccttgttagaaagtccaagttacacagtttgtgtctctgagccagataaagatgatgattttctttctctgaactttcccaggaaactttggaaaatagtggaaagtgaccaattcaagtctatttcatgggatgagaatggaacttgcatagtgattaatgaagaactcttcaagaaagaaattttggaaacaaaggctccttacagaatatttcaaactgatgctatcaaaagttttgttcgacagctcaacctttatggatttagtaaaattcaacagaattttcaaagatctgcctttctagccacctttctgtcagaagagaaagaatcgtctgtcttaagcaagttaaagttctattataatccaaatttcaagcgtggctatccccaacttttagtaagagtgaagagaagaattggtgttaaaaatgcttcacctatatctactttattcaacgaagatttcaacaagaagcattttagagcaggggctaacatggagaatcataattctgccttagctgctgaagctagtgaagaaagtttattttcagcctctaaaaatttaaatatgcctctaacaagggaatcttctgtcagacagataattgcaaattcatctgtccccattagaagtggtttccctcctccttcaccttcaacctcagttggaccatcagaacaaattgcaacagatcaacatgctattttaaatcagttgaccactattcatatgcactctcatagtacctacatgcaagcaaggggccacattgtgaattttattacaaccacaacttctcaataccacatcatatctcccttacaaaatggttattttgggctgacagtggaaccatctgctgttcccacacgatatcctctggtatcagtcaatgaggctccatatcgtaacatgctaccagcaggcaacccgtggttgcaaatgcctacgatcgctgatagatcagctgcccctcattccaggctagctcttcaaccatcaccactggacaaatatcaccctaattacaactgatctgccattaaaagaggaccagattatgaatgacaacagagactaacatttacattgacaaaaaaccctaaaaatttctgcaattatcttattgaacaataaaattgcatgtttacttct

SEQ ID NO: 61799 - DNA, 2509 bp, Homo sapiens
gtctcaaatttgcagggagggacggggtggggggtggggggaccccggttgtgcagtttgatattgagggagcccccacctactcgctggggctgcgtaatctggacgtttccaaactgaagcgaaggcgtcgggagactaggcctcagagaaccatggctactgccaagggaatcgccataggcatcgacctgggcaccacctactcctgtgtgggggtgttccagcacggcaaggtggagatcatcgccaacgaccagggcaaccgcaccacccccagctacgtggccttcacagacaccgagcggctcattggggatgcggccaagaaccaggtagcaatgaatccccagaacactgtttttgatgctaaacgtctgatcggcaggaaatttaatgatcctgttgtacaagcagatatgaaactttggccttttcaagtgattaatgaaggaggcaagcccaaagtccttgtgtcctacaaaggggagaataaagctttctaccctgaggaaatctcttcgatggtattgactaagttgaaggagactgctgaggcctttttgggccaccctgtcaccaatgcagtgattaccgtgccagcctatttcaatgactctcaacgtcaggctactaaggatgcaggtgtgattgctggacttaatgtgctaagaatcatcaatgagcccacggctgctgccattgcctatggtttagataaaggaggtcaaggagaacgacatgtcctgatttttgatctgggtggaggcacatttgatgtgtcaattctgaccatagatgatgggatttttgaggtaaaggccactgctggggacactcacctgggtggggaggactttgacaacaggcttgtgagccacttcgtggaggagttcaagaggaaacacaaaaaggacatcagccagaacaagcgagccgtgaggcggctgcgcaccgcctgcgagagggccaagaggaccctgtcgtccagcacccaggccaacctagaaattgattcactttatgaaggcattgacttctatacatccatcaccagagctcgatttgaagagttgtgtgcagacctgtttaggggtaccctggagcctgtagaaaaagcgcttcgggatgccaagatggataaggctaaaatccatgacattgttttagtagggggctccacccgcatccccaaggtgcagcggctgcttcaggactacttcaatggacgtgatctcaacaagagcatcaaccctgatgaggccgtagcatatggggctgcggtacaagcagccatcctgatgggggacaagtctgagaaggtacaggacctgctgctgctggacgtggctcccctgtccctggggctggagacggctgggggcgtgatgactgccctgataaagcgcaactccaccatccccaccaagcagacacagattttcaccacctactctgacaaccaacccggggtgctgatccaggtgtatgagggcgagagggccatgacaaaggacaacaacctgctggggcggtttgacctgactggaatccctccagcacccaggggagttcctcagatcgaggtgacgtttgacattgatgccaatggtattctcaatgtcacagccatggacaagagcaccggcaaggtgaacaagatcaccatcaccaatgacaagggccgcctgagcaaggaggagattgagcgcatggttctggatgctgagaaatataaagctgaagatgaggtccagagggagaaaattgctgcaaagaatgccttagaatcctatgcttttaacatgaagagtgttgtgagtgatgaaggtttgaagggcaagattagtgagtctgataaaaataaaatattggataaatgcaacgagctcctttcgtggctggaggtcaatcaactggcagagaaagatgagtttgatcataagagaaaggaattggagcagatgtgtaaccctatcatcacaaaactctaccaaggaggatgcactgggcctgcctgcggaacagggtatgtgcctggaaggcctgccacaggccccacaattgaagaagtagattaattctttttagaactgaagcatcctaggatgcctctacatgtatttcattcccctcatcttcaaacatcattattattcttgaccagacctgaatctaagttaccatcccttggaaattctggagaaggagtctcatgcaccacctatcacactccctcacatcctgtttctgactttggaatggactcaggaaaactaggcccctctttaaaccgtgtgatgtatttgaatgtctgttatttccagccaccctaacattcttcttcctgtgtggatgcttatttgtcaatcagtaaatttgttcgtaaagaaaattacttctggtatttaggctgtgaatgtaccttgaaggggagagttcatggagagagcatgtgttctctgattgtgaggtcactgtgaatgattaaattggtaagggtaaagta

SEQ ID NO: 61800 - DNA, 5282 bp, Homo sapiens
ccggcacccggagctcctgggcacacggcattggcaggggccgcttcggcagagtgatgactgatgatgagtccgagagcgtcctctccgactcccatgaagggtcggagctggagctgcctgttatccagctgtgcgggctggtggaggagctcagctatgtaaactctgctctcaaaactgagactgagatgtttgagaaatattacgctaaactggagcccagggatcagcgacctccacgattatcagaaattaaaatatcagcagcagattatgcacagtttcgaggcaggcgtagatccaaatcccggacaggtatggaccgtggggtaggcctgactgccgaccaaaaacttgagctggtacaaaaagaggttgcggacatgaaggatgacttacgacacacaagggcaaatgcggaacgcgacctgcagcatcacgaggcgatcattgaggaggctgaaattcgatggagtgaagtttcgagagaagtgcatgagtttgaaaaagatattctaaaagccatatccaagaagaaagggagtattttggccactcagaaagtgatgaaatacattgaggacatgaaccgccggagggataatatgaaggagaaattacgtttgaaaaatgtttctctcaaagttcagaggaaaaaaatgcttttacaattgaggcagaaggaagaggtgagtgaggcccttcacgatgttgattttcagcagttgaagatagagaacgctcaatttcttgagacaattgaagcaaggaatcaagaactgacccagctaaagctgtcatctggaaacactctgcaggttctcaatgcctacaaaagcaagcttcacaaggcaatggaaatatacctcaatctggacaaggagatcttgctgagaaaagagctacttgaaaaaattgaaaaagaaacactacaagtagaggaggaccgggccaaagccgaggcagtgaataagaggctccggaagcagctggccgagttccgggcaccacaggtgatgacttacgtccgggagaagatcttaaatgcggacctggagaagagcatcaggatgtgggaaaggaaagtggagatagcagagatgtccttaaaaggccatcgtaaggcttggaatcgaatgaaaataaccaatgagcagttgcaggcagattaccttgctgggaagtagccagaggcaggccacggcttacagaccactacatgacctataaaagtaatcagctcctttctagtcacgggctcctctcactgttccctgtctgcctggtgttcccaaccccccacccaggctgagtatcatctcctgggccacatctgcccatggggagtgttttcacagcctggcccctggaactgttaccactgaaagaaccacagggcactctaatggtttgacacttgttagccagcatttagttcacaagcatagtgaaagtgaccttcccacacctgggagagggatagaggagggagagccagcccagtgtatgccatgggcttatccgtggcagccccagtgtgcaactatcaaaaacagacatcaaaacagcatggtgaatgcctggcactcagcattctcagtttactcttcagtttggtggggtagctcctggactagatactgctgcaaaagaaaacaagcacgaaggaaaccaagatgatttcttcgggctgatacaacctgttctgacctgcaaaaatcctaccttcccccacctccccaccgtaatagtcatagtataagggttgtacagacgcctcaggagacctgcctgattcctttacatccttctccctaacatctagactatctctagagctgtttcctagtcgtgaatgcgtgatggtccttctttgtccctgcaagtatgatccaacatggcccagttcagaatcagaatatgtcttctgtgtcatggtggcatttggtccatggtgggagaaagaaatcaacttttcccagtggtggagtgaggacaggggagggccggccctctcagccttggatgtgatccatttgctgtagtcttccaccttggtgtacagaaacaggccagggcacgtctcaccaccgaagttcaggactcctctcagaacccacagatcgaactgctgtagctggcacatcattgggcttcctgggtccccctgtgataaaagacagaaggcttcaagtcttagaaaaactagtttttgttgtaaatctatccttgtgcaatatactgtttgttctagaaatgttttacgctggttctcactggaaatggggcaaattataggatacaatttcaaatctaggcagccaccaccacaaattccaacaagatgacttttccttttattatgcaaattagctgtggacttctgctgattgcctatagcttcctggttcatatttcattttcttgcccctttccagtcctttggccaaaccttccctctcttctggcttctcattcctgaaatgttggtgtttgtttctgttttgtcctgaaatgctcacattttcccttctctgccttgcttcaacccttagtgtaagccacttcctgccacctggcaactgcttaccagcctggctggccgtgctctgggtcttccctactcccaatggagcagtcctctgggacttgggaattctgccacatacactttatctaacttaaagtgacggagtagaagcttggcatcattagctagatatgggaccctggcaagtgaccaaatcctctctgagccaaggtgggaacacagttaatgcctgtaacacgtgctgagcacagcacagtgcctggcacacagcaaacactcaatagaatattagctaccatcatcctgatgtcgctataaaggccagcatttttctgaaaagttggggaaaatgggaaaagcaacaaggcaactagtaggtatcacttaccttacctgcccagaccccacacccctaggtctcctctcaaaggaattcctgcccctcccatggcccatcttggtccgagaagggggtggtcatccccaggctagccagccacttctgacctgtgtggcctgcctggctggaaggcccaggcaatgacatgttgctctcgcagtttggactgagacatggaatggggccgcaattaacaacaggaaacaatctgaacagactgaaccacgagcagcagaaaggcagaagagcagccgcttcagccccttaccatccgagacctgggtgtgtggtctgtcttggtcactctctctgtctctctttctctctttctttctctgtccccaaggctggagtgcagtggtgcaatcttggctcactgcaacctccacctctgggattcaagcaattctcccacctcagcctctcgagtagctggggctacagctatgcgccaccatgcccagctaattttttttttttttttttgagatggagtcttgctctgtcccccatgctggagtgcagtggcatgatctcggctcgctgcaacctcctcctcctgggttcaagcgattctcctacctcagcctccccagtagctgggattacaggcgcccaccaccacacctggctaatttttatttttagtagagatggggtttcaccatgttggccaggctggtctcgaactcctgacctcatgatccacccgcctcggcctccccaagtgttgggattacaggcgtgagccactgcacccggcctaatttctgtatttttagtagagatggggtttcacgatgttggccaggctggtcttaatctaacttcaagtgatctgcccgcctcgccctctcaaagtgctgggattaggcatgaactaccatgcccagtggggtattctctttcaataaagctcctcttttccaaggaagccacaccagaacagagatgaagaccagtgggaaaacatgggagcaactccgtgggcaggccagcggggaggccatgctgcaaagctgccgtgattccctggtgatctctcagcaggccaaggccagacatgtgaggaaggccttgaggacttcattctgtgcctctccttggatggaagggggtgctttagtgtggcactcctgacttttcaattgactggtgaagaggcccttgtgtgcacctcactatgtctgcctaggtcatgggggctccctggccaagaatgacgtggttccccctttcatcagtccgattcgcagtttgtcttaactgtagtggtatagccagagcaagaaaaagaatgtgatttaggacaaatgattggatgagtgattggtagatgtcctcagctatggcgtggttttgcaggtcactgttccacccacctgggcacagcatatacgctttttctcttccccataatcccgtaggggctgcgacttctgaagcacaagaggcagaggcgaacagctccaggtgcccctctggagctaccctacctcatctcccaagggagcggccacagcccagagtggggtctttcattttgtgatcttttcccttgacattcagcaaaagccctgacagtggtagaataaaggcaggatgggtgagtgcagagtgattctgcttttgttgggtttcagggaaacccataggcagattctgaacctggtggttgattctacatgtgggaattgtggctttgaagacctctggacatgagaacatatttccaagacagaggattctatggggacgggtcaccattaaatggtgtgcaagcataattctgttcaaaaatgaaggcatgtttagaggtgtgtcacagttaaaaaccaacctgaactttgcagttagattttaaaagatggtcagttagagtagaaatagcttagaatattccattgagtctaagatacagttagaaatcaacatctttgaaattagggtgtgtcttttaatcagttgatgtcagagtttaacgggcagcatttttttctttcttgggattacaaaaaatgatggtgcattctataattggcagcatcttagatctgaggaagtatgatacttgtttgacggaatggttgacggcagaattttgttaaaaagctatatcttcactgtattttaacacattatctaatttaagaaattgttaagatcccccacctggcagaggacccagtacaaaataggcactcaatagatgttacaccaactttggaagggcaaacatatttcttaatgagaggcagtccttcatgttttgcaataaaatgacttttaaaaaaaaaaaaaaaaaaaaaaaaaaaaaaaaaaaaaaaa

SEQ ID NO: 61801 - DNA, 1282 bp, Homo sapiens
aagccacccagcctatgcatccgctcctcaatcctctcctgttggcactgggcctcatggcgcttttgttgaccacggtcattgctctcacttgccttggcggctttgcctccccaggccctgtgcctccctctacagccctcagggagctcattgaggagctggtcaacatcacccagaaccagaaggctccgctctgcaatggcagcatggtatggagcatcaacctgacagctggcatgtactgtgcagccctggaatccctgatcaacgtgtcaggctgcagtgccatcgagaagacccagaggatgctgagcggattctgcccgcacaaggtctcagctgggcagttttccagcttgcatgtccgagacaccaaaatcgaggtggcccagtttgtaaaggacctgctcttacatttaaagaaactttttcgcgagggacagttcaactgaaacttcgaaagcatcattatttgcagagacaggacctgactattgaagttgcagattcatttttctttctgatgtcaaaaatgtcttgggtaggcgggaaggagggttagggaggggtaaaattccttagcttagacctcagcctgtgctgcccgtcttcagcctagccgacctcagccttccccttgcccagggctcagcctggtgggcctcctctgtccagggccctgagctcggtggacccagggatgacatgtccctacacccctcccctgccctagagcacactgtagcattacagtgggtgccccccttgccagacatgtggtgggacagggacccacttcacacacaggcaactgaggcagacagcagctcaggcacacttcttcttggtcttatttattattgtgtgttatttaaatgagtgtgtttgtcaccgttggggattggggaagactgtggctgctagcacttggagccaagggttcagagactcagggccccagcactaaagcagtggacaccaggagtccctggtaataagtactgtgtacagaattctgctacctcactggggtcctggggcctcggagcctcatccgaggcagggtcaggagaggggcagaacagccgctcctgtctgccagccagcagccagctctcagccaacgagtaatttattgtttttccttgtatttaaatattaaatatgttagcaaagagttaatatatagaagggtaccttgaacactgggggaggggacattgaacaagttgtttcattgactatcaaactgaagccagaaataaagttggtgacagat

SEQ ID NO: 61802 - DNA, 4478 bp, Homo sapiens
ggaaaagaaacgggaagtggccgtgggccggtgaattccgtgtagtggccaagctttgttccaaagagggggaggtggtgacagtctcttgcccactgaagcgtgccagacagagtgctaggcatgggggcagaggtgaatcagatgacagccacctctcaccacgaggagtggctgaaagtgtgactggactacaggcaatcctggccttggcagggagtggggccagccagcagaaacagtgggctgtacaacatcaccttcaaatatgacaattgtaccacctacttgaatccagtggggaagcatgtgattgctgacgcccagaatatcaccatcagccagtatgcttgccatgaccaagtggcagtcaccattctttggtccccaggggccctcggcatcgaattcctgaaaggatttcgggtaatactggaggagctgaagtcggagggaagacagtgccaacaactgattctaaaggatccgaagcagctcaacagtagcttcaaaagaactggaatggaatctcaacctttcctgaatatgaaatttgaaacggattatttcgtaaaggttgtcccttttccttccattaaaaacgaaagcaattaccaccctttcttctttagaacccgagcctgtgacctgttgttacagccggacaatctagcttgtaaacccttctggaagcctcggaacctgaacatcagccagcatggctcggacatgcaggtgtccttcgaccacgcaccgcacaacttcggcttccgtttcttctatcttcactacaagctcaagcacgaaggacctttcaagcgaaagacctgtaagcaggagcaaactacagagatgaccagctgcctccttcaaaatgtttctccaggggattatataattgagctggtggatgacactaacacaacaagaaaagtgatgcattatgccttaaagccagtgcactccccgtgggccgggcccatcagagccgtggccatcacagtgccactggtagtcatatcggcattcgcgacgctcttcactgtgatgtgccgcaagaagcaacaagaaaatatatattcacatttagatgaagagagctctgagtcttccacatacactgcagcactcccaagagagaggctccggccgcggccgaaggtctttctctgctattccagtaaagatggccagaatcacatgaatgtcgtccagtgtttcgcctacttcctccaggacttctgtggctgtgaggtggctctggacctgtgggaagacttcagcctctgtagagaagggcagagagaatgggtcatccagaagatccacgagtcccagttcatcattgtggtttgttccaaaggtatgaagtactttgtggacaagaagaactacaaacacaaaggaggtggccgaggctcggggaaaggagagctcttcctggtggcggtgtcagccattgccgaaaagctccgccaggccaagcagagttcgtccgcggcgctcagcaagtttatcgccgtctactttgattattcctgcgagggagacgtccccggtatcctagacctgagtaccaagtacagactcatggacaatcttcctcagctctgttcccacctgcactcccgagaccacggcctccaggagccggggcagcacacgcgacagggcagcagaaggaactacttccggagcaagtcaggccggtccctatacgtcgccatttgcaacatgcaccagtttattgacgaggagcccgactggttcgaaaagcagttcgttcccttccatcctcctccactgcgctaccgggagccagtcttggagaaatttgattcgggcttggttttaaatgatgtcatgtgcaaaccagggcctgagagtgacttctgcctaaaggtagaggcggctgttcttggggcaaccggaccagccgactcccagcacgagagtcagcatgggggcctggaccaagacggggaggcccggcctgcccttgacggtagcgccgccctgcaacccctgctgcacacggtgaaagccggcagcccctcggacatgccgcgggactcaggcatctatgactcgtctgtgccctcatccgagctgtctctgccactgatggaaggactctcgacggaccagacagaaacgtcttccctgacggagagcgtgtcctcctcttcaggcctgggtgaggaggaacctcctgcccttccttccaagctcctctcttctgggtcatgcaaagcagatcttggttgccgcagctacactgatgaactccacgcggtcgcccctttgtaacaaaacgaaagagtctaagcattgccactttagctgctgcctccctctgattccccagctcatctccctggttgcatggcccacttggagctgaggtctcatacaaggatatttggagtgaaatgctggccagtacttgttctcccttgccccaaccctttaccggatatcttgacaaactctccaattttctaaaatgatatggagctctgaaaggcatgtccataaggtctgacaacagcttgccaaatttggttagtccttggatcagagcctgttgtgggaggtagggaggaaatatgtaaagaaaaacaggaagatacctgcactaatcattcagacttcattgagctctgcaaactttgcctgtttgctattggctaccttgatttgaaatgctttgtgaaaaaaggcacttttaacatcatagccacagaaatcaagtgccagtctatctggaatccatgttgtattgcagataatgttctcatttatttttgatgtagaatttacattgccatgggtgttaaataagctttgagtcaaaagtcaagaaagtgactgaatatacagtcaccttttatgaaatgagtctctgtgttactgggtggcatgactgattgaggtgaagctcacggggccaggctgaccgtcttgaccgttccacttgagataggttggtcatcgtgcagaaggccccaggacctcagcacacacagcctcctcttggtctgagtaggcatcatgtgggggccagatctgcctgctgtttccatgggttacatttactgtgctgtatctcagatgttggtgtctggaagtttattcttaagagactgctacccagctggtctgtattattggaagttgcagttcgtgctttggttggccttctggtctaaagctgtgtcctgaatattagggatcacaattcactgaaatacagcagtgtgtggaggtgatggccagttaatctgctgaactggttttgactaatgacaaacctctttttaagatggtagaatggaggtgatagtcacaaaagtaaatgttccatttttatgaatgactttctacagagtttctatttctaaagaaaaaacaattgttcacatcccatctgatgattagcatgtgtgtaatgaatgctgtcttggtctcccctgtggaaacccttctccctgtgccttagagcaggtgtgtacatctctcactacctttctcatgggtgctgttagattttggcacccgttttctcagcattcagcccagggaatgtggttttcacttcttcgtcagataagaccaacatgaaggggtatgttgagaaacatcctgaggcaaggtgggaggtgggatggggcaggactttcccttccaagcacatgcatggcaggtggggaaaggggggcttgcacccctgctggaaagaaaaggtttgtgtatatttctgatgcaaatgtcatactcactgctctgtaaaggcagctggcagctttttgggaaaagaacgtgctcgtctgttctctggcatcaagtttcttgcagctgctctgagggagagacagtgagctgcaagactgcctccccataacaacaggcaactcagagaagagtcattttatgttgttcctatggaatctggaatgagtgcagagctcctacccacacatgactgccccgccatttcatcctaggcattctgtgaaggagattggttagtccaaacttgctaacatacgaaaattcacttggaacatgatgagagatttcttattgaggccaagagatgtttcctgtcccagaggaaccattaggagtcgcttttagggtattcagctttgttcatgaaataaggcatctctgagaaagtggccccagggagagaatggaggactgggaggagaagcattaactgagctccaagggtgtgtgggcagagagcttgctatgtgaactcactccttaagaaaatggaagagaaaaagagagtgctagttaaaaaatcgggatgttttagtttggatttagggttttgatacttatgttgaaatactaatgtttctgatcaataaaatcaaactcttaatataccgagtaatgaaaccatagtgtgattgcctcagaataaattgagaagtccaaaaaaaaaaaaaaaaaaaaaaaaa

SEQ ID NO: 61803 - DNA, 2055 bp, Homo sapiens
atggcgtgcctgggcttcctcctccccgtgggcttcctcctcctcatcagcaccgtggccgggggaaagtacggcgtggcccacgtggtgtcggagaattggagcaaggactactgtatcctgttcagctccgactacatcaccctcccccgggacctgcaccacgccccactcctgcccctgtatgatggcaccaaggcaccctggtgcccgggtgaggattccccccaccaggcccagctccgctcccccagccagcggcccctccgccagaccactgccatggtcatgaggggtaactgcagcttccacacgaaaggctggctggctcagggccaaggtgcccacgggctgctcatcgtgagccgggtcagtgaccaacagtgctcagacaccaccctggcaccccaggatccccgccagcccctggcagacctcaccatccctgtggctatgctccactatgctgacatgctggacatcctcagccacactcgtggggaggccgtcgtccgcgtggccatgtacgcacccccagagcccatcatcgactacaacatgctggtcatcttcatcctggctgtgggcacagtggctgcaggcggctactgggccggcctgaccgaagccaaccggctacagcggcgccgtgcccgaagaggaggggggtctggtggtcaccatcagctgcaggaagctgcagcagctgagggagcccagaaggaagataatgaggacatcccagtggacttcacgccggccatgacaggcgtggtggtcaccctgtcctgctcgctcatgctgctgctctacttcttctatgaccactttgtctatgtcaccattgggatctttggcctgggtgctggcattggcctctacagctgcctgtcacccctggtgtgccacctgtccctgcggcaataccagaggcctccgcacagcctctgggcctctctgccgctgcctctgctgctgctggcgagcctgtgcgcaaccgtgatcatcttctgggtggcctaccgcaatgaggaccgctgggcgtggctcctgcaggacacactgggcatttcctactgcctgttcgtcctgcaccgtgtgcggctgcccactctcaagaactgctcctccttcctgctggccctgctggcctttgatgtcttctttgtcttcgtcacccccttcttcaccaaaaccggtgagagcatcatggcgcaggttgccttgggccctgcagagtcttcaagccatgagaggctgcccatggtactcaaagtgccccggctaagagtctccgccttgaccctgtgcagccagcccttctccatccttggcttcggtgacattgtggtccccggcttcctggttgcttactgttgccgctttgatgtgcaagtctgctcccgtcagatctacttcgtggcctgcaccgtggcctatgctgtgggcctgctggtcacattcatggccatggtcctcatgcagatgggccaacctgccttgctctacctagtgtccagcaccctgctcaccagcctggctgtggctgcctgccgccaagagctcagcctcttctggactggccagggcagagctaagatgtgtgggctcggctgtgccccttcggctggctctaggcagaagcaggagggcgcagcagatgcccacacagccagcacacttgagagaggcaccagccgaggagcaggggacttagacagcaaccctggagaagacaccactgagattgtcaccatatctgagaatgaagccaccaatccagaggaccgcagtgatagctccgagggctggagtgacgcccacttggatcctaatgagctgcccttcatcccccctggggcctcggaggagctgatgccactgatgccaatggccatgctgatcccactcatgcccctgatgcccccgccctcagagctgggccatgtccatgcccaggcccaggcccacgagactggcctgccctgggcgggactccacaagaggaagggtttgaaagtaagaaagagcatgtcgacccaggctcccttgtga

SEQ ID NO: 61804 - DNA, 2131 bp, Homo sapiens
cctccgagaacggtgtccatgacacagggcgggaagagataaggcctagggaaggcgcccctcgggcctatccacctcttctggggctcggcactaggaagcagcttccctctcaggcccctttgtctccaagccgttccaaactgagtaccgggagacgacacaaagggagggcggtgacggatggcgcaggcgcgggagccgcctaggctgctgggagtggtggtccggccgcggaatggagatcctgaaggagctagacgagtgctacgagcgcttcagtcgcgagacagacggggcgcagaagcggcggatgctgcactgtgtgcagcgcgcgctgatccgcagccaggagctgggcgacgagaagatccagatcgtgagccagatggtggagctggtggagaaccgcacgcggcaggtggacagccacgtggagctgttcgaggcgcagcaggagctgggcgacacagcgggcaacagcggcaaggctggcgcggacaggcccaaaggcgaggcggcagcgcaggctgacaagcccaacagcaagcgctcacggcggcagcgcaacaacgagaaccgtgagaacgcgtccagcaaccacgaccacgacgacggcgcctcgggcacacccaaggagaagaaggccaagacctccaagaagaagaagcgctccaaggccaaggcggagcgagaggcgtcccctgccgacctccccatcgaccccaacgaacccacgtactgtctgtgcaaccaggtctcctatggggagatgatcggctgcgacaacgacgagtgccccatcgagtggttccacttctcgtgcgtggggctcaatcataaacccaagggcaagtggtactgtcccaagtgccggggggagaacgagaagaccatggacaaagccctggagaaatccaaaaaagagagggcttacaacaggtagtttgtggacaggcgcctggtgtgaggaggacaaaataaaccgtgtatttattacattgctgcctttgttgaggtgcaaggagtgtaaaatgtatatttttaaagaatgttagaaaaggaaccattcctttcatagggatggcagtgattctgtttgccttttgttttcattggtacacgtgtaacaagaaagtggtctgtggatcagcattttagaaactacaaatataggtttgattcaacacttaagtctcagactgatttcttgcgggaggagggggactaaactcaacctaacacattaaatgtggaaggaaaatatttcatttagcttttttattttaatacaagtaatattattactttatgaacaattttttttaattggccatgtcgccaaaaatacagcctatagtaaatgtgtttcttgctgccatgatgtatatccatataacaattcagtaacaaaggtttaaagtttgaagattattttttaaaaaggtaaatggttaaattttacatgacagatattttatctattggcctgttccccaaatggccattttaaaatgcttgggtacacttctcttaagtggtctagtcaaggaacctcaagtcatgcttttgctatcaccaatcatagtgtacccatctttaatttatatcaggtgtataaatgtacatttccaaatgaacttgcacttgttatattataattggaagtgcagtcagcagatgctgttgtgaagctaatgtcacaattatgtgcaaaggtgtgcttcctgctgtatgtgagctgtaaaaatgttacgtgaagaaataaatgaaacttggccagtttgttcctctagtagtatatttaattttgacataagtaacttttaaaatttgtcttaaaaatttatacaccagcaatttagacaaagccttaagcaaattttgtattattgttctcacttattattaataatgaagtagaagttacttaattgccagcaaataaatacgtgtcaaaaaagaatctgtattcagaccctgggtcaggaaattactgcccacttgtcaagttcagcccaccatctgtttgaagattatatgaagtttaaattctagtgtccataaataaagtttcagcggaacacaaaaaaaaaaaaaaaaaaaaaaaaaaaaaaaaaaaaaaaaaaaa

SEQ ID NO: 61805 - DNA, 2213 bp, Homo sapiens
gtcaggggctgaggagcgagttgcggtagttgctgtgtaccatggtctcggaggtttctgtcccgcggcccgttaggtcctggtcgggttttcagcgaagcaggccgctcccctgcgtttcccagcgggcgtgctgtgccgcccaacaggctctgcctccaagtgccaaaaactcctagtaaagtttgcgcctcgcccgccgtccacaccccagcggccctgacgctgtcccctccgcgaccctcgcctctggaaaaagtgacaggcaaggccacgcccccgcgagggccggcctggagcccgcagcccccagggcctgggacgagatcctgaaggagctagacgagtgctacgagcgcttcagtcgcgagacagacggggcgcagaagcggcggatgctgcactgtgtgcagcgcgcgctgatccgcagccaggagctgggcgacgagaagatccagatcgtgagccagatggtggagctggtggagaaccgcacgcggcaggtggacagccacgtggagctgttcgaggcgcagcaggagctgggcgacacagcgggcaacagcggcaaggctggcgcggacaggcccaaaggcgaggcggcagcgcaggctgacaagcccaacagcaagcgctcacggcggcagcgcaacaacgagaaccgtgagaacgcgtccagcaaccacgaccacgacgacggcgcctcgggcacacccaaggagaagaaggccaagacctccaagaagaagaagcgctccaaggccaaggcggagcgagaggcgtcccctgccgacctccccatcgaccccaacgaacccacgtactgtctgtgcaaccaggtctcctatggggagatgatcggctgcgacaacgacgagtgccccatcgagtggttccacttctcgtgcgtggggctcaatcataaacccaagggcaagtggtactgtcccaagtgccggggggagaacgagaagaccatggacaaagccctggagaaatccaaaaaagagagggcttacaacaggtagtttgtggacaggcgcctggtgtgaggaggacaaaataaaccgtgtatttattacattgctgcctttgttgaggtgcaaggagtgtaaaatgtatatttttaaagaatgttagaaaaggaaccattcctttcatagggatggcagtgattctgtttgccttttgttttcattggtacacgtgtaacaagaaagtggtctgtggatcagcattttagaaactacaaatataggtttgattcaacacttaagtctcagactgatttcttgcgggaggagggggactaaactcaacctaacacattaaatgtggaaggaaaatatttcatttagcttttttattttaatacaagtaatattattactttatgaacaattttttttaattggccatgtcgccaaaaatacagcctatagtaaatgtgtttcttgctgccatgatgtatatccatataacaattcagtaacaaaggtttaaagtttgaagattattttttaaaaaggtaaatggttaaattttacatgacagatattttatctattggcctgttccccaaatggccattttaaaatgcttgggtacacttctcttaagtggtctagtcaaggaacctcaagtcatgcttttgctatcaccaatcatagtgtacccatctttaatttatatcaggtgtataaatgtacatttccaaatgaacttgcacttgttatattataattggaagtgcagtcagcagatgctgttgtgaagctaatgtcacaattatgtgcaaaggtgtgcttcctgctgtatgtgagctgtaaaaatgttacgtgaagaaataaatgaaacttggccagtttgttcctctagtagtatatttaattttgacataagtaacttttaaaatttgtcttaaaaatttatacaccagcaatttagacaaagccttaagcaaattttgtattattgttctcacttattattaataatgaagtagaagttacttaattgccagcaaataaatacgtgtcaaaaaagaatctgtattcagaccctgggtcaggaaattactgcccacttgtcaagttcagcccaccatctgtttgaagattatatgaagtttaaattctagtgtccataaataaagtttcagcggaacacaaaaaaaaaaaaaaaaaaaaaaaaaaaaaaaaaaaaaaaaaaaa

SEQ ID NO: 61806 - DNA, 2897 bp, Homo sapiens
gcgagttgcggtagttgctgtgtaccatggtctcggaggtttctgtcccgcggcccgttaggtcctggtcgggttttcagcgaagcaggccgctcccctgcgtttcccagcgggcgtgctgtgccgcccaacaggctctgcctccaagtgccaaaaactcctagtaaagtttgcgcctcgcccgccgtccacaccccagcggccctgacgctgtcccctccgcgaccctcgcctctggaaaaagtgacaggcaaggccacgcccccgcgagggccggcctggagcccgcagcccccagggcctgggacggtgaggggcgtgaatgcggcggggggcggggccgttgccgggggagggggccggggcgcatgcgcgctgcgcagcggggctgaatgtttcccaagtgtttgaaactggtatttgggttttccacgttggacaagtgcggctcggcggccagcggagcgcgccccttcccgctgcccgctccgctcctctcttctacccagcccagtgggcgagtgggcagcggcggccgcggcgctgggccctctcccgccggtgtgtgcgcgctcgtacgcgcggcccccggcgccagccccgccgcctgagagggggcctgcgccgccggccggggcgtgcgcccgggagccaccgccaccgcggcccgcgccctcaggcgctggggtccccgcggacccggaggcggcggacgggctcggcagatgtagccgccgggccgaagcaggagccggcgggggggcgccgggagagcgagggctttgcattttgcagtgctattttttgaggggggcggggggtggaggaagcggaaagccgcgccgagtcgccggggacctccggggtgaaccatgttgagtcctgccaacggggagcagctccacctggtgaactatgtggaggactacctggactccatcgagtccctgcctttcgacttgcagagaaatgtctcgctgatgcgggagatcgacgcgaaataccaagagatcctgaaggagctagacgagtgctacgagcgcttcagtcgcgagacagacggggcgcagaagcggcggatgctgcactgtgtgcagcgcgcgctgatccgcagccaggagctgggcgacgagaagatccagatcgtgagccagatggtggagctggtggagaaccgcacgcggcaggtggacagccacgtggagctgttcgaggcgcagcaggagctgggcgacacagcgggcaacagcggcaaggctggcgcggacaggcccaaaggcgaggcggcagcgcaggctgacaagcccaacagcaagcgctcacggcggcagcgcaacaacgagaaccgtgagaacgcgtccagcaaccacgaccacgacgacggcgcctcgggcacacccaaggagaagaaggccaagacctccaagaagaagaagcgctccaaggccaaggcggagcgagaggcgtcccctgccgacctccccatcgaccccaacgaacccacgtactgtctgtgcaaccaggtctcctatggggagatgatcggctgcgacaacgacgagtgccccatcgagtggttccacttctcgtgcgtggggctcaatcataaacccaagggcaagtggtactgtcccaagtgccggggggagaacgagaagaccatggacaaagccctggagaaatccaaaaaagagagggcttacaacaggtagtttgtggacaggcgcctggtgtgaggaggacaaaataaaccgtgtatttattacattgctgcctttgttgaggtgcaaggagtgtaaaatgtatatttttaaagaatgttagaaaaggaaccattcctttcatagggatggcagtgattctgtttgccttttgttttcattggtacacgtgtaacaagaaagtggtctgtggatcagcattttagaaactacaaatataggtttgattcaacacttaagtctcagactgatttcttgcgggaggagggggactaaactcaacctaacacattaaatgtggaaggaaaatatttcatttagcttttttattttaatacaagtaatattattactttatgaacaattttttttaattggccatgtcgccaaaaatacagcctatagtaaatgtgtttcttgctgccatgatgtatatccatataacaattcagtaacaaaggtttaaagtttgaagattattttttaaaaaggtaaatggttaaattttacatgacagatattttatctattggcctgttccccaaatggccattttaaaatgcttgggtacacttctcttaagtggtctagtcaaggaacctcaagtcatgcttttgctatcaccaatcatagtgtacccatctttaatttatatcaggtgtataaatgtacatttccaaatgaacttgcacttgttatattataattggaagtgcagtcagcagatgctgttgtgaagctaatgtcacaattatgtgcaaaggtgtgcttcctgctgtatgtgagctgtaaaaatgttacgtgaagaaataaatgaaacttggccagtttgttcctctagtagtatatttaattttgacataagtaacttttaaaatttgtcttaaaaatttatacaccagcaatttagacaaagccttaagcaaattttgtattattgttctcacttattattaataatgaagtagaagttacttaattgccagcaaataaatacgtgtcaaaaaagaatctgtattcagaccctgggtcaggaaattactgcccacttgtcaagttcagcccaccatctgtttgaagattatatgaagtttaaattctagtgtccataaataaagtttcagcggaacacaaaaaaaaaaaaaaaaaaaaaaaaaaaaaaaaaaaaaaaaaaaa

SEQ ID NO: 61807 - DNA, 711 bp, Homo sapiens
gcctggggtcacagggatgccgcggctcctccgcttgtccctgctgtggcttggactcctgctggttcggttttctcgtgaactgagcgacatcagcagtgccaggaagctgtgcggcaggtacttggtgaaagaaatagaaaaactctgcggccatgccaactggagccagttccgtttcgaggaggaaacccctttctcacggttgattgcacaggcctcggagaaggtcgaagcctacagcccataccagttcgaaagcccgcaaaccgcttccccggcccggggaagaggcacaaacccagtgtctacttcttgggaagaagcagtaaacagttgggaaatgcagtcactacctgagtataaggataaaaagggatattcaccccttggtaagacaagagaattttcttcatcacataatatcaatgtatatattcatgagaatgcaaaatttcagaagaaacgtagaaacaaaattaaaaccttaagcaatttgttttgggggcatcatccccaaagaaaacgcagaggatattcagaaaagtgttgtcttacaggatgtacaaaagaagaacttagcattgcatgtcttccatatattgattttaaaaggctaaaggaaaaaagatcatcacttgtaactaagatatactaaccatcttagaattttttctaacctaataaaagcttaatacatttatttaaaaa

SEQ ID NO: 61808 - DNA, 3032 bp, Homo sapiens
ccagggggaacgcaggtcgcttacccggctgggtaggtcggcggcctggttgccatggcagcggggtcgcgggccggcgccagggaaggccccgaggctgcgggcggccagggctgcccgcggattcccagacccggacgcccgagccagcaaccctgaggggcggccgggcagcgccgccaccatgttcctgggcaccggggagccggccttggacacgggagatgacagtctgtctgcagtcacctttgactctgatgtggagacgaaagcaaaaaggaaagctttccacaaacctccacccacatcgccaaagtcaccttatctctctaagccgagaaaagtggcctcctggaggtccctcaggacggcagggagcatgcctctgggcggccgagcgtccctgaccccgcagaagctgtggctgggaaccgcaaagccaggaagtctgacccaggccctgaactcacccctcacctgggagcatgcgtggactggcgtccccggcggcactcctgactgtctgacagacaccttcagagtgaagaggccacatctcaggcgctctgccagcaacggtcatgtccctgggactcctgtctacagagaaaaagaagatatgtatgacgagattattgagttaaagaagtcattgcacgtgcagaagagcgacgtggacctgatgagaacgaagctccggcgcctggaggaggaaaacagcaggaaggaccggcagatagagcagctcctggatcccagccgcggcacggattttgttcggactctggcagagaaaaggcccgatgccagttgggtcattaacgggctgaagcagaggatcctgaagctggaacagcagtgcaaggagaaggacggcaccatcaggaaactccagaccgatatgaagactaccaacctggaagagatgcggatcgccatggagacatactacgaggaggtgcatcgtctccagaccctcttggcaagttctgaaaccaccggaaagaagcccctgggggagaagaagacgggcgccaaaaggcagaagaagatgggcagtgccctcctgagcttgtcccggagtgtccaggagctcacggaagagaaccagagcctgaaggaggacctggaccgcgtgctgagcacctccccaaccatctccaagacacagggttatgtggagtggagcaagccccggctgctgaggcgcattgtggagctggagaagaaactaagtgtgatggagagctcaaaatcacacgccgcagagccagtcagatcacacccgccagcctgccttgcatccagctctgcgctgcacagacagccacgaggggaccgcaacaaggaccacgagcgtctccgaggggctgtgagagacctgaaggaagagcggaccgcgctgcaggagcagctactgcagagagatttggaggtgaagcagctcctgcaggcgaaggccgacctggagaaggagctggagtgcgcgagggagggcgaggaggagaggagagagcgagaggaggttttgagagaggagattcagacacttaccagcaagctccaagaattgcaagaaatgaagaaagaagagaaagaggattgcccggaagttcctcataaggcccaagagctcccagctcccactcccagcagcaggcactgcgagcaagactggccgccggattccagcgaggaggggctcccgcggccccgctccccctgctctgatgggagaagagacgccgcggccagagtcctgcaggcccagtggaaggtgtacaagcacaagaaaaaaaaggctgttctggatgaggcggctgtggtgcttcaggcagctttcaggggacatctcacgcggacaaagctcttagcaagcaaagcacatggctcagagccacccagcgtgccaggcctctcagaccagagctctcctgtgccccgcgttccgagccccatcgcccaggccacgggcagccctgtgcaggaggaggccatcgtcatcatccagtccgctctgcgggcacacctggcccgggccaggcacagtgctaccggtaaaagaaccaccaccgcagcttctaccaggaggagatcggcttcagccacacacggggacgcctcctccccacccttcctcgcagctcttcctgacccctctccctcagggccacaggccttggcacctctacctggggatgacgtcaactccgatgattccgacgatattgtcattgcaccgtctctgcccacgaagaactttccagtttaggtccccgtcactgtctccacgccgtgatggcagcgctgccgaggacataggaaccacgactggaaagataatttatcgtgttaggagaagaacgatgatacctacttaacacctcagcatctgcgtcgtgtctctttgtgcttttgtttgtggaaggagacccaaatgcctttactttattctctggggagggccagcggctcgcatccccctcatctccagctgcagctcggatggtggattttcagtgccaacagacacatctgccgtgaactcgcagatgccagggagccctgtagtgacacgttctctgacagcaccttgccgcctgcccacgaccttgaccgtgaggagctgctatccgcaaccagcgccgacaccatgccccctcttcctggtgacaccctcaacaaccaggatttgctcgatctcagcccagcaggccaggcagacacaccccgctgtgccttaggaaggtgtgagaccggcttcccccatccccacagcaaaacacggcctgtcccaagccagtgaggagctaaagacacccaggtccccaaatgatcttactccatgccccacccgctcacaccgtcctttcccgtcacccttgctatcccctggagcactgccctccagagctgcccttcccaggaaggaatttggttggattctgtcactgtggagaccaagattttttaaaattcccaattacaaaagcagcatcacacttgcttctgagaaaaaaaaaaaaaaaaaa

SEQ ID NO: 61809 - DNA, 5248 bp, Homo sapiens
tccttctagggaagggctggggaggagggggtggtgacacggtggagacaccggctaggccagggggcctgcccttgggacaggtccagacccatggagccccccgggaggagcagcaggtccacagcgtctcatactctacaccagtattgctgtcctactcaggtccttgactccatgaagcttaccccctcaggcaggctggcagagagcagtgtggagggtgatgccccaggcagtgacctgagcacagcggttgatagtcctgggagccaacccccctaccggctgagccagctgcccccctccagcagccacatggggggcccccctgctggagtgggccttccctgggctcagcgggcacgcctccagccagccagtgtcgccctgaggaagcaggaggaggaggagataaagcgctccaaggccctatcggacagctatgaactctccacagacctgcaggacaagaaggtggaaatgctggagaggaagtatgggggctccttcctgagccgcagggctgccaggaccatccagacagccttccgccagtaccgcatgaacaagaactttgagcggctacgcagctcagcctcagagagccgcatgtcccgccgcatcatcctttccaacatgcggatgcagttctcctttgaggagtatgagaaggcacagaaccccgcgtacttcgagggcaagcctgcctcgctggacgagggtgccatggctggtgcccggagccaccggcttgaacgggggctcccatatggaggctcctgtggtgggggcatcgatggtggtggaagctccgtcaccacatctggagagttttctaatgacatcacagaacttgaggactccttctccaaacaggtaaagtctctggctgaatccatcgacgaagccctgaactgccacccgtcagggcccatgtctgaggagccagggtcagcccagctggagaagcgggagtcaaaggaacagcaagaggacagctcagccacatccttcagtgatcttcccctctacctggatgacacagttccccaacaatcccctgagcgactgcccagcacagaacccccaccccagggccggcccgagttctgggcgccagcccctctcccgccagttcctccaccagtgccatcaggaacccgggaagacggtagccgtgaggaaggcactcgcaggggtcccgggtgcttggagtgccgggatttccggctgcgggctgcccaccttcccctgcttaccattgagcctcctagtgacagctccgtggacctgagtgaccgctcagatcgcggctctgtccaccgccagctggtgtatgaggctgatggctgcagcccccatgggaccctgaagcacaaggggccaccaggcagggccccgatcccacaccgccactacccagcccctgaaggcccagccccagccccaccagggcccctgccaccagcccccaacagtggcactgggcccagtggtgtggctgggggtcggaggttggggaagtgcgaggcagcaggcgagaactctgatggtggagataacgagagccttgagagctccagcaattccaatgagaccatcaactgcagctccggctcctcttctcgggacagtctaagggagcctccggctaccggcctgtgcaagcagacttaccagcgggagacaaggcatagctgggactcgccagctttcaacaatgatgtggtccagaggcggcactaccgaatcggcctcaacctcttcaacaagaagccagagaagggtatccagtatctgatcgagcggggcttcctgtcagacacaccggtgggagtggctcacttcatcctggagcggaaaggcctcagccggcagatgataggggaattcctagggaaccggcagaagcagttcaacagagacgtgttggactgtgtggtggatgagatggacttctcctccatggatctggatgatgcgctccggaagttccagtcccatatccgggttcagggtgaggcccagaaagtggagcgactcatcgaagccttcagccagcggtactgtgtctgtaacccagccctcgtgcgccagttccggaacccagacaccatcttcatccttgcttttgccatcatcctcctcaataccgacatgtacagtcccagcgtcaaagctgaacgaaagatgaaactagatgacttcatcaagaacctgagaggggttgacaatggtgaagacatcccccgagacctcctggtgggcatctaccagcgcatccaggggcgtgaactgcggaccaacgatgaccatgtgtcccaggtgcaggctgtggagcgcatgattgttggaaagaaaccagtcctgtctctccctcaccgtcgactggtttgctgctgccagctctacgaggtgccagatccaaaccgcccccagaggctagggttgcatcagcgggaggtcttcctcttcaatgatctccttgtggtcaccaaaattttccagaagaagaagatcttggtgacgtacagtttccgtcagtctttccccctcgtggaaatgcacatgcagctcttccagaattcatattaccagtttgggatcaagttgctgtctgcagtacctggtggggagcgaaaagtcctcatcatcttcaatgcccccagcctccaggaccggctgcgctttacatccgacctgcgcgagtccattgcggaggtgcaggagatggagaaataccgtgtggagtcggagctggagaagcagaaaggtatgatgcggcctaacgcctcacagcctggaggggccaaggactcagtgaatgggacgatggcccgcagtagcctggaggacacttacggggcaggcgatgggctcaaacggggcgcactcagcagttccctgcgagacctctctgatgcaggggtctgttattagcagtccacgccctcaccagaggatgccacctccgcccccacccccgccgccagaggagtacaagagccagaggcccgtctccaactcctcatccttcctgggctccctatttggaagcaagcggggcaaggggcccttccagatgccaccaccgccaacaggccaggcctctgcctcctcttcatctgcttcttccacgcaccaccaccaccaccaccaccatcatggccatagccacggtggcctgggggtgctgcctgatgggcagtccaagctccaggccctgcatgcccagtattgccaaggaccgggccctgccccgccaccctacctcccaccccagcagccctctcttcccccacctccccagcagcccccacccttgccccagctgggctccattccaccgcctcccgcctcagccccacctgtggggccacatcgccacttccacgcccatggcccagtcccagggccccaacactataccttgggccggccaggcagggcacccagacggggggctggaggacaccctcagtttgctccacatggccgccaccccctgcaccagcccacatccccactgcccctgtacagtcctgccccccagcaccctccagcccacaaacagggccctaagcacttcatcttcagccaccacccacagatgatgccagcagcaggcgcggctgggggccctggatcccggccaccagggggctcctactcccacccccaccacccccagtcaccattgtcaccacactcacccatcccaccccacccctcctatccacccctccccccaccctcccctcacaccccgcactcaccccttccacccacctccccccatggcccgctgcacgcctctgggccccctggcacagccaacccccccagtgcaaaccccaaggccaagccaagccggatcagcaccgtggtctgatgaatggagagagtgagctggggaacaggaaagtctggggagccacaggagagggaccttgcaccctctttgcttcctcggttttttcaaaaatatatatacacatagcaatgtcctcctccccatgtcctccctgccttgggacccgtcctctcacccccagcagttgccatggggtttccttccagattcgaggatccttgccacttgaagcctggactcagggtgctccagcgctggggagtggtgagggccttccagagatcctcgtactctttctcccgtcttcttcttccccacttttccctggaggtctagctctgtggcctcagacctctgggcctgtgtgagctctctgtgagctctggctggcggagaagggcaggtgtccggagctgtcggggtgaaggcttccctggggctcctctggccgtgtggggctaggagagcgctctgtagagttgtggccaaacttcagctggcttggccctctctctgacctcagggcctggccacacacttccatgtgtctttttgcctgctggaggacacggaccattgatgcacttggtgggtgggaccctgcttgtgttggccccacgtggggcagtgcttcctctctcgagccagtctatgccctttctccagtaggccccagcccagacctcttcggcttcaggaacttgcctcgccctgcaacgttcttatcctgatcaaagtccagacaggttttggggggggctcaggtctgggatgagaagggcactgccctccctcacccatattgcatgcccccccgccattcccttacacctaccccacctacaactgaagacaatgcactttacagatatcacccacacacacctcgctggggcaggggcacccagcatcagccctggggagagaggctcccaaagggccaccatgagcccaagatatccttcctgaggcagagattgaagccatcagagctggggttgggagccagaatgcctgagtccttctgtccgtcagaatctccgctgcctctccagcccttttgcagccctgtttatttattataaatatattttttacaagccccagctcctcttcttgccccgcatatccagctcctcactcagctcctgcctccctctcccctctccaccatgggctgcagtatagacagacagatggaccctggctgtacgaagggccagggccactggggcttgggggcgggggagggtggcagtgggaggggctgtatggagaggagctggggttcaggcattgtcttttttcctccttgtatataagaatgtatatttgatgcctcataaaagaccttgtgctcaaaaaaaaaaa

SEQ ID NO: 61810 - DNA, 1595 bp, Homo sapiens
gaaggagatcctatcagtggggagagtgtgaggggagagggagagcctgcagggcaggcgctgaggatcacgcatcctgtgactctcccctgtcccccgccaccctctgaaccactggccaccatggctacttcaaagttgcccgtggtgcctggggaggaggaaaacaccatccttatggccaaggaaaggctggaggccctgcgcacagcctttgagtcgggtgacctcccccaggccgcctctcacctccaggagctgctggcctccacggaaagcatccgcctggaggtgggcgtcacgggcgagtcgggcgcgggcaagtcctccctcatcaatgccctgcgtggcctggaggccgaggaccctggcgcggctctcacgggcgtcatggagaccacgatgcaaccgtcgccctatccacacccacagttccctgacgtgaccctctgggacctgccaggagccggctctccaggctgcccggctgacaagtacctaaagcaggtagacttcagccgctatgacttcttcctgctggtctccccccgccgctgcggggccgtcgagacccgcctggccgctgagatcctgtgccagggcaagaagttctactttgtgcgcaccaaggtggacgaggacctggcggccacgcgcacccagcggccgtcgggcttcagagaggccgctgtcctgcaggagatccgagaccactgtgccgagcggctgcgggaggccggcgtggctgaccctcgcatcttcctggtgtccaacctctcgccggcccgctacgactttcccacgctggtgtccacctgggagcacgacctgccctcccaccggcgccacgctggcctgctgtcgctccccgacatctcgctggaggccttgcagaagaagaaggccatgcttcaagagcaagtcctcaagaccgccctggtgttgggcgtcatccaggccctgccggtcccagggctggcggccgcctacgatgatgcgttgctcatccactcactgcgtggctaccaccgcagctttggtctggacgacgactcgctggccaagctggccgagcaggtgggcaaacaggcaggtgacctgcgctcggtcatccgctccccactggccaacgaggtctcgcctgagactgtcctgcggctctattcccagtcgtccgacggcgccatgcgggtggcccgcgcctttgagaggggcatccctgtgtttgggacgctggtggctggcggcatcagctttggcgctgtctacaccatgctccagggctgcctcaacgagatggctgaggacgcccagcgtgtccgcatcaaggccctggaggatgacgagccgcagccggaggtcagcttggaagtggccagtgacaatggcgtggaaaaggggggctccggggagggaggtggggaggaagccccactctcaacctgcaggaagctcggcctccttcttaagtacattctggacagctggaagaaacacgactcagaagagaaataaagagtgcagccccgcccccctgcctcacccacaaactaagtcttaacaaaatccaaattaccaacaaaaaaaaaaaaaaa

SEQ ID NO: 61811 - DNA, 6253 bp, Homo sapiens
atgaattgtctgaagggacctcccattccccaaaaccaaaacggcaccttttccacaagggacaagaaacttttaaagagtcgcaaggttagatttcaggagcccttctatgggccatatcttttcctgtcgtccccaaatagctcttattgttcacacagcccaggagagacgttttggagtagcgtgtccgggccttttgggctgtttcacagccttaggaggctgaactcccagaggggtgacgaggacaaagctgatgagatccagaacctggataatatggaagaagaaaaatgggtctccggggcgggccggagcctgaggaagaggaaggggacgaggacaacgagcgactgggcggcggaggacgaggaggaggaagaggaggccgagcaacaagatggcccctgctgcaggagcagcctcagcagcagcaggtgggaggccggaggcggtgctggcggtggcggcggcagccgtggcccggcggcctgggacagaatcagagtcaacggtggcctcggcggcggcggcggctgccgcggcggtggcgacggccgcggggactcggagctgagaggagctgctgctcggaccagcgcggtgagcgagcggcgggcggcgacttggggagcggggctgccgcggccggggcctcagtcgggaacaataggcagctgtggtcgggaagggtttgtcctcgcccgccctctgctcctccgcggcagcggcagcccggccggccccaggctcctcagggcccccgccggctgttctggggcttgtcagtggccggcgtcctttaggcctcaggcctctgcatgccgcctgtagggcctgtcggggtaggtaggccgagaggaggacgaagggaggctcggacgagagggagggggcgaaagggctacctggctcctgtggtactcccagggcctgggccaggcggggaatgcgcacgggaactgctttttggacccctagtctgtgggggtgggggagggcgaaggcgtctgtaaacaggcgccgcctcggcctcccagcacctcagggctgcttcctcccccagcccctgaagcgctccccttctttggccaagtggatttcacggtgtctgtttccctgaagtccctggagatctagcctggtagtcttctccctgctggcgatgggaaaattgtgtgtgtgcaggtgtctttaaaaaaaaaaaacaaaaaacttaaatgcaacaaaaacatataaaatgtggttatcggtaaaggatggagtggtaagggatgcgcctctctaaacatctctaagtatcagttctataaacatcagttatgcccgcatcccaggtgagagtggattgaaacaagggctcttttggaacagtaataacacaactcttgacataccagaatagcctatgaaactggaaacaaacactggcaacgcggagacaaactgtaatgtttaaagaggacttttattccagctaggcgttttgaattactaacatgcagtataagaagcaacattaactagcataaagtggacctcaggaagcacttcgaaaggagacaggtggttcatctccggccatagagcttcttgtgccttgtctcgtgtttcagtaatttttcctgaaattgttcaagaccagtcttttctctgagtttgaaatttgatttcgtttttgttttgttttgcgacggagtcttgctctgtcacccaggctggattgcagtggcacaatctcggctcactacagcctccacctcccggattcaagcgattctcctgcctcaccatccggagtagctgggattacaggcgcccgccaccatgcccggctgatttttgtatttttagtagagacggggtttcaccatgttggccaggctggtctggaactcctgacctcaagtcatctgccctcctccgcctcccaaagtgcttggattacaggcgtgagccacctcgctcagccttaaacttaatttttcaaggcttctaccacattttcttacaagtgagggaaaaggtagatttatttctaaagtactttctacctaggtatgcagaaatttatattaaaatcgcttggatacatccaaggagattgcttttcacttgttaacattcaactgcaaggcctaagggttataggttgtgttcttttcagcactgacctgtgctgaaaagatgccagttaatatctttcacctcttctaagggtaaatttctaagtagaattggtccaagtctgttctaattaaaaacattataagcagcactagtctagttcttagttcttccacaacaattgacactgaatagattagcaattgaataaacataaaggttgaattttcttgtttaggatttgaagtatagtgaatgaatatcaatactgaccttcattttatgcttagcataaataatgttggagatgttttgattttttgaatgatggagaaataacaactttctatggctcctgatgttgtgacttttttgcagatatttcagaaaggacaccgtttttcaggtgctcaaatctgtgattttttttttttttctgtgctaattttgttaggtcagcacagattccaagtaaagtctgtgttataatgatacttaaatttatgtatggccctaaacctattagaacaattgtagtaatttataggttgtaagttttaagtggttcatgtgctgtgttatgaaaacaatctcaccgtgttatgtcaagggcagatttacctcatatttaatatcattttcctgaaaataaatatttttaagtggtaaggttttgtatttcagattggttattgacccagcaatttatgggcttagtctgggtccgtatttctgttcaataggaaaaaaatttagggaattgtttttatttattttgtgtcaaaacagttttaagttttgacacaaactcaactgtcccttcttcagtatcaatacttattacttaagttcacattttctcaggtaataaaaatttacttctaagaagttttggaaccagagcttaagaattagatttatattttcttggtaatattaaaagttaatatatgcttgatttatttgaagaaataaaaaagggtaatttgtacacaacgcctttcagaacatatttgttgaatgaataaaaatatttaagcttcctcattatgctgcagtattagttctgttgtcctcattttttcatatgaagaatgtgaagctaagagtagctatgtaaccagcaaaaagatcacataattaataggtaaaagagcttactcagactcagatcttgtgacacaaattagattctttgccactaccacatgtgtcacagttaaactttgaagcatcttctgtgttgacagattcctttttttgcctgtgaacttaccctattatcattatttgtatcctgtcagatatctacttgtaagaccaagaaagtatttgttcatgtgaatcacaaaagaaacacttaaatttttgtttttagcatatctgaatgctataaaatataaaaactcatactgtttacataggacagatttatcatactgctgtaattgttttcatggttaatttgttacataggcaattactaaattgtgcctttgaaatactttataaatttttttaaataattaaagatattcaatgatgttaaagttgggtcagctaatatttgaagttcttaatttataattttttttctttaagccatagataatttagaattctgcagtatttttcatctccagatcttagggcttgaaatggattctgatgggtctaatcagtccactcttgcatatatcttgaaaatggtcagcatccaacaaagtgaagaataaactgataaatgatccctgtttggtgaacacctcagatcaggatgttccttggcagggtattctgacctggtttagctttggccccgtctgtgctcagggttcaggtattctgcaggattgggttcagagggattaaaattctcagattggcctgtatcaaaacagtcacagattttggtcagccttttcccagaaccgtctccaagattttttcttttgtgtaattctggaatctaggctggatttggactagctttagaggttatgataaaagattaattttgtcaggcatttatacaaaggaggttttcttactacagagtttcttaaggtagattccttctatttttgaagtgtgacatttaccaatctgaagtaatgttgccctacatcccccagacacttaactttagcatatttatttctgtccatttttggtcaggattgtgcctgtttacttatataatattcttgtttactttttgtttattagatacttcttattagtttatattgttttcctgattgaggcttggggaaagaattttcctcaaatttaaagtcaccttacttatttgcagatgtatgtcagagcaatattcttttgacagttatcaagcattttagcaatgctgtatgtatatattatgaatgaatgacagagtcactcatggtctgtcacccaggctggagtgcagtggcattatcatagctcacttcagcctcaaactccttggtttaagtgttattcccgccttacctggctactttttttaatttttattatttttatagagatagcattttgctgtgttgcccagggtggtctcaaactcctgggagcaaggtgatcctcccacttctgcctcccaaagtgctgagattacaggcataacaatgttttaaactgacactggtataccttcactgattattactgtgcacatgtggtaataatttaacttataagtgcattttatctaaaaaatttccaagatctaaatagcatttgaacatggtagcagtttttttttttttttttttttttttttgagcaagaaaagagttctaaaggggtcagttttatctacagattaacataattttttttattgaggttaagtcacataacattaaccattttaaagtaaacagtttaggtggcactttatacattcacaatgttgttcaaccaccagctctaattccagaatgtgttcattaccccaaaaggaaacactgtacccattaagcagttactctgtattcccctcttccctaatccctagcaaacgccattctgctttctgtctctaatttgagccaacatcgaggaagagtactctgtacaattgaaattgcagaaaaaactttgggatgtgattgttaggaataaaaaaccacctaattctttgcatgcttctctaagtacagtagacatgctgccagggactctttatggaagaaaagttgagactcatagaagtttgcagttttgttttgatcaccccagagggttttgctcaaactcttagactcatttgtatttcttcattgggttataagaactaaaatttaatgttctatacaaatgtgaacaactaatacttggtctcctatctagaacttgtttgccttttaggttttcttaatgtatagaagaaactaggaatattcacaaaggatttatttgaagttacactgggaaacgatttttagaatttgaagctctttgatccctgtgaatctaactttatgactattttattcagctaatctttgagaatatttagagttttgatttgcgtggcactctgcttttaatcccttgttgaataagtgttagaaaccttgatcttggccctatacctgatcacctctaaaaacatgaacagtgttacaaaggcagttgtttagtaagcttttttggattgttttaattggctgactgagggagacaaaattagtttttttttttctttctagaataaagggtaataaacttggactttagagttactgctaagattgacatttccatttggggctttagaaatatattgttatcttaaattcaaaatggtactttatctaattgaattgaaatcttaaaatttatgagaaacaaaagtcactttatgttcttagtaaatatttctaatggggttataggagatctaagtacaaaaaaaatttaaaattttgttattaatctcccctccttaaggaaaattttattaatatacataattataatttagttataagaacaacttaagttgagtacagtggctcaagcctgtaatcctagcactttaggaggccaaggcaggaggatctcatgaagccaggagttccagaccagcctgggcaatagagtgaaaccc

SEQ ID NO: 61812 - DNA, 6254 bp, Homo sapiens
atgaattgtctgaagggacctcccattccccaaaaccaaaacggcaccttttccacaagggacaagaaacttttaaagagtcgcaaggttagatttcaggagcccttctatgggccatatcttttcctgtcgtccccaaatagctcttattgttcacacagcccaggagagacgttttggagtagcgtgtccgggccttttgggctgtttcacagccttaggaggctgaactcccagaggggtgacgaggacaaagctgatgagatccagaacctggataatatggaagaagaaaaatgggtctccggggcgggccggagcctgaggaagaggaaggggacgaggacaacgagcgactgggcggcggaggacgaggaggaggaagaggaggccgagcaacaagatggcccctgctgcaggagcagcctcagcagcagcaggtgggaggccggaggcggtgctggcggtggcggcggcagccgtggcccggcggcctgggacagaatcagagtcaacggtggcctcggcggcggcggcggctgccgcggcggtggcgacggccgcggggactcggagctgagaggagctgctgctcggaccagcgcggtgagcgagcggcgggcggcgacttggggagcggggctgccgcggccggggcctcagtcgggaacaataggcagctgtggtcgggaagggtttgtcctcgcccgccctctgctcctccgcggcagcggcagcccggccggccccaggctcctcagggcccccgccggctgttctggggcttgtcagtggccggcgtcctttaggcctcaggcctctgcatgccgcctgtagggcctgtcggggtaggtaggccgagaggaggacgaagggaggctcggacgagagggagggggcgaaagggctacctggctcctgtggtactcccagggcctgggccaggcggggaatgcgcacgggaactgctttttggacccctagtctgtgggggtgggggagggcgaaggcgtctgtaaacaggcgccgcctcggcctcccagcacctcagggctgcttcctcccccagcccctgaagcgctccccttctttggccaagtggatttcacggtgtctgtttccctgaagtccctggagatctagcctggtagtcttctccctgctggcgatgggaaaattgtgtgtgtgcaggtgtctttaaaaaaaaaaaacaaaaaacttaaatgcaacaaaaacatataaaatgtggttatcggtaaaggatggagtggtaagggatgcgcctctctaaacatctctaagtatcagttctataaacatcagttatgcccgcatcccaggtgagagtggattgaaacaagggctcttttggaacagtaataacacaactcttgacataccagaatagcctatgaaactggaaacaaacactggcaacgcggagacaaactgtaatgtttaaagaggacttttattccagctaggcgttttgaattactaacatgcagtataagaagcaacattaactagcataaagtggacctcaggaagcacttcgaaaggagacaggtggttcatctccggccatagagcttcttgtgccttgtctcgtgtttcagtaatttttcctgaaattgttcaagaccagtcttttctctgagtttgaaatttgatttcgtttttgttttgttttgcgacggagtcttgctctgtcacccaggctggattgcagtggcacaatctcggctcactacagcctccacctcccggattcaagcgattctcctgcctcaccatccggagtagctgggattacaggcgcccgccaccatgcccggctgatttttgtatttttagtagagacggggtttcaccatgttggccaggctggtctggaactcctgacctcaagtcatctgccctcctccgcctcccaaagtgcttggattacaggcgtgagccacctcgctcagccttaaacttaatttttcaaggcttctaccacattttcttacaagtgagggaaaaggtagatttatttctaaagtactttctacctaggtatgcagaaatttatattaaaatcgcttggatacatccaaggagattgcttttcacttgttaacattcaactgcaaggcctaagggttataggttgtgttcttttcagcactgacctgtgctgaaaagatgccagttaatatctttcacctcttctaagggtaaatttctaagtagaattggtccaagtctgttctaattaaaaacattataagcagcactagtctagttcttagttcttccacaacaattgacactgaatagattagcaattgaataaacataaaggttgaattttcttgtttaggatttgaagtatagtgaatgaatatcaatactgaccttcattttatgcttagcataaataatgttggagatgttttgattttttgaatgatggagaaataacaactttctatggctcctgatgttgtgacttttttgcagatatttcagaaaggacaccgtttttcaggtgctcaaatctgtgatttttttttttttttctgtgctaattttgttaggtcagcacagattccaagtaaagtctgtgttataatgatacttaaatttatgtatggccctaaacctattagaacaattgtagtaatttataggttgtaagttttaagtggttcatgtgctgtgttatgaaaacaatctcaccgtgttatgtcaagggcagatttacctcatatttaatatcattttcctgaaaataaatatttttaagtggtaaggttttgtatttcagattggttattgacccagcaatttatgggcttagtctgggtccgtatttctgttcaataggaaaaaaatttagggaattgtttttatttattttgtgtcaaaacagttttaagttttgacacaaactcaactgtcccttcttcagtatcaatacttattacttaagttcacattttctcaggtaataaaaatttacttctaagaagttttggaaccagagcttaagaattagatttatattttcttggtaatattaaaagttaatatatgcttgatttatttgaagaaataaaaaagggtaatttgtacacaacgcctttcagaacatatttgttgaatgaataaaaatatttaagcttcctcattatgctgcagtattagttctgttgtcctcattttttcatatgaagaatgtgaagctaagagtagctatgtaaccagcaaaaagatcacataattaataggtaaaagagcttactcagactcagatcttgtgacacaaattagattctttgccactaccacatgtgtcacagttaaactttgaagcatcttctgtgttgacagattcctttttttgcctgtgaacttaccctattatcattatttgtatcctgtcagatatctacttgtaagaccaagaaagtatttgttcatgtgaatcacaaaagaaacacttaaatttttgtttttagcatatctgaatgctataaaatataaaaactcatactgtttacataggacagatttatcatactgctgtaattgttttcatggttaatttgttacataggcaattactaaattgtgcctttgaaatactttataaatttttttaaataattaaagatattcaatgatgttaaagttgggtcagctaatatttgaagttcttaatttataattttttttctttaagccatagataatttagaattctgcagtatttttcatctccagatcttagggcttgaaatggattctgatgggtctaatcagtccactcttgcatatatcttgaaaatggtcagcatccaacaaagtgaagaataaactgataaatgatccctgtttggtgaacacctcagatcaggatgttccttggcagggtattctgacctggtttagctttggccccgtctgtgctcagggttcaggtattctgcaggattgggttcagagggattaaaattctcagattggcctgtatcaaaacagtcacagattttggtcagccttttcccagaaccgtctccaagattttttcttttgtgtaattctggaatctaggctggatttggactagctttagaggttatgataaaagattaattttgtcaggcatttatacaaaggaggttttcttactacagagtttcttaaggtagattccttctatttttgaagtgtgacatttaccaatctgaagtaatgttgccctacatcccccagacacttaactttagcatatttatttctgtccatttttggtcaggattgtgcctgtttacttatataatattcttgtttactttttgtttattagatacttcttattagtttatattgttttcctgattgaggcttggggaaagaattttcctcaaatttaaagtcaccttacttatttgcagatgtatgtcagagcaatattcttttgacagttatcaagcattttagcaatgctgtatgtatatattatgaatgaatgacagagtcactcatggtctgtcacccaggctggagtgcagtggcattatcatagctcacttcagcctcaaactccttggtttaagtgttattcccgccttacctggctactttttttaatttttattatttttatagagatagcattttgctgtgttgcccagggtggtctcaaactcctgggagcaaggtgatcctcccacttctgcctcccaaagtgctgagattacaggcataacaatgttttaagctgacactggtataccttcactgattattactgtgcacatgtggtaataatttaacttataagtgcattttatctaaaaaatttccaagatctaaatagcatttgaacatggtagcagtttttttttttttttttttttttttttgagcaagaaaagagttctaaaggggtcagttttatctacagattaacataattttttttattgaggttaagtcacataacattaaccattttaaagtaaacagtttaggtggcactttatacattcacaatgttgttcaaccaccagctctaattccagaatgtgttcattaccccaaaaggaaacactgtacccattaagcagttactctgtattcccctcttccctaatccctagcaaacgccattctgctttctgtctctaatttgagccaacatcgaggaagagtactctgtacaattgaaattgcagaaaaaactttgggatgtgattgttaggaataaaaaaccacctaattctttgcatgcttctctaagtacagtagacatgctgccagggactctttatggaagaaaagttgagactcatagaagtttgcagttttgttttgatcaccccagagggttttgctcaaactcttagactcatttgtatttcttcattgggttataagaactaaaatttaatgttctatacaaatgtgaacaactaatacttggtctcctatctagaacttgtttgccttttaggttttcttaatgtatagaagaaactaggaatattcacaaaggatttatttgaagttacactgggaaacgatttttagaatttgaagctctttgatccctgtgaatctaactttatgactattttattcagctaatctttgagaatatttagagttttgatttgcgtggcactctgcttttaatcccttgttgaataagtgttagaaaccttgatcttggccctatacctgatcacctctaaaaacatgaacagtgttacaaaggcagttgtttagtaagcttttttggattgttttaattggctgactgagggagacaaaattagtttttttttttctttctagaataaagggtaataaacttggactttagagttactgctaagattgacatttccatttggggctttagaaatatattgttatcttaaattcaaaatggtactttatctaattgaattgaaatcttaaaatttatgagaaacaaaagtcactttatgttcttagtaaatatttctaatggggttataggagatctaagtacaaaaaaaatttaaaattttgttattaatctcccctccttaaggaaaattttattaatatacataattataatttagttataagaacaacttaagttgagtacagtggctcaagcctgtaatcctagcactttaggaggccaaggcaggaggatctcatgaagccaggagttccagaccagcctgggcaatagagtgaaaccc

SEQ ID NO: 61813 - DNA, 4155 bp, Homo sapiens
ccagtagctacgggctggtggaagcgctgctcacagtcagtgtcggtacgtcttcgtccgcccttaccctccttatcctgctccaggtagcggagagccgcctcccgccgcgcccccgccaccgaggcccgggtcagaggctagaggccgcccgcccctgcgcggccctttcccctgagcccgcggagcccgccgccccgggcctcggggcgacgatgctggagtccattcgcgtgacggaaaagcttcactggcctgagcaagaacttgctaagaagtctattctaaatgcagaagattcattgatcattgacaacaaaagaagcatttcacatttgtcctcgggagtgctaaaagacattttcacaactggaaccagtagttacaatgtcctactacagagcaaggagaaaaaaaagtatcattcacaaaaacagtcttcctccacctactccaaaagatgtagaaaacccagcaaatctcctaacacttctcgtagcaaagatcctcgcaggatgaaagccctggtgcctgtgacaagcagtggtacttggtactgcctggagaggcggcctgctgtttttgtcactagttcagtgtcaagtcctgtaaagtttacacatgatatctctgttacagggaatggcatagtactgccacctaaacccaaaagcaaggtcaagtggtgccatttctccactcttccaaagccaaagcctcagctgtctagaagctttgaaaagggagatgacttttctgggaagaaattttgtatattgactgctataaaacccaccaacttagagaaagaaaaactgagattcttcaaatctgactatacctacaatcctcagtttgagtatgccaatcctgctctgccaagcgtattagctaagcatagccacgcatctgaccgatttcttaagcagattgtagttcatctcactgaggacctgctttcccgagcgtcaatgacagtagtaaatggatgtccgactctgactatcaatgtgtccactgcacgtgagcattggctggagggaatgctgaggcatgaaataggtacacattattttcgaggtattaacaacctccagcagccatggaacagttggactggacgtaaaaaacatgagctaaagccaaataatcccacagaggaaggactagcaagcattcacagtgttctgtttagaaaagacccttttttatggagggctgccctcctctactacactgtttatcaagccagccaaatgtctttttgtgaactctttaaagatattggcaggtttgtcaaggaccccaatacaagatgggattattgtgtacgggccaagaggggatggactgatacttcccaaccagggtgttttagtaaagaccaggtatacttggatggaattcttcaaatcctccgatacagagataccatagacttccatctgctgactgctctcgggaaggtttcttatgaagatgtggatcgcttaaaaggattggcagttaccgaaaacatgagggtccctcatttcctgcaggaccatggccgatatatggaacacttagagaagatcatggaagtgaatgaactgactgacagggaactgaaagatcttatatagtaattagcgttctggcaaacatagctaagctatgcctccatgtatattaccagttaggtgcagttagcaccagaagatttataaaagaagaaagactacttgtgttttctgaagaagggtcttcagtattcagcggaatttttaggttaagtacagatcttaaactatttccctaaaatgtttctataggctgcagggggaagttattcctattttctgaatctcgacagagtcagatgaaaatactactgctgagcatttttgaagactcttggtcaaattgcatgataaatttctgcctgagcagtaagcactggcctagtgcttctgcctaaatatggaggtcagctccaactggagactggctgaattccattgctgttcagactccaaagttatattttatttgataaataatggtaattattctcctttgaaaaattagttttgtgttgctccaaaaagctagctatatatctcagctttcttatttcttttatatgttgagggattttaaagggagaggaaaagcaatttgaaaatttttcattaagtgttttattttaacattattgtttcaccttatcagcttataggaactaaattagagaatcacctctttttgtccggttatctcttaactatgttttcatttgctgaaacatattgtacccttttaaattttttacagagttttaacgtcttttccactgcatcctttataaaaataagtacaaattccagagaggttttcctacacaaatacaaaataattggggaagggctactcaccttttttatgaaacagaatatgtaacaagcagaggacaaatagactgacctggttaaacgtaggttctggatgttgatgggtagcacctgcagtaaacttgaccatgctctgaaaaaagaaatttctgggtattgatggtttataaagccagctttgtgctattggttcagtatattttatcaaatctttgacttcatcaacccagtaatgacatagtttaaattttaaaatgagagttctgttttgctgtatttctcctgctagcctagctttgtattttatcatcagcttcagtatatacttgtatatatatacctggattcaaatggttcttcatacaacttaatgatcagaaagaatgctgctgtaaacaccccactcaagattgctgctggaatttctacccaaagctgtctgagagtttatctttacctcagtgcaggcttaaataatggtgctaatactggtagatatatactgtgaagcctggttcacattcatgctagaaaatgattttgggaaatcttttataggagaggttacatgatttttctctttcacatatctagaaggacttgcctcaaagaagaatgttgcagcaaacaggatatactctagctggtgcccaaaggttcttgcaaaaccatgaatcttgcttttagcagtaaagggccagacactttggagcattgaaaggccttagcccctgctccccaactacgtgccatgctgggtagtgtgtatcctgtacatctgtgtgccaggctggggcagactgtgccaatgctcaccaaacactagaatctgctcttacacctctagcatgtatctcgttgtagcagagttgtgcactttctcagcattgtgtagtgttttctaattgcatctaaaaacttatcaaaagtgattgtgaaaacagtgtcttagaagtataaacagaaatggcaatatttatgtcctgtgattcaagcccaaaggttataaattcaactttcacagggaatagcactgctaatcttactttatgatttaaatataaaggaaaatcacagcagccttaatttcctgttggtcggatcatttgcagcagttctagttcctgacttttaaaatggatgaaattttctctttgtctgatttggaaaaggaactgcttttttgccttactgctttggtataaggatgaaaaacatgagcactctgcagacaaaatgaccttaaatcacattgattaagatattttaaaagttagcagtgaaccaaaagtagtttcagattagcagaaataaagagctttaagttttaaaagttgagattgaatatttaatgaaagtttattaattctttttccaggaatagcagtaaggtcagtttttttccctaaaataaaaagttttaataaacagaaaattatagcaacagtacttaggagaatagttgaagattgtattaattttaattataatagttatttgtcataggctattgatgattagaatttcattagttttgtccactataattttaaaaatagttgtgtcaaatacaaattctggtaaactgttaggttttaacaccagacagtattcaaaggaaattaatgtttgcaaacataaatccatagtcttcatttctttatattgtcacctttgtaaaagtgtttaaaatttgtattgtttgttttgtatatctttgggcatcttgtgtctagctataataaaaagaaacggtgccaag

SEQ ID NO: 61814 - DNA, 3906 bp, Homo sapiens
agagcacagagaagctcccagctttgaaggtcttgcggtggtgcgtggcgggcaggaacccacaattccaaatacaaacggtcggcgcgagaagcgcttctgggcgcaggcgcctggctgtagcgactggttgcgggaggctggactctggtgactgtaagcatcaagtgtacctgatttgtgaacctatcttgcttcagttggtttcctcctaaatattaggcagatgggattggctggtctgtgctctgctaggtgaaaaattagacgatttcaagaattggagctgaatctgatgttaagtaatggcaacaggtgacttaaaaagaagcttacggaacctagaacaggtgctccgcttgctaaattatcctgaagaggtggactgtgtaggtttgataaagggagacccagcagcatctttgcccatcatcagctattcttttacctcatactcaccttatgtaacagaacttataatggaatccaatgtagagctcatagcaaaaaatgacttgcgctttatagatgctgtctataagcttcttcgtgatcaatttaattataaaccaattttgacaaaaaagcagtttatccaatgtgggtttgcagaatggaaaatccaaattgtttgtgatattttgaattgtgtgatgaaaaagcacaaggaattaagcagtcttcagaagattccatcacaacaaagaaagaaaatcagttctggtaagtcagaacctcctttgggcaatgagaaaatatctgcagaggctgttggcgttgatatcagtggcaggtttatgacctcaggaaagaagaaagctgtggtgattcgtcacttgtataatgaagataatgttgacatttctgaggatacattaagtccaataacagatgttaatgaagcagttgatgtgtctgacttaaatgctactgaaataaagatgcctgaagtaaaggttcctgaaatcaaggctgagcaacaggatgtaaatgttaatcctgagattactgcactacaaactatgcttgctgaatgccaagaaaatcttaagaaactgacttcgatagagaaaaggttagactgtttggaacaaaaaatgaaaggaaaagtgatggtagatgaaaacacctggactaatcttcttagtcgtgtcactcttcttgaaacagaaatgcttttgtctaaaaagaatgatgaatttatagagtttaatgaagttagtgaagactacgcttcttgtagtgacatggaccttctgaatcctcacagaaaaagcgaagtagagaggccagcaagtattcctctgtcctctggctatagtacagcatcatcagattcaactcccagagcctctactgttaattactgtggtttgaatgagatttcagaggaaacaacaatccagaaaatggaaaggatgaaaaaaatgtttgaagaaactgcagagttactgaaatgtccaaatcactacttgtaggattttctacatgaacttttttctaggactttggttactatacatattgtatattttaagaattctttatacaattttaatatactgcaatactgcagtttttgacaatttggattccatttggtatatgaatttttgcattcattattgaataactcttttaatatttttgagcaatgattatactgctttaccttgtgtcactttttttttttttaggaaaaactcatgttccagtatatttctcttacagagtgaagtcattacagcactgtatttctgtgttgacatttgttggcagtgtgctaagtaatgttttttaaagcacaggcttaaggactatggtttacatcctgttggaaacattccaaatgggacttgtgtattatacccaggaggctctcatatataccatcttggcatctgtactgatgaataagttataatgaacagttaaaaatgctcattgaaaattaaataaaacaaaaaggcagttatttcatgcttggtcaaaaacatcaatacctttccaattaacactgagaaattaaggttaagattctccttttgtactgggaaacaggctggaggactatggtcctcaagtttagaccaagaggactatggtctcaaggttcaccatgagaaatgtgttgaacattttagtatgctctattgtataatttttttggagggggggatggagtttcgctgttgttgcccaggctggagtgcaatagcacgatcttggctcaccgcaacctctgcctaccgggttcaagtgattcttgtgcctcagcctcctgagtagctgggattataggcatgcaccaccatgcccagctaattttgtatttttattagagacagggtttctccgtgttggtcaggctggtctcaaactcctgacctcaggtgatctgcctgtcttggcctccggcgtaacactttttaagaccagtgtaacagaaagagaatgtagccattctagccaccgttaaaagatacacagtgaggtgttgtgttttgtttttttaatgatgaaaagttacacattttttggagagaaaagtcttagctgaaggtaaatcaatggaaaaatgaaatttatttttaatattactactatatgaattatctttttttaaacttgtagataaaagtgttccagtaatcagaaaatcctcaagaaaattgacttcattatttggaaggaaaattagtattttttttaatattatatggaccatctgattatattttatttattcatctatttatgggtctcactctattgcccaggctggagtgcactggcgtgatctcggctcactgcaccttctgcctaccgagttcaagcgattcttgtgcttcagcctcctgagtagctgggactataggcctgtaccgtcatgcctggctaatttttgtatttttgtagagacagggtttcaccatgttgcccagtctgttctcaaactcgtgagctaaagctactcgcccacctggatgtcccaaagtgctagattccatggaattttcctgcatggagtgctacatcctcttgttccagtctcagctggctgctccgtgggcatacttcatacctttcatcacagagctttgcttggcctctctcctgtgtgtaatctctgtttcttggatcctgtgcttaccttttcctgctgtactctgatgtttcagtgaagctcatccacgaagtccagaattctgcctggaaaccagcttcctcctcagctccagctcttttaatgggcatatcaaaactgatgactttttccttcctgctacatgggtaacacttagttgtttgtctaatttctattttccagaaatttctcaaaatgtctgctgatagcccctcactcatatttttcatgtgggtttatagctttcatatttctttattattgtaaatgggggctgtggaaggtgagaaaacacatgctttcttaaaacagaagctctctccttcattaatttaaatatttttatcggctctagaaaatgcataaggttagtacaagatcagtagagagaaagtcaaagattacagaagtgctgaagcagaccattcttcctttcttcccaatgtctattaagatcacacataggtaaactgttacaaatccagaatggtgaaagagtccaacaatggctgagggaagtagaggttaagatatagctcaacagtgaaagtagcagggaaagagctgggcaaggccaagaccatcttttgtaccgttggtacagtaggctaaaggtacggtgttccatattaaatacagcaatatgaagaaaaataaattaagtcccttatacctaaaaaaaaaaaaaaaaaaaaaaaaaaaaaaaaaaaaaaaaaaaaaaaaaaaaaaaaaaaaaaaaaaaggaaaaaaaaaaaaaa

SEQ ID NO: 61815 - DNA, 2510 bp, Homo sapiens
ggaggtggtttcggttgcggcagtcgcgtcccgggagcgtcgctgcctggtgaacgctagaatgggtactaggaaaaaagttcatgcatttgtccgtgtcaaacccaccgatgactttgctcatgaaatgatcagatacggagatgacaaaagaagcattgatattcacttaaaaaaagacattcggagaggagttgtcaataaccaacagacagactggtcgtttaagttggatggagttcttcacgatgcctcccaggacttggtttatgagacagttgcaaaggatgtggtttctcaggccctcgatggctataatggcaccatcatgtgttatgggcagacgggagctggcaagacatacaccatgatgggggcaactgagaattacaagcaccgggggatcctccctcgtgccctgcagcaggtttttaggatgatcgaagaacgccccacacatgccatcactgtgcgtgtttcctacttggaaatctataatgagagcctgtttgatctcctgtccactctgccctatgttggaccctcagtcacaccaatgaccatcgtggaaaaccctcaaggagtcttcattaagggcttgtcagttcacctcacaagtcaggaggaggatgcattcagcctcctttttgagggtgagaccaacaggattatagcctcccacactatgaacaaaaactcttccagatcacactgcattttcaccatctacttagaggcccattcccggaccttatcagaggaaaagtacatcacttccaaaattaacttggtggatctggcaggctcagagaggctggggaagtctgggtctgagggccaagtcctgaaggaagccacctacatcaacaaatcgctctcattcctggagcaggccatcattgcccttggggaccagaagcgggaccacatcccctttcggcagtgcaagctcacccacgctctgaaggactcgttagggggaaactgcaatatggtcctcgtgacaaacatctatggagaagctgcccagttagaagaaacgctatcttcactgagatttgccagcaggatgaagctagtcaccactgagcctgccatcaatgaaaagtatgatgctgagagaatggtcaagaacctggagaaggaactagcactactcaagcaggagctggctatccatgacagcctgaccaaccgcacctttgtgacctatgaccccatggatgaaatccagattgctgagatcaactcccaggtgcggaggtacctggaggggacactggacgagatcgacataatcagccttagacagatcaaggaggtgttcaaccagttccgggtggttctgagccaacaggaacaggaagtggagtccactttgcgcaggaagtacaccctcattgacaggaatgactttgcagccatttctgctatccagaaggcggggcttgtggatgttgatggccacctagtgggtgagcctgaaggacaaaactttggactcggagtcgcccctttctctaccaaacctgggaagaaagccaagtccaagaagacattcaaagagccactcaggcccgacaccccaccctccaaaccagtggcctttgaggagtttaagaatgagcaaggtagtgagatcaaccgaattttcaaagaaaacaaatccatcttgaatgaacggaggaaaagggccagcgagaccacacagcacatcaatgccatcaagcgggagattgatgtgaccaaggaggccctgaatttccagaagtcactacgggagaagcaaggcaagtacgaaaacaaggggctgatgatcatcgatgaggaagaattcctgctgatcctcaagctcaaagacctcaagaagcagtaccgcagcgagtaccaggacctgcgtgacctcagggctgagatccagtattgccagcacctagtggatcagtgtcgccaccgcctgctcatggaatttgacatctggtacaatgagtcctttgtcatccctgaggacatgcagatggcactgaagccaggcggcagcatccggccaggcatggtccctgtgaacaggattgtgtctctgggagaagatgaccaggacaaattcagccagctgcagcagagggtgcttcctgagggccctgattccatctccttctacaatgccaaagtcaagatagagcagaagcataattacttgaaaaccatgatgggcctccagcaggcacatagaaaatagaacctcatcgccagtaccttaaaggacaagaccagcaactcccacctactgtagtggagctgctcaaccacctgcccagagctgcagccccctgtactccaatgctgggacccagcacagcgaacacatttggcctgcatgttgggaggagcatcctccaaggacaaccttgctcatctccacagagcactttgggttttaattcactgtcttatatgcagggacaggataaaataactttctagtttggacttttaaaaaaaaaaaaaaa

SEQ ID NO: 61816 - DNA, 2764 bp, Homo sapiens
gttgccatggcgactatgtacacagccaggcagccccgcgtggggagtgcaggtggtttcggttgcggcagtcgcgtcccgggagcgtcgctgcctggtgaacgctagaatgggtactaggaaaaaagttcatgcatttgtccgtgtcaaacccaccgatgactttgctcatgaaatgatcagatacggagatgacaaaagaagcattgatattcacttaaaaaaagacattcggagaggagttgtcaataaccaacagacagactggtcgtttaagttggatggagttcttcacgatgcctcccaggacttggtttatgagacagttgcaaaggatgtggtttctcaggccctcgatggctataatggcaccatcatgtgttatgggcagacgggagctggcaagacatacaccatgatgggggcaactgagaattacaagcaccgggggatcctccctcgtgccctgcagcaggtttttaggatgatcgaagaacgccccacacatgccatcactgtgcgtgtttcctacttggaaatctataatgagagcctgtttgatctcctgtccactctgccctatgttggaccctcagtcacaccaatgaccatcgtggaaaaccctcaaggagtcttcattaagggcttgtcagttcacctcacaagtcaggaggaggatgcattcagcctcctttttgagggtgagaccaacaggattatagcctcccacactatgaacaaaaactcttccagatcacactgcattttcaccatctacttagaggcccattcccggaccttatcagaggaaaagtacatcacttccaaaattaacttggtggatctggcaggctcagagaggctggggaagtctgggtctgagggccaagtcctgaaggaagccacctacatcaacaaatcgctctcattcctggagcaggccatcattgcccttggggaccagaagcgggaccacatcccctttcggcagtgcaagctcacccacgctctgaaggactcgttagggggaaactgcaatatggtcctcgtgacaaacatctatggagaagctgcccagttagaagaaacgctatcttcactgagatttgccagcaggatgaagctagtcaccactgagcctgccatcaatgaaaagtatgatgctgagagaatggtcaagaacctggagaaggaactagcactactcaagcaggagctggctatccatgacagcctgaccaaccgcacctttgtgacctatgaccccatggatgaaatccagattgctgagatcaactcccaggtgcggaggtacctggaggggacactggacgagatcgacataatcagccttagacagatcaaggaggtgttcaaccagttccgggtggttctgagccaacaggaacaggaagtggagtccactttgcgcaggaagtacaccctcattgacaggaatgactttgcagccatttctgctatccagaaggcggggcttgtggatgttgatggccacctagtgggtgagcctgaaggacaaaactttggactcggagtcgcccctttctctaccaaacctgggaagaaagccaagtccaagaagacattcaaagagccactcagctccttggcaagaaaggaaggtgccagcagccctgtgaatgggaaggacttggattacgtttccacctccaagacccagctggtcccatcctccaaagatggggatgtcaaagacatgctttcgcgggaccgggaaacttccagcattgagccccttccctcagactccccgaaggaggaattacgcccaattaggcccgacaccccaccctccaaaccagtggcctttgaggagtttaagaatgagcaaggtagtgagatcaaccgaattttcaaagaaaacaaatccatcttgaatgaacggaggaaaagggccagcgagaccacacagcacatcaatgccatcaagcgggagattgatgtgaccaaggaggccctgaatttccagaagtcactatgggagaagcaaggcaagtacgaaaacaaggggctgatgatcatcgatgaggaagaattcctgctgatcctcaagctcaaagacctcaagaagcagtaccgcagcgagtaccaggacctgcgtgacctcagggctgagatccagtattgccagcacctagtggatcagtgtcgccaccgcctgctcatggaatttgacatctggtacaatgagtcctttgtcatccctgaggacatgcagatggcactgaagccaggcggcagcatccggccaggcatggtccctgtgaacaggattgtgtctctgggagaagatgaccaggacaaattcagccagctgcagcagagggtgcttcctgagggccctgattccatctccttctacaatgccaaagtcaagatagagcagaagcataattacttgaaaaccatgatgggcctccagcaggcacatagaaaatagaacctcatcgccagtaccttaaaggacaagaccagcaactcccacctactgtagtggagctgctcaaccacctgcccagagctgcagccccctctactccaatgctgggacccagcacagagaacacatttggcctgcatgttgggaggagcatcctccaaggacaaccttgctcatctccacagagcactttgggttttaattcactgtcttatatgcagggacaggataaaataactttctagtttggactttcaaaaaaaaagaaaaaaaaaaaaaaaa

SEQ ID NO: 61817 - DNA, 3188 bp, Homo sapiens
gccgtggtggctggttccctgtctcttcagtagagagtctagaccccacccagtcttcatgtacggccgaccgcaggctgagatggaacaggaggctggggagctgagccggtggcaggcggcgcaccaggctgcccaggataacgagaactcagcgcccatcttgaacatgtcttcatcttctggaagctctggagtgcacacctcttggaaccaaggcctaccaaccattcagcactttcctcacagcgcagagatgctggggtcccctttggtgtctgttgaggcgccggggcagaatgtgaatgaaggggggccacagttcagtatgccactgcctgagcgtggtatgagctactgcccccaagcgactctcactccttcccggatgatttactgtcagagaatgtctccccctcagcaagagatgacgattttcagtgggccccaactaatgcccgtaggagagcccaatattccaagggtagccaggcccttcggtgggaatctaaggatgccccccagtgggctgccagtctcagcttccactggaatcccaataatgtcccacactgggaaccctccagtgccttaccctggcctctcgacagtaccttctgacgaaacattgttgggcccgactgtgccttccactgaggcccaggcagtgctcccctccatggctcagatgttgcccccgcaagatgcccatgaccttgggatgcccccagctgagtcccagtcattgctggttttaggatctcaggactctcttgtcagtcagccagactctcaagaaggcccatttctaccagagcagcccggacctgctccacagacagtagagaagaactccaggcctcaggaagggactggtagaaggggctcctcagaggcaaggccttactgctgcaactacgagaactgcggaaaagcttataccaaacgctcccacctcgtgagccaccagcgcaagcacacaggtgagaggccatattcttgcaactgggaaagttgttcatggtctttcttccgttctgatgagcttagacgacatatgcgggtacacaccagatatcgaccatataaatgtgatcagtgcagccgggagttcatgaggtctgaccatctcaagcaacaccagaagactcatcggccgggaccctcagacccacaggccaacaacaacaatggagagcaggacagtcctcctgctgctggtccttaggtgaatgaagaaggaagaggattccaggctgagagcactggacgtggcaactgttcagaggagaggcagtcttcaagttctacattcattcagaaaaatgttttttgagcctacaatactgagcgcaacaaggctgtggagacccatggtgaggagcatggagttaactaaaggatgtgtcagggaagaaagacttctcaaggaggtgcctccatcagacccaaaggactcatgggggctagctgcacctcacatttcttggacatataccgttggacatgtctatcttctggaaactatggcatggacagtaaggattcagaagtgcatgaaggcaccctgcctctgcagagcagaaagatcatagacaacatttatgaatgtgcccagtgctgccaagaagagaagccggtcctctgcaggctcaagcctatctgggcctctggggaagccccacagccttggctgtgcctgcccctgccctctcacccctaccctgaccttgtcctacttcactgcctttgtctgtgttactagtggccccagtatacctgggatggacatccaggtgcccttcatccaagctcctatgtgaggggaatggacattattaaaagaacaggggcagaagtggctcatttatgacccattcactagccccagggattgaagtcttgggtactcaaagtgtctttctaccagggcaccagatcccttccatggagcaggtcatctcgggttcactgggccagggatggtctctgttccccagcccacctggctcacacacagcctcatgggtagggtcagcaaaccagatggcttgttgttggaatgtaggatgagaggcctgcttggtgacctagcattttcaccaagaagtggacgtggagaggaccagagtgatcaagggtgtatgatgtgcactacaatggtgggcaaaacaggctcctgctcttgtggaggtcacaatctagcggagaaaggatgttactagaagtacacaaattgggcccggcgcgatggctcacgcctgtaatcccagcacttttggaggccgaggcaggcggatcatttgaggttagagattcgagaccagccgggccaacatggtgaaaccccatctctacaaaaaatacaaaaattagcctggcatatggcgggtaccgtaatcctagctactcgggagactgacgggagaatcgcttgaacccaggaggcggaggttgcagtgagctcagatctcaccattgcactccagcctgggcgactgagcgagactctatctcaaaacaatcaaaacaaaaaagacctgtggactctagtagattttgaatcctgcctctgccatttcctggctatgaggtgtcttgagaaatttacttgtcactcttgcttctgatagtaaaggggatggtgcgatagattcaagatggagagataaggttaagtgttttctttggctgcaacatggagattagattagagcaaggatgtaagggagaggaagggacatagcagtatttcaggtgagagtcaaggtggctttggctagggtgtgagagtggaggtagggagaagtaggaaagtgatagttaactggatttgttaggtgagggtgaggccaagggtgacttccaggttcctgacttgtgttataagtaacacagaagaagaatggatgaacttgattcgttttccattgattgtgatatctatcatacctgcaaaaaatattttgtatatatccaatttaataataaatgcactcatgttaggaaggtcaaaaaaaaggaaaaaagaaaaataataaaaaataataaaaatccttaggataacttgaggccaggagtttgagaccagtgtgaccttgtctctgtaaaaaataaaattaaaagaaaaaaaaaaaaaaaaaaaaaaaaaaaaaaaaaaaaaaaaaaaaaaaaaaaaaaaaaaaaaa

SEQ ID NO: 61818 - DNA, 1970 bp, Homo sapiens
aaaaagatgtagtagggaaaaggagcgacagctggctaaaggggccccccacaaccctccccgacaccctaggaaagcagcctctctccgctgtcccagggtgccatggagatggagagcgcggcggcctccacacgtttccaccagcctcacatggagaggaagatgagtgcgatggcctgtgagatcttcaacgagcttagactagagggcaagctctgcgacgtggtcatcaaggtcaatggctttgagttcagtgcccataagaacatcctctgtagctgcagttcctactttagagctttgtttacaagtggctggaacaacactgaaaagaaggtatacaacatccctggcatttctcctgacatgatgaagctaatcattgagtatgcatacacccggaccgtgcctatcacaccggacaatgtggagaaactgcttgctgctgcagaccagtttaacatcatgggtatcgtcaggggttgctgcgagttcctcaagtcagagctgtgcttggataattgtatcggcatctgtaagttcacggactactactactgccctgagctgaggcagaaggcctacatgttcatactgcacaactttgaggagatggtgaaagtctcggcagaatttttagagctctcggtcactgaacttaaggatatcattgagaaagatgagctcaatgtcaaacaggaagatgctgtatttgaggccattttaaagtggatttctcatgacccccaaaatagaaagcagcacatttcaattttgcttcctaaggttcgcctggccctaatgcatgctgagtacttcatgaacaatgttaagatgaatgactatgtcaaagacagtgaggaatgcaaaccagtcatcattaatgccctaaaggccatgtatgacctcaacatgaatggaccctctaattctgatttcaccaacccactcaccagaccacgcttgccctatgccatcctctttgcaattggtggctggagtggtgggagccccaccaatgccattgaggcatatgacgctcgggcagacagatgggtgaatgttacttgtgaggaagagagtccccgtgcctaccatggggcagcctatttgaaaggctatgtgtatatcattggggggtttgatagtgtagactatttcaatagtgttaagcgttttgacccagtcaagaaaacttggcatcaggtggccccgatgcactccagacgttgctatgtcagtgtgacagtcctcggcaattttatttatgccatgggaggatttgatggctacgtgcgtctaaacactgctgaacgttatgagccagagaccaatcaatggacactcatcgcccccatgcacgaacagaggagtgatgcaagcgccacaacactttatgggaaggtctacatatgtggtgggtttaatggaaacgagtgcctgttcacagcagaagtgtataacactgaaagtaatcagtggacagtcatagcacccatgagaagcaggaggagtggaataggcgtgattgcttatggagaacatgtatatgcggtaggtggctttgatggagctaatcgacttaggagtgccgaagcctacagccctgtggctaacacttggcgcacaatccccactatgtttaatcctcgtagcaattttggcatcgaggtggtggatgacctcttgtttgtggtgggtggctttaatggttttaccaccacctttaatgttgagtgctatgatgaaaagaccgatgagtggtatgatgctcatggcatgagtatataccgcagtgctctgagctgctgtgtagtaccagggctggccaatgttgaggaatatgcagctagacgggacaacttcccaggattagcactgcgagatgaagtaaaatattctgcttcgacaagtaccctacctgtacgagcctcttcatttagctaataaaaagtctaagcaataag

SEQ ID NO: 61819 - DNA, 2866 bp, Homo sapiens
agcgggtgcggcggcggttgcgagagagatgagccgcggcgatgagcccggaaaagcagcaccgggaagaggatgaagttgactccgttctcctttcagcgtccaagatcctaaattcttcggagggggtgaaggaaagtggctgcagtgacacagaatatggctgcatagcagaatcagaaaatcaaatccaaccacaatcagcattgaaagtccttcagcagcagttggaatcatttcaggctttgcgaatgcagactttgcagaatgtcagcatggtacagtcggaaatcagtgaaatattgaacaaaagtattattgaagtagaaaacccacaatttagctcagaaaaaaatctggtgtttggcacgcgcattgaaaaggatttgcctacagagaatcaagaagaaaacctttctatggagaaaagtcatcattttgaggattccaagacacttcattcagtggaagaaaaattaagtggtgatagtgtgaacagtctccctcaaagtgtaaatgttccatcccagatacattccgaggacacattaactctgagaacttcaacagacaatttatcttcaaacataattatacacccttcagaaaattctgacatcttgaagaattataataacttttatcgttttctacctactgcacctccaaatgtgatgtctcaagctgatacagtaattctggataaatccaaaattactgtgccttttctcaagcatggattttgtgaaaatttagatgacatttgccattctatcaaacaaatgaaagaagagcttcaaaagtcacatgatggggaagtggcacttacaaatgaacttcagactttacaaactgatccagatgttcacaggaatggtaaatatgacatgtcccctattcaccaggataaaatgaactttattaaggaagaaaacttggacggtaacttaaatgaagatataaaatcaaagagaatttcagaattagaggcattagtgaagaaattactccccttcagggaaactgtgtcaaaattccatgtgcatttttgtagaaaatgtaaaaagttatctaagagtgaaatgcacaggggaaagaaaaatgagaaaaacaataaagaaattcccatcactggcaaaaatattacagatttaaaattccattccagagttccaagatacacactgtccttcctcgaccaaacaaaacatgaaatgaaagacaaagaaagacaaccatttctagtaaaacaaggatcaataatatctgaaaatgagaaaacttccaaagttaattccgttactgagcagtgtgttgcaaaaattcagtacttacagaattacctaaaagaatctgtgcagatacagaaaaaagtaatggaactggagagtgaaaatctaaaccttaagtccaaaatgaaacctcttatctttaccacacaatctctcatacagaaagttgaaacatatgaaaagcaacttaagaatctggttgaagaaaagagtactattcagtctaagttaagtaaaacagaagaatacagcaaagagtgtcttaaagaatttaaaaaaataattagtaaatataatgttctgcaaggccaaaataaaactctagaggaaaaaaatatacaactttctttagagaagcaacaaatgatggaagcattagatcaactaaaaagtaaggaacacaaaactcaaagtgatatggccattgtaaataatgaaaataatcgaatgagtatagaaatggaagcaatgaaaaccaatattctgttgatacaagatgaaaaagaaatgttagagaaaaaaacacaccagcttctaaaagaaaaaagctcacttggaaatgaactaaaagaaagccagctagagataatccagctaaaagagaaagaaagattggcaaaaacggaacaagagacacttcttcaaataatagaaacagttaaagatgaaaaactcaaccttgaaacaacattacaagaatctactgctgccagacaaattatggaaagagaaattgagaatattcaaacctaccaatctactgccgaagagaattttctgcaagaaataaaaaatgcaaaatcagaagcaagtatttataagaatagcttgtcagaaattggcaaggaatgtgaaatgttatcaaaaatggtaatggaaaccaaaacagataatcagattctaaaagaagaactaaagaaacatagtcaagaaaatataaaatttgaaaacagcatcagtagacttactgaagacaaaatacttttagaaaattacgtaagaagcatagaaaatgaaagggataccttggaatttgagatgcggcatcttcaacgagaatatttaagtttaagtgataaaatttgtaatcagcataatgacccttcaaaaacaacttatatttcaagaagagagaaattccattttgacaactatactcacgaagatacttctagtcctcagagtaggcctttggcttcggatttgaaaggttatttcaaagttaaagacagaactctcaagcatcattaggattcctcaagattgctaagaaactcccttcgagaaatagccaatgttaattgtactgctaactgaactatgcatatctaactcatctcaaatgactcataatgaggcgctatatatttgctttaaaaattatgcacagaatggtttggtgcagataacttaagctttctcagctgggaatttcagaagatgggggagaacttctacaagggagggcaggtacctgtacatggaaggagctgagatgtctaaagtcacccacatttgtcatttgaaaaagtatatataaataaaagatactattttgaaaaaaaaaaaaaaaa

SEQ ID NO: 61820 - DNA, 3846 bp, Homo sapiens
gcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagcatgcttccattgcgagacctgcaagatgacactgaacatgaagaactacaagggctacgagaagaagccctactgcaacgcacactaccccaagcagtccttcaccatggtggcggacaccccggaaaaccttcgcctcaagcaacagagtgagctccagagtcaggtgcgctacaaggaggagtttgagaagaacaagggcaaaggtttcagcgtagtggcagacacgcccgagctccagagaatcaagaagacccaggaccagatcagtaatataaaataccatgaggagtttgagaagagccgcatgggccctagcgggggcgagggcatggagccagagcgtcgggattcacaggacggcagcagctaccggcggcccctggagcagcagcagcctcaccacatcccgaccagtgccccggtttaccagcagccccagcagcagccggtggcccagtcctatggtggctacaaggagcctgcagccccagtctccatacagcgcagcgccccaggtggtggcgggaagcggtaccgcgcggtgtatgactacagcgccgccgacgaggacgaggtctccttccaggacggggacaccatcgtcaacgtgcagcagatcgacgacggctggatgtacgggacggtggagcgcaccggcgacacggggatgctgccggccaactacgtggaggccatctgaacccggagcgcccccatctgtcttcagcacattccacggcatcgcatccgtcctgggcgtgagccgtccattcttcagtgtctctgttttttaaaacctgcgacagcttgtgattcctacccctcttccagcttcttttgccaactgaagccttcttctgccacttctgcgggctccctcctctggcaggcttcccccgtgatcgacttcttggttttctctctggatggaacgggtatgggcctctctgggggaggcagggctggaatgggagacctgttggcctgtgggcctcacctgcccctctgttctctcccctcacatcctcctgcccagctcctcacatacccacacattccagggctggggtgagcctgactgccaggaccccaggtcaggggctccctacattccccagagtgggatccacttcttggttcctgggatggcgatggggactctgccgctgtgtagggaccagtgggatgggctctacctctctttctcaaagagggggctctgcccacctggggtctctctccctacctccctcctcaggggcaacaacaggagaatggggttcctgctgtggggcgaattcatcccctccccgcgcgttccttcgcacactgtgattttgccctcctgcccacgcagacctgcagcgggcaaagagctcccgaggaagcacagcttgggtcaggttcttgcctttcttaattttagggacagctaccggaaggaggggaacaaggagttctcttccgcagcccctttccccacgcccacccccagtctccagggacccttgcctgcctcctaggctggaagccatggtcccgaagtgtagggcaagggtgcctcaggaccttttggtcttcagcctccctcagcccccaggatctgggttaggtggccgctcctccctgctcctcatgggaagatgtctcagagccttccatgacctcccctccccagcccaatgccaagtggacttggagctgcacaaagtcagcagggaccactaaatctccaagacctggtgtgcggaggcaggagcatgtatgtctgcaggtgtctgacacgcaagtgtgtgagtgtgagtgtgagagatggggcgggggtgtgtctgtaggtgtctctgggcctgtgtgtgggtggggttatgtgagggtatgaagagctgtcttcccctgagagtttcctcagaacccacagtgagaggggagggctcctggggcagagaagttccttaggttttctttggaatgaaattcctccttccccccatctctgagtggaggaagcccaccaatctgccctttgcagtgtgtcagggtggaaggtaagaggttggtgtggagttggggctgccatagggtctgcagcctgctggggctaagcggtggaggaaggctctgtcactccaggcatatgtttccccatctctgtctggggctacagaatagggtggcagaagtgtcaccctgtgggtgtctccctcgggggctcttcccctagacctccccctcacttacataaagctcccttgaagcaagaaagagggtcccagggctgcaaaactggaagcacagcctcggggatggggagggaaagacggtgctatatccagttcctgctctctgctcatgggtggctgtgacaaccctggcctcacttgattcatctctggttttcttgccaccctctgggagtccccatcccattttcatcctgagcccaaccaggccctgccattggcctcttgtcccttggcacacttgtacccacaggtgaggggcaggacctgaaggtattggcctgttcaacaatcagtcatcatgggtgtttttgtcaactgcttgttaattgatttggggatgtttgccccgaatgagaggttgaggaaaagactgtgggtggggaggccctgcctgacccatcccttttcctttctggccccagcctaggtggaggcaagtggaatatcttatattgggcgatttgggggctcggggaggcagagaatctcttgggagtcttgggtggcgctggtgcattctgtttcctcttgatctcaaagcacaatgtggatttggggaccaaaggtcagggacacatccccttagaggacctgagtttgggagagtggtgagtggaagggaggagcagcaagaagcagcctgttttcactcagcttaattctccttcccagataaggcaagccagtcatggaatcttgctgcaggccctccctctactcttcctgtcctaaaaataggggccgttttcttacacacccccagagagaggagggactgtcacactggtgctgagtgaccgggggctgctgggcgtctgttctttaccaaaaccatccatccctagaagagcacagagccctgaggggctgggctgggctgggctgagcccctggtcttctctacagttcacagaggtctttcagctcatttaatcccaggaaagaggcatcaaagctagaatgtgaatataacttttgtgggccaatactaagaataacaagaagcccagtggtgaggaaagtgcgttctcccagcactgcctcctgttttctccctctcatgtccctccagggaaaatgactttattgcttaatttctgcctttcccccctcacacatgcacttttgggcctttttttatagctggaaaaaacaaaataccaccctacaaacctgtatttaaaaagaaacagaaatgaccacgtgaaatttgcctctgtccaaacatttcatccgtgtgtatgtgtatgtgtgtgagtgtgtgaagccgccagttcatctttttatatggggttgttgtctcattttggtctgttttggtcccctccctcgtgggcttgtgctcgggatcaaacctttctggcctgttatgattctgaacatttgacttgaaccacaagtgaatctttctcctggtgactcaaataaaagtataattttta

SEQ ID NO: 61821 - DNA, 1463 bp, Homo sapiens
gcactgcgtctcccaaggtggctgaagctggccagctgcgggctccgcgccgctcgtcccgggtctatgggtccattccccacgcccacccggaccccggggtcactcgggtctccgtctgtgccagggagggagaatcacgcccagggtcctctctggcttcgcgcgactgagaacgcgcccggacgcggcgcggcgctcctgagtcaaaggagaggtggcggcaggaccaccccagggcgccgtctgcacccccggacgcactcggccgtgctgcgcttccgggacaaggcgtcggttctcgcctgagggccaaaccttgcccctgcccaccttcctcacccccgccatttccaggactcacatccaaaggcgacagcaccaggatttgctcccgcctttggcacagaggaggacgggtccctctctcagcctggccagtctttcccagggcttgatgggaaaaaggacttccctagaagtgagtcttggggagttggggggagaaaagtgtcgaggagggcgtcggagtttcccaccgctggctgcttcccggcccgcacgcccgggagggtggcggtgggcgcgcagagatctttgcaaaacagcgtccagggcggaaaacaactcacaggcctgccgcccccaaaggcgggcaggtccggacgcgctgggccctggtcccttcggccgcaaacggcgcaagtcacgcactgcgttcaccgcgcaacaggtgctggagctggagcggcgcttcgtcttccagaagtacctggcgccgtccgagcgagacgggctagctacgcgactcggcctggccaacgcgcaggtggtcacttggttccagaaccggcgagccaagctcaagcgcgatgtggaggagatgcgcgccgacgtcgcctcgctacgcgcgttgtccccggaagtcctgtgcagcttagcactgcccgaaggcgctccagatcccggcctctgcctcggccctgccggccctgactcccggccccacctgtcagacgaggagatacaggtggacgattgaagacaaagccgccgccaatcctgggctctggggccctggactcctcacctcgcgctctgcctctggccagagttccagggtggaggaaggaggtccacttgggcctcttccggcccacagtccagacgctcacctttcccggtttttttgtaagtttgttttgttgtctgagacagggcctcgctctgtcgcccaggctggagtgccgtggagcgatcaccgctcactgcagtcgcgacctcctgggctcaagcgatcctcctgcctcaacctcccgactagctggcattacaggcgtgcagcaccaccccaggctaatttaaaaaacttttttttttagagaggaggtcccgctatgttgtccaggctactttcccaatatttgagaataaagtcgagactctgccgcaaaaaaaaaaaa

SEQ ID NO: 61822 - DNA, 1278 bp, Homo sapiens
cgtgcgtgtctcgagtcgcacggacggcaaccgtcgacgggcttagcgcctcaactgtcgttggtgtatttttctggtgtcacttctgtgccttccttcaaaggtggtgctttgtccctgtgggtcatctgtactgattgcgccaagaaagcatttgttctccaaatgtcaactgtcaaggagcagctaattgagaagctaattgaggatgatgaaaactcccagtgtaaaattactattgttggaactggtgccgtaggcatggcttgtgctattagtatcttactgaaggatttggctgatgaacttgcccttgttgatgttgcattggacaaactgaagggagaaatgatggatcttcagcatggcagtcttttctttagtacttcaaagattacttctggaaaagattacagtgtatctgcaaactccagaatagttattgtcacagcaggtgcaaggcagcaggagggagaaactcgccttgccctggtccaacgtaatgtggctataatgaaatcaatcattcctgccatagtccattatagtcctgattgtaaaattcttgttgtttcaaatccagtggatattttgacatatatagtctggaagataagtggcttacctgtaactcgtgtaattggaagtggttgtaatctagactctgcccgtttccgttacctaattggagaaaagttgggtgtccaccccacaagctgccatggttggattattggagaacatggtgattctagtgtgcccttatggagtggggtgaatgttgctggtgttgctctgaagactctggaccctaaattaggaacggattcagataaggaacactggaaaaatatccataaacaagttattcaaagtgcctatgaaattatcaagctgaaggggtatacctcttgggctattggactgtctgtgatggatctggtaggatccattttgaaaaatcttaggagagtgcacccagtttccaccatggttaagggattatatggaataaaagaagaactctttctcagtatcccttgtgtcttggggcggaatggtgtctcagatgttgtgaaaattaacttgaattctgaggaggaggcccttttcaagaagagtgcagaaacactttggaatattcaaaaggatctaatattttaaattaaagccttctaatgttccactgtttggagaacagaagatagcaggctgtgtattttaaattttgaaagtattttcattgatcttaaaaaataaaaacaaattggagacctg

SEQ ID NO: 61823 - DNA, 1171 bp, Homo sapiens
ctgtcgttggtgtatttttctggtgtcacttctgtgccttccttcaaaggttctccaaatgtcaactgtcaaggagcagctaattgagaagctaattgaggatgatgaaaactcccagtgtaaaattactattgttggaactggtgccgtaggcatggcttgtgctattagtatcttactgaaggatttggctgatgaacttgcccttgttgatgttgcattggacaaactgaagggagaaatgatggatcttcagcatggcagtcttttctttagtacttcaaagattacttctggaaaagattacagtgtatctgcaaactccagaatagttattgtcacagcaggtgcaaggcagcaggagggagaaactcgccttgccctggtccaacgtaatgtggctataatgaaatcaatcattcctgccatagtccattatagtcctgattgtaaaattcttgttgtttcaaatccagtggatattttgacatatatagtctggaagataagtggcttacctgtaactcgtgtaattggaagtggttgtaatctagactctgcccgtttccgttacctaattggagaaaagttgggtgtccaccccacaagctgccatggttggattattggagaacatggtgattctagtgtgcccttatggagtggggtgaatgttgctggtgttgctctgaagactctggaccctaaattaggaacggattcagataaggaacactggaaaaatatccataaacaagttattcaaagtgcctatgaaattatcaagctgaaggggtatacctcttgggctattggactgtctgtgatggatctggtaggatccattttgaaaaatcttaggagagtgcacccagtttccaccatggttaagggattatatggaataaaagaagaactctttctcagtatcccttgtgtcttggggcggaatggtgtctcagatgttgtgaaaattaacttgaattctgaggaggaggcccttttcaagaagagtgcagaaacactttggaatattcaaaaggatctaatattttaaattaaagccttctaatgttccactgtttggagaacagaagatagcaggctgtgtattttaaattttgaaagtattttcattgatcttaaaaaataaaaacaaattggagacctg

SEQ ID NO: 61824 - DNA, 523 bp, Homo sapiens
ggaaccaaagggaaaagccaccttcccaggcacagccataacatccacctcactcaactgcttgtcaagttcaccaccaacacagagggggctcagataatcaagaaacaatgtcgagtgatgataaaagtaaatcaaatgaccccaagactgagcccaagaactgcgatcccaagtgtgaacaaaagtgtgagtccaaatgccagcccagctgtttaaagaagctgctgcaacgctgtttcgaaaagtgcccatgggaaaagtgtccagcaccacccaagtgcctgccctgcccctcgcagtctccttcatcctgccctccccagccctgcaccaagccctgtcctcctaaatgcccttcatcctgcccacatgcttgcccacctccctgccctcccccagagtgaggcactgtgggcactacccaaccccaccaccactgccacctccaccatgtacaacgctgtggggctggagactgaaaccatgaactgacaagtaaacgtgttcctctgctgtgcaa

SEQ ID NO: 61825 - DNA, 3396 bp, Homo sapiens
cctttaagagcggctggccaggcacggcctccgcctctcagtacgcggagcgccggcggtcacctggggctcgcggagcggccagatcgcggcggagtcggcgcgcttccccgagggaaggtgggagaggggacccggacgcgaggtgccccgaagccctctcgagcgtaaccgtcccgcgcctctctgaggcggaggatgcgggagcgcatctgggcgccgccgctgctgctgctgctgccgctgctactgccgccgccactgtggggcggccccccggacagcccacgccgggagctggagctggagcccgggcctctgcagcccttcgacctgctctacgccagcggcgcggccgcctactacagcggagactacgagcgagcggtgcgcgacttggaagcggcgctgcgcagccaccggcgcctgcgggaaatccgcacgcgctgtgcccgccactgcgcggcgcgccacccgctcccgcccccgccccccggcgagggccccggcgctgagctgccccttttccgctccttgttggggcgggcgcgctgttatcgcagctgtgagacccagcgcctcgggggccccgcatcccgccaccgcgtcagcgaggatgtgcgcagcgacttccagcgcagagtgccctacaactacctgcagcgggcctacatcaagcttaaccagctcgaaaaagcagtggaagcagctcacacatttttcgtggctaaccctgagcacatggaaatgcagcagaacattgagaattacagggcgacagctggtgttgaagcattgcagttggtagacagagaagccaagccacacatggagagttacaatgcaggagttaaacattatgaggctgatgactttgagatggctatcaggcatttcgaacaagccttaagagaatatttcgttgaagatacagaatgccggaccctatgtgaggggcctcagagatttgaagaatatgagtatttagggtataaggctggtctgtatgaagctattgcagatcactacatgcaggtgcttgtttgtcagcatgaatgtgtgagggaacttgccacccgccctggccgcctctctcccatcgagaattttcttcctctgcactatgattacctacagtttgcctactatcgagttggtgagtatgtgaaagccctggagtgtgccaaagcctatcttctatgccatccagatgatgaggatgtcctagacaatgtggattactatgagagtctgctggatgatagcattgacccggcatccattgaggccagagaggatttaacaatgtttgtgaaacgtcataagctggagtctgagctgataaaatcagctgcagaaggtctggggttttcatacactgaaccgaattattggatcagatatggaggacgacaggatgagaatcgggtcccttcaggagtgaacgtagagggagcagaagttcatggattctcaatgggaaaaaagctatcacccaagatagatcgagacctaagagaaggtggtcctctactctatgagaacatcacattcgtctacaactcggagcagctgaacgggactcagcgggttctcctggataacgtcctgtcggaagaacagtgccgggagctccacagcgtggccagtggaatcatgcttgttggtgatggatacagaggaaaaacttcaccccatacacccaatgaaaagtttgaaggtgcaactgtcctgaaagcactcaaatctggttatgaaggtcgagtcccactgaagagcgctcgtctgttttatgacatcagcgaaaaggctcgaaggattgtagaatcttattttatgctgaactcaactctgtatttttcctatacacacatggtctgccgaacagccctgtctggtcagcaggatagaagaaatgacctcagtcatcccatccatgctgacaactgtttgttggatccagaggccaacgaatgctggaaggagcctcctgcttacacatttcgagactatagtgctctcctatatatgaatgatgactttgaaggaggagaattcatattcacagagatggatgctaagactgtgactgcctctataaaaccaaaatgtgggcgcatgatcagcttctcatctggaggagagaaccctcatggggtgaaggcagtcaccaagggaaagaggtgtgctgtggctctgtggttcaccttggacccactttatagagaattggagcgaatacaggctgatgaagtgattgcaattctggatcaagaacagcaagggaagcatgaactgaatatcaaccctaaagatgagctataaaaatgagaaagaatgttctatcaaatatttatttaaattgttaatcttatgagaacctttttatttttgtacagagccatggtataaattaacaggttaatgtcagtcatcagatcttccttctcttcctaaggatgcttgtgttgcctcaatctatcaatctatctttcttgttttgggttgttttctctctctctctctctctctcttcttagagacatggtctaaccatgttgtctaggatatagggcagtggctattcacagatgtgatgatagcacactggagcctcaaactcttaggctcaggcgatccttcaagcctcccggggagctgggaccacaggcacgtgccaccacacccagctctctttcttggtttttcatcatttcatgtatctatcaaagcccagttcacctcctcccccaaacacacacacacacacacacacacacacacacaattaagttgctgcagattcaaaagcttagagagaataagcttcttggtggtgaaactacaactctcacgtgtgctccagttctaaaattaacctgtgcctggtctctgaagccctttcttgctctgtgcctttcagccacatccttaggtgctaacggccatgagctccgactctccaaagtgagctccactttgggtctgaggagcccctggcagagtccacgctgcctcaggtatcatgggcgtaatgatcacccaggctccgggagatctcatggatgattactgtatgagacagaggggacttcagtctttccagggccttggtggaatttttggctctggtgttttcgccagacaataaacttacactggaagctttgatccaccctccacagtactccagaaaggactgtcctataagttgtacactttaaaaggtcatgtagaggttgtagtagaatggcttttcaccctggtgactttggaagaaactcttgaatactgcctgcatccgggcaccatggccaggttgcctaggagtggggtccactgatgaaaagaggtgttttgtacttacataagaaaaataaatttctgattgatttt

SEQ ID NO: 61826 - DNA, 5504 bp, Homo sapiens
aattgacaaagtcacgtgtgctcagggggccagaaactggagagaggagagaaaaaaatcaaaagaaggaaagcacattagaccatgcgagctaaatttgtgatcgcacaaaatcaagatgttagattgatgcagaagatcactccgttccaaagggaaagttttcatctcacgagtttggagctgagggcccgtggggcaacatggccgaaggcggggctagcaaaggtggtggagaagagcccgggaagctgccggagccggcagaggaggaatcccaggttttgcgcggaactggccactgtaagtggttcaatgtgcgcatgggatttggattcatctccatgataaaccgagagggaagccccttggatattccagtcgatgtatttgtacaccaaagcaaactattcatggaaggatttagaagcctaaaagaaggagaaccagtggaattcacatttaaaaaatcttccaaaggccttgagtcaatacgggtaacaggacctggtgggagcccctgtttaggaagtgaaagaagacccaaagggaagacactacagaaaagaaaaccaaagggagatagatgctacaactgtggtggccttgatcatcatgctaaggaatgtagtctacctcctcagccaaagaagtgccattactgtcagagcatcatgcacatggtggcaaactgcccacataaaaatgttgcacagccacccgcgagttctcagggaagacaggaagcagaatcccagccatgcacttcaactctccctcgagaagtgggaggcgggcatggctgtacatcaccaccgtttcctcaggaggctagggcagagatctcagaacggtcaggcaggtcacctcaagaagcttcctccacgaagtcatctatagcaccagaagagcaaagcaaaaaggggccttcagttcaaaaaaggaaaaagacataacaggtcttcttcatatgttctttcctttacccggttgcaaagtctacctcatgcaagtataggggaacagtatttcacaagcagtagctgacctgggattttaactactattggggaactgtgaattttttaaacagacaaatcactctaagcaaattacatttgagcagggtgtcatgttttatgttaattcagagaataagatactatgtctgtcaatatgtgcatgtgtgagagggagagagcctgagtctgtgtgtgtacatgaggatttttatataggaatgtagacacatatataaagaggctttgtctttatatatttgtgtatagatcaaagcacacaccctctctcatataattggatatttccaagaattgaaaacccatgtgaagcattatagatagttttaaatttaacccactggagttttcttgaaataccacttcttttatattatataaaactaaaaacacgactgttaccttttgtgtgaaccaaaggatacttcagatctcagagctgccaattatggggtactaaaggtttttaagacatccagttctcccgaatttgggattgcctctttttcttgaaatctctggagtagtaatttttttcccccttttttgaaggcagtaccttaacttcatatgcctctgactgccataagcttttttgattctgggataacataactccagaaaagacaatgaatgtgtaatttgggccgatatttcactgttttaaattctgtgtttaattgtaaaattagatgcctattaagagaaatgaaggggaggatcatcttagtggcttgttttcagtagtattttaatatcagcttcttgtaaccttttccatgttgtgagggttgtaagggattgtgtggcaacagcagcttcccttggctaactcaatcttctacccattgcttagagcagggagccctccttatttactactgaagaccttagagaactccaattgtttggcatatatttttggtggtggtttttattcctcctggagagttatctaatttgtttctaaaacaaacaagcagcaaagaaatgaattaaatactggggttgagaattaaaattaagtggatgttcacagttgcccaatatatatgacctgcaaatgatacgaaaaagtgcagcatttagtggcagttaacaagagtgacaagcctggggcagaggtaccaaacctctcccaccagagagctagaagtattttatacagtaactttgatcttatggaagtgaccttcaatgcttattctgaagtaacctatatggtggatacaggatgaacattcagtgccagggagaatcttctcaggttggttctcgttagagtgataaactggctaggggccatagtattggtcctgttaggtttcggtcatggaaaaaaaaattattttggggtcatcctggctctagatgttatgggcaaatttctgaaacatctgcaagaaggtaccagttaattatagtgcttaatattgggaataagattaagcattataattataatgtatgggcctgttggtgtaagctcagataattaaataaaaatagcatgactcaaatgagacatattctgctgaacagtttctacttcctctcccgcctgtcctgtcatgggagacgtgtatagttgctgctgtttcagcaaaccaccataagacgaaaatgcctcaggttgggttgccagtcctttacaactcagcttgaatttcacaacagtgattgtgagaatctgcgtggtatacactgaaatatcggtgtgctgtgatgcaaagcttacctttgacgatattgaatgtgatatagctgtagagaagtacttccttgccttatgtgaggatttcaaacttatttaaattatgtagacaaatcaaagtggcattgcttaatttttagcaggcataataagcaagttaacagtaaaatgcaaaacatgataagcgttgctcaatttttagcaggtataataagcaggttaacagtaaaaatgcaaaacatgatagataagtcactttgaaaattcaaaccaaagttccttcaccttatggaaataggaaattatggacttcaaaattggacacttcctgtttacaaaaagaaattcagagctaaaatcatggtaaaaaaaaatagaaacacttgagaactatggtctttatgggtgcaatttgaaatccttttcatcatcttaccagactaaactaagagcacataccaaacctatcttatggttgaaagttggggtttattttttatatgagaatattatcactattacataacatactcaggacaaagaactttgctcagggaacataccatgtaatatttttgttgtttctttacagactagtctacagtcctgcttactcaaaacaaaccaaataacttatacctttatataagtattatgtactgatgatagtaactacctctgagtttgacacagatcaaaatttttgaatatcagatatcagttatcctatttttatttcatgtgaaaactcctctaaagcagattccctcaactctgtgcatatgtgaatatcactgatgtgaacacattgttcatttacataggtaaaatattactctgtttacagcaaaaggctacctcatagttgatacatagcacacctgtatgtatgctgttccagccttacaggtggctgataattctctggtacagaacctttttatctgtattataaatagcaattcacaactgcatgtttctgacaaacacttgtgaataatgaagcatctcgttttagttagcaaagtctccaaacatttccttaaaataatcatgtatttagtttaaagaattatgggcactgttcaacttaagcaaaacagaacacggaagcagtcttagaagcaccactttgcccagaggtggaggttggaaggggtagcagggagaggggttggtgtatgcaggtattcatgctaggcaaagagtttaaaagacgccaatgtccttcatttactgtctgtgctgccctgaagccaagcgtattgcagcattatagccccaggcacataactaactagcactggcttgccaaggaatgaacatgcaatgccattactagctattgagggaaaagggtctgtgtgaagcatcactttgcagggattactaatggtggggcagcaggtctgtgaattaagttatctcttgacctcaccctcatgtcaacacaaatgtaattcctaaacaagatgcattgccagtctcttagccctgtaagctgatcttttgctacatggcagactataatgaaaacatttttatacttgggtttctagtcttcactagaaggccttggatgtatttttgcagttgaaagatttagaaagatttttacctgcttataacttggaagtttagagtgcaatgtaagaaaaaagatcaagaaatgtcatgttattagcatcagtccacctccaatattgccgatactttttttattctggctcagttttattttgcaccagtgcggccccaagttactgctggttgtatttagtttgtgaataggagcccataagtgttaatagactttgtaacattcactataagatgaattatacaggacatgggaaatctcattaagtcttaaagttaatttaaattaatttatctgttttctctaagaaatgtttatcataaaatatatatgtgtatttcccctttggttataaaatttgggaaagtatgtacaagtgcagctgcactgactttaattttctagatgtcttaatgagatttatttgttttagagaagaacatcttgttaaaagcatcaaactctgtcttacatagctgtcaacagcctctttaagatgtggtggttgtatgatctgtgtcttaattgttcagttagagtgagaagttgacctatgattcatttttaaattttatatttggaacaaagctgcaagttatggtaaagtactgtactgtgagaagtattatgatatttaatgcatctgtggcttaacacttgtgagagttaccagcttgaaaatgatggtgttgactacctcttgaatcacatctatcaaccactggcacctaccaccaagctggcttcaattagtatgtgttgctttttggtattaacaactaaccgtactagagaccaaagtgaaccctgatttttatatgtctttaataatggtgttttatctagtgtttttaaattatcctgtgtagtatttagattacctcattgtccattttgactcatgttgtttacaagtgaaaataaaaacacttgaactgtatgtttttaaaagacaaaaaaggggtagatgtttggaatgcgtttcactcgcatgcagtcatctggagggactgaagcactgtttgcctttctgtacactctgggttttatattctcatttcatgcctaatgtcttattctgtcaattatggatatgttgaggtttaaaaaaattacttgattaaaaataaaacatataacgttggcattt

SEQ ID NO: 61827 - DNA, 1513 bp, Homo sapiens
agagactatgagggttcactatctgtttgctggaagatatacaagacttttgaggataatacttaaatgaagatagaccggatgtataatatgctttttcttagctttcctatgactctacttagcaacttttgctaaaagaaacacaatatatgattgactactttgaagacacatatattggacacttaaaatcaacaaaagcagagaggtcccaaacgtggtatcttttcacaatgatgtattttatccgaattcttggaattactcatggtgtctttcaaaattaaagatctgtgaaacctgaagcagatatgaatattagccagattatttcctactggggctaccctgatgaagaatatgatattgtaaccgaagatggttatatccttggcctttatagaattccttattggaggacagacaataataaaaatctagctcagagggttgttgtatacttgcaacatggtttgcttacatctgccagcagctggatttccaatcttcccaacaatagtctgggcttcattctggcagatgctggttatgatgtgtggatgggaaatagcagaggaaatacctggtccaggaaacacttgtacctagaaacgagttccaaagaattctgggctttcagttttgatgagatggcaaaatatgaccttccagcctctattgatttcactgtgaagcaaaccagacaagaggaaatattttatgtaggccattcacagggtactactattggtttcataacattttctactatatcaaagatagctgaaagaatcaaaatattttttgctttagcaccagttttttccacaaagtacttaaaaagtcctttaattagaatgacatacaaatggaagtcaatagtcatggctttttcaggcaacaaagacttcttgcctaaaacctcatttaaaaaattcgttggttcaaagctgtgtccactacagatttttgataagatttgcctcaatatcttgtttatgatgtttggatatgacccaaaaaacttaaatatgagtcgtttggatgtgtatttttcacacaacccagcaggaacatctgttcaaaatatgcttcattggagtcagcttttaaattctactcatttgaaagcttatgactggggcagtcctgatctgaacttggttcattataatcagacaacgtctccattatacaacatgacaaacatgaatgtggcaactgcaatttggaatggtaaaagtgacttgttggctgaccctgaagacgttaacattttacattctgaaatcacaaaccacatttattataaaactatttcttactacaatcatatagactctttgtttggattagatgtctatgatcaagtttaccatgaaatcattgatattatccaagacaatctataaagaaccatggcgctgtgtgtttaaagatctacatcattcctaatgaaatccaattcttatttttttttaaaaaaaaaaaaacaaaaaaaaaaaaaaaa

SEQ ID NO: 61828 - DNA, 1554 bp, Homo sapiens
gtgcggcgcgcgtgggcaggtcattgcagttgggcgctcagcagctgtggcagccggttgaggtctggaagtagcgttgggctgaagcagcggagttcgccatgcgcgagtgtatctctatccacgtggggcaggcgggtgtccagatcggcaatgcctgctgggaactgtactgccttgaacatggaattcagcccgatggtcaaatgccaagtgataaaaccattggtggcggggacgactccttcaacacgttcttcagtgagactggagctggcaagcacgtgcccagagcagtgtttgtggacctggagcccactgtggtcgatgaagtgcgcacagggacctacaggcagctcttccacccagagcagctgatcaccgggaaggaagatgcagccagtaattacgccaggggccattacaccatcggcaaggagattgttgacctagtcctggaccggatccgcaaactggcggatctgtgcacaggactgcagggcttcctcatcttccacagctttgggggcggcactggctctgggttcgcatctctgctcatggagcggctctcagtggattacagcaagaagtccaagctagagtttgccatttacccagccccccaggtctccacagccgtggtggagccctacaactccatcctaaccacccacacgaccctggaacattctgactgtgccttcatggtcgacaatgaagccatctatgacatatgtcggcgcaacctggacattgaacgtcccacgtacaccaacctcaatcgcctgattgggcagatcgtgtcctccatcacggcctccctgcgatttgatggggccctgaatgtggacttgacggaattccagaccaacctcgtgccgtacccccgcatccacttccccctggccacctacgccccagtcatctcagctgagaaggcctaccatgagcagctgtctgtggctgagatcaccaatgcctgcttcgagccagccaatcagatggtcaagtgtgaccctcgccatggcaagtacatggcctgctgcatgttgtacaggggggacgtggtccccaaagacgtcaatgcggccatcgccaccatcaagaccaagcgcactatccagtttgtggattggtgcccgactggatttaaggtgggcattaactaccagccccccacagtggtccccgggggagacctggccaaggtgcagcgggccgtgtgcatgctgagcaacaccacggccattgcggaggcctgggcccgcctggtccataagttcgatctcatgtatgccaagtgggcctttgtgcactggtacgtgggcgaaggcatggaagagggagagttctctgaggcccgcgaggacctggcagctctagagaaggattgtgaagaggtgggcgtggattccgtggaagctgaggctgaagaaggcgaagaatactgaggggagggtgtggtgggttctcccctgccacccctaggatggctgctttcaagttgtttgcaattaaagattctgtataaaaccaaaaaaaaaaaaaaaa

SEQ ID NO: 61829 - DNA, 2079 bp, Homo sapiens
agccgacttagaactggtgcggaccaggggaatccgactgtttaattaaaacaaagcatcgcgaaggcccgcggcgggtgttgacgcgatgtgatttctgcccagtgctctgaatgtcaaagtgaagaaattcaatgaagcgcgggtaaacggcgggagtaactatgactctcttaaggtagccaaatgcctcgtcatctaattagtgacgcgcatgaatggatgaacgagattcccactgtccctacctactatccagcgaaaccacagccaagggaacgggcttggcggaatcagcggggaaagaagaccctgttgagcttgactctagtctggcacggtgaagagacatgagaggtgtagaataagtgggaggcccccggcgccaccgttcccatccaggcttgtcggcggccaccggcggaccgggcttcgagatggcctccccgccgcggtgctccccgacagcccatgacagggaatgcaagttgccgccaccctccgcccccgccagcgagtattgtcccggcaagctgtcctgggggaccatggcgagggccttaggccgcttcaagctgtcgatcccgcacacgcacctgctggccaccctcgaccccctggccttggacagggaaccaccaccgcatctgttgcctgagaagcaccaggtgccggagaaattgatctggggcgaccaggaccctctctccaagatcccatttaaaattctgagtgggcacgagcacgctgtgagcacctgccacttctgtgtggatgacacaaagctcctcagtggctcctatgactgcactgtgaagctgtgggatccggtggacggttctgtggttcgcgattttgagcacaggcccaaagctcctgttgtagagtgcagcatcaccggcgacagcagcagagtcattgccgcatcctatgataagacagtgagggcctgggacctggagacaggcaagctgctgtggaaggtcaggtatgataccttcatcgtctcctgtaagttttctcctgatggtaaatacgtggtctcaggcttcgacgtggatcatggaatctgcataatggacgccgagaacatcaccaccgtttccgtcatcaaagatcatcacacaaggtccatcacgtcatgctgctttgaccccgacagccagagggtggcttctgtctcattggacaggtgcatcaagatctgggatgttacatcccaggccacgctgctcaccatcactaaggcacattccaatgcaatctcaaactgctgttttaccttcagtggccatttcctgtgtacaagctcctgggataaaaacttaaaaatatggaacgtccacacaggggagtttcgaaaccgtggagcctgtgtgactctgatgcagggccatgaaggttctgtcagttcctgtcactttgccagagacagctcttttctcatttctggagggtttgataggactgtggctatttgggatgtagcagaaggctaccggaagctctctttgaagggccataatgactgggtgatggatgttgccattagcaacaacaagaaatggatcctgtctgcttccaaggataggaccatgagactgtggaatattgaagaaattgatgaaattcctttggtaatcaagtacaaaaaggccgtgggcttaaagttgaaacagtgcgaaagatgtgacaggcctttctccatcttcaagagtgacacctcttctgaaatgttcacccaatgcgtgttctgccggatagatacaaggggcttgccagcagatacttcatcgtcatcatcatcatcggaaagggagaactcaccgccgccaaggggaagcaaggatgactgacagccacaggcccctttgagtgactccagcacaggctacctagcatgtaggtttcggggctttgcaggggctttctcttgggcccctcccaggctcagcaggcctgtcagactggggcaggacccaagccctggctggactcagcacagtgccacctcctcagctctcagcttggggagtgaacactttccgttttcatgcagaataaatctaattcctttgg

SEQ ID NO: 61830 - DNA, 2765 bp, Homo sapiens
atggagagaagcctggagccacgggaacctctggatggtgtcaggtgctctgcggcccacgggggcgggggaaggactagtgagcagaaactcctcctcgccttatcaggctctcgtgtcatcctgctgggcatcctgttagcagccccgcatgctgactctcgtggagaacagggaaggccccaggtgactgggacatataatgttggctgtaagtttgtcatcgatggcttttattacgttaagggtggtctggccctaaccgctcccgcatccctcgcctgcacagtgggcagtctggcgcctgtggcgtcgtgtttgctgagggcccggctgccgttgactgaggctgcgatggcggcggcaggccggggtcgggagcaggactcggcgcgcttcgtctatgtgacgcgcttcggctcgcatcagtgcagtggcgtcctgcaactgggcggccgtggagctcaaggcctttggggtcaggggcctggggcaggctgtcgccaggagaagccgagggaagcaatggcggtggcgggcgttcagggtggcagcgagctgcccctcggttcccagctcagggtccccacgacccctggtgtggaggctgcggcctctgcctcctcccagctgcgggcatcgagagttcagagcggcaccagacagtcggcgcgtgcaggtttaatccagaaggatgcagctaaaaagtatgattttcccataccattgaatgaagcttccaaaataatgaagaaaaagaaaaaggttttagtatggaatagagtatacaaagtcatttcaagaatgcttgaagaaaatgaaaaatatagacacaggctgaaatgccaaaggttatctagtgaaagctcaaattacacaagatgaatcttcttatcttctggaataacctatctttggatgtttcccaaagaagagtatgaagaatctaaagatgaaacattaaatgaatcataattatttgttaattttgatgtgttttattagaattgggactttagtagtcgaacagaaaaattaccttctttataaattaataatatttctttgctacttaataatacctttagttaaatattgttaaccatatgcatgcaagtgttattttcagaattaatgcttattctacatacttttaaattaacctcatacataaaattaaattagcatatcaatgcaattgcatgaattttataattaccagcttttccattttattaatgagtctacaactgctgctttgttcatctcttcttttagatgtaactcttaaattaaacttggattcatttaaattatttttggcttcctctaaacttctcaattattttatggaaaaaaccttagaatttacatagcaacgattattttgggtgttaaaactaagctaatgattatttaagccatcttttcatcctaaggaaaattagtaaatgtatgcatttataatatggatatattataatggactatattataatatggagtattttaggaaaatttttgggcaaagatcagaggagatgccctttaccttgccaggcccctaagtaatacattatttttaagtcaatgaatgagaggattagaattctgaaaatcatttagaagtattgtttaataagtcctttttttctactcaacattaagtagtaatcaacttttacctccgccagtttttctgcttttttgctggtacgatctctctttctaaattgaatcaaagacctaggtggaactggaaacttaggagggaaagacaaaatgaggcttgttcatgatcaaattctgtgtactctagttgcttctttcccttggagtgacaggtacttttatatccaggatgattacagtgatgacatccattcttttttgggggcattgagaaggtgggcttcctaattattttacaaaggtattacaaagtgttaatatacaaaattctcatgaaatagtacaagttgtaaggactgtaaagtaattcatagttttgttttttcctctaatagttgtaacttaattacttcaggagactacgacagtgtagaatttgtggtaacatgatcttctagtgactatttatcaaatccacctgtttctagatgaaggacacattgcctggggaaatggcctcggtttttttgccatgtaggctctcaagtttccctgcattgagggtcacacaacttctttatattatgctgggtaaatttcaggctgctaaatccttgggtgaagcttcaaattttagcttatgcaactgaagtccattgcaaaatgagacatatttacactgtttatactgtaatttatgctgcataaagttttgtagtgaatgtgtatgagagttttaggtttgcttcaatgtatgtttatatttatgtgacttatacaacttgacatagtagtctgttttaatttattaggtatatcaatatttgttagatttaaaataagagtctaatgctggatacaaactcagtttatttcactgttctagaaccatggaggaatgaagactcccactgaaatgaatgttctaaatatttgttctaaatcttttaatttttgtttaataatttctggtgaatatgtgttcaatctgttatgttaaatagaatataataaacataagacttttctttactgatacatcactgaacataagctgcaatactttaacttatttctgttccataatttcagtaggggctaatgacccacccctgctacattaaagacttcag

SEQ ID NO: 61831 - DNA, 2765 bp, Homo sapiens; identical to SEQ ID NO: 61830

SEQ ID NO: 61832 - DNA, 1189 bp, Homo sapiens
agaaactctgtggggaagataagtcctgagcctagagctgccatttccacagacaactgaactaccttcaaacagatgtgtttttaggggcagcagatagaaggagctgaatccaggagtttccttccctgaaatgccccaacagaggcacagtcctccaccttccctggaacagagggctttcatctgtctctctgaagccatctccctcccctgtttatgcccagagctgctttccaatcccatggagtgcctccgtatctaaccatagccactgagtctaccaggtgttcctgagaagacaactaagccaaccgctccacactctgctgattttcttctacatctcacagggggaagagctggatcaccatgaaatatgtcttctatttgggtgtcctcgctgggacatttttctttgctgactcatctgttcagaaagaagaccctgctccctatttggtgtacctcaagtctcacttcaacccctgtgtgggcgtcctcatcaaacccagctgggtgctggccccagctcactgctatttaccaaatctgaaagtgatgctgggaaatttcaagagcagagtcagagacggtactgaacagacaattaaccccattcagatcgtccgctactggaactacagtcatagcgccccacaggatgacctcatgctcatcaagctggctaagcctgccatgctcaatcccaaagtccagccccttcccctcgccaccaccaatgtcaggccaggcactgtctgtctactctcaggtttggactggagccaagaaaacagtggccgacaccctgacttgcggcagaacctggaggcccccgtgatgtctgatcgagaatgccaaaaaacagaacaaggaaaaagccacaggaattccttatgtgtgaaatttgtgaaagtattcagccgaatttttggggaggtggccgttgctactgtcatctgcaaagacaagctccagggaatcgaggtggggcacttcatgggaggggacgtcggcatctacaccaatgtttacaaatatgtatcctggattgagaacactgctaaggacaagtgagaccctacttctccctctgcattccactggctctgccatggactatacaagcagataattttccctctattcaaaataaaatctccaaatgaaaatttgggaatgtagc

SEQ ID NO: 61833 - DNA, 4037 bp, Homo sapiens
atgaaccaactgatcctcacaactggagggagaattaacaccttccatgggacaaagaaaaagcacattctggcctgctggcaagtcacctgtcgtttccagctcatcttcatcgctctacgtgtaaaatgcctgggtagaggcggcggcggcggcggcggcggcgggctcggaggcagcggttgggctcgcggcgagcggacggggtcgagtcagtgccgtttgcgccagttggaatcgaagcctcttaaaatggcagatgatttggacttcgagacaggagatgcaggggcctcagccaccttcccaatgcagtgctcagcattacgtaagaatggctttgtggtgctcaaaggctggccatgtaagatcgtggagatgtctgcttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtaccagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccaaggtggcagtggtggcagcagtgatcctccgaacctgcagaggccccctcccccagcctggcctggctctggcctggtcctaggttggactcctcctacacaatttatttgacgttttattttggttttccccaccccctcaatctgtcagggagcccctgcccttcacctagctcccttggccaggagcgagcgaagccatggccttggtgaagctgccctcctcttctcccctcacactacagccctggtgggggagaagggggtgggtgctgcttgtggtttagtcttttttttttttttaaattcaatctggaatcagaaagcggtggattctggcaaatggtccttgtgccctccccactcatccttggtctggtcccctgttgcccatagccctttaccctgagcaccacccaacagactggggaccagccccctcgcctgcctgtgtctctccccaaacccctttagatggggagggaagaagaggagaggggaggggacctgccccctcctcaggcatctgggaagggcctgcccccatgggctttacccttccctgcgggctctctccccgacacatttgttaaaatcaaacctgaataaaactacaagtttaatatgaaaaaaaaaaaaaaagaaagaaagacgtgtaaaatgccaagaactctaggaaacagggacaaaaacacttcaaagagaaagttcatgcacttgtttctgaccacccagggcacccttcagcacacgctgtctggagtggcctgaagcaaggagtgtcttgtgaggtgcagaggatgcaatgggagcagggtcctgtccccaccctaaaggagttcacagtttaacgcaaatgagaagccagtgaggacatcactactcctgctgtgaacttgggaactagaaacacaaaacctgagtctggagggaagctaaggaagcattctgctctggagtagacatgagtgcgtgtgaagcttctgatctcccatgagagcaatggggacatggggcagaatctaaaacccatgactgaaagcaccaaattgctaaaatggcaataaagagacatgaggccaagatggagaagaaggaacccaggacgagggtcagcctcacatttggggctcatttccctcagtttcctcactgaatttcagaagggactaactgagatgcaaagaagcagagcagcttttgcaccatgtggaggactagatggaaaacaagtagactgagggtctgctagtgaaggtgacccctactgaagtccactggctttggttgggacccagaagagtcacacgccaggaatagaggtggacaggaaacaccctgacttttgtagggactgaacctcactgataacctcaattgcggatggtatggagggtgtctaggtgtgctaggacccctgcccattccccagaaatagactcccatcttttctacagcaagataacgtgctagtaggcctcaattcattgctaaatatttttaacgagtgtcttacatttagccaaaaagactagtcatgtggcaggaaaaatacaatgtcatatgaccaaaagctaaaagactgtgaaaatgaatccagaggtgacccaagcattgaatttaacaatgccagtacctggacctccgcttgcccctaaaacattacaatcaagaatgtaggaagggaaaggaaacacgaagattaatcaagcaggaaggacaagctcagttttgcacccactgaatttgccacaaatattgtggaaaatattctcggggacattgcagttgtctactttggttggcacatggttcatacaacagtgtttgtgtcagtgaacatcttactcttcctcggcagtctttctttgcccagagatttcgcaatgactgttgaccttcatcatcaccttttggactttggcttgcactttagcttctgtagatctccatgatgtaaagaagtattttaggtccattttaattcctgcaaaggataaaatccttctatttgtgtgcatataagtggacctgagcccttggttagggtgtagagaggagaaggggagaaacctgagggccagaagctgttctttcccttaaaagggcaaactcatttccacactatggggactctgacagatagcataccttcctgtctatggctattggacctgcaggctttcccctgtaaatccgtgttctgtcattgacattttgtgactgtaagacagacttgagataagacatctagaaaacaataattgaacaatgatgtgaatatatttcacacaactgaactgtacatttcaacaaggttaagatggtaattatcacgttatacattttttaccgcaggttaaaatgtttcacaggttgaaaggaaagcaactaccttcagttctctgagttcaagaatttgtaacatttcaccccctgctccttcctgatcttctgtggagcatcttttttccatccatgctctactcagagcccactttcccttccctgacaccagcttcactgaggctggttggaacctaacacaaaacattctcagtaatgactgaattcccacaaagaattccatatagactgcatatgagttgaatcttctaagacatgaaatatttgttctcttcttggctaatatgcaatgcaaatcctgttgcagatgtacgtcatatacctctgaaattcctgatgtattcaatgaaataacatctttaaagttctgtgtagaatgttttttttctgatttcttcacatacgatagaaaaaaaaacccaaaaaaacatgtactaggatttcaatagaagcaatgggtgatctaaaaagatgaaagagcaaccgcatgcgccctacagctaccgctagattttatggggaaagcagctggcccagtttgcagctaggagaaatgtcaaacacatgaagaaatgagaagcaaagaaaaaccatgaggcatgaacatttcatggcaatcacgatgtcctggtttgtgagataatgggatagaggagtagaaaacaaggagaaagatgagaaggtacaaagtggttcaagtcaaacagctcaactgaacttttcttaatggaatatttaaaaagtggtacattaaaaaacttcccccagttcacatcaaaaattctctcttcaggactaagttgggtagagactgttcaatgtgcctagatatcttcagaacttatatattttctgttttctacgtatgttgaagggcagtgccaaatgatgtgtaattatctaggttgtaaaaataaaacatactcccccttcccttgaggat

SEQ ID NO: 61834 - DNA, 2716 bp, Homo sapiens
ggagcacgccgggaagctcgcgggtcggcaccgggacagctcccgggcgccgtggaatgcacacgtcccgcacccggaccttccggtcagcttcccggctcgctgtctgatgcccgcggtagccaatgagctagtggtgtttgtcctgctccgtccccgccctccaggggaaccaatcccattgcaggagaggcaggacgcgcaaaggcccgaaagaggagctgggcggggtggggggaaggcggaggcagtctagtaatgtaaagctccgctgagagggagagtgctgaagaaggggacagcctctgtacctgcggcgcggcccgaggggcggacgcgagcggagtgacgcgctggaggctgtttatagcgctgtcaggacagcgcggggagtggaggcagaggcctgagagctccccggattatggtgcactgagaaggcatctggaagcctgggccctcatggcatccaacgataaaggcatggcaccctcgctgggctctccctgggcctcccagatggggccctgggatgccatcctcaaggctgtcaaagaccagctcccgtctctggactcagactcccctttgtcggactatggggaagaggagctgttcatcttccagcgaaaccaaacctccctgattccagacctgtcggaggagctggctgaagatcctgccgatggcgacaagtccagggcctgggtcgctgcagctgaagagtcccttcccgagccagttctggtgcctgcagaattggccacagaacctgggtgcagacagaacacaaggacaaaggatgcatcctctcaggaaggaagagaccctggcaggccttttgaaagctctggtgaggtcagcgctcttcttgggatggccgaggagccccccaggtggctggaaggcgaccttggaagcctgtctttcaacaccaaaggatcccagggtcctccctgggacccacaggccgaagccactctctcctgccatgaaggagacccaaaggcagagcccctcagcactgcctcacaagaatctgtgaaccgccgggccctccgacaggagagaaggaagatgatagagacggacatcctccagaaagtcacccgggatgcctgcggcccgaccagcagtgacaaaggtggggtgaaggaggcgccctgccacgctgcggagtcagctcccagatccaaaatgcccctcgtggagcctccggagggaccaccagtgctctcgctccagcaacttgaagcgtgggatttggatgacatccttcagagtctggcgggacaagaagacaaccagggaaatcgtgcacctggaactgtgtggtgggcagctgaccaccgccaagttcaagaccgcatggtgccgagcgcccacaacaggctcatggaacagctggccctcctgtgcaccacgcagtccaaggcctctgcttgtgcccggaaggtgcctgccgacactccccaggacaccaaagaggcagattcaggaagcagatgtgcctcaaggaagcagggctcccaggctgggccaggcccgcagctggcccagggcatgaggcttaacgcagagtcccccaccatctttattgacctgcggcagatggagctaccagaccacctgtccccagaaagctccagccacagctcctctgacagtgaggaggaggaggaggaagagatggcagctctgggagacgcagagggggcatctccttcctccctggggctacggacctgtaccgggaaaagccagcttctccagcagctcagggcctttcagaaggggacagcccagcccgagctgcctgccagcaaggggcccgcgggtgggagggctcaggcccctgaagacacagctggatcacgaactgggaggaagcaacacatgaagctctgtgccaaggggcagagcgcccaggctcgactcccaagaggcaggcccagagccctgggggatgttcctgagccaggggcagccagggaggccctgatgcctcctctggagcaactatagctgcctcaggatgtgtcctgctgtctgccccgtgggaagagcagagaaatcatcaccaccttgggccccacggtgccacgggctcaggcagcacagtagggcgccgggcctttgggacagtgtcccagcttcccctggggttcacccctggctgccaggccactgaggatgggcaggggtctcttctcatcaagccttgtaccaggcaaaagacaggccctgcttggccgtggtcactggccgccaagatcagggctacagatgtctgctctctggaccccacgtgatctggccactggggacccccacccgaccccactcccaatgatgaggggcattttcattgcaagtcaaaggcaagacaggcttccataaagtcccaggaggtccctcctgtagggcacaaggccaggctgcctcccagcccccaggccctctcccacctacagagaccctcccctgccccctccactccggggcctgtgccgccagaaccgggctctgcccccatacgctgccctcgcagcctggcggcctccgctgtggctgcctagctgtcaagagcaaaggctttttttttcttcaaccccattttcttccatttctcccacctttttaatgccagtaacctcactgagaatgttttacagtgatggaaaataaactctgttccaagttcaaaaaaaaaaaa

SEQ ID NO: 61835 - DNA, 537 bp, Homo sapiens
tcccagtgggctaatccacaccagtggacttgaaacacgctttgggttgctgtatggtagtatgctaaaggacagcaagaatcacttgacaattggtttgtgaccataatggcatctataaacagaaccattgaaataatgaaaaaacatggagtaagcaaacaacatctcctggaggagataaacaaaaagcgtgaatccaactgcttggtggaacgaagcaatcaagtcagcttactgagagttcaaaagaggcacttcccggatgcctatcagtcctttactgataccacaaccaaagagcctgttcccaacagtggcaggagctcctggatcaagctgagtctccttgctcacatggagagaaagcactttccaccaaaaaataatgccatatttggataaagtgcatctccagagacacacggaaatacattctctttgattcttcttcagtgtgtctaaattatttacaaattattaattataaacaaagctaaacaaaaaaaaaaaaaaaaaaaaaaaaaaaaaaaaaaa

SEQ ID NO: 61836 - DNA, 6101 bp, Homo sapiens
aatctcccggcagttggttcccggaggcagaatctgttaaactgacaaagcccacgtctccgggtccctgtctcggggagtcgggactattgggtcaccccgggtagtcgagactctagactgagctgtctcggtcactcaggaggcagttggcagagtattcgtggtcagggaggtgacccgtggtcagcagggtcaggccacccagggacaaagggtgctcctgcaccgggccttggagaaggacagagcggtggggacttggggtcagcgggggagcctccgcggatggggagtcaccacctgccggcaatcagccatgactgcctttgcactgtccatgctctcagcccaccacctcctccccctgccattgcagtggctaacactggagacgaagaccaagacaccacagcctttctccagtacctctcaaatcagcacagacaaggacaaaggcctcaatccacaactgctgaagatggaccctggccacatgggatggtcagacacgcctgcccagctatctgcaggcgaagaggctcagaagaggtttaggggcctgaaggacatcttgcttccatgtccatatgagcaggctatttctgctccatgagtcaattttgccatataaaatacttaatttcagccattccagggtgctataggatgcacagcttcccatcagcccacctgaactccagccatgccattttaataccaggaataaggtcacctgctttcctgccccttaggaggccggagccgtggaagcaaaatggcacttctgtttacctgttatattatttttttgtcatccttatatgtttgaaaaatgcaattatatgaaaaaagtttagtaattacagacataacagcagaaagtcctcggaaccaagcttattctcatggccgattctgctccacctgggactctgctgtgctgcgggcatcctgtggtcagaatcgcagaggggccatcagggaggaccttcccagaggatggacctcacgtgactgctgcgtgggcaagtggcactggccactctgcctggagagaggagtaaatgcagggctggccaggcgacctgcacactctgctaccggccttgtccatctttagcctctaatttgaaaatgaggatcacacagaccaagagtatctttgagggttagtacagaccacagaaatgccctgggcctttcactctctccttttgcaaattcccatgtgtggaaatgccgtttggataatgagggagcctgaaggaggtggacacatgagcagccccgacaggcctggctccatcctctgaaaatggggccccgtgcccggcgtgtggccttactggttcagtcttctttacagtggtaggttttgagtgcccagatgcccagtgcctcctacccggaacaggacaggaccaggctgtcccctggaagaatcccatgcacacttggctattcagggagtttccacccagccgagctcgcctctgtggctaccctggtcttgctgctcatatctgccaggaaaggcctggacttggagagaaacctgggatttggattcagtccttgccagcctggctggttcatatccttacctctgtctgtggaagcctatgttcctgagcagcgagtcagagggggcatctgaacgcagagcagggagcttcagatgggaagaagtcagaggaaccagaatgtatcagacgatgtggagttgggtgcctgagctcaaagcaagctgggccttgggctggctgtgtgatcttgggcaagttcgaccagcttctttgtgcctcttttctctccttaataagataaatgtcttcactagtacactgagggctgccattaagttctatgtgcagggatccaaggcaggccctaggtctcttggtgagtgctactcctccttacaatttgctgcccggagcaacattgggtgacagaacttcttagcaccttggcagtccttgtcctcctggaccctctgttttgagggtggaatgaggtgaagggcaagtgctttcccagctggtcaggtgctctaccaactgggcatattctaatccccccagagtatacagatcagagtttgatgtggccaatgggtccaatgcccaagtgagaatctcttgatgaagttattggtgtggggttttgctttggtttttaattatagagagcaaaagtattgaaagtattacatttaccctaaaggtgtaagcaagttatggtcaagtgaagatgaagtaccatcctcaaacacgggttccattcttagctcatctcatttaaaggagagaaaagccttgcaggtgaaacatggtgggggtagacaggggttcagccaatttcagtgtttggccccaagaagtgaatttgggtttgaggacctctctctggaaggattttatgaccagatcttcctggagatgatattagaagcttttctcaccaaatatttatttgcctggggtgcaacttctgcttcattctctctttgactccagctgtctttttggactgaagtgcaggttgctcacagcatcctacaaagtaactgtcttcccaaatctcacttacctctgagtttctgctgtattcctgtctttctctctctctttttgaactggaatctattactttggatgatgcatgctggcgttttctaaagttttctgattgattgtgtctttaaaaaataatctgatagtattttagcttcttgaattttgtggcatatttttaggcctctcctaaacccatttttgagtgctatgacattgttcatgtatgaagttatgccagtagaaacaaaatgctgtcatataggctcccctaaaacttcaaatctggtccagatcttagactggcagcttctgctgtcattggatctcagtgagacctttgcacccatttcctccctttgtgattcatccacggacatccccatctccttgagaacaatctcaggaatattccttgccttctttcggctctcactccatctcattttctgctgttcactcgggaataaagagatgtcccacactttaaagagtaaaaacaaaaattggagctcagagagggtgaacttgtcaatatcacacagagctgggagtgtggtaagcccttgaaatggggctcaatgacaccgctacctcccagggattcctaatgtctgagggttccagtgagctgagatgaacccagggcctaagaagaactctctgacctcctcacctccaaagccccacccagtgcacatggcctgaggcgtccatggtgatggtaaagaaacctcacctgccatctctcccattactgccatgtcccctctcatcctattctgtgccaaatgtccagatgtgatcaatagaatcaggagaaaattgaggcctgaggggagggggccagactctgggagtggagagtggattgaagtcagactagggctgttcagcaaggagttcagggccttcaagtgttgggagcttggcagcaatgccaaggggaatgggggtggatttgggtccaagtttatgttcgaagaatataagcatgatttggagactcctgatgttcatatgcccccatcaagcagagctaggggtcgccagaggagagaatggtgctagaagttcaggtgagaacagggcagacccctgcataaatgtgggatctctctgtttgaatcacggcccaaacaccgtggcagggacactcccaaggaactcaaacatgtattttatcagggctttaacataaggaatattgattcttaagaaaattggaaacatatgagaatctaatttactctgttatgagatgccatacacctggaagaacaggttaactgtcaaattactaccaaattgttgcaaaaaattgccaatgaagcaatcatacaaagctcaggtaacagagtgggtggccatcactctgggagagggagatagcactggagaaggtccttgtgactcagatcaaagagagcaaatggcaaagaagggggacagttgctgttttctgaagtaaagcctcttaggtgttatttgaccatttgttacctgtgaatgtataattttgatttttaaaataagtagaaaggagcctctttcttaaaaccaaccaatctctgagccccacagatggtattctggtttcttgcaggaggttctgggtcccacccgcctgcccccttctaggacaaccccaccagcaaggaggtcttttagttccttctgtgtgtgttcacctgctcgtcctggcttgggccccagggagcccaggaacctcagggttctctcagctgcacttccatccgtggtgcccaacctcagtgcctaggactctgtgtgcctgacctcctccaggcggggctgctccctccaggtgtccacctggtatgggcatcccgtggcagctctcctctgatgaccgagtgtggtgggggtgctaaggccaacttgctgctggcacgcccagaacttatttgctggctgtttcaaagactccctaaaggcaccatggattttccttagaatacagttctgtgcagtcccgcccatcctcttcccctctgtttcccactagggctgatacttgctttaaggtctgatggctcacccagtccttcataattttcacaatgttatgttccttcctaaaacccttgcagtttaatctgctcttggcgtctgcttctcagaggagctgaggaacagagacttcaacccttcttctctcagttcctgctgcccctgtagtgaggctgacagttgcagaccatagagccagcctggccttgcccagagcatacatgacctcttagtaaggctgggccctgctaagggctatgttttgcacacgttcctgctagtcacatccagcacatctgggctaccacttggatggcaacattacattgaagaccactgtggccatggcaggagtagacaaggtggcagtcttgtcttcagtcgtcatggaaatcccagctatgcagcactagcaggtgttttgtaatggaggatcagatgcttgagcttctgagcaggccccctccctctactgccttctgtcagggtcttggcagcagccggctctggaaggcatcccggctctgggttcaagagcttgctgggcttctacatgaaggtgtgaagtgtgaatgttaccttttctgatttacacttctgttttctgctacaaacttgggatgttttctgagggatgctgaatagatgggggtggatggggggagggaggcaggggctagaaagtgttcttctggggccaccctccagcctggggcatctgatggatgaggaggggagaatctttgagatcctgtttatgagggcactgcaaataccacatttttttcttgtttgcaaattctagtggagaagttttaccaggttgggagagaggcctcagaattaagtccctgtctcctgccacagtttacaccggtgaagcttcctggccgagcataaactcccaggtggagtacaaacagccttcaacaatggcaccatcattggtaccaatggcattgagaggaggtggcactgacaccctaagtgggtggcactgacacctaagacttatggtcttctgctgcctggagagctttgcctccatcactggtgcccaccttgggaattcccaggaattactcttcaaaggtacactcggacgcccactctgcaaggccattttgttcccttacagtgcctctgaaatcattttgagagaggagaatagggaattagggtaaacaacggttaaggcataagcaaaagaacagcaggtgcagccagctctagacagcatataggccacatcctcactcctgttataacaaaacagaagtttccacttcagccttttgtttcatcctgggtaagtccttcatagggtgtaaccaattggaggcctctaaagggcacctaggggtgttgctaaattattaatagcttaaaaccctaaagaacattgtaatcagcgctcttgagccctttacataagttggcttccactctgtggagtgtactttgcttcaataaatctgtgctttcatt

SEQ ID NO: 61837 - DNA, 6101 bp, Homo sapiens
aatctcccggcagttggttcccggaggcagaatctgttaaactgacaaagcccacgtctccgggtccctgtctcggggagtcgggactattgggtcaccccgggtagtcgagactctagactgagctgtctcggtcactcaggaggcagttggcagagtattcgtggtcagggaggtgacccgtggtcagcagggtcaggccacccagggacaaagggtgctcctgcaccgggccttggagaaggacagagcggtggggacttggggtcagcgggggagcctccgcggatggggagtcaccacctgccggcaatcagccatgactgcctttgcactgtccatgctctcagcccaccacctcctccccctgccattgcagtggctaacactggagacgaagaccaagacaccacagcctttctccagtacctctcaaatcagcacagacaaggacaaaggcctcaatccacaactgctgaagatggaccctggccacatgggatggtcagacacgcctgcccagctatctgcaggcgaagaggctcagaagaggtttaggggcctgaaggacatcttgcttccatgtccatatgagcaggctatttctgctccatgagtcaattttgccatataaaatacttaatttcagccattccagggtgctataggatgcacagcttcccatcagcccacctgaactccagccatgccattttaataccaggaataaggtcacctgctttcctgccccttaggaggccggagccgtggaagcaaaatggcacttctgtttacctgttatattatttttttgtcatccttatatgtttgaaaaatgcaattatatgaaaaaagtttagtaattacagacataacagcagaaagtcctcggaaccaagcttattctcatggccgattctgctccacctgggactctgctgtgctgcgggcatcctgtggtcagaatcgcagaggggccatcagggaggaccttcccagaggatggacctcacgtgactgctgcgtgggcaagtggcactggccactctgcctggagagaggagtaaatgcagggctggccaggcgacctgcacactctgctaccggccttgtccatctttagcctctaatttgaaaatgaggatcacacagaccaagagtatctttgagggttagtacagaccacagaaatgccctgggcctttcactctctccttttgcaaattcccatgtgtggaaatgccgtttggataatgagggagcctgaaggaggtggacacatgagcagccccgacaggcctggctccatcctctgaaaatggggccccgtgcccggcgtgtggccttactggttcagtcttctttacagtggtaggttttgagtgcccagatgcccagtgcctcctacccggaacaggacaggaccaggctgtcccctggaagaatcccatgcacacttggctattcagggagtttccacccagccgagctcgcctctgtggctaccctggtcttgctgctcatatctgccaggaaaggcctggacttggagagaaacctgggatttggattcagtccttgccagcctggctggttcatatccttacctctgtctgtggaagcctatgttcctgagcagcgagtcagagggggcatctgaacgcagagcagggagcttcagatgggaagaagtcagaggaaccagaatgtatcagacgatgtggagttgggtgcctgagctcaaagcaagctgggccttgggctggctgtgtgatcttgggcaagttcgaccagcttctttgtgcctcttttctctccttaataagataaatgtcttcactagtacactgagggctgccattaagttctatgtgcagggatccaaggcaggccctaggtctcttggtgagtgctactcctccttacaatttgctgcccggagcaacattgggtgacagaacttcttagcaccttggcagtccttgtcctcctggaccctctgttttgagggtggaatgaggtgaagggcaagtgctttcccagctggtcaggtgctctaccaactgggcatattctaatccccccagagtatacagatcagagtttgatgtggccaatgggtccaatgcccaagtgagaatctcttgatgaagttattggtgtggggttttgctttggtttttaattatagagagcaaaagtattgaaagtattacatttaccctaaaggtgtaagcaagttatggtcaagtgaagatgaagtaccatcctcaaacacgggttccattcttagctcatctcatttaaaggagagaaaagccttgcaggtgaaacatggtgggggtagacaggggttcagccaatttcagtgtttggccccaagaagtgaatttgggtttgaggacctctctctggaaggattttatgaccagatcttcctggagatgatattagaagcttttctcaccaaatatttatttgcctggggtgcaacttctgcttcattctctctttgactccagctgtctttttggactgaagtgcaggttgctcacagcatcctacaaagtaactgtcttcccaaatctcacttacctctgagtttctgctgtattcctgtctttctctctctctttttgaactggaatctattactttggatgatgcatgctggcgttttctaaagttttctgattgattgtgtctttaaaaaataatctgatagtattttagcttcttgaattttgtggcatatttttaggcctctcctaaacccatttttgagtgctatgacattgttcatgtatgaagttatgccagtagaaacaaaatgctgtcatataggctcccctaaaacttcaaatctggtccagatcttagactggcagcttctgctgtcattggatctcagtgagacctttgcacccatttcctccctttgtgattcatccacggacatccccatctccttgagaacaatctcaggaatattccttgccttctttcggctctcactccatctcattttctgctgttcactcgggaataaagagatgtcccacactttaaagagtaaaaacaaaaattggagctcagagagggtgaacttgtcaatatcacacagagctgggagtgtggtaagcccttgaaatggggctcaatgacaccgctacctcccagggattcctaatgtctgagggttccagtgagctgagatgaacccagggcctaagaagaactctctgacctcctcacctccaaagccccacccagtgcacatggcctgaggcgtccatggtgatggtaaagaaacctcacctgccatctctcccattactgccatgtcccctctcatcctattctgtgccaaatgtccagatgtgatcaatagaatcaggagaaaattgaggcctgaggggagggggccagactctgggagtggagagtggattgaagtcagactagggctgttcagcaaggagttcagggccttcaagtgttgggagcttggcagcaatgccaaggggaatgggggtggatttgggtccaagtttatgttcgaagaatataagcatgatttggagactcctgatgttcatatgcccccatcaagcagagctaggggtcgccagaggagagaatggtgctagaagttcaggtgagaacagggcagacccctgcataaatgtgggatctctctgtttgaatcacggcccaaacaccgtggcagggacactcccaaggaactcaaacatgtattttatcagggctttaacataaggaatattgattcttaagaaaattggaaacatatgagaatctaatttactctgttatgagatgccatacacctggaagaacaggttaactgtcaaattactaccaaattgttgcaaaaaattgccaatgaagcaatcatacaaagctcaggtaacagagtgggtggccatcactctgggagagggagatagcactggagaaggtccttgtgactcagatcaaagagagcaaatggcaaagaagggggacagttgctgttttctgaagtaaagcctcttaggtgttatttgaccatttgttacctgtgaatgtataattttgatttttaaaataagtagaaaggagcctctttcttaaaaccaaccaatctctgagccccacagatggtattctggtttcttgcaggaggttctgggtcccacccgcctgcccccttctaggacaaccccaccagcaaggaggtcttttagttccttctgtgtgtgttcacctgctcgtcctggcttgggccccagggagcccaggaacctcagggttctctcagctgcacttccatccgtggtgcccaacctcagtgcctaggactctgtgtgcctgacctcctccaggcggggctgctccctccaggtgtccacctggtatgggcatcccgtggcagctctcctctgatgaccgagtgtggtgggggtgctaaggccaacttgctgctggcacgcccagaacttatttgctggctgtttcaaagactccctaaaggcaccatggattttccttagaatacagttctgtgcagtcccgcccatcctcttcccctctgtttcccactagggctgatacttgctttaaggtctgatggctcacccagtccttcataattttcacaatgttatgttccttcctaaaacccttgcagtttaatctgctcttggcgtctgcttctcagaggagctgaggaacagagacttcaacccttcttctctcagttcctgctgcccctgtagtgaggctgacagttgcagaccatagagccagcctggccttgcccagagcatacatgacctcttagtaaggctgggccctgctaagggctatgttttgcacacgttcctgctagtcacatccagcacatctgggctaccacttggatggcaacattacattgaagaccactgtggccatggcaggagtagacaaggtggcagtcttgtcttcagtcgtcatggaaatcccagctatgcagcactagcaggtgttttgtaatggaggatcagatgcttgagcttctgagcaggccccctccctctactgccttctgtcagggtcttggcagcagccggctctggaaggcatcccggctctgggttcaagagcttgctgggcttctacatgaaggtgtgaagtgtgaatgttaccttttctgatttacacttctgttttctgctacaaacttgggatgttttctgagggatgctgaatagatgggggtggatggggggagggaggcaggggctagaaagtgttcttctggggccaccctccagcctggggcatctgatggatgaggaggggagaatctttgagatcctgtttatgagggcactgcaaataccacatttttttcttgtttgcaaattctagtggagaagttttaccaggttgggagagaggcctcagaattaagtccctgtctcctgccacagtttacaccggtgaagcttcctggccgagcataaactcccaggtggagtacaaacagccttcaacaatggcaccatcattggtaccaatggcattgagaggaggtggcactgacaccctaagtgggtggcactgacacctaagacttatggtcttctgctgcctggagagctttgcctccatcactggtgcccaccttgggaattcccaggaattactcttcaaaggtacactcggacgcccactctgcaaggccattttgttcccttacagtgcctctgaaatcattttgagagaggagaatagggaattagggtaaacaacggttaaggcataagcaaaagaacagcaggtgcagccagctctagacagcatataggccacatcctcactcctgttataacaaaacagaagtttccacttcagccttttgtttcatcctgggtaagtccttcatagggtgtaaccaattggaggcctctaaagggcacctaggggtgttgctaaattattaatagcttaaaaccctaaagaacattgtaatcagcgctcttgagccctttacataagccggcttccactctgtggagtgtactttgcttcaataaatctgtgctttcatt

SEQ ID NO: 61838 - DNA, 5614 bp, Homo sapiens
atggccaaggactcgcccagccccttgggcgcgtcgcccaagaagccgggctgctccagcccggcggcggcagtgctggagaaccagaggcgggagctggagaagctacgggcggagctggaggcggagcgggcaggctggcgggcggaacggcggcgcttcgctgcccgggagcgccagctgcgtgaggaggccgagcgggagcggcggcagctggctgaccgtctgcgctccaagtgggaggcacagcgcagccgggagttgcggcagctgcaagaggagatgcagcgggaacgcgaggccgagatccggcagctgctgcgctggaaggaggccgagcagcggcagctgcagcagctgctgcaccgggagcgcgatggcgtggtgcgccaagcccgggagctgcagcgccagctggccgaggagctggtgaaccgcggccactgtagccgcccgggggcgtccgaggtttccgcggcgcagtgccgctgtcgcctgcaggaagtgttggcgcagcttcgctggcagactgacggcgagcaggcggcgcgcatccgctatctgcaggcggcgctggaggtggagcgccagctcttcctcaagtacatcctggcgcacttccgcgggcacccggctttgtcgggatcaccggacccccaagctgtgcattccttggaagaaccgctgccccagacctccagcggctcttgccacgcccccaaacccgcctgccaactcggatctctagacagcctgagtgctgaagtcggtgtgcgctcccgctcgctaggcctggtgtcctctgcgtgctccagctccccagacggcctgctctccacgcacgccagctcccttgattgcttcgcacctgcgtgttcccgctcgcttgacagcacccggagcctccccaaggcctccaaatccgaggagcggccctcctcaccagacacctccacccctggctcccggaggctctcgccgccaccatcgccactcccgccgccaccaccaccgtcagcccacaggaaactcagcaacccgcggggaggagaaggctctgagagccagccctgcgaagtcctgactccctcacccccgggcctgggccaccacgagctgataaagctgaactggctgctggccaaggcgttgtgggtgctggcgcgccgctgttataccctgcaagaggagaacaagcagctgcggcgtgcaggctgcccctaccaggcagacgagaaggtgaagcggctcaaggtaaagcgcgcggagctgaccgggctcgcgcggcgcctagctgaccgcgcccgcgagctgcaggagaccaacctccgggccgtgagcgcgcctatacccggcgagagttgcgccggcctggagctgtgccaagtctttgcccgccagcgcgctcgggacctgtcggagcaggcgagcgcgccgctggccaaggacaagcagatcgaagagctgcggcaggagtgccacctcctgcaggcgcgtgtcgcctcgggtccctgcagcgacctgcatactggaaggggcggcccctgcacccagtggctcaacgtcagagacttagaccgcctgcagcgcgagtcccagcgggaagtgctgcgcctgcagaggcagttgatgcttcagcagggcaacggtggcgcttggcccgaggcgggcggccagagcgcaacctgcgaggaggtgcgacggcagatgctggcgctggagcgcgagctggaccagcggcggcgcgagtgccaggagctgggcacgcaggcggccccggcgcggcgacgtggcgaggaggccgagacacagctgcaggcggcgctgctcaaaaacgcctggctggcggaggagaatgggcggctgcaggccaagaccgactgggtgcggaaggtggaggctgagaatagcgaagtgcgcggccacctgggccgcgcgtgtcaagagcgcgatgcctccggcttgatcgccgaacagctgctgcagcaggcggcgcgcgggcaggacaggcagcagcagctgcaacgcgacccgcagaaggccctgtgtgacctccatccttcctggaaggagatacaggcgctccagtgtcggcctggtcaccctcctgaacagccctgggagaccagtcaaatgccggagtcccaagttaaaggtagcagaaggcccaagttccacgcacggcctgaagactacgcagtgtcacagcccaacagagacatacaggagaaaagggaagcctccctcgaggagagcccagttgcccttggggagtcagccagtgtcccccaagtttcagagacagtccctgccagccaacctctgtccaagaaaaccagctcccagtcaaactcctcctctgaggggtcgatgtgggccaccgtgccgtcctcccctactctggacagggacacagccagtgaggtggatgacctggagcctgacagcgtgtccctggccctggaaatggggggctcggcggctcctgctgcccccaagctcaagatcttcatggctcagtataactacaacccatttgaggggcccaatgatcaccctgagggtgagctgcccctcacagctggggactacatatatatcttcggggacatggatgaggatggcttctatgagggggagcttgacgatggccggcgggggctggtgccctccaacttcgtggagcagattccggacagctacatcccaggctgcctgcctgccaaatcccctgatcttggccccagtcaactcccagcggggcaggatgaagctctggaggaagacagcttattatctgggaaagcccagggaatggtggacagagggctgtgccagatggtcagggtgggctccaagacagaagtagcaacagagatcctggataccaagacggaagcctgccagctgggcttgctgcagagcatggggaagcagggcctctccagaccccttctggggaccaaaggggtgctccgtatggctcccatgcagctacacctgcagaatgtcacagccacatcagccaacatcacctgggtctacagcagccaccgccacccccatgtggtatatcttgatgaccgagagcatgccctgaccccagcgggcgtgagctgctacaccttccagggcctgtgccccggcacgcactaccgggtgcgggtggaggtgcggctgccatgggacttgctgcaggtgtattggggaactatgtcctccaccgtcaccttcgacacactcttggcaggacctccctacccaccgctggatgtgctggtggagcgccatgcctcgccaggtgtcctggtggtcagctggctccctgtgaccattgactcagctgggtcctccaatggagtccaggtcaccggttatgctgtgtatgcagatgggcttaaggtttgtgaggtcgccgatgccactgctgggagcaccgtattggaattctcccagctacaggtgcccctcacgtggcagaaggtctcagtgagaaccatgtcactctgtggtgagtccctggattcagtgcctgctcagatccccgaggacttcttcatgtgtcaccgatggccagagactccaccctttagctacacttgtggcgacccatccacctacagagtcaccttccccgtctgcccccagaagctgtcactggctcctccgagtgccaaggccagcccccacaaccctggaagctgcggggagccccaggccaagttcctagaagcattctttgaagaacccccaaggaggcaatccccagtgtccaacctgggctcagaaggagaatgtccgagttcaggggctggcagccaagcccaggagcttgcagaggcctgggagggctgtagaaaggacctgctctttcagaagagtccccagaaccacaggccaccttcagtcagtgaccagcctggggagaaggaaaattgctaccagcacatgggcaccagcaaaagccctgctccaggattcatccatctacgcaccgagtgtgggcccaggaaagaaccgtgtcaggaaaaggctgcccttgagagggtacttcggcaaaagcaagatgcccaagggttcacacctccccagctgggcgccagccaacagtatgcatctgacttccataacgttttgaaggaggagcaggaggcactgtgcttggatctgcggggcacagagaggcgagaggagaggagggagcctgagccccacagcaggcaaggacaagctctgggggtgaagagagggtgccagctccatgagcccagctcggcactgtgtccagctccatccgccaaagtcatcaagatgcccaggggtggcccccaacagctggggacgggggccaacactccagccagggtctttgtggccctctctgattacaaccccctggtgatgtctgccaacctcaaggctgcagaggaggagctggtcttccagaaaaggcagttgctaagagtgtggggctctcaggacacccatgatttctacctcagcgagtgcaacaggcaagtgggcaatatccccgggcgcctagtggctgagatggaggtggggacagagcagactgataggaggtggcgttctccggcccaagggcacctgccttctgtggcccacctcgaggactttcaggggctcatcatcccccagggttcctccctggtgctccaggggaactccaagagactcccactgtggactccaaagatcatgatagcagctctggactatgatcctggggatgggcaaatggggggccaggggaagggcaggctggcgctgagggcaggagacgtggtcatggtttacgggcccatggatgaccaaggattctattatggagagttgggcggccacaggggcctggttcctgcccacctgctggatcacatgtccctccatggacactgagcaagcatccttgcccaggtagtggcctctggctgctcacaccctgccagaggagaagcaagcgttcagaccctcacaccagcacccctcctcaccaccataagtagcatgtgctccaagtgccactgtgttaaactgatggtagtccttaagtgtcccctaggctctgaaagtagcaggacttaagcctgagttatttgcaaaagcaaacacaacaagccaacccctgagagtctgagaagccatttcaaagttgctgataactatggcaggtatacggagaagcgcctttttctgtggccaatgtgtgttttctctgggaggttaaggttatctgtccattgccttgtacgaaagtctcaagaaaagtctacatcttaaaaaagaaaaagcaatctgagtgttatttttgggatgtgagggtgatctggctgcgacatgtgtcaccccattgatcatcagggttgattcggctgatctggctgactaggcgggtatccccttcctcccgcaccactccatgtgcgtccctccagaagctgtgcgctcaatggaagaggatgaccatccccgatagaggacgatcggtcttcagtcaagagtataagagtagctgcgctcccctgctagaacctccaaacgagctctcagaatgttatttttctgtcttatgtccaacccctcattaaaatgt

SEQ ID NO: 61839 - DNA, 1208 bp, Homo sapiens
ctgccccatacctctactggagctttcaatagtagtaaaggaaatgtgaaatctcttaggccaagaagaacaacctgaggactctctttctggaggtaattgaactcctttagtaaatccagaggagaaatctgagatcagtacatcttttgtatctatgatagctaaggatacatcacttgaaagattcactgtactaactactttcttcagcatttgactcttggtccttgtgttgtgagctccttgttcctgcaaagctggctggggtcaccatagtgggtcaaaaaaaaattcatcaatgaaaaagatagggaatctccaatctctatcccaagacatgttctcgatgacttgagcacatcacacatcagcagatgctcaggatacagaagagagatttcatctacgggaaaaagaccctctgaaaagaagtgtgaaatcatcaaaagagccattggaggggacaccagagagtcgtgtggctgaggtttcacatgatcccgccatgcttccagtccagaggagaaagctagacccactcctcaaaaagtataggcatcataagaaggccacaaggacaaaaagaaggaggaaggagaaaatggaggcccagtgctcccctgttcctccaacaccttcaacaccaccacaaagtgaagaagatgaggctgtagacaaaaagccaactctactcagtgcccaggaagatactcctgaccttctccatgaggacagattacagtatctgcaggaagagggttccggtgtgatgcatcaggaatgtcagatccagtcctgtgagctctcggtggctcagaagcccaggccctcttctcctgcagtgacatccttggcatcaccaccactctgctttggcagtttcctaagctgtgtctgccagaccttctcaaggtctaggaagcagaagcctcccagaagaaagggtaacaaccaggctgaggcaggaggtgatgctgaggtcctgagacctggcccggcaaaaccagagttgagcctcagcaaaacgtgtagccacttgaaatcgatagagctttcctttgtgtttagttttatagttctctctgtatgtcattgttcctcttagttgagtttttgcctgtcaaagagatagagagctgcttttatgctgagatcctcaagccaaaacccacagtaaacgcaaagtaaaactttgaggctttgaa

SEQ ID NO: 61840 - DNA, 1453 bp, Homo sapiens
aaactagccttgctgagagattctttgtctcagtgttgatttttgcaacaccgagcactagttcccaacaatttggtggcccgtatggggaataacattcccctcttggatggtgtttgcccctctctcatggggaggtgccctgccacccgttgttgccgcggccccagcaggagagccgggacctacctggtgtgaggaatatacttggagtctcagcatcggcggggaaagagagaggcttgtgggaccgtggtgaccaggtgactccgtgcgtgggccaaggaaatgtgaaatctcttaggccaagaagaacaacctgaggactctctttctggaggtaattgaactcctttagtaaatccagaggagaaatctgagatcagtacatcttttgtatctatgatagctaaggatacatcacttgaaagattcactgtactaactactttcttcagcatttgactcttggtccttgtgttgtgagctccttgttcctgcaaagctggctggggtcaccatagtgggtcaaaaaaaaattcatcaatgaaaaagatagggaatctccaatctctatcccaagacatgttctcgatgacttgagcacatcacacatcagcagatgctcaggatacagaagagagatttcatctacgggaaaaagaccctctgaaaagaagtgtgaaatcatcaaaagagccattggaggggacaccagagagtcgtgtggctgaggtttcacatgatcccgccatgcttccagtccagaggagaaagctagacccactcctcaaaaagtataggcatcataagaaggccacaaggacaaaaagaaggaggaaggagaaaatggaggcccagtgctcccctgttcctccaacaccttcaacaccaccacaaagtgaagaagatgaggctgtagacaaaaagccaactctactcagtgcccaggaagatactcctgaccttctccatgaggacagattacagtatctgcaggaagagggttccggtgtgatgcatcaggaatgtcagatccagtcctgtgagctctcggtggctcagaagcccaggccctcttctcctgcagtgacatccttggcatcaccaccactctgctttggcagtttcctaagctgtgtctgccagaccttctcaaggtctaggaagcagaagcctcccagaagaaagggtaacaaccaggctgaggcaggaggtgatgctgaggtcctgagacctggcccggcaaaaccagagttgagcctcagcaaaacgtgtagccacttgaaatcgatagagctttcctttgtgtttagttttatagttctctctgtatgtcattgttcctcttagttgagtttttgcctgtcaaagagatagagagctgcttttatgctgagatcctcaagccaaaacccacagtaaacgcaaagtaaaactttgaggctttgaa

SEQ ID NO: 61841 - DNA, 2955 bp, Homo sapiens
cattatgtgagagcagatgaaaccaaagccttgggcccacacagcaaacctttgggtagcaacgagttctagaaaaatggagcctaaggagtccagattgtttttccttgaaataccaagcaagtctaaaatgattactacccatgagatatatttttaatgatgttaggtttgggggtgtgttagattgttttgcattgctataaatgaatacctgaggctgagtaatttgtaaagaaaagaggtttatttggctcacatttctgcctggcagtggctatagttggcttctagtgaggcttcaggaagcttttactcatggtagaaggcaaggggggggcaggcatgtcacatagcaagaggaggagtgagagagagaaggaggtgccaggctcctttaaattgtaaactaacagcaagaactcactcattcccatgaggaagggaccaggccattcatgagggatcctccctcatgacccaaacacccccgactaggccctacctccaattctgaggatcacattccaacataagattcagagagtgaaaacattcaaagtctaccaggaggtgattaaagtgatatgacaatgtgaggtatatgttacctggaaggtagtaggagcagatggtgggaagaagaaaagtgtagcaactacccagtcctctgcatgaaagagccctccctcaagagcttggaagcaacacaaaatggggagtagaccaggtctactatcagcacagagataagagactctgaacagagaagacggatccaagggggacagcctggagtcgggggacccagctggaggccagcacagttgcctgggcgagaggtgagccctccctcctggagaggtgagcccttcagaggaagagatgagaaacggaaacccctgactcattaccatcggccttggcttgctgttccattggcagccctttctacctgtgatcaacacatgcctatctagcagcatactaactctgtctctcattctagagcacgcatccgcccagagttaataagttttagaatgtcggcgtcctgtcattgcatcatccacagattcagtgaccagagaggaagaaacacagggaagctttatattaataaaggtcttgcgttgaatattcctaagcaactgtcaaaagtaagcagttcgtatgcttcttttctggtgacaataatagactgggccccatcccttcccagagctcccgataagcaactggatccagtctccactccagaacctgaatggactttttgctcaatacagctactgctggccagtcagcttcatgggacatgtgccaagaggtcttccattccatcttgagtaaacaaattagagtcctagcaaaaactcttcccatgagccctttaactgacctaaattcaacatatgtcataatctaggaggaagcaccaaaatggaaaactactttaattcacagaagctaaaggagcaattgtaatgtaagtggtttctacaaagtatatatgcaggatcagcaagcatgggaaacgcacaccagcccctgcagggattctgggctacgagtgcatgaaggcagagtcgagactgtggattctggaagaagaatccccttgagagagcatctgattcaaaattcatccatatatgacttaaaagccacccaggttgtcatatcatctgtaatgattattcactagagccaagagtgtttatattctgaagatcagaacaagattcccaacaaaacagaaactaaggttctcagcatgtccatggaggcggattacatggatcaggctgttctctggagcggtagttgtttatctccgtctgccttctctctcaccgaagtgtatgtcaccaccccaaggaagattcaatggacatggacacaagccccctgtggctccagaactatcttttggttgtgaactaaaggccgatgaagatgatcggtttcgggtggataatgatgaaaatgagcaccagttatctttaagcacggtcaggttaggggctgtgtaaaagatgaattgcacattgttgaagcagaggcaatgaattatgaaggcagtcctattgaagtaacactggcaactttgaaaatgtcagtacagtcaacggtttcccttgggggctttgaaataacatcagccgtgggattacagttgaagtgtggatcaaggccaatgcatattagtgggcagcacttagcagctgtggagggagaggcagagtcagaagatgaagagcagggggatgtgaaactcttaggtatttaatatatctggaaggcaatcttcccctggaggtagcagcaagtttccacagaaaaaaaagtaaaacttgctgctgatgaagatgatgatgatgataattttgatgatgaagaaattgaagaaaaagctccagtgaagaaatctatataagatgctccagccaaaaatgcaccaaaatcaaaccaaaatggaaaaactcaaaactatcaagaccaagatcaaaaggtcatgaatacttcaaaaaaaacaggaaaaaactcctaaaaatccaaaaaggacctagttctatagaagacattaaagctaaaatgcaagcaagtacagaaaaagcacattgaacagtcctgggcaatactgcaaaattaagtccaaagatggggacagaggaaagagaaatatagtccatgctgagtatcatcagccatccagactgaagtcttctgttttaatctgaatccccttttctgatttgccagccatgctccttccaggctggaaacgaactcactcttcatgtcctaaagcactttcttttgacagctgtgattctgtgaacctagccccttgctttctgttacttgcacatttgcctcacctctctgaccatgttttaatcacctttgggtctccttggctgctcaataaatatttgaatgaatcaaaaa

SEQ ID NO: 61842 - DNA, 2955 bp, Homo sapiens; identical to SEQ ID NO: 61841

SEQ ID NO: 61843 - DNA, 2037 bp, Homo sapiens
gcggagttcctttacagaatcaaccctggggtggctttaggactgggctctttggagctcatccttggacccacagtggagcgctggtctgtgctaacatcttcagataccaatcaatgggcatttggctccttgcttccactgacctcttgagtactttcaacgatcggtgtcaagggtgcccctgctgctgtttctagagcatctctgcaacccacggtggcctctcctctttctgcgggccatggacagcacagtcccttcagccctggagctgccccagcggctggcactgaacccaagggagagcccaaggagtccggaagaggaggagccccacctgctgagcagcttggctgcagtccagaccctggccaatgtcatccggccttgctatggcccccatggccggcagaagttcctggtgaccatgaaaggagaaacagtgtgcacggggtgtgccactgccatcctcagggccctggagctggagcacccagcggcatggctcctccgggaagcagcccaaacccaagcagagaatagtggggatggcacagccttcgtggttctgctgacggaagccttgctggaacaggcagagcagctgctgaagttcggcctgcctcgcccgcagctccgggaggcctacgccacagccactgcagaggtcctggccacactgccctccctggccatccaatctctggggcctttggaagatccgtcctgggccctccattctgtgatgaatacccacaccctgccccccatgaaccacttgaccaagctggtggcccacgcctgctgggctatcaaggagctagacggcagcttcaagcctgagcgtgttggggtgtgcacgctgcacggggggacactggaggattcctgcctcctccaggggttagcaatatctgggaagctctgtgggcaaatggccgcagtgttaagtggtgccagggtggctctctttgcttgcccctttggtcctgcccatccaaatgcaccagcaacggcctgtctttctagtcctgctgatctagctcaatttagtaaaggaagtgaccaattactagaaaagcaagtaggccagctggcagccgcgggaattaatgtggcagtggtgttgggggaggtcgacgaggagaccctcacactggcggacaagtatggcatcgtggtgattcaggctaggtctcggatggagatcatttacctgagtgaggtgttggacacaccgctgctgcctcgtctgctccctccccagaggccaggcaagtgccagagggtttacaggcaggagctgggagatggtttggctgtggtatttgaatgggaatgtacaggcacacctgccctcaccgtggttctcaggggagccaccacccaggggctgcggagtgcagagcaggccgtctaccacagcattgatgcctatttccagccatgtcaagatcccagactgatcccaggagctggggccacagaaatggctttggcaaaaatgctctctgataaaggaagcagattggaagggcccaatgggcctgcattcctagcatttgcccgggccctgaagtatcttcctaaaaccttggcagagaatgcaggcttagctgtctcagacgtggttgcagaaatgagtggagtgcaccaaggtgggaacctcctaatgggtgtgggagctgaagggataataaatgtggcccaggaaggggtgtgggacaccctaatagtcaaagcccaaggatttcgagcagtggctgaggtggtgctacagctcgtgactgtagatgaaatcgtagtggccaagaaaagtcccacacatcagcagatctggaatcctgactctaagaagacaaagaaacgcccacctcctgtggaaaaaaaaaaaatccttggaatgaataactagtgataccctcaataaaacagggattgccaagaagggaacaatcaccccaaaaatgaatgtttgcctttattccatgtttggtacttgattcagtttctttaaataaaaacatgaaggaa

SEQ ID NO: 61844 - DNA, 2194 bp, Homo sapiens
atgacggtcctgtggtatttcctgcacccccagagtcccagaccatttcagggaggggctacccaggaccaggcttttgatgaaccacgactgttcggggtgccgtcttgggagagccacgtcagtccctctgagattccaaacggccgacagcggacacctcgggaccacatccaagcctcggggacctgtcaagacgccatcgacggtcctggaccaaatcccgcccgggaagggaaggcggagcgggaggccggaccggggagccgagcggcggcgtcggcggcgtcggcggcggcggcgacggcggcgggggcggtaatggcggagctggtgcaggggcagagcgctcctgtggggatgaaggccgagggcttcgtggatgccctgcaccgggtccggcagaaagccacaggagtcattgtattagaagaaggtcttcactcgggcgcttgaagatatggtctttacatctctttccagtattccaggggagggaaccctacctgtttccctgataactgacttttcatgttatatattgatgctcctatagacattatattggatcccagaactttccaaacctgtggttccacctaaaattttatctgatgaattgttactttactgcctagctgccaaccagtacagtagtgagtatccatcttacttagacttcagatccacccatggctgtaatggatgaacatgccacccagctccccttccaccactctgcttgctggcgtgttacagtgctctcctctacagtacagggtcctgaaccttgtttctcactggctactaatatgtaatggctttcgctctgtgctgatgtgtgacagtcaccttgttggccttctatgtccgggaagaattatagtcactgccctaaagggctcagatcctcagtttgcagaaggcctgtagttgaacataaagtgaattttgaaccattgagaagacattccgcttctcttgagccagtggttgaactcatattcttggacaacctgctccagagggagaccctctggtaaatgctgacctaatgtggattgttgaagcagtggtgtttactactagcagtgaaaacttcattggaattgttctcagctctgaaatgcaccattgactggagcagtaataagcccaatggagacagggctgtaagtgtgttccttctgaatgttaacagctggaggtccatactatctccaaggatttgatggcctttaaaaactaaagaaaaaccaggttggtgggtaattttaggtttattgtatatagatttgcattgggcaagaacggaatgttagaaatctgtaatactgtatgctgatggtaaacttactgtaaggatctcatttgggtatctggaaggtgatagttctgtttctttgttatatacacagcatgttacagagatgtgatttttctccccattaaacagaactaaaagacagtatatttatttaaacgcaaagctttttccccttttatgtctcctcataaactccagagacagtctggaaggccctcttaaatttgtcaaagagcagtaaagtgtctcacgctcagtttttctagcagatcgtaatactctcagttgaccctgctgggatttgaacctgcagtttctattaagtttggtgtgtgaagtccaacaccttatcaactaggctttccctctgacatcttgaagcctccgtgtatatcctttggactctgcagcaaagtgcatcagttgttagtttactctgagcatggtattcttagattgaaaagaagtctctgaagatgtcaaataaaatgtaaacattttctccagcagtgtgaagtctagtgagttaatgtttggcacaagcaggtaatttacatccattctatagggtagtagaaatgtgatctgggcaagtcacagtggctcatgcttgtaatctcagcactttgggaggctgaggtaggaggatggcttgagctcaggggtttgataccagcctgggcaacatagcgagaccttgtctctactaaaaattaaaaaaattagctggatgtggtggcccacccctgcagtctcagctgtttgggaggctgaagcaagaggctagcttgagcatggagatcaaggctgcagtgagctgtgattgctccgctgcattccagcctgagtgacagagtgagacactgt

SEQ ID NO: 61845 - DNA, 2263 bp, Homo sapiens
atgacggtcctgtggtatttcctgcacccccagagtcccagaccatttcagggaggggctacccaggaccaggcttttgatgaaccacgactgttcggggtgccgtcttgggagagccacgtcagtccctctgagattccaaacggccgacagcggacacctcgggaccacatccaagcctcggggacctgtcaagacgccatcgacggtcctggaccaaatcccgcccgggaagggaagggtcgcgaccggaccctggagacccacggctgcctgggcgactttccttttccggctacgggtccccaagcggagcgggaggccggaccggggagccgagcggcggcgtcggcggcgtcggcggcggcggcgacggcggcgggggcggtaatggcggagctggtgcaggggcagagcgctcctgtggggatgaaggccgagggcttcgtggatgccctgcaccgggtccggcagaaagccacaggagtcattgtattagaagaaggtcttcactcgggcgcttgaagatatggtctttacatctctttccagtattccaggggagggaaccctacctgtttccctgataactgacttttcatgttatatattgatgctcctatagacattatattggatcccagaactttccaaacctgtggttccacctaaaattttatctgatgaattgttactttactgcctagctgccaaccagtacagtagtgagtatccatcttacttagacttcagatccacccatggctgtaatggatgaacatgccacccagctccccttccaccactctgcttgctggcgtgttacagtgctctcctctacagtacagggtcctgaaccttgtttctcactggctactaatatgtaatggctttcgctctgtgctgatgtgtgacagtcaccttgttggccttctatgtccgggaagaattatagtcactgccctaaagggctcagatcctcagtttgcagaaggcctgtagttgaacataaagtgaattttgaaccattgagaagacattccgcttctcttgagccagtggttgaactcatattcttggacaacctgctccagagggagaccctctggtaaatgctgacctaatgtggattgttgaagcagtggtgtttactactagcagtgaaaacttcattggaattgttctcagctctgaaatgcaccattgactggagcagtaataagcccaatggagacagggctgtaagtgtgttccttctgaatgttaacagctggaggtccatactatctccaaggatttgatggcctttaaaaactaaagaaaaaccaggttggtgggtaattttaggtttattgtatatagatttgcattgggcaagaacggaatgttagaaatctgtaatactgtatgctgatggtaaacttactgtaaggatctcatttgggtatctggaaggtgatagttctgtttctttgttatatacacagcatgttacagagatgtgatttttctccccattaaacagaactaaaagacagtatatttatttaaacgcaaagctttttccccttttatgtctcctcataaactccagagacagtctggaaggccctcttaaatttgtcaaagagcagtaaagtgtctcacgctcagtttttctagcagatcgtaatactctcagttgaccctgctgggatttgaacctgcagtttctattaagtttggtgtgtgaagtccaacaccttatcaactaggctttccctctgacatcttgaagcctccgtgtatatcctttggactctgcagcaaagtgcatcagttgttagtttactctgagcatggtattcttagattgaaaagaagtctctgaagatgtcaaataaaatgtaaacattttctccagcagtgtgaagtctagtgagttaatgtttggcacaagcaggtaatttacatccattctatagggtagtagaaatgtgatctgggcaagtcacagtggctcatgcttgtaatctcagcactttgggaggctgaggtaggaggatggcttgagctcaggggtttgataccagcctgggcaacatagcgagaccttgtctctactaaaaattaaaaaaattagctggatgtggtggcccacccctgcagtctcagctgtttgggaggctgaagcaagaggctagcttgagcatggagatcaaggctgcagtgagctgtgattgctccgctgcattccagcctgagtgacagagtgagacactgt

SEQ ID NO: 61846 - DNA, 2283 bp, Homo sapiens
gtgctccccacgtgaaggcacccgccctgcgcgtgtgaaagggcgagagcagcgcgagatacggcctagcgcctcagatcttcgttggcggccatggcttcggcttctcagggcgctgacgacgacggcagtcgtaggaagccccgcctggctgcatcgttgcagatcagcccccagccccgcccctggcgaccgctacccgcccaggcccaaagtgcctgggagcccgcgcccgcgcccgcgacgtatcgcgcggagggcgggtggccccaggtctcggtgttgagggacagtgggcctggggcaggggccggagtcggggaactgggggcagcccgggcgtgggaaaacttgggggaacagatggggaaggccccgagggtccctgtgcccccagcagggctcagcctgccgctcaaagacccacctgccagccaggccgtgtccttgctcacggagtacgcggccagcctgggcatcttcctgctcttccgggaggaccagccaccaggaaaagtgttcaaatatagagcccctggaggagaggaattgaaagcaatgtgtctgtggcaggtggaagtgctcagagccttcctcctgagaacagggtggcgtgggctctggagaggggacctggatttgggtcctgactcaagttgggcaaaccgcctgccgtttctgctcatctgtgaaatggagtcacgcatccctgctgtggaggagttgggtccctgcttccccttctcggtgagcgcggaactggatggggtggtctgccctgcgggcactgcgaatagcaagacggaggccaaacagcaggcagcgctctctgccctctgctacatccggagtcagctggagaacccagagtccccccagacctccagccggcctccactggcccccctgagcgtagagaacatcctgacccatgagcagcgctgcgcagcgttggtgagcgccggctttgacctcctgttggacgagcgctcgccatactgggcctgtaaggggactgtggctggagtcatcctggagaggggctgggccgtctctgccccctcctgcacagagatcccgcgtgccaggggccacgtgaaggagatctacaagctggtggctctgggcaccggcagcagctgctgtgctggctggctggagttctcgggccagcagctccacgactgccatggcctggtcatcgcccgcagggccctgctgaggttcttgttccggcagctcctgctggccacacaggggggccccaagggcaaggagcagtccgtgctggccccccagccagggcccggacccccattcaccctcaagccccgcgtcttcctgcacctctacatcagcaacacccccaagggcgcggcccgtgacatctacctgccccccacctcagaaggtggcctcccgcacagcccacccatgcgcctgcaggcccatgtgctcgggcagctgaagcctgtgtgctacgtggcgccctcgctctgtgacacccacgtgggctgcctgtcagccagcgacaagctggcacgctgggctgtgctggggctgggtggtgccctgctggcccacctggtgtccccactctacagcaccagcctcatcctggctgactcatgccacgaccctccgactctgagcagggccatccacacccggccctgcctggacagtgtcctggggccatgcctgccacctccctacgtccggaccgccctgcacctgtttgcagggcccccggtggccccttccgaacccacccctgacacctgccgtggcctgagcctcaactggagcctgggggaccctggcatcgaggttgtggatgtggccaccgggcgtgtgaaggccaatgccgccctggggcctccctcccgtctctgcaaggcctcctttctccgggcctttcaccaggcggccagggctgtggggaagccctacctcctggccttgaagacctacgaggctgccaaggctgggccctaccaggaggctcgcaggcagctgtctctcctcctggaccagcagggcctgggggcttggccctcgaagccactggtgggcaaattcagaaactgaagccagcctcggcgggaccgaggtcccggagccaagctgtacccctgctgggggagtgccctatctgaggagcgttgtggggagaacatgggttgtgcggggtgaaactggggctggagggaaggaggagcctgctgtggttgggaggcggctgctgcacgtttgggcttgaataaagaagtatttctggtt

SEQ ID NO: 61847 - DNA, 894 bp, Homo sapiens
gtgcggaactcaaaaccgactgcggagagcccagcgggcgggagctggggcgcacgttggggccctgccgaggggcgggcagggcccggtgccagccccggcaccgacgggacgccctcctccctccgcagggcgggaggatgccgccgccagcgaaggagggcgggcgcaagggcccgcgggagcgaagcgggaagagcgcgccaggcacggcgcagggtgaggagcgtgccaagggggcgcccgcgacagagccccccaagccgggctgggccctgacgccgcagggactggcggccatgctccctgcgcagcgccaccgccatctgctcttcggcgacctgctggaggacgtgggcgcggcggcctccaccttcccgtgcgggtcggtggaaccggggtaccgcatgcccgacccgcgcccgtggacgcagtcgctcgagctgcccgccgagcgccagaaccggctcctcggcgtcctcaaggcagcggaggcccgcgggcgagtccgcgccctgcggctgcgctacacccgcatgcgggccgaggagatcgcgctgctcatccagcggcagaagtccgcgcgcgccgccatccggctggagctgttcctgccgccgcagctgaagcccgcgcggatcccggaccccctggaccgccaagaggtgcagacaagccccggtaggggcggggaaaggggaggggccctgcccgcctccgcacacgccggaccccagcctctctccccggcagcggaggcgcgtggagaccatcctggaggagaacgtggatggcaccatcttcccgcggtgacggcgactgagagtgtgcgacgcgccccagcctcccacataaagttataattctcaaaaaaaaaaaaaaaaaaaaaaaaaa

SEQ ID NO: 61848 - DNA, 2023 bp, Homo sapiens
ctcaagggttggatggcggaggctttgtgcttgtgtgttactgaacggacgtttctgggtcctcccattactccttggggaaggagaattgggaagagaagtctgaggcagcaagaactgaaggagccaagcaccggtggatgatggaaggtcagcgaggggctccccggaggagccggggccgcccggtgtccaggggaggtgccggacacaaagccaagagagtcacagggggccggggcggccggcaggggcccagccctgccttccactgtgctctctgtcagctccaggtcaattcagagacccaactgaagcagcacatgagcagcaggaggcacaaagaccgcctggccgggaagacccccaagccctccagccagcacagcaagctgcagaagcacgcagcgctggctgtgagtatcctcaagtctaaactggccttgcagaagcaactcaccaagacgttggcagcccgcttcctgcccagcccgctccccaccgcagccactgccatctgtgctctgccagggcccctggccctccgccctgcccctacagcagccactaccctcttcccggctcccatcctgggcccagctctgtttcgcaccccagcaggagctgtccgccctgctacaggacctatcgtccttgccccttattagccctcatggggaggccagagctgatttcccaatagccactccttgtctcctcctgtcctgagacaccttggtttcctacatgccacagggactgtgaacagcttcaggggtcctgcccgatccagaaagagctgggctagttttaagggcagctgccttccaaggactgtccccaccctcctttcgcaggccttccagggttaatcctaggcttgcctgcatttcccaccctgacagaccccaaagatctatgcaaaatctcagccccagccatgtggtgctctcactttcctccacccaagacccacatggccagactctaggaatcttagcttctacaagccatcctctcctagccaggggacgactctctgacctctattcctaggctttggggcttcactggagatagggatggggtctctagctgcagcaggctcaaggctgtcaggacaaggtgaccatgggagtgtgacagaggaccatggaggagaaagggggacccaaaagtccttcgatcagcagtgctaaggtggggcagagccaaggaggtagtggggctggttctgaaagcttttgggggcttcatctgctctgaaggggtgggactaagagaggaggtgatgttctggttgggcccagggttttgttttaatcttaagtcttctgggcattcatgggcccagtctttttttctgtttgagagtatcattctgttgcccaggttagagtgcagtggtgcaatcttggctcactgcatgcagcctctgcctccctggttcaagtgatacttgctgataagcccagtcttaatattgagggagtaactcatccctcagaagctcttcttcttagcctttctctgacttcctgaaccccaactcttggagggcgggtgtgggtctccctcagactatggactcagctaacaccgaaccccccgcagagctcccaaaggaagagctttcccctacagcttcccactccaaactggtcctagcactaaattcagctttcccttctcccaaccagcccctgccactgtgaagctgagtgttgggaggcagtctcacatgcactggcaagacccattttcatgctgtcaatgtcaatgtcacaaactcctttccactgcagcactgccccctccccaccccacaatatgggaccctgccagtatccccctgtatcttttttttgttttttaaagacatttccaatgggagaaccagaaaaagggggaggggagggaaactttttgataacaattgtggttttattgtgtccaaccaatgcatcaataaatgaacttgaagcccaaaaaaaaaaaaaaaaaaaaaaaaaaaaaaaaaaaa

SEQ ID NO: 61849 - DNA, 657 bp, Homo sapiens
actagctggcgggggcggaagatggcgacgcccctcgggtggtcgaaggcggggtcaggatctgtgtgtctcgctttagatcaactgcgggacgtgattgagtctcaggaggaactaatccaccagctgaggaacgtgatggttctccaggacgaaaattttgtcagtaaagaagagttccaggcagtggagaagaagctggtggaagagaaagctgcccatgccaaaaccaaggtcctcctggccaaggaagaggagaagttacagtttgccctcggagaggtagaggtgctatccaagcagctggagaaagagaagctggcctttgaaaaagcgctctccagtgtcaagagcaaagtccttcaggagtccagcaagaaggaccagctcatcaccaagtgcaatggtaggcgggaggcccgtgctctccaccacggttatataaacgggctctttcctaaccacccagtgcctgtgtcaaaggcagggtttcactctaacacctgtccccagctgaggatacaggcaggcccgggtgggccacaccttcgaaaaggccttaagggaccaggcaggccacggaaatgagggaagcagtcggtgtactatattcttcaccgccataaaggaatgggcttgctcccatttttcctgaaa

SEQ ID NO: 61850 - DNA, 657 bp, Homo sapiens; identical to SEQ ID NO: 61849

SEQ ID NO: 61851 - DNA, 1160 bp, Homo sapiens
atgacggttcaggatggccagagcctcttccaagacaaccccctggggaaatggggtgacctggggagccaggggtcctgggcagctgcccaccaaccctgggttccggaaactctgagtcagtctggctccgtctcctggcaaccagatgcaggggccatggcactcttaacaccccagggagtgaaagaagtcttccaacttcagagaccacaaggtcgggagcgcctgcggaggcttctgaactgggaggagtttgacgaacagagagactcccggaggagcatcctgctggacaccctctacgagagcatcatctttgcagtgggcaaaggcttcccatgggtggaggtggcccaggtggtcaagttcacagaagagctgctaagggaaaccaaaggctgctccattactgaggctgtgacgatcctggggaacaagcttagagattaccggggccatttcaacaccacccacctgctggccctctgtgactacttccaccacaccttcatccgccactacaaactctaccagtatgtcctgggccaggaccagcaggtcgacctgaccgttgcccacctggaggtgtgcatgccaccccatcccctcccgctggccgagggcatggacagggacttgtggatccacgagcagcaggtggccacactgacggaggccgaggcacagaagcgcgccgacgtgctgctcctgaaagaggcgctgcgcctggagcgggagaactcgctgcagaaggcgttcgctgccgccgcgcctgcgcagcccggccaggtcctggagagacaggagttggagagcctcatctgccaggcagtccacacccagatggagctcctgcaggagctgctgcagcgccagatccagaacacattcgccatcttggacctgaagcttcagaagaagactctgaacctcaacgcccccacccctatcccgccccccatcaccagccacgcaggccaggaggaagccctgaagccccaaagagcgagcaaaggaaagaaagcgaaggcaaggaagtagaaggtcccgactgccacacgagactgactggggaccagccacccataaccatgagccttgcggcacggtgagctcagcacccacagagagacttcttgtgattaaaagaaacaaac

SEQ ID NO: 61852 - DNA, 1160 bp, Homo sapiens
atgacggttcaggatggccagagcctcttccaagacaaccccctggggaaatggggtgacctggggagccaggggtcctgggcagctgcccaccaaccctgggttccggaaactctgagtcagtctggctccgtctcctggcaaccagatgcaggggccatggcactcttaacaccccagggagtgaaagaagtcttccaatttcagagaccacaaggtcgggagcgcctgcggaggcttctgaactgggaggagtttgacgaacagagagactcccggaggagcatcctgctggacaccctctacgagagcatcatctttgcagtgggcaaaggcttcccatgggtggaggtggcccaggtggtcaagttcacagaagagctgctaagggaaaccaaaggctgctccattactgaggctgtgacgatcctggggaacaagcttagagattaccggggccatttcaacaccacccacctgctggccctctgtgactacttccaccacaccttcatccgccactacaaactctaccagtatgtcctgggccaggaccagcaggtcgacctgaccgttgcccacctggaggtgtgcatgccaccccatcccctcccgctggccgagggcatggacagggacttgtggatccacgagcagcaggtggccacactgacggaggccgaggcacagaagcgcgccgacgtgctgctcctgaaagaggcgctgcgcctggagcgggagaactcgctgcagaaggcgttcgctgccgccgcgcctgcgcagcccggccaggtcctggagagacaggagttggagagcctcatctgccaggcagtccacacccagatggagctcctgcaggagctgctgcagcgccagatccagaacacattcgccatcttggacctgaagcttcagaagaagactctgaacctcaacgcccccacccctatcccgccccccatcaccagccacgcaggccaggaggaagccctgaagccccaaagagcgagcaaaggaaagaaagcgaaggcaaggaagtagaaggtcccgactgccacacgagactgactggggaccagccacccataaccatgagccttgcggcacggtgagctcagcacccacagagagacttcttgtgattaaaagaaacaaac

SEQ ID NO: 61853 - DNA, 3125 bp, Homo sapiens
agcgggacgccgagagcccggcaacacctcagcccgagcccggcgaggtctctgggctcctggagcgagagaggtggcatctcactacgtggcctaggctgatctccctctcctggactcacatgatcctcccaccttggcccttcaacgtgctgagatcgcaggtgtgagccaccacacccggccctgataaaactcatcagtgctttgaaacaagcagctctgaaccaaagaaatcatttgattcaagtaaccattggatcttcccaaggcaatggtgaaagaaaagaaaaaagcagacaaaaaaggggagaagtctgcccgctctccctcatctctctctgataatctagacttttccaaacaagatggcaacaccactaggcaagagatgtccccagctggtgtcccattgctgggaatgcagctcaacgaagtgaaacccaaaaaagaccgccaaaacgttcagcagaacgaagatgccagccaatacgaagagtccattctgaccaaactcatagtggaaagctatgaaggggaaaaggttcgtgggctgtatgagggagaaggcttcgcggcctttcaaggcggttgtacctatcgtggtatgttttcagaaggactcatgcatggacaggggacttatatttgggccgatggattaaaatatgagggcgactttgtgaagaatgtcccgatgaaccacggcgtgtacacgtggccggacggcagcatgtatgaaggcgaagtggtcaacggcatgaggaacggattcgggatgttcaagtgcagcacccagcctgtgtcctacatcggccactggtgcaatggcaagcggcacgggaagggctccatttattacaatcaagagggtacgtgttggtacgagggagactgggtacaaaacatcaaaaagggctggggaataagatgttataaatctggaaatatatacgaaggccagtgggaagacaacatgcgccacggggaggggaggatgaggtggctgaccaccaacgaagagtacaccgggcggtgggagaggggcatccagaatggctttggaacacacacatggtttctaaagagaatccgcagttcccagtatcctttgagaaatgaatacataggggagtttgtaaatggatatcgtcacggacgtggcaagttttattatgccagtggagccatgtatgatggagaatgggtttccaataagaaacatggcatgggccgattaactttcaagaacgggcgtgtgtacgaaggcgcattctccaatgaccacatagctgggtttccggatcttgaagttgaattcatcagctgcctggacctgtcttcaggagttgccccaagactgtccaggagcgccgaactgatcagaaagcttgatggcagtgaaagtcattctgtgttgggatcgagcattgagctggatctaaatttgctcctggacatgtaccctgagacagtccaacctgaagaaaagaagcaggtggaatatgccgtcttaagaaatattacagaattaagaagaatctacagcttttacagcagcctgggatgcggccactctctggataatacctttctgatgacaaagcttcacttctggagatttctaaaagattgcaaatttcatcaccacaaactaactcttgctgatatggacaggatattaagtgccaataatgacataccagttgaagaaatccattctccatttacaacaatacttttgagaacatttttgaattacctcctgcatttggcgtaccacatttatcatgaagaattccaaaagagaagcccatccctcttcttgtgttttacaaaactgatgaccgagaacattcgtccaaatgcctgccagataaaaggcaatttattccgtgagcaacagcggacgctctactctataagttacatgaataagtgctgggagatttatctcgcttactgcagacccagcgcagcgcctccccacgagcctacgatgaagatgagacacttcctctggatgctgaaagactttaaaatgataaataaagaattaacagcagctacatttatggaggtcatagcagaggataatcgtttcatatatgatggaattgacagcaactttgaacctgagctggttttcctggaattctttgaagctctcttaagctttgcattcatctgtgttactgaccaaatgactaaatcctatacaaatgttccagctgatgatgtgtctggaaataaacatgaaactatttatacaatactaaatcaggacgcccagaacaagagtcccagcgcggtcatgagccacgaatcggatgctgctcactctgacagtgccaggtcatcttccagcaagttagaactctcgcctgatgttaacaaaataaggaaatcagagcccaagatcaagaagtctgtaagtcatgaaagagtctccaaaatgaattttaaattgactggaaaagggatcacctttttctcatctgagagcaagaaatatgagagacccaaggatgatcgagaggaagagttcaacacgtgggtcaataatatgtacgtcttctttgtgaacacgctctttcatgcgtataaacgtgaagaagctatcaaggagaaaataagggcagacaggttacgtagcacagcacaggcccagcagcggaagatggaagatgacgaactggaagcaaggctgaacatcttcatcttgagagaggaagaggccaagagacatgactatgaggtggacatcacagtgctcaagaagccggcagacgtgtcatcctctcacctcatactggaccctcccaaggaggatgtgaccgtgtccccatccagcaagaccatcaccagcaagaagaagaaaaagtagagagacacgaggacacacacacaggcttaggatggcacgtgctgtaagatttcctgagcattacagttcttagcactgaactcgtcacagtgttttaacataccccttggcccactgcatctcaggtttcctacatggctggattacgggagttcgagaccagcctgggcaacatagtgagacccccccatctctgcaaaattaaaacatcagccgaccgtgaaaaaaaaaaaaaaaa

SEQ ID NO: 61854 - DNA, 1917 bp, Homo sapiens
atggcggctctggcggttctagcaccggaggcggcttcttggacacccggcgttcgcgggagcctgaggcgctcggttgctagagccttagctgggagtggcgcggctgcttcccgcccgcgcaggatcaggccggcccccgcgggcctggagctggatccagagctagggaaactggaaaaacaggcacaaactcggaagccgcggtacggcaagagcctaagcaaagaatcctttccaagattcacacctcgtctacaccagggcaccgcctgggcctacggccttccgaacccgaagcgcccgcagcccagagctggcatcaggccatcaggccgggaaggtcgtcgcaggccccagagtgcgggcgcggggggcgcgcgcccacaggacgcccggggttgggtaggcaggagagaagggcgccagcaggcccgcggctgtttcccctcggtccgcacagcgggcccgggaggccattttgagagcgcgaagaggggcggcaagatggctgcgtgggcacccggaaggtcgccgcgccaagggcccgctgagcccctcctcccattcgtccagccgcgcggcccacagaagcggaacgcgcgtcgagagcgccctgtccgctcgccccagacagatgcccggttattcattaccgcgaggcctagaggaaagagtggctgccgtcttcctgcccacagcccgccggaccctccgtcgcggctgcccggtccccggagccgcagccgccgagcccggctgtgcgtgtcgtggctgctggggagaaagaggcttccggacatgctctggagtcagaagacagcgaaaagagaagcagaagccccggtggcaagagtctgaagcaggaaggatgactgtagcctgtggattgtactgcagtaggaaactgtcctagcaaggctccactttgccccagcttcaagctggaaaggaggagaacatgaaacattgcttgaagacaatggccgagacagcaggtcccaccctgcacagccaccagcatctctcccctcagccctgtctcctcttctgcagttgggatctgcacatttaagcctgaaattgtcctgtgaagtgaagtatgatcggacagcctcttttcagcttttatgacaatggagacagaggaattgtggctcttgccaaggtcacaggattggaatacagagccaagccaccccaggacatgcaagagcctcagaagggaaaaaagcccagcaggaagggagaacaagtagcctctgtcctgaagttgtaacagccaggggccaggatggaggaggaggaccccataatctgcccatctgggacttggcaggggacctgggaaaatgtaccccaacccatcccttaagggcctttgtctttggcccattggcctagcatctacttcttcaccgtgtctgttcttgtcacacctagtcaggtctgtttgggtctgaggtgcatggaacattctgggtaggcctccagcaaacggaagctcttcaccgtgtttccagcctgggaccaagggcagcatactggcaaagttgccaaagcaagggactccagcctcttaggagttaatgactccctctccccagctgtcctccccttggtgctcctcttcctccctcctcctgctcacagcaggcagggcctagacccgggagccatgctgctgtgctgttgccaggggagcacggaggcagatctgagctatgcagggaaaaggcccagcctgtcaaagtgtctgagatgaaccgccgccgtccctgtgcagctgggctcagacgtgtctcagctcttgttctgtgcctgagaatggcgaaacccagtgaggttcaagggcaaactcgctattcattagtcaggggttcttgacgtcccgtctctcccagggatgagttcccc

SEQ ID NO: 61855 - DNA, 1917 bp, Homo sapiens
atggcggctctggcggttctagcaccggaggcggcttcttggacacccggcgttcgcgggagcctgaggcgctcggttgctagagccttagctgggagtggcgcggctgcttcccgcccgcgcaggatcaggccggcccccgcgggcctggagctggatccagagctagggaaactggaaaaacaggcacaaactcggaagccgcggtacggcaagagcctaagcaaagaatcctttccaagattcacacctcgtctacaccagggcaccgcctgggcctacggccttccgaacccgaagcgcccgcagcccagagctggcatcaggccatcaggccgggaaggtcgtcgcaggccccagagtgcgggcgcggggggcgcgcgcccacaggacgcccggggttgggtaggcaggagagaagggcgccagcaggcccgcggctgtttcccctcggtccgcacagcgggcccgggaggccattttgagagcgcgaagaggggcggcaagatggctgcgtgggcacccggaaggtcgccgcgccaagggcccgctgagcccctcctcccattcgtccagccgcgcggcccacagaagcggaacgcgcgtcgagagcgccctgtccgctcgccccagacagatgcccggttattcattaccgcgaggcctagaggaaagagtggctgccgtcttcctgcccacagcccgccggaccctccgtcgcggctgcccggtccccggagccgcagccgccgagcccggctgtgcgtgtcgtggctgctggggagaaagaggcttccggacatgctctggagtcagaagacagcgaaaagagaagcagaagccccggtggcaagagtctgaagcaggaaggatgactgtagcctgtggattgtactgcagtaggaaactgtcctagcaaggctccactttgccccagcttcaagctggaaaggaggagaacatgaaacattgcttgaagacaatggccgagacagcaggtcccaccctgcacagccaccagcatctctcccctcagccctgtctcctcttctgcagttgggatctgcacatttaagcctgaaattgtcctgtgaagtgaagtatgatcggacagcctcttttcagcttttatgacaatggagacagaggaattgtggctcttgccaaggtcacaggattggaatacagagccaagccaccccaggacatgcaagagcctcagaagggaaaaaagcccagcaggaagggagaacaagtagcctctgtcctgaagttgtaacagccaggggccaggatggaggaggaggaccccataatctgcccatctgggacttggcaggggacctgggaaaatgtaccccaacccatcccttaagggcctttgtctttggcccattggcctagcatctccttcttcaccgtgtctgttcttgtcacacctagtcaggtctgtttgggtctgaggtgcatggaacattctgggtaggcctccagcaaacggaagctcttcaccgtgtttccagcctgggaccaagggcagcatactggcaaagttgccaaagcaagggactccagcctcttaggagttaatgactccctctccccagctgtcctccccttggtgctcctcttcctccctcctcctgctcacagcaggcagggcctagacccgggagccatgctgctgtgctgttgccaggggagcacggaggcagatctgagctatgcagggaaaaggcccagcctgtcaaagtgtctgagatgaaccgccgccgtccctgtgcagctgggctcagacgtgtctcagctcttgttctgtgcctgagaatggcgaaacccagtgaggttcaagggcaaactcgctattcattagtcaggggttcttgacgtcccgtctctcccagggatgagttcccc

SEQ ID NO: 61856 - DNA, 3741 bp, Homo sapiens
gaagtgagactaggaagagaagatgaacaattccctggattatctggcctaccctgttatcgtctctaatcacaggcaaagcacaaccttcagaaagaaactggactttggccactacgtatctcacaagaatagaatacaaatagcgaagcctactgttgataccaaacctccagtggcgcacacaaatcacattttaaaattgagcaaactacagggtgaacaaaagaaaatcaacaaaatcgagtatgaaaacaagcaactgtgtcagaaaatcgcaaatgcccatcgcggccctgccaaggtggattgctggaatgaatatttttccaagagcttaaacagagaaacaaggaaccgcgagctagtgagaatcaccatggaaaaccagggcattctgaagaggcttgttgatcgcaaaccccactatgaccgcagggcatctgagatagactggcagaattcaaggcgctatatcagaaataccacgagatatcttctctcccaaaatgaataggttactcaccatggaaaagatacaagagaaggccctaggatttcttggctgctcaggatctcaagacactcccgactggctgaatgctccatcttcagatgcttcaataaagcttggaacataaaatgcgtaagttacatttaggggacccaaaggctttatgttctcattccaaaatggggcaggcagaaggaaagatgcaatgagcatttttatttggggctatgaaaagaagttttaacgagagagagagagagaaatctgagagaactctttaaaacatacaccatcatcaccatcccgtggaagaagaaaagctggggtgagatcatccagccacaagtacagcactgtcaaaatggaaaacgaaatcacatgacaacatcaaggttcagaaaacacaaggaacaaatgccattagttcctctgtgaatacacacgatcggaaaagaatgcctcattgaagtttccatggactctgttcatttatagggagcagcagcagtgaaaatgtctcaaaacatacggtgagacaatgttgcaggcctgctatgattggtcatgctagttttcagcccaactatattagtcagcatttgccaaagagacagactcaataggagagagagagagagagagagagtgagagagatagatagagagtgagagagagagagaaagagagagagagaggagaggatttatttggggaattggctcacaagatcatggaagctaaagaagtcccaccacaggccatctgcaagctggagaccctggtggagcagggcagacaacccccaaagtggggcttagcctgcgagtgttcttggcttcacccaggaaagaatttaagggtgagccagtggtagggtagaagaagacagttttattgaagcagcagtgttacagctccatgactgctcctgcagtacagggctaccccaaaggcagagagttttgcagtcatagttatacgtacttttaattacatgtagattaaggggcggtttgtgcagaaattctagggaaggagtagtaatttttttttttttttttgagatgaaatctcactctgtcgcccaggctggagtgcagatggcgcgatctcagctcactgcaacctccgcctcctgggttcaagcgattctcctgcctcagcctcccaagtagctgagactacaggcactcgccaccacgcccagctaatttttgtatttttagtagagacgaggtttcaccatcttggccaggctggtcttgaactcctgacctcgtgatccgcccgcctcggcctctcaaagtgctgggattacaggcgtgagccaccatgtccggcctataggaaagggtagtaatttttgggtccttgggtcattgccctggaaaggggtggtaactcctaggtgttgctacggtaatggtaaactgacatggcacactagtgggagtgtcttatggaaagctgcttccacccctttcctgttttagctagtcctcaattggatcctgtgtccaagccccgcctctggagtcaaggcctgcctcccacctcactgggatgctggtagcatggcttggtccaagcccaaaaacctcagaaccaagaagaaggtggtgtaactctcagttcgaggccaaaggctgagaacccactaggggggacaagggtgctggtgtgagtcttggagtacaaaggccaaggagcctagagttgttgtcccaggacaggagaggaagagtgtattccagttccagcagatagattgacatattcgcctcttgtctgtttttgttctttctgaatccacagcaagttggatgatgcctctccacattgagagtggatcttcccacatagttcactcagacttacatgctaatctcccctggaaacactcacagacacacccaaaaataatgctttaccaggtttctattcagtcaagttggcaccttaaattaaccatcgcactgactttttaaactttctattttgaaataatgaaaattcacaggtagttgcacataaaggaacagggaggcctcctgcaccctttacccagtctccaccaatgttagcatcttgcgtaactggagtacaatatcaaaaccaggaaactgacattggcatgatgcatggaacctatgcaggtttcatcagttatacatgcactcatttttgtacatatatgtatagctctatgcggtttttgccacatgtatagctttgtgtaaccacattcgagatacttaaaaccactattatcaaaagacactcttattgccacccttttagccacagtcacctcagaccctcaagcctaactcttggcaatcacaatctgttttccacctctctgttagttcatggtattacgtaaatggcgtcatgcaatgtatgttcatccttttgagattggcttttttcactcaggataatttccttgatgttcatccaagttgtgtgtgcctttttattgctgagtagtattccatggtatggacatgctacaatatatttaaccatacatccatcaaaggacattggggtagtttctagtttttcaaacattattattattattattattattattttgagatggagtctcattctgttgcccaggctggagtgcagtggcacgatcttggctcactgcaacctccacctctggggttcaagcgattctcctgcctcagcctcctgagtagctgggattacaagcatgcatcaccaggcccggctaatttttatatttttagtagagacagggtttcaccatgttgacccggctggtctcaaattcctgacctcaggtgatccacctgcctcggcctcccaaagtgctgggattacagacatgagccaccacacctggcctgattttttaaatagcaaattttgaaagttatttacatattataggaataagtcctttgcctgctatgcgccttgcatgtatttttctcccagtctataatttgtcttttcatcctcagggtctttgacagagtaaaatatttttatttggatgacatccaatatatcaatgatgaaactgttctatatcttgactctatcaatgtcaatatccttgttgtgatactgtaccatatagttttgcactatgctaccactgggggaatctggtaaggagtttacaggatctctctgtattatttcctacatgcatgtgaatatacaattatctcaaaataaa

SEQ ID NO: 61857 - DNA, 3741 bp, Homo sapiens; identical to SEQ ID NO: 61856

SEQ ID NO: 61858 - DNA, 815 bp, Homo sapiens
atggacactgtgtgcacggatgtcaaaaaggagaggtggcataggagtaacgacccggagcggactgctggccaccagagggctcctttgtccagcagtagcgccagcatctgggaagatgcccgttgccaagcagaccctggtctagcggtagccgcggccatcctttactacctgtgccgcaagtacagcgcaccatcgcactggtgcccgccagacccgcacgcacgtgcccgtgtggatgagttcgtggcttggcaacacacggcctttcagctgcccatgaagaagatagtctggctcaagttgctgatcccaaagataacaggggaggaagtttcagctgagaagatggagcatgcagtggaagaggtgaagaacagcctgcagctcttcgaggagaagtttctgcaggataagatgttcatcaccgggaaccaaatctcactggctgacttggtggccgtggtggagatgatgcagcccatggcagccaactataatgtcttcctcaacagctccaagctagctgagtggcgtatgcgggtggagctcaatatcagctctggcctctttagggaggcccatgatcgactaatgcagttggccgactgggacttttcaacactggattcaatggtcaaggagaatatttctgagttgctgaagaagagcaggtgaccctaggcgcagcctgtcccgcagggcctggctggcttagcaatctgagccaccttccttaaaggaaatactaaaacaaaaacaaaaacaaaaacaaaaaactgttctttgcctaataaagaactggaacaacc

SEQ ID NO: 61859 - DNA, 584 bp, Homo sapiens
caggctaggtgcacactggacagtcagggtggttgtgagctgatggagactgtaaatgaaccagaaacaggtgaagtgagcaaagatgcagtcattgtaaagcaggagaaaaataatgaatattgccttcaggatattgatgataaattgtcagaatcagcagaggatgatggtgaagatgataccaatgatgaagatgatgatgaagatagtaaccctaaaaagaatactcaggccccactagagttaatggcagaatttctgagagcagaaatggcccgagagtaccagctggcaaaaaaattatgtcagatgatcctaatctatgaaccagaaaatcctgaggccaaggagtttttcacacttattgaagaaatgttgctgatggagaaaactcagaatcatgagcaagacggtgaaaacagtgatgaagacagcagtggtgagagtaaaggagaaagcgatgaggagctgagtgacgagagctctgacgaaggtgaagatggatcatgagtgttgctgcaatacttgaagcttcatgtattttcattaatgtataccatgcaaatataaagacaagtgac

SEQ ID NO: 61860 - DNA, 584 bp, Homo sapiens; identical to SEQ ID NO: 61859

SEQ ID NO: 61861 - DNA, 1142 bp, Homo sapiens
cagttgacatggatattctctttcctctggacagtgttattggtacagagctgtgccccagccccattccccagatcatccatttcgtcctctttgttgtgttcagcctggtgatcctgattatcttacgcctctacattcccagggagccgtcctcagtgcctcccagagaggaggacagcgagaatgatcaagctgaagtgggggaatggctcaggatcggaaataaatatatcactttgaaagattacagaattctcttgaaagaactggagaaccttgagatctacactttcctgtcgaaaaagtgcctgaagaagctctctagggagggcagctcccatcaccttccacgccaagtccgcccagggccagtgtacaaaccagcacctgctaggaaccaccggccacgtggggggcgtgggaaagcttctcccaccagcttccatgtgtccccacgggctcccctggctcctctggcctccatgccgtcatcagtcccgaagacctccgtagagtccttggggtctccatcatccctgagctcctccaagccacgagagcctctgtgtcccctgaagcacccttcacaccagccacctgcgagcaccctatcaccaaacccgaccagctccacagaatccttgggggagaccccacatgcaggcaggtggaggcaggggtcccgctttcctcagcctggatgtgccaacgctgctggacgcataagacaccaaaatcccagacactcccatggacaccgaatatccgacatccacgaacaattgggaatctcctgaggacaacttggagatggagtctcactctgttgctcaggctggagtgcagtggcaccatcttggctcaccacaacctccgcctcccggattcaagccattctcctgcctcagcctcccgagtaactgggattacaggcttgtgccaccgcacccagctaatttttgtaattttagtcgagagaaggtgtcaccatgttagccaggcttgtcttgaactcctgaccttgagatatctgcccacctcagcctctcaaagtgctgggattataggcttgagccaccacggctggatgaatcataaattgtaaacctgaataaaatgctgcaacctccaatgagagg

SEQ ID NO: 61862 - DNA, 1540 bp, Homo sapiens
ttgcctgaggacagcagtgcagttgacatggatattctctttcctctggacagtgttattggtacagagctgtgccccagccccattccccagatcatccatttcgtcctctttgttgtgttcagcctggtgatcctgattatcttacgcctctacattcccagggagccgtcctcagtgcctcccagagaggaggacagcgagaatgatcaagctgaagtgggggaatggctcaggatcggaaataaatatatcactttgaaagattacagaattctcttgaaagaactggagaaccttgagatctacactttcctgtcgaaaaagtgcctgaagaagctctctagggagggcagctcccatcaccttccacgccaagtccgcccagggccagtgtacaaaccagcacctgctaggaaccaccggccacgtggggggcgtgggaaagcttctcccaccagcttccatgtgtccccacgggctcccctggctcctctggcctccatgccgtcatcagtcccgaagacctccgtagagtccttggggtctccatcatccctgagctcctccaagccacgagagcctctgtgtcccctgaagcacccttcacaccagccacctgcgagcaccctatcaccaaacccgaccagctccacagaatccttggggtatctgtcatccctgagctcctcccagccaccagagcctttgcgtcccctgaagcacccttcacacaagccacgtgggcgttcccttccccgacgacggaatcctggctgggtgtcctggtccgactccatgcaggctgattccgaaactgacaccataatatgcccaatgtgcaaggcccctgagcgctcctgtccacacacctggtgggtgccttctagccctcgagtgatccgaggcgttggtcgctgcagtgatcccaacctgggcctctcctggaggcaggaggctgctagagcctggtgccactgcacctcctcacagttcccattcaagcaccctaatcttcccacccacctaccaaaggcttccttctagggagaccccacatgcaggcaggtggaggcaggggtcccgctttcctcagcctggatgtgccaacgctgctggacgcataagacaccaaaatcccagacactcccatggacaccgaatatccgacatccacgaacaattgggaatctcctgaggacaacttggagatggagtctcactctgttgctcaggctggagtgcagtggcaccatcttggctcaccacaacctccgcctcccggattcaagccattctcctgcctcagcctcccgagtaactgggattacaggcttgtgccaccgcacccagctaatttttgtaattttagtcgagagaaggtgtcaccatgttagccaggcttgtcttgaactcctgaccttgagatatctgcccacctcagcctctcaaagtgctgggattataggcttgagccaccacggctggatgaatcataaattgtaaacctgaataaaatgctgcaacctccaatgagagg

SEQ ID NO: 61863 - DNA, 2711 bp, Homo sapiens
gggggcgtggactcctcattccggctgtggccgcgccgctgcggggcctgaggccctcttgggttttggttcagcgttagttaacggttaacccgccaaggcgggcttccgcccaggcacaggagactcaccgagcttgttcaccttgaaacttgggccacacctgagacctgccacctaaggggggtacgcgggtcgtttttaacaagctttcatggcatttgtgccatgaaagctctaaagtatagaagctgctccagggcttccgcagccccggctgtcctggagatactcgcctcctggagtctgtgtcgagaatttgcagcacctggacagccacgtgcagtctcagaactgcaggcggtctttaccgaaatgttaaacacaacttgaagttaggcaggataactgccagagctggatggaccttagaggtgccagctaacgcgctgtgagcgttttctgcggttaggcctgctctaaacatttgacatgtgttaaagcatttatgtgctttacccacacccctatgtggcgggcccttcttaaagtaaaagaaactgcagcacagcgaagttaagcaacttgccccaaatcacgcagagctgggatgcaaacccaggtctagctcactcgtgatcacaattcaacatcatacgatggtgctgatttccagagcagctctgtgactttatataaaattattgggcaagcgttcaattgtaaacattcgtgaacatagctgttgcacattagcgttccttttttttttaattcaggaccatctttggtgacaaatataaatatcaatactatatatatcaccaatatacatatttgctttgctaaaaggtttctgtgtcttcaggatagtttacttgcaagcctcatgtttttataaaaacgtgggtgctacctgaataaaactaatgcctacccgttggcggttttgtgaagactaatgaactattatattcaaagggtccaagcagtaggcatttactaaaggacagctagttttatctgttattattctgccattcagagagataccaaaactactctctaaggcatttctcttccctgcatgtaaaagcaagggtgtcatacttgagataagcattctgataatgtgtaggcaaagtttccacacttggtaaaagcatcttagtcatggttcaagacgagtgacaagttaccacctatttgcaattcaaggagaatataagacagagaagaaagctgtgaatgaatttcatttgattagcaatagattggacactctactgatcttgcctctctacaacctctcttccacctgacctctaaatgttgaagtgtttcaggaattgtcttagaccttcttccttatctacacttcctctccaacatgaatcttgatggctctgcacaagatcctgaaaagagggaatattcttctgtgtgtgtgggcagagaagatgacattaaaaaatctgaaagaatgacagctgttgtccatgatagagaagtggtcattttctaccacaagggagaatatcatgctatggatattcgctgttaccactcaggaggacctttacatttgggagatatagaggattttgatggacgaccgtgtatagtttgcccctggcataaatacaaaattactttggcaacaggagaaggtctgtaccagtctataaaccctaaagatccatcagcaaaacccaagtggtgctccaaaggaataaagcaaaggattcacacagtgacagtagacaacggaaatatttatgtgactctttctaatgaaccttttaagtgtgactctgatttttatgccactggagacttcaaagtaattaagagttcttcctgataaaaaatatatagaaatgaaaaatgttgtgtatgcttgaaaacatttttagaataactctgcttcagttttaaaggtgatgaaatttttcaacataggcacaactgtttaaaattcacatacatttgagaggtttaagagcacacatacttagtatgatgtaaggattatcatcaggatcaatagaatacattttatcgaatcttctggattaattagaaacctgaaggttataggtttgggatgttctgtttaagaaggataaaaataaatttggagtaaacaaataataggtaaaaattaaggattagtaagaaaaaattttttaatttaaaaaatttaatttttaaaataggaaaaaatccctgtttgatgtagcagacttaattctggaaaagttttagtatatacaaagtaaacagactatataatgaacttccatcactcagctttaacagttatcagcattcttccattcttgttttatttatacctctgtggatttgctacctctcctatttgattgttatttttacatttttaggaaagtttaaatacattgaaatgttcacctctgaactgtgcaaccttcctaaataacagactttttatacttaaaaaatgcatccaaaaatgagataggtttacctgctgaacttgaaaataagaaacttaaccactgttaagtgatctgtgatcaaggcagatcttgaagtaaggaagccagacacagctgctgcccagccatgagagatgtaaagtctcctattcagtgagccaatgttctttgaatgcctatatgaaattttcaaataaagatttttaaaaacgaaaaaaaaaaaaaaaa

SEQ ID NO: 61864 - DNA, 823 bp, Homo sapiens; identical to SEQ ID NO: 27912

SEQ ID NO: 61865 - DNA, 2724 bp, Homo sapiens
atgtacaaggaggataggggcagcctcctgggcctgatgggtgtgctggccggatgccaagcacccagcagggagtgtggctcaggtggcaaggagcatgctcaggccctcaaactggtcagtgacacggtcaggtcatctccagctggctctgctgaccctgaagctctcctttcctggaatgacatcatgacatcatgcttactggaaacccagcagcagatccctgggaccccacactctgtgctgccccggccctgccatggcaacaaggacagcgccggggcctcgcgccttatttttctgctcttagaaaagtttctgcctcggcagctttcccgagctgagtcagcagggaaggcagctgtctggacctcggggtggaagcccattcatcagcccgctttcttggtgctcgcccaaggatggcttcgtggggggacgtgctctgcaggccctgaactctgcacctcctggaccacagtgtctgggatgagaagggaagtgggggcgtcaggggcaacccacagggcagcccctggaaatctgtgctggcaagcccttccgcagccttgcaaaccagggccccgcgcgttgaacccaggagccaggccatgtccggagaggctgagcgccctccagcaccggccacctggccctagcccagctgcaagcaaaggctctgtgcctagcgtggcccggccccacaggactgatcaggctcacgtggccgaccctcccagccccctaaccccggtcgggcccatcacccagagccccaaacgcaccctcgcggcgcttcagcggggtgggcgtggtctggtcgacccggtggtgccgccccacagcgccccctcgcgtctcccctgtagcaccagccagaccatcccatcactgctggatgagctccaatgcgggtctccaggtgtcagaaagccaatccttacaaagttgagtgatccaagtctacctgtcagaaaactacgttccctcaagactggggaatcctcctctcctcctctgcagcagctgcctccactctgtcaacttggggctgcctgtccccactcgaaagccaaccccgcttcccccaaaatgcggctcccaagttccccaccccttcttgagagagccctggctccccagtgggccacactctccccacagcagcaggaggaccacccaggaactgggcagcacgttgccctgagccccacacggccgccacacctctgggccctccctcctctctcagcagtgggtgtgcaggctgcactggccttgaggagcgactcctgtcccagtgggtcacatgggaatgcagacttttctcacaggttgggctgggagtcctccacattggtcaccagacattgccacttctcctcagggcaggtcctcagcaggagccccccaccaggccacatcataagggccatggtcagggtccagggcctcgtgaaggctatcaagagagccctgggatccttcaaggagcgagaacccctttcactgaaacaggggagaagctgggaacatggtggtgtgtggggagtggcaggtgagtccagcgccacagagagaggagcagacgtcccaggccagccacatgagctgcatcatggcatcagtgggacagcccctgagggccacccagactctgacagccaggggagccaggagagcagaccttgccaaaaggagatggcccaaggatgtgctgttgtgactggcctcagccacttctccctggagcagtggatgggctacactgagtcctgggcaaggcgacggccagccctagccctgcatgactctctaggaccagagggagaatgcactttgtcctgccaagagaatgtggttgccaaggggacagaacaccagtgttccacgtggaacttccaggcagggcactggggcacagtaggaggaacccagaagatgctgcctctcctgatcatctgtctcctgcctgccattgaagggaagaactgcctccgctgctggccagaactgtctgccttgatagactatgacctgcagatcctctgggtgaccccagggccacccacagaactttctcaaagtattcactccttgttcctagaggataataattttctcaaaccctggtaccttgatcgtgaccatttggaagaagaaacagccaaattcttcactcaagtacaccaagccattaaaacgttacgagatgataaaacagtacttctggaagagatctacacgcacaagaatctctttactgagaggctgaataagatatctgatgggctgaaggagaaggacatacagtccacactgaaggtcaccagctgtgctgactgcaggactcacttcctctcctgcaatgaccccactttctgcccagccaggaaccggcggacctccctgtgggctgtgagtctcagcagtgctctactcctggccatagctggagatgtttcttttactggcaaaggaagaaggaggcagtaaagcaggaacagggcagcccgcatgtcttccagaagtgaacagaggccgcagctaccaccgtcacaaagttcactcatctctgggtcccggtgaccccatccccccataccctccatcctgggtcctggggccccaaagctctgaggcctaggagactgcgctgtctcgtggtttgcctactcctacacctttgtaaagagtctcttcattaaaacccctcttcat

SEQ ID NO: 61866 - DNA, 662 bp, Homo sapiens; identical to SEQ ID NO: 61591

SEQ ID NO: 61867 - DNA, 1186 bp, Homo sapiens
aaccttaacagccctgcagtgtagtgggcactgggcagtgctgctccttcactaagcggtctgagttctttagctatctcggagattcaactacgtttactcgtactgaatctttttaatgaatttcctgagagccaagaagggccaatctacaggaaaaagtgggaggtggacattaagcatcttctagaaactcttctagctgatatcatgaaacgacgacaaaagaggaaacatttggaaaatgaagagtcccaggaaaccgctgagaagggaggaggaatccagagaatacatcgagacagcccccagcctcaatcacccctggcccaggttcaggaacgaggagagactcctccccgctcacaacatgtctccttgtcgtcctattcatcctataagacttgtgtgtcctctctgtgtgtaaacaaagaggaaaggggcatgaaaatatactacatgcaggtacaaatgaacaaaggtgtggctgtctcctgggagacagaggaaactttggagtccttagaaaagcagccaaggatggaagaagtgaccctttctgaggttgtgagggtaggtactcccccctctgatgtgtccaccagaaacctcctgtctgacagtgagcccagtggggaggagaaagagcatgaggaaaggacagaatcagacagcctgccaggctcacccaccgttgaggacacacccagagccaagactcctgactggctggtgaccatggagaacggcttcaggtgcatggcctgctgccgggtgttcaccaccatggaagccctccaggagcatgtgcagtttgggatcagagagggcttcagctgccccaagatgagcaggaggaggaaaatggaaatgagaaggaggaggaagagaaaccagaagcaaaggaggaggaggggcagcccacagaagaagaccttggcctgaggagatcctggagccaatgtccaggctgtgtgtttcattctccaaaggacagctgagacttatgggccagaagatactggaagatggtgtggccttctcttgcaagagggagaagaaagagccatggagatagtagcagacaggctgcccaaggtatgaagcagatgagggaccagcactcagtctaacatgtaaacatcatacgtaataaaggttgtgtttcaaaccttaaaaaaaaaaa

SEQ ID NO: 61868 - DNA, 3098 bp, Homo sapiens
atgactcctgaggcacactggactggtccccccaaccccggtgccttgggctacccccaccaaagttttgtcagtcagccccaccccttcagcaagcagcccagtccttgccctcgccaatcaccccagggtgactttgggtgggtgactcctggggcttcccgctccattactgggccctcatctcctgccgccccaagcttgatctccgtgggctctttgggctctcatctccaaggagccaggccccaccctcgccagtcatccttgggtgactttgggctggtgactcctgggactccctgctgcagactgtgccctcccctcctgctgcctcaaggtcgacctccctgggttctttgtgctggcgtctccaaggagctgggtcccaaccctgtgcttccctcccccatcgtggagcagcgacttggacatggtgctgacatggtccctccccccgaccaggaggagtggaatgttgtgatgtcacagtccacctacacaaatttccagctggaaggggaatggagactatgggacctaggagcaagaggttccaggctgcctcactcccttacagatgttgacggggctgacggttctcatgaatattactgctcttctttccaacagttaaaagaatattggcagaaaaacagacctagagttccagcaggagtgaacagaaacaggaaaacaaatggcagtatccctgagacagccacttccggtggttgccacctctctccccactcctgctccacctcctcctctctgcatgcacctcagagcccgtgccaagaacgagcagtagtcctggattcaacgtccgtaaaaatcagtcgactgaagaacaccatcaaatctttgaaacaacagaagaaacaagtggaacatcagctggaagaagaaaagaaagcaaacaacgagagacagaaagccgaaagggagctagaggttcaaatccagacattgatcatacagaaagaggaactaaatacggacctgtaccacatggaacgttctctcagatactttgaagaagagtccaaggacctggctgtccgcctgcaacattcattgcagtgtaaaggagagttagagagggctctgtctgctgtcatcgccacagagaagaagaaggcaaaccagttgtccagctgcagcaaagcacatacagagtgggagttagagcagtccctacaggaccaggcactgctgaaagcgcagctgacacagttgaaggagtcatttcaacaactccaattagaaagagatgagtgtgctgaacatatagaaggagagagggcccggtggcatcagaggatgagtaaaatgttgcaggagatttgcacattaaagaaagagaagcagcaagatatgcgtcgggtagaggagctggagaggagcttgtccaaactcaaaaaccagatggctgaacccttgcccccggagcccccagcagtgccctctgaggtggagctgcagcacctgaggaaggaactagagagagtggcaggagagctccagtcccaggtcaaaaacaatcagcacataagtctcctgaaccggcgacaagaagagaggattcgggaacaggaagagaggcttcggaagcaggaggagaggcttcaggagcagcacgagaagcttcggcagctggccaagccacagagcgtcttcgaggagctgaacaatgagaacaagagcacactgcagttggagcagcaagtaaaggagctacaggagaagcttggcgaggtgaaggagacggaaacctcggcccagaaggagccagaggcagccagaggccctggagccccagggcctgggggcgagtctagcagctttatggaccacctgaaggagaaggcagacctgagtgagctggtgaaaaaacaagaacttcgcttcattcaatactggcaagagagatgccatcagaaaatccatcaccttttatcagaaccagggggccgtgccaaagatgcagcactgggaggaggacaccatcaggctggagctcagggaggagatgaaggtgaagctgctggagctgcagcagatggtattgcggcttacagcaactacaacaatgggcacagaaaattcctggccgctgcccacaactctgctgatgagcccggtccaggagccccagccccccaggagcttggggctgcagacaagcatggtgatcttcgtgaggtgaccctcacctcctctgcccaaggagaggccagggaggatcctctccttgacaagcctactgcacagccgatcgtgcaggaccaccaggagcacccaggcttgggcagcaactgctgtgtgccattattttgttgggcttggctgccaagaagaaggagataaacatcaccatcatcaaacagctgctcaagaaatttttaaataagaaaccaagttatggggttaatctcctacacaattcatttacttcctttgaatgttagactcactcatgattatttgtgtttctaatttatagtttaagtttatttgtaaaaagttaaaagagagtgggtgtctgtggctctcactgatgttcactctggcatcctttagcatttttcttttttaatttcataattgtaggtcattagcgtgcatatcgagtttgcccttacgtggtgggagttcaaacacacaaagacccactctttgcccaaaactgttctctttggtttggaataggctgccatgcttttttaatgttattgcagcatgtatattcactacagcattcagacaaaatttgcctatgttctgctgttgtttgatgtaatcttaatcacagtgagctcttccttagctcaatatgtagtttgcccccaagtgtgcactgtttattactttgtaatacgccactatgagtactgacatttagagttgtttaaaggccaagaattggaaacagcctttcctccattttctgtgtattggtgatgggagtgataaccttttgggggagctttttaaatctcacagaagaggaaagtggcctcctctggcaggtatgtgcaagatagagtgtgtttcatctcttccggtgccaggaattagcggtgtattatggt

SEQ ID NO: 61869 - DNA, 3045 bp, Homo sapiens
atgagcttctcactcacgttcaccgagctggccaacatcgccatcccacagtgcggggtgctgaacttcaaggccctgcacctcctgctgcacggcatcttggagcacatccacatggccgagctcaagaaagtcctctcaggcgatgaggacttcctgcagacctcgcaggtggtcatcatgcccagggaaggagacgcccagcctatcctcaaccccatgaagaggctcagcaatgtcttcgaccacgtggtgagccgcctcgacaagttggagaaccagctggccctgctgcaggacctgccctccactgcccagctgctggaagccagccagggcactgcccggcccgtccaggacctgtggcatctgatcaagctccggaagatggtggagggtcatgatgaagtcatggccaagtcaatgcagaccctgcaggacttgctcactgatcttcatgcactccaggtcaccatcacagccctcagaaaagaagtggacatgctgaagaacatgcttgacaaggtacacccagaaagaatggacatctttgctgaagacttcaaaatacagaactggaagatggttgcactgcagcgggaagtggcttctctccagaataagtttaaaaccatccccaaaaccgaggacatggtgctctggagtggccttcatgatgccatgttcacctcagaaattggttcatcaccactggacctgtggcagtctgtagagcagctcccagaggctgccctggcccagaccaccaagtaccttgaagctactcgtgccatccaggtctccgagcccgtccaaaacccccagctactgcagactgtctggcattatgaggtcccagagctcctcccggagggctcatctgcccaagcagtttcactcagcagagcccaggagccagcgcagcctccggccctcacgcctgagtctgcacctgggtgcacaactgaatttgcacctgggcctgcacctgggactgaacctgtgccaggactggagctggggctggagctggagcctgtgcctgccctggggcctgtcccagggcccagtccatatcagtctcgccagggagaagccctccagctcgcagctgtccaagtaaagggggaggaaaatgatgtccccagcctaaggggccttcgggagagggcccgcaaggatggggcccccaaggatagaactcgcaaggatggggtccccaaagatagaggtggcaaggatgtggaccccaaggatagagctcacaaggatgatgtccccaaagatagaggtggcaaggatgtggaccccaaggatagagctcacaaggatgatgtccccaaagatagaggtggcaaagatggggaccccaaggatagagcagccaaagttgctgccaagtttgtcaaggatgccccagccaccaaaatggccgccattgcaacagacacggctgcagctgggcccctaggggtctttgcagatgtcctgggtgcagggccttcccggggagccacagaatcccagatcttgggcgatgattccgaaatctacgaaatcctctctccctcctactctgctgccagcatcggtcccgatccagccctgtcccaggccatggtggctaccaagcaggccatgagccctgaagacaagaagagggctgtcaagtattccatgagccacatagcccagatacctgtcaaacacgactctctgaaggaagaatttgcccagctgtcctgtaacctgaaccagcgcttgagttatctagccaatatgggaggtccttccagcctcgggacaacagtggacatattgcagaaaaagattggcagcctccagaaatctaggctcaaggaggaagaacttgagagaatttggggcaaccaaatagagatgatgaaggatcgctacatcactttggacaaggcggtggagaacctgcagattcgcatggatgagttcaagactctccaggctcaaatcaaaagactggaaatgaacaaggtgaataagagcacgatggaggaggagctgagagagaaagctgacaggagtgccctggcaggcaaggcaagccgcgttgacctggagactgtggccttggagctgaacgagatgattcagggcatactcttcaaggtcacgatccatgaggacagctggaagaaggctatggaggagctcagcaaggacgtgaacaccaagttagtccacagtgatctggatcccttgaagaaagaaatggaagaggtctggaaaatcgtccggaagctgctgattgagggcttaagactggatcctgacagtgctgctggctttaggaggaagctgttcaagcgcgtgaagtgcatctcctgtgaccggcctgtggagatgatgactggcccacagctgatcaccatccgcaaagcccacctgctgtcccggctgcggccagccagcgccaacagctgcgagtacttgcagcggcaacagatgagggaacagcagtggctgcagctccaggacctcggtatccaggaggattgtcagcaggactggggtgatggcccccaaaacgccaccagcctcaagtgcaagtcctgcaacctgttgacgctctatccctacggggatccccacgtgatcgactatgacagcgccgaggtggacatcctgggcgtggatgggatcctgtacaaaggccgcgtgaacagccagcgtggggctcagcccttggccgtcgcaaaggagctggcagctgtgaaggctccatctcccccgtcacaaagcctgtatgaccgtgtgcactccagtgccctatttggcgccatctgcccccccctgtgcccccgctccagtgcctgctcagctgcctcgggccctcacctgacgatgccagctcgaccaccttccctgccacctctgctgctgctgccaccgctgattccatccctaagggacccccagcaggccccagggtccaccaggctctcaagagctccacacattgagtcccgagtcggcaggaagccccccgaggagcccgccaacccgtga

SEQ ID NO: 61870 - DNA, 1491 bp, Homo sapiens
atggctgcaaattgcacatcctcatggagtctaggagaatcctgcaacagccctgggtcagagccaccacagtccatgccatccccagcaactcaacttggaaatcatgacagtgatcctgagacttgtcacgtgaacttcaggatgttcagctgcccgaaggagtcggaccccatccaggctctgaggaaactcactgagctgtgccatctgtggctgaggcccgacctccacaccaaagagcagatcctggacatgctggtgatggagcagttcatgatctccatgccccaggagctccaggtcttagtcatgatgaacggtgtgcagagctgcaaagacctggaggacctgctacgaaataacagaagacccaagaaatggtctgtagtcagttttcttggcaaggaatatcttatgcaggaatcagatgtggagatggctgaagcccccgccagtgtcagagatgatccgagacacgtgtccagccagcggacctcctctgtgaaccagatgtgtccggaggaaggccaggccagccaagagctgcagaccctgcccagggtccctgcactgttcaggaggcaggaagaggacttcctgctgccagagactactgtcatgaaaggtgacccaaaggctctgagacccaagccgaccttggagaaggacctggaggaagacagggaggagaacccaggacttacatccccagagcctcagcttccaaacagtcccacaggggtggtgggagcaaaggaggggaaggaaccccaaaaaagagcctctgtggaaaatgtggatgctgacacaccttctgcctgcgttgtggagagagaagcttcgactcacagcgggagcagaggagacgctctgaatctgagaggtctcaaaagaagcaaaccagacgccacctccatttcccaagaagagcctcaaggagaagccacacctgtgggcaacagagaatccccgggacaagctgagatcaatccagttcattccccaggccctgcgggcccagtcagtcaccccagtggccaagaagtcaaggaactgctgccctttgcatgtgaggtgtgcggcaagaggtttaagtatcgcggcaagttagccgtccacacgagatcacacacaggcgagagactctttcagtgtaatctctgcgggaagcgcttcatgcagcgcataggcctgcaatttcaccagcgaacccacactggcgagaggccctacacgtgtgacatctgccagaagcagttcacccagaagtcctacttgaagtgtcacaagagaagccacacaggggagaagcccttcgaatgtaaagactgcaagaaagttttcacctacaaggcaaatctgaaggagcaccagcgcatccactctggagagaaaccccacaaatgttccaagtgtccaagagccttcggtcggccggcgaccttaagacgccaccagaaaacacatcgagaagccacttcacagtga

SEQ ID NO: 61871 - DNA, 1199 bp, Homo sapiens
ggggaggaaatgctggggaggtgggggcagatcacatcaacatcctggcattgggctgggtcggcgtggagccccagaaatgttcccaagcccattcttaccaagaaccaatgagtaaaatcaggggcctcccacctgaggtcagggaaccaggccctggagtggaacttggggtggaaaatggccttctttgtcaactgattcattctccagaattcaatttgttctccaactcggtggtgtttgaaagcaactttatccagacccatgtacctgaggctgatttccaggtcactaagcccgggaactggagagatgtctgtgaagggtctgccaccgtgatcctcggggtcacctcctcggtgccctccctgccactccccaatgtcctcctgatggccaatgttacctggccccagggtccatttaccacctggagcacacctggtgacgccccagtcatcaacctcagcaggcttctccccctgaagtacgtggagctacgaatctacgaccggctccagcgcatcctgagggttaggacagtgaccgaaaagatctactatctgaagctccacgaaaaacacccagagattgtgtttcaattctgggtccgcttggtgaaaattctgcagaaaggcctgtccatcaccaccaaagacccgagaatcaaattcactcactgcctggtgcccaagatgcccaccaactccacagaaacaacacctgaaaacagcctcctgtcatccccccagcccagcgagcccctcgtgctgctggcggctgagcagaccagtggcagtttctcacagctctcaggaaagccccagctcacagcagacaggaacaatgacactgccattgaaatagacaactgcagcagctacaagataccctctccagtggcatctccaatcaatttgaatatacccatgagagctgccttgagccacagcctctgggaacaagaggactggaatgagcaccttctacaagttcatatagccagttacctaggagagcacttcttgggagcctgacacctaggcaaaacatgctcttccttgcatacgtgtacttgctaccacctcttataatgctccttttccactgtgagccaagtgaccttgggagaggtaagatggtgtttccaacaaggtgcttctctacttccaccaataaacttccaagtgagtccc

SEQ ID NO: 61872 - DNA, 1051 bp, Homo sapiens
atggcagtccacggaaagcgcaaaagtgcaagggtgaggctgcgcccctcccctaacccccacaggaacatacgacagcagcacgtgctgtctggagcactttacagcagtcacgtctgcacaagggcaaacccacgccctttcacccccacagaacagcggcagctgctgtctggagcattttacggcaaacattggcatgtagtctggagcactttacagcggttacatgaggcgcgagggcaaagccacggcctcgcacgcccgcagaacaggagcacgtgctgtctgcagcactttaacggcattcaggcaaaggcccgcggaacagcggcacgtgctgtcggcgcactttgtggcagccacgcgaaggctcgaggtcgcgagcgtgtgcccagtcagggtcggctgcgggtactcggctttgcgctctatttcgttgtggtctggctgttgatccgtaggcacgcctacggctattccatcatggcgaggatggcggtactgtggcggaagatgagagataacttccagagcaaggagttccgggaatacgtgagcagcactcacttctggggtcccgcgttcagctggggccttccgctggctgcctttaaagacatgaaggcgtcgccggagatcatcagtggccgcatgacaacagcgctcatcttgtactcggcgatcttcatgcgcttcgcctaccgcgtacagcctcgaaacctgctgctgatggcgtgccactgtaccaacgtgatggcgcagagtgtgcaggccagtcgctacctactctactactacggcggcggcggcgccgaggctaaagcccgcgaccctccggctaccgccgccgctgccaccagcccgggttcccagcccccgaaacaagcttcttaagaactgagagggcctgatctcatctctgcaggtcacaagcactgaactgccattcctcctgaaaaaagaccaatgaagacctcggttttgactctaaaacagtgcgaatctgacttaaacctgcagtttgattaataaagaaatacaaagtaac

SEQ ID NO: 61873 - DNA, 1051 bp, Homo sapiens; identical to SEQ ID NO: 61872

SEQ ID NO: 61874 - DNA, 1989 bp, Homo sapiens
ggtccggattctccgatgcgaggtcctcctcccagggcccggggctggggagcggaagccatcagtgggctcggaggacactgtcccagccaggacacggccatcggtcactaatctgcagcaccggaatgtccccaggccaatcagcgggcccagcctgactcctggagattgtgaatagctccatccagcctgagaaacaagccgggtggctgagccaggctgtgcacggagcgcctgacgggcccaacagacccatgctgcatccagagacctcccctggccgggggcatctcctggctgtgctcctggccctccttggcaccgcctgggcagaggtgtggccaccccagctgcaggagcaggctccgatggccggagccctgaacaggaaggagagtttcttgctcctctccctgcacaaccgcctgcgcagctgggtccagccccctgcggctgacatgcggaggctggactggagtgacagcctggcccagctggctcaagccagggcagccctctgtggaaccccaaccccgagcctggcgtccggcctgtggcgcaccctgcaagtgggctggaacatgcagctgctacccgcgggcttggcgtcctttgtcgaagtggtcagcctatggtttgcagaggggcagcggtacagccacgcggcaggagagtgtgctcgcaacgccacctgcacccactacacgcagctcgtgtgggccacctcaagccagctgggctgtgggcggcacctgtgctctgcaggccaggcagcgatagaagcctttgtctgtgcctactcccccagaggcaactgggaggtcaacgggaagacaatcgtcccctataagaagggtgcctggtgttcgctctgcacagccagtgtctcaggctgcttcaaagcctgggaccatgcaggggggctctgtgaggtccccaggaatccttgtcgcatgagctgccagaaccatggacgtctcaacatcagcacctgccactgccactgtccccctggctacacgggcagatactgccaagtgaggtgcagcctgcagtgtgtgcacggccggttccgggaggaggagtgctcgtgcgtctgtgacatcggctacgggggagcccagtgtgccaccaaggtgcattttcccttccacacctgtgacctgaggatcgacggagactgcttcatggtgtcttcagaggcagacacctattacagagccaggatgaaatgtcagaggaaaggcggggtgctggcccagatcaagagccagaaagtgcaggacatcctcgccttctatctgggccgcctggagaccaccaacgaggtgattgacagtgacttcgagaccaggaacttctggatcgggctcacctacaagaccgccaaggactccttccgctgggccacaggggagcaccaggccttcaccagttttgcctttgggcagcctgacaaccacgggtttggcaactgcgtggagctgcaggcttcagctgccttcaactggaacgaccagcgctgcaaaacccgaaaccgttacatctgccagtttgcccaggagcacatctcccggtggggcccagggtcctgaggcctgaccacatggctccctcgcctgccctgggagcaccggctctgcttacctgtctgcccacctgtctggaacaagggccaggttaagaccacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcgaaggagaggacaccgccagtggtccaaaaaggctgctctcttccacctggcccagaccctgtggggcagcggagcttccctgtggcatgaaccccacggggtattaaattatgaatcagctgaaaaaaaaaaaaaaaaaa

SEQ ID NO: 61875 - DNA, 2220 bp, Homo sapiens
cgggcgctgagctgcaggcgcgcgcctaacggcttcgcgggctgagaggtcagaggctgcgagtgtcgctgctgaaggctgtggtggacccggccgggtcgcggattctgagctacatctcgggtttggggttagggttagtggaaaggccacgaggagccgcgggggctcaggagccggtggtgggcgtctgaggagaagtcgccccatgaggaagctcttcagcttcgggagacgcccgggccgggcggtcctgggctccatcgaccacgagtacccgggtcccgcgtaccacaccagggacgcggaactgcggaagatccacagggcggccctcaagggcgacgccgcggaggtggagcgccgcctggcgcgcaggtgccgggacgtggatgctcaggacaggactgttctacatttggcctgtgcccacggccgtgtgcaagtggtcactctcttgctgagcagaaaatgtcagatcgacatctgtgacagactaaacaggacgcctttaatgaaggctgtatattgccaggaagagacgtgttccattattctgctggaacatggcaccagtccaaacattaaggacgtctacagcaacactgctcttcatgatggtaaacattgaggatgtctacggcaacactgctcttcatgatgctgtctatgataaggggacttcactggcaggaagcctgctttcccaccatgcaaatactgaagcactaaacaagaaacaacagctatgaagcctgcaaatttgtaaaaaggagaagaaggtgcaaaagaacacgacttaaaagtggcttcagaggaaaagcaagaaacgcttgaaagaagtgaaaataaacagccagagattttcaaagttatagaaaaaagaaggatgtgatatatacaaattgcatattgaagggagatattgccacactcaaacaggaataatacacaataaaaaatgacagtgtcaaaaaggaaaaggaatatattcaggaaattaagagtattagagaaataaatgctaactttgaaaaaagtgcaagactcaatgaggaaatgacaacaaaaacgatgtcccagtattgtcaacagcttaatggcctcaaagctgagaatacaaggctgaattcaaaattggagaaggaagaacaccacacagatggactggaagctgaagttgaattcttccattctaggctggctgctgctataaatgagcacaatgaaagtttagaaacgaaagacctagaacttgttttacagagagcacataatttttccgtacataaaaaaataagttctactgtttctcaactaaaagataaaaatgagttgcttactgaacaattttctaaagctcagatgaagttcaataccttaaaaggtaagctccatgagataagagatgctctcagggaaaagacattggctttagaaagtgtacagatggaccaaaggcaagcacagcatcgaataaaggaaatggagcagattcatccaaatgaggaaactaaaggagtcgatccaccggaaagcacaactgtgtagaggagagactatgtcaactagaatgtgacagtctcttgcttcaacgacaactagagggtgctcataaggaaggcaatgataaagagatagtaattaatatccaaggaggctgtcttgagagtggaaagatcttctagaagagaaaaataagaaactaatgaatgaatataattctataaaagaaaaactgtttcagtatgtaaaagaagaaggagaagtaagtatgaagaaagataaatatatttaaccttccagaaagaaaatttaaacatttcattgtggctatatgttgaatctagttcaatataataataaatagatgaaaatgtatttaccatactgtataattccattaacatgaaacatccagaaaagacatgtatagggacagaaagaagatgaatgtttctgtagggctggggctggaaatgggtcgtgactgctgatgggcatgagggatcatcctggagtgatgaaaatgttctaaagctggattgtaaagatgactgcacgactggtaaatttactaaaaatctttgaactgtatgttaaaacagataaattctgtagtatgtaaatcatattttagcaaagctgttttaataaaaaaacaaaaaaaaaaaaaaaaaaaaaaaaaaaaaaaaaaaaaaaaaaaaaaaaaaaaaaaaa

SEQ ID NO: 61876 - DNA, 855 bp, Homo sapiens
atggagtggaagttagagcagtccatgcgggagcaggcactgctgaaagcgcagctgacacagttgaaggagtcacttaaagaagtccagctagagagggatgaatatgctgaacatctaaaaggagagagggcccggtggcagcagaggatgagaaaaatgtcgcaggaggtttgctcgttgaagaaggagaagaagcatgataaatatcgggtagagaagctggagaggagcttgtccaaactcaaaaaccagatggctgaacctctgcccccggagcccccagcagtgccctctgaggtggagctgcagcacctgaggaaggaactagagagagtggcaggagcgctccaggcccagctggtggagaaagaagaacttggattcttccagtactacagagagggatgccatcagaaagtttatcaccctataacaaagccagggggcagtgccaaagatgcagcaccgggaggaggacaccatcaggctggccctggacagggaggagatgaaggtgaagctgctggagctgcaggagatggtgttgcagctggtggcgactacaagggacacagcaaattcttggtgactgcccagaaccctgctcatgagcccagtccaggagccccagccccccaggagcttggggctgcccacaagcatggtgatctttgtgaggtgagcctcactgacagcgtggagcctgtgcaagtagaggccagggagggttctccccacgacaaccctactgcacagccgatcgtgcaggaccaccaggagcacccaggcttgggcagcaactgctgtgtgccattcttttgctgggcttggctgccaagaagaaggagataa

SEQ ID NO: 61877 - DNA, 1132 bp, Homo sapiens
atgcggctgcgcttttggctcctcatttggctcctgctgggatttatcagccatcagcccacccctgtgtctttcctgaagactatcttctggtctcgaaatggacatgatggatccatggatgtacagcagagagcctggaggtccaaccgcagtagacagaaagggctgaggtccatttgtatgcacacaaagaaaagagtttcttcctttcgaggaaataaaattggcctgaaagacgtcattactctacggaggcatgtggaaacaaaagttagagctaaaatccgtaagaggaaggtgacaacgaaaatcaaccgtcatgacaaaatcaatggaaagaggaagaccgccagaaaacagaaaatgtttcaacgtgcgcaagagttgcggcggcgggcagaggactaccacaaatgcaaaatccccccttctgcaagaaagcctctttgcaactgggtcagaatggtggcagcggagcatcgtcattcttcaggattgccctactggccctacctcacagctgaaactttaaaaaacaggatgggccgccagccacctcctccaactcaacaacattctataactgataactccctgagcctcaagacacctactgagtgtctgctcactccccttccaccctcagtggatgataatatcaaggagtgtcctcttgctcctcttccaccctctcctcttccaccctcagtggatgataatctgaaggaatgtctctttgtcccgcttccaccctctcctcttccaccctcagtggatgataatctcaagactcctcccttagctactcaggaggccgaggtggaaaaaccacccaaacccaagaggtggagggtggatgaggtggaacaatcaccgaaacccaagaggcggagggtggatgaggtggaacaatcgcccaagcccaagaggcagagggaggccgaggcacaacaattacccaaacccaagaggcggaggttgagtaagctgagaacacgccattgcactcaagcctgggcaataagaataaatccgtaggtcgaaaaaaagaaaaaaatcaaaaaacaaaacaaaacccacgctccaaaaacaaactaacgaagaataaataaataatataaaaataaaa

SEQ ID NO: 61878 - DNA, 1570 bp, Homo sapiens
tgccaaatcattcacccctcaccacaaccgaatgagctaaggattctcattatatatagtttatggagagggaagtgcagacataaagaggtgaattgtcttacccagatcacacagctgataagtggtggaggcagaatagaatctaaacagtgtggctccggagcccacatgcattgattcgacaagtgtttattgagcacctgccacggacaaggccttgtgtgattaaatagggttataattagtaatataaaaatgagaaatcactaatgctttttagacttaacattttctttttttgtaggtttcaggcacagaactgtatatccaataatagtgaaatggatcccactaattatgacagaaatgatgatacatttaaatgacttggatgttttataggttggcactcatgatgagcccctgttctcattctgcaaatggtgaagctctctattgtcctgaccccacagttcctgtcgcatgaccagagccagctcaccaaggagctgcagcagcatgtaaagtcagtgacatgcccatgcgagtacctgaggaaggttatcaatagtctggctgtctatcgtcatcgtgagactgactttggtgtaggagttcgagaccaccctggccaacatggcaaaaccccatctccacaaaaattggataatttgataattatcattattgggtttctgagacgttacacatttaacattctcttctgcacaagttgcctttgtgtgtctttcctgaagactatcttctggtctcgaaatggacatgatggatccatggatgtacagcagagagcctggaggtccaaccgcagtagacagaaagggctgaggtccatttgtatgcacacaaagaaaagagtttcttcctttcgaggaaataaaattggcctgaaagacgtcattactctacggaggcatgtggaaacaaaagttagagctaaaatccgtaagaggaaggtgacaacgaaaatcaaccgtcatgacaaaatcaatggaaagaggaagaccgccagaaaacagtaagatgtgccttgacacaaatactgttgtatgaaccatgtgccaatcaaagtagacaactgtaaagtccttgagaatattttctacaatatttgtggcaaattcagtgggctcaaaattgagtttgtcctttctgcttcattagtttaagctgtataattcctttcccttcctacattcttgtttgtaattttttcgggggaagaggagttgctagtactggcattggttttcctttctctctctctttttttttttcctgagatggagctttgctgttgttgcccaggctgtagtgcaatggcacaatctcagctcactgccttttggcttcaagcaattctcctgcctcagcctcccaagtagctgggattacaggtgcccaccaccacgcccagctaatttttgtatttttactagagatggggtttcaccatgttgtccaggctggtctcgaacttctgacctcaggtaatccacctgcctcagcctcccaaagtgctgggattagaggtgtgagccaccac

SEQ ID NO: 61879 - DNA, 1404 bp, Homo sapiens
cccggtccccgtccccttccctcccccctgccctaagccacctccacctctgtcctggccgcctcagggcaccctgaaaggatcatgacatgcggctgcgcttttggctcctcatttggctcctgctgggatttatcagccatcagcccacccctgttatcaatagtctggctgtctatcgtcatcgtgagactgactttggtgtaggagttcgagaccaccctggccaacatggcaaaaccccatctccacaaaaattggataatttgataattatcattattgggtttctgagacgttacacatttaacattctcttctgcacaagttgcctttgtgtgtctttcctgaagactatcttctggtctcgaaatggacatgatggatccatggatgtacagcagagagcctggaggtccaaccgcagtagacagaaagggctgaggtccatttgtatgcacacaaagaaaagagtttcttcctttcgaggaaataaaattggcctgaaagacgtcattactctacggaggcatgtggaaacaaaagttagagctaaaatccgtaagaggaaggtgacaacgaaaatcaaccgtcatgacaaaatcaatggaaagaggaagaccgccagaaaacagaaaatgtttcaacgtgcgcaagagttgcggcggcgggcagaggactaccacaaatgcaaaatccccccttctgcaagaaagcctctttgcaactgggtcagaatggtggcagcggagcatcgtcattcttcaggattgccctactggccctacctcacagctgaaactttaaaaaacaggatgggccgccagccacctcctccaactcaacaacattctataactgataactccctgagcctcaagacacctactgagtgtctgctcactccccttccaccctcagtggatgataatatcaaggagtgtcctcttgctcctcttccaccctctcctcttccaccctcagtggatgataatctgaaggaatgtctctttgtcccgcttccaccctctcctcttccaccctcagtggatgataatctcaagactcctcccttagctactcaggaggccgaggtggaaaaaccacccaaacccaagaggtggagggtggatgaggtggaacaatcaccgaaacccaagaggcggagggtggatgaggtggaacaatcgcccaagcccaagaggcagagggaggccgaggcacaacaattacccaaacccaagaggcggaggttgagtaagctgagaacacgccattgcactcaagcctgggcaataagaataaatccgtaggtcgaaaaaaagaaaaaaatcaaaaaacaaaacaaaacccacgctccaaaaacaaactaacgaagaataaataaataatataaaaataaaa

SEQ ID NO: 61880 - DNA, 994 bp, Homo sapiens; identical to SEQ ID NO: 8752

SEQ ID NO: 61881 - DNA, 341 bp, Homo sapiens
atggtgcgagaactttggatgtggaacgtggaggaggaggaacacgaagtggggatctgcacttggggtggtcagcactgcggatgcccagcaaagtcactgcctggtccacatcccggaggggtctctgcgcctcagtcggcatcgcagctgatggtgaaacttttggtgtggcagaagagtgtccacaaacttcggaagttgctagagaaaactgaaaactactagttttgaaagcctcacttctgccaatggaagcacattccagcatgtcgccaacgcaatccactttccaccactttcacaaaaaacgttactgcacaattatactatcctaccct

SEQ ID NO: 61882 - DNA, 639 bp, Homo sapiens
atggtgcgagaactttggatgtggaacgtggaggaggaggaacacgaagtggggatctgcacttggggtggtcagcactgcggatgcccagcaaagtcactgcctggtccacatcccggaggggtctctgcgcctcagtcggcatcgcagctgatggtgaaacttttggtgtggcagaagagtgtccacaaacttcggaagggccgcggcggcaaggtccttgctcccatggcgtgactccagggtgcaggagcctgggctgagcaggtggagtagggtgagctccgccaagaacccagcgagagtggcgccccagggcggcacaggaggccgcatttaacatgtcaatcatctgaaagattttatggcatcttttttttgacatcttataatatctataatgtttattatatcttgtgatataattattaacaccacttcagtgtgattattatgattatttttataccaacacatcttcaattattaatattcccagttgctagagaaaactgaaaactactagttttgaaagcctcacttctgccaatggaagcacattccagcatgtcgccaacgcaatccactttccaccactttcacaaaaaacgttactgcacaattatactatcctaccct

SEQ ID NO: 61883 - DNA, 1000 bp, Homo sapiens
tctctggatgccaggagacgcaaagggccgaccagaatgaggaattcccaggcggagtccaggggaggcagcacggcatcccagcctcagggctgcccggacggtgttggttggggtaagattggggaagatgccaggtgatagaatccaccctgcctctgacagcatccaatctggagcaaaggcttctttcaaccttcccccaagctcccaatacaagcccaaattctggaacaagtcctttccaacacctccttcagagaagctccctggctccaggcagtgcttgctcccctcactgcagcaggaagcctaacttgcgaactgcaggtgtgctccaggtggtcactggatgcaagaaatggtgcgagaactttggatgtggaacgtggaggaggaggaacacgaagtggggatctgcacttggggtggtcagcactgcggatgcccagcaaagtcactgcctggtccacatcccggaggggtctctgcgcctcagtcggcatcgcagctgatggtgaaacttttggtgtggcagaagagtgtccacaaacttcggaagggccgcggcggcaaggtccttgctcccatggcgtgactccagggtgcaggagcctgggctgagcaggtggagtagggtgagctccgccaagaacccagcgagagtggcgccccagggcggcacaggaggccgcatttaacatgtcaatcatctgaaagattttatggcatcttttttttgacatcttataatatctataatgtttattatatcttgtgatataattattaacaccacttcagtgtgattattatgattatttttataccaacacatcttcaattattaatattcccagttgctagagaaaactgaaaactactagttttgaaagcctcacttctgccaatggaagcacattccagcatgtcgccaacgcaatccactttccaccactttcacaaaaaacgttactgcacaattatactatcctaccct

SEQ ID NO: 61884 - DNA, 465 bp, Homo sapiens
atggcgtacctgagcgagtgtcgcctgcgactggagaaaggctttatcttggacggggtggctgtgagcaccgctgcccgcgcttatgggcgctctaggcccaagctgtggtcggcgattccgccctacaacgcgcagcaggactaccacgcccgcagctacttccagagtcacgtggttccgccccttttgcggaaaactgatcaggatcatggcggtacaggaagggatggctggatagtagactacatccacatcttcgggcaaggacaaagatacctcaacaggagaaattgggcagggacagggcattctctccagcaggtgactgggcatgaccactacaatgctgatctgaaaccgatcgatgggttcaatggaaggtttggctaccgcaggaacactccagccctccgtcagagcacgtccgtcttcggagaggtcacccacttccctctgttctaa

SEQ ID NO: 61885 - DNA, 465 bp, Homo sapiens; identical to SEQ ID NO: 61884

SEQ ID NO: 61886 - DNA, 1272 bp, Homo sapiens
ccaaagaaagcaaggggaccaaggccgggactgctggggtgaaggtccgggaggctgagtaaggggacggaagggcacaggccatggaaaggaatgacatcatcaacttcaaggctttggagaaagagctgcaggctgcactcactgctgatgagaagtacaaacgggagaatgctgccaagttacgggcagtggaacagagggtggcttcctatgaggagttcaggggtattgtccttgcatcacatctgaagccactggagcggaaggataagatgggaggaaagagaactgtgccctggaactgtcacactattcagggaaggaccttccaggatgtggccactgaaatctccccggagaaagcccccctccagcccgagacgtctgctgacttctatcgtgattggcgacgacacttgccaagtgggccagagcgctaccaggctctactgcagcttgggggtccaaggctcggctgcctcttccagacagatgtgggatttggacttcttggggagctgctggtggcactggctgatcacgtggggccggctgaccgggcagcggtgctggggatcctatgcagcctggcgagcactgggcgcttcaccctgaacctaagcctgctgagccgggcagagagagagagctgcaagggcttgtttcagaagctgcaagccatgggcaaccccagatccgtgaaggaggggctcagctgggaggagcagggtctggaggagcagtctggtgggctccaggaggaggagaggctcctgcaggagctgctggagctgtaccaggttgactgatgcagcaagctaccctcagaggtcccagtggtcactggaggcagttttttggttgttgtcttgggggttctgcaggaccataataagaaacccacacctggttcccttctcaacttggaattttcagagcaaaaacaggaatcaagtcttccccacttctccagtccctcagtgtctcgctgttttgaactgtgtgtatccatggacagtcaagagctcaggaagttgagagcggttttgtttcccacccttagagtctgccaagcctctagcccactggccttgagagatgagtgtgtgcccaaccaaatgctggctataccagttacagcctccactcataaaagggaaaaagcaaaatctttatggtaaacaaacactgatctccacagctcttaacaagaatgtttatagccccaaaccaatgaatggacatgtaatcaaaaaaaaaaaaaaaaaa

SEQ ID NO: 61887 - DNA, 1016 bp, Homo sapiens
gatggcgacgagtcagtatttcgacttcgcgcagggcggcggcccgcagtacagcaccctcctggaggacgggactttggtctggttattccccgctgctgtgacagcgcccatgacagcagctggtccccactagcacccaggaagtatttatccaatgactcaatgaatctgccgccggatcgcccgggactgctttcactttctgtcagtccagaagtggagaccactcccccggcccttgcatctgggcttccttgtgccctgccttggacagttggctgcagtggaagtgacgctgtgactgccctgtgcccaagcttaagaggccttgcctgcatctgctccatcttatgggaccctgcctggtgaaggacccaaggctggcctgctggaggaggagatataaggagaagagtcacagtgccccatccaacaggtagctgccctccaggggcagagaagcccagccatggtcaggagagccacccagctgaggcccacctccaccaggattgccacccagctgaaccccacctcagccaggagagccacccagctgagccccatctggccaggagagccatccagctgagccccacctctgccaggattgccacccagctgagccccgccttggccaggagagccacccagctgagccccgcctgggccagaagagccacccagctgagccccgccttggccagaagagccacccagctgagcaccgccttggccagaagaggcacccagctgagccccgcctggccaggagagctgcccagctgatccccgcctgcagaatcacaagtgaaataaatgattgttgctttgagtcagaggtcagcggaccttttctgtaaaaagccacatagtaaatatctttggctttgtgagccacaccatgtctgtcacattagtgaaccctgctattgtattgcaagatgagccgtggacaatgtgtcatccagtgggcttggctgtgtgccaataaaactttatttttttggaca

SEQ ID NO: 61888 - DNA, 1016 bp, Homo sapiens; identical to SEQ ID NO: 61887

SEQ ID NO: 61889 - DNA, 1626 bp, Homo sapiens
ctgtgctgagtttttcgaaggtcagagcagattgaacctttgtgctttcatttttcctgattttgatttttcttatggggatccacttttcctgcattcgaggtgacttgaagaagccttccaaaaagcgtgtgaaaagggagccctactctactaccatgttacaggtgacttcattgagcccaatcaatgaaattttgagaagatacagcctgtacaccaaccagcattggaggcatcatggcttctggagaaagaagatacagccacaagaagcctctgaggagcctccagctcacaaggacagaggaggtggagagaggccagtcaacgcgagggtggtgcgggtggcccctctgaggcctggttttgctctttgtgggtacgctgtacaagacatctctaaagaagacactgtatatgacatctgtaatgaggatgctgtagacatctctgatgaggacactgtagatatctctaatgaggcttctgtacatgacatctctaatgaggctgctgtatgtgacatctctaacgatgccgtaaacatctctaatgaggctgctgtacgtgacatctctaatgacgctgtagacatctgtaatgaggctgctgtacatgacatctctaatgaggacactatagaagacatttcttatgaggacactgtatacgacatcactaatgaggatgctgtacgatacctctgtaaaaaagatgctaccaaggagccattgacactggagaatgatttgattgtggagagcatgtctgatgacgaggattttgcagcttaaagggagctcccggggtgagtgacggaggcgggatcggaccctggcagtttgacggcaacacctgtgttcctctgcactgggccgtggatgacattacacaccttggtgagaatcaggaattgaggctaatcacatctgaaattgagctcgctcactggacaggatagactgggcgcccaggcctcaagggcttatgatttcttctcgggtttgaaacatgcccccagatgagcaagacggggctgccacattgacggagcagctgcgggacacacccaagaaacctcctggagaacacaggggacattcacggctggaggcttcatctatggccgggggcttcatccatgagctggggacttcatccatgggctggggacttcatccatgactggggacctcatccacgtctggagacttcatccgcgactgggggcttcatccatgggctgggggattcatccacgggctgggggcttcatccatcactgggggcttcatccacgggctgggggcttcatccatgactgggggcttcatccacgggctgggggcttcatccatgggctgggggcttcatccatgactgggggcttcatccacgggctgggggcttcatccacgggctgggggcttcatccatgactggggacttcatccacgactggagacttcatccataggctgggggcttcatctacagctggagacttcatccacagcaggggcttcatccttggttggtttgcctgatctgtatctgagccacagatacagattattaaacagataataattttaaaaaaaaaaaaaaaaaaaaaaaaaaaaa

SEQ ID NO: 61890 - DNA, 1658 bp, Homo sapiens
tcctatgaagctttttgccttaaatatttttctctgtttataagaatgtgctgtttcctaggccagttttgtacacactcttccatagaatagatccagaagaaacacaacaatactgccttcatcatatcaggagatcttgataccaaatacgagtgttgcctccaagatgcaagatcctgagggctccaaagaatccactgtccgtcacaaatcgacggtccgccagctcagtttcagagacgtggtgctccgctgcaggcctcatcctcaggtgcaccctggcagtcagccatctgaaggtactatggaaattcagttactcactcttgggagcagaaggattccagaccattcctgtgtgcaccctggcagggagccatctgaagatttcagggaccacctggaggggagcggaccagagagacttcctcggaataggctgtggctcttcacaaggtgtcttctatgctttatttgggagccattgccttgagcgttatttcccagatggttttctaatgtcaccaactgaagaaaagacccatgcacacaggacacagcatgatctgatgctcacagcgttttccttcctctctgaaaacggactcagcgattctggcaagcggtacttactctgagatcacccgtttgctaaggaaaaatcttagtactgagaaaggtgacactttcctccctgcttttgctggagagacactttggttatgagttatttctagcataacacagtttatttcagaagtccagctcaatagcagaccaaggcatgaacaacacatgaaaatttatgttgggaaaatatatattgtatgtctgcttgaactgtgggttcttgattaatacaaaactggttgatgaaggttgttaccttcaggaaaatgcaaatctagtggagggacaaaactcacagtaacagtatttcatcatagccaccatgaggcagtacattatgaagcatgtcagtgatgaattactggcaggctggtctgtcattgaagctacactctgtttctagcttctgttgcttctgctgtctctctcctaacatctgcatattcctccactttgtggtggaggaagcattagggctgatataggggatttccagtgagtgtataattcagtgcagaattggcaggaatatattccatggttaggagctggagaaagtaagaaataaaaatagaccttgaagaatgggtaggattttcaaaatcagagataaagacgcaagaaagagaattcagtttttcaagtttctaagcaatcatatttacatgcatagacattttgctggtttctgtcttactaatgtatactacactgtgtctaatcactctgagggctggtatttcgggtctgttccagacactcaggaatcatttgttcagcttgttctatatgctggaaactgttgcagggatggatatatgcagtccttgtcccaaagcagcttatgactccaagagcaagggatagaatatgaacatgtgtctttgggttacttctaggggtaagaatgagttctgtgggcagatgcatacaggaagtggggagagggagaatgagatacaaactatccaggcaggaggcattgcagtaatcaaagtgaactatgagagaagcctggggtgttg

SEQ ID NO: 61891 - DNA, 500 bp, Homo sapiens
cggaggagtgcgggccggagggtgatgggaccatctagcccctaaccatgggcccagaagagaagaccatcatgacagaaaggtctgcagctgttttcatccaggcctggtggcggggcatgctggtgcgacgcacactgctgcatgcagccctcagggcttggatcattcagtgctggtggaggcaggtgctggagaagctgctggcaaagaggcggaggatggtgttggagttctatgtgcagcaggaatgggcagcagtcaggctgcagtcctgggtccgcatgtggtgtgtccgccagcgttactgtcgtttgctcaacgctgtccgcatcatccaggtctattggcgctggcacagctgccattcccgtgtctttattgagggccactatgaactcaaagaaaaccaacttaatattcaacttgaaatctctttgggcttacaggcttgtaaggtgcaacaatgcataccccttccattaaaagaatgaccaggt

SEQ ID NO: 61892 - DNA, 500 bp, Homo sapiens; identical to SEQ ID NO: 61891

SEQ ID NO: 61893 - DNA, 738 bp, Homo sapiens
atgtcgtctaggttaagcctgtttactaagaagctcagcagagaacagcccgttgatcctgacctcaaggactatagattcagcagagatgatgaaaaagaaagagctttggccaaagaagggctccttcacagcagcagcagcagcagcagtcttggctgttgccacagccacagggggactgtggaggagcggccctcggcaatgaaaataattccaggagactcttggattaaaattgaaattgcaaggcataaagaaggtggcaaattcgatcattcagcaaatttggaaaaattagttgataacgtcttccaggagacctacggccatcctactgatatgaaccagatcatacctgccctgatgggatgccagagaaagactgctgcaagtagggatcctctggaaacagaacagagggaagaagataccttccctgaagcccagatgttccagaagcctgcgcctcattcacaaagtcaccccaaaaatgccctagagtttggagttttgaagaagcgggaagaaggcctgagtaagggcctgggaaccaagttagatcctacttcagcatcagcacatgccagcgatggtgcacacaggtggagagcggcctgcccgtcttttccatggtgcccacagacccatttaggatgaaagatcagaaaattctctccatgtcaccgcttctgaaacatgtgaatattaatatttggtgcctaaaaggccatggca

SEQ ID NO: 61894 - DNA, 738 bp, Homo sapiens; identical to SEQ ID NO: 61893

SEQ ID NO: 61895 - DNA, 544 bp, Homo sapiens
ggcgtggctcaggctcgtggaggcgtccgagctccagggcagctctggggcagaactgtccggatctaacaatccctggggagccggagaccggtgacccgccctgcccgcaggccatgtggcccccgctgttgctgctgctgctgctgctcccggccgccccggtccccaccgccaaagccgctccccacccggatgctaacacccaggaaggccttcagaacctgctccaaggagtcggggctggcggagacggagagctgcgggcagactcacacctggccccgggctctggctgtattgatggggctgtggtggccacgcgaccagaaagccggggaggaagacctgcggttccgtgagaggcgtccagggctgcaggccacggcgacaggctccggggaacatggggctttccctgtccactcccaaggagtgtgggcctcaacgcattggcaggggacggccgtgtgccctctccagaccccacccccagatgcatttattagaaataataaagttctttcttagctagaaaaaaaaa

SEQ ID NO: 61896 - DNA, 2292 bp, Homo sapiens
aacatgggacttccacagcaatgggatttccttccgcattcagtttgtgcctttcccatgagcgagagactcctaggggagccgcagcccgttaggaagccatgtgggaactcatccacagactggactctgaaacgggcatgtacagagaagaggagaccccaacacgcttcaagctttgagtggagaggacacagcctctgctgggacagggaacagagggatgcggagaccctgaagatgcttttggacagtggtctgaggttgggacagtggcaggagataccattcacccaggatctccaggacaagagatcagcctggcagttacatgtgttttttttcaaactggttgccaggttggcatgagcgatgacatcagagattccgaccttcctgattggagggaccggactctgtcggcacctgggagttcagttggacaacagtaacttctcagagctgttctccactcctgacttctcccagcctcgagaattgataacacactcttctggatcccagcagtgtccagaagaagaccaaggacagaacagagactaggtttggtgagatgggacagattttgggaaagatcatgatgagccatcaaccgcagccccaggaagagcggagcccccagcggagcacctcagggtaccccctccaggaggtggtggatgatgaagtgtcgggaccatcagcccctggggtagatcccagccccccacgtaggtcccttggctggaaaaggaagagggaatgtttggatgaatctgatgatgagccagagaaggagctcgcccctgagcctgaggagacctgggtggcggagacgctgtgtggcctcaagatgaaggcgaagcgacggcgagtgtcgctcgtgctccctgagtactacgaggccttcaacaggctgcttgaggatcctgtcattaaaagactcctggcctgggacaaagatctgagggtgtcggacaagtatctcctggctatggtcatagcgtatttcagccgggccggcctcccctcctggcaataccaacgcattcatttcttcctggctctctatctggccaatgacatggaggaggacgacgaggcccccaaacaaaacatcttctacttcctgtacgaggagacccgctctcatatacccttgctcagtgagctttggttccagttatgccgttacatgaacccgagggccaggaagaactgctctcagatagccttgttccggaagtatcggttccacttcttttgttccatgcgctgcagggcttgggtttccctggaggagttggaagagatccaggcttatgacccagagcactgggtgtgggcgcgagatcgcgcccacctttcctagagctccagggaccgtggaggcctgaggtcatcggcctgagagaagaacaccggacccaggggagatgtggattttcagcaggaactttattccaatgctaatggcagacatcaggaaggaggagaggaaccatttgtgcagatcatctagaagaacctggaccattcttgacagagctgaatacagtgatcacgttgtcctccaaggagcaggggtggggtggggtacttctaggagtccttggagaaaagtaagaaaccaggagtgtttccagttccaccctttcctgcggcaccacctccctttttatattgctgaatgccaacctccctggggcggaacctggaggtcctgtttcttatggacttggttgtcacagtccaggagcatttgaaggcacagtgcaggggctcagattggcacagaattctttgtgaaatatgagtgccacagactgtaacagatagcttcatgcacactatgcattttattggtttgtttggaaaatgttggccattgaattattaataggtttatttcaaatagtttggaaattgttgtacttttgaaaacatgctgttcctgtagagttttttgatgagagttatagttgttatatatacctaaagataattttcttttcatttttaagtgagaattctttttatcctaaatcttttattatctttaattttttttctgtattattatatgtgctcctgaagcgagcactctttttatctatgatacttccataataatctcttctatttatagctattggtagttccccaccagaaaaaaacataattctggtgatagaaatttttatttgctgtttaggtttgtgactgacttgtgagaattcagttgtgatttttaacatgtctcagatatatataacaaaaaaaaaaaaaaaa

SEQ ID NO: 61897 - DNA, 1007 bp, Homo sapiens
atggcagcagatgacctgttgacatcctacacagaggtcctggcagtgggaatagagaaacagatggtgcttcctgaggccccaggacttgtgccccagtatacagtctggtggccagcatggcatcgtgctcagcagaacttctccctcctcctcgctgttgtggtccagtccaaacatcccagccccaacattccctggttccccagctctgtgacatcacagacagccttctgtctactctgccagctgcagtgcaatggggtcactagagacctgaagttcatacccactggggacaacccaagggccctcttctttggtttctgcttccctctagagggggtcactggacctggaccagctgggatcattggaagccagaaacagcccagcccagtgaactgggctcaaactcaagactggctgattcaacaaggcacccctgcagacaaagctggcagagtagaagtttcaactcctttccatggggactgtcaggagccctatgccatcaatgactccaaggttcccagtcaaacccaggagcacaagccatcgacccaaaatttgctgcttcagaaggatgagcttgacagacaaaatcccaagcgcattaacgcagtctcccatttgccttcgagaacacccctgatccagacaaaaaagagcacttcctccagcagcagtgagtttgaggatctgaatgcatatgcttcccaaagaaatttttacaagagaaacttaaaccgctactgccaggagcactggccattccagccatgcctcactgggaggccctgagcattctagccggcggctgcacagctgctggggcatctccatgaggaagagggcggtggacaggagtcatgaagactaattcggaaactcccctgaaggaggagaagacatctgagccatccttgtgccaccaagcaagagtcactccagctcctaaaaagccaccatgggaagagctgcctccaattaaagttcttgattgc

SEQ ID NO: 61898 - DNA, 2415 bp, Homo sapiens
attcaggatgggacgaccttataccgcggctctttctggcaaaggtaatgacatacgcatctgtgccagcatcccaagagtgaggctggtttctggaaatccattctgactctgtgacagcggggatggatgtgaccttgcccgtggttagaaaacaaatttactgagttctctgggtgccctgcagacctttggatcctgccaccttgctggacgggagggctctctagctcctgccagcccttagagccacaggaccttggtcacaacatctacagaaggccctgcagctaagtgatctaatccaggatcatatgctgcctttaggtgacacatccctttagtctcctttaatcaggagcagtttctcagtgttcatcttccatgaagtcgacatttttgaagagtataggtgtcagatctttttcaagaacagcagaaaatgatcgaataccagatacctgtgtcattcaaagatgtggttgtgggcttcacccaagaggagtggcaccggctgagtcctgctcagagggccctgtaccgggatgtgatgctggaaacctatagcaacctcgcctcagtgggttatgaaggcaccaaaccagatgtgatcctcagactggagcaggaagaagcaccatggattggtgaggcagcatgcccgggctgccactgttgggaagacatctggcgagttaatatccagaggaaaagacggcaagacatgcttttgaggccaggcgcagccataagcaagaaaacattgcccaaggagaaaagctgtgaatataataagtttgggaaaatatcacttctgagcactgatcttttttcttcaatccagagccctagtaactggaacccttgtggaaagaatttgaaccataatttagacttgattggttttaagagaaactgtgcaaaaaagcaagatgagtgttatgcttatgggaaattgcttcagcgtataaatcatggtagacgacctaatggagaaaagccccggggttgcagtcactgtgagaaagctttcacccagaacccggcacttatgtataaaccagcagtaagtgattctctcttgtacaaacggaagagggttccacctacagaaaaaccccacgtctgtagtgagtgtgggaaagccttctgctacaagtctgaattcattaggcatcagagaagtcacactggggagaagccttatggctgcactgactgtgggaaagccttttcacataagtcaaccctcatcaaacaccagagaattcacactggggtaagaccctttgaatgttttttttgtgggaaagcctttacccagaagtcacaccgcacagaacatcagagaacacacacaggagagagaccctttgtctgcagtgaatgcgggaaatcgtttggtgagaagtcatacctcaatgtacatcgaaaaatgcacacaggagaaagaccgtatcgttgcagagaatgtggaaaatccttcagccagaagtcatgcctcaataaacattggagaactcactttggagaatcttcccttagaagtaaaagctccaatacataaaagacagatgaacatgtgaacatggacatttattgtaaaaattgttcttaatggcaaaaaaacccccaaaaccaaagcaaacactagaatcaaagtaaatacccatcaactgggaaattgtagaaaggaaaaaactatagtgtatccattccatagaatgttaatatagccattaaggtggacaaattaaaactatgctagtggacttgagtggaattccacaatgttctcttgagtgaaaaatgcaaggtagatattaagtatgttaaatatgactccatttttgtaaatcattaacaaaatgtctctaggtgtttgtcagcaataaacggtatctatatatgtttatttgattttatgtgcatgaagaaaagtatagaagagtatgcattgacttggagggaggtgggtaatgcaggtaggttatgggggagtcaggggtgtagggaaaaggaaaaccaaaaaaagaaaaatacataaatgactgaatcacgggtgataccacaaatgtgtgagttagtaaatttggctggggatgagggagctagaattttgctaatttgtggggatgttcatggtatatattgtaaaaagggaaaatttcataataatgtatacgattctatttttaaaaaaagtaaaaactcctgtgtgtgtgtatatatgcatgtggatgtttatatgaacatagaaaagtgtagaagaatacacacgaaggtgttaacattcattggttaccttggtggagaagggtaataagttttctgaatacctttgcattgtcttgttcacatatattgcttttgtaatttgaaaaacaaaataaagggggaaaacatttcaaactg

SEQ ID NO: 61899 - DNA, 2038 bp, Homo sapiens
gccacgccccttttctgcattctagtgagaccctggtgacacctcctgtggctcagtcacatagctgcgtggtacgtgactggaggcatatcactgtcctcgcctggatcacgccaatgtggccccaaccccacctccctccccaccccatgatgtcagaaaaaacctgacacagaaaattggctggggccaagagaaagttcacagactatcgtcagtggaacattgctggtgttggtaccggagcaaccgacaccaaaaagaagaaaataaatcatggcactaaccctgagacaaccacttcggggggctgccactcgcctgaggataaacaacagaacggagctcagctgaaagaggaaaagaaggcaagccaccaacatcagcaagccctaaggaggcagctagaggcccaggatcataccatacgaatccttatgtgtcagaaaactgaactggagacagcgctccatgacagccaggatgctgccaggaaatttgaagaagattccaaggatctggcaggctgcctgcatcattcctggcactttgcaggagagttacagcgggctctctctgctatgtccgcagagcacaagagggcggacaggtacatcgaggagttaacaaaggagagggaagccatgagtctggaactgtacaggaacacgtaggatgggggaaggtgggatgggaggtctgggggcccttagcgtgggtggtgtgctgggaggtggggggtacaggtgagcatggtagggggtcatacaggtttacatgtgtgtgcagggaagctccagtgacggctgtgccactgactcatggggtagcctcaggcaactcatgtcttctctctggcctgccacctgggacttttaattcctggggtcccttccaatgccacggttctgtggttgtggggcgagggtagagggtcgatcaccaaagcggtcctttctgttcttcgttcattcctttctctactgcctccggccatagcataaccaatgaggagctgaaggagaaaaatgccgaactacaagaagaacttcaactggtagaaactgaaaagtctgagatccagctccacatcaaggagctaaaaaggaaactggagacggacaaaatcccgctgccacaggttcaaaccaacactttgcaggagaagatgtggaggcagaaggaggagctacaggatcaggagaagctacggaagcacaaggagaagatgtggtgacaggagcagaggctgcgggaccaggagaaggagctgtgggagcaggagagcagatgtggaagcaggaggagcaaatgggggagcaggaggagcagatgcagaagcaggaggagcaggtgcgaaagcaggaggagcagatgcggaagcaggaggagcagatgcggaagcaggaggagcagatgcggaagcaggaggagcaaatgcggaagcaggaggagcagatgggggagcaggaggagcagatgggggagcaggaggagcagatgcggaagcaggaggagcagatcatgcagctgccccctggaatgaagaacgcccaggagcgcccaggcttaggcagcacctcctgcatcccattcttctaccgaggagacaagaaaaagatcaagatcatcaatatctaaaaagaacggtcaacaaggcctacagaagtgtaagccgccatgtgaccttgtgaatatagtctgagaacaaacttgaaaaaaagaaaatgtattttaaattgtggcaaaatactggccgggcacggtggcctgcacctgtaatcacaccactttgggaggcctaggccggtggatcaccaatcccagctacgtgggaggttgaggttgcagtgagccgagatcacaccactgcactccagtctgggtgacagagtgaaactcccatttcaaaaaaaaaaaaaaatttttctacctgaggactctaatatctatgtatgtttctattgttttttttgtttgttttctcctttcgtcttgtgttgtcttgtcttatggcatgcctagtaaagttttatgt

SEQ ID NO: 61900 - DNA, 1839 bp, Homo sapiens
agcaggggtggtcgccatggagactcgtggccctggcctggcggtccgcgctgagagtcgccgactagtcggcatcgggcctcgggcgcccccggggcgggttgggttgcagcccagcgggcggctggaccgccgcggtggggcggggacaatggggtacaaggacaacgacggcgaggaggaggagcgggagggcggcgccgcgggcccgcgggggtctagactgccccccatcacaggcggcgcctccgagctggccaaacggaaggtgaagaagaaaaaaaggaagaagaagaccaaggggtctggcaagggggacgataaacatcagagtcagagcctgaagagccagccgctttcttcctcctttcatgacatcttaagtccttgcaaagagcgtggcccgaaaccagagcacagacagagcaaagtggaaaagaagcacctcccttctgactcctccaccgtcagcctccccgactttgccgaaatagagaaccttgcgaatcggatcaacgaaagtctgcgttgggatggaattcttgctgacccggaggcagagaaggaaaggattcgcatctataaactgaatcggagaaaacggtaccggtgcttggccctcaagggcttccaccccgaccccgaggccctcaagggcttccaccccgaccccgaggccctcaagggcttccaccccgaccccgaggccctcaagggcttccaccccgaccccgaggccctcaagggcttccaccccgaccccgaggccctcaagggcttccaccccgaccccgaggccctcaagggcatccaccccgaccccgaggccctcaagggcatccaccccgaccccgaggccctcaagggcttccaccccgaccccgaggccctcaagggcttccaccccgaccctgaggccctcaagggtttccacactgaccccgaggccctcaagggtttccacattgaccccgaggccctcaagggcttccaccccgaccccaaggccctcaagggcttccaccccgaccccaaggccctcaagggtttccacactgaccccgaggccctcaagggcttccaccccgaccccaaggccctcaagggcttccaccccgaccccgaggccctcaagggcttccaccccgaccccgaggccctcaagggcttccaccccgaccccgaggccctcaagggcttccacactgaccccaatgccgaggaggcccctgagaacttaccctacctctcggacaaagatggcagctccagccacaggcagcccacgtcgaaagccgagtgccccaatctctgttttgaaggaaaccttaccccaaagcttctacactctgacttagctcctactctgctggagtgaaaatctacccacgacgctcacaaacttataattcctcctcaccacaagtttatgtgttaaaaaccatcatcataaaaggaaatgagacccgtatctgaaggaaacagatgttcggtacacggacgacgccgactctcccatcaccaagctgccctcggttgcccaggagagccacagtgccttgagaacataagcaatttagtgaacagagttcttttcagaatttcctttttcttaagtaagcatctctgttacttaatttctcaccacagctagatgtctataatctgccccaaaaagaaaagaaagcgtgtagatgatttacctcttaagtctcaatctcatggtgaaactcctcacacggtacctgcttctgttggccggaggacgatgccctgaacctcttggagcctttttctgttttaattaaatgcatggcctgcctttatatggcctcaaat

SEQ ID NO: 61901 - DNA, 2045 bp, Homo sapiens
atggcacggacgcagggcgcatgcgcccgcgcccccccacccccagctccgcggtcctccaggcagcctgcgcccctcgcgccgcgcccgtggagctcccgggcccggctgccccgctcccgccccagcgccatccctcctggctggggccgcgcgggaggcaaggactccgcgggctggtgtgccgggggtccggcgccgcgggccacccacgcccccagccagcaactcggcgcggacggccccgaggccgtggcgcaggacacgcggcggcgcctcgggcccccgacggcgctgtggccccgagcggaacggcccggaagaggagacgcgtccccgggaacccagtgcccgccctggcccagccccgatccagcctgcgcctcacctcgggttgtagacagagcggcggggatcccagaggggttcgcgggtcggacctggagtaccggcccggcgaagcgcgccgctgtcgcccgcacgtgactggctcggacaagatggcatgagcggagaagcggccggatcccagatgcgcgcgtgccgccgccgcgggcactgcgcccgtttgcctgcccctcgtcggggatcgggcgctccctctgagacctgaaagggcacccaagtgccccctgtctgcgaagtccggcgcgggcccttcggcgcccccgatgtctctaggcttccgcaggaggcgccctgtaaatcttgagtcttcctgcagcgagggggcacaggacagctgcgaattgggacgaacgagcccagagccccgggaaggatcagaacctcgaaggcggcttcaagtcggccccgcagcccgaggtgaccgtgggcggttacgttgcccgagctcgccccctcctcctgagcgcaggtgcccgtgggacatacacccgcccacctgctccggaaagttccctccagaagggagttcccgcgccaccgagacccgggagctcccgatcagactcccaggccgtgaaaggcgttatcggacagggcccagaggcgcccccacagcaagaagaaagtctggggttctcaccgtgtgccaggtgcgagctcaagccacctccctcaaccgctctgagaaatatcccacttcacaaacttgctcaaagtcacgctgctggctggatttgaatccagattttttttagcaccactgaaaaaacaatatgacaaccggagaaagaaaaatctaaaaagaatacagtaatccatattgttacaaagaaatgcaacttttcacgacatgaaacatatatatactgtgtatagttgcaaccacactttttttgttactactttcactaccatttttatttgttcacgattcatttttaaggtgtgcaggtgtccttaactattcactcagccccctaatgtttttggttctttacggttgtttgctaacgtatccttgaattctgcacttgggacaaatacctgggagtggaaaggctcccaggtagaaggctatgaatggccaagtggtcttggcttacagcgtcatatttttcccaagagctgccccaattattctaccgcctccaaggaacaagtgtaaggagtttaacacacttataaacattgagtgccatttcccccctactttaatagtctattgctagttcaaggttacttagcatttcttaggtgacacaacattcaaaaatgaatgtttttccatgcatttactatatgcattccctctcctgtgaataatctattcatatccatcttctggggacttgaacctcttctaactttgaacaagcatttttttatgttacagatattacttctttgtcgtcattgatgcaaatattttctagcctgttgttctttcttgttttattctaatgttcagtgtgtcattctaatgttttaattgcttcagtgctgacaaagtgagctttctgctgcccatctgatagtcttttttctgctagttttgtacaatttcatttcatatttcattctctgatgactatcccgattttattttggcttatttatttggagtaaaatatggacat

SEQ ID NO: 61902 - DNA, 3354 bp, Homo sapiens
cctgccctccgacggcgtctccaggccccaaatggcctcgggtcggtgggcttctccaggcccagcttgggcctcccggcggcctctgcaggctcaagtggtcctgaagtcagcctctccaggcccagctccggcctcccagcaagcaagctcttttggctcagctcctgcccagctcccgccggcttttgtagaccctgaactttctccagcgatgctcctcagtcccacctgcctcccggtggcctgtacaggcccaggtctggctggagaacagcctctgcaggccccactcttgcctcctaggggcatctccaggcccagctctggcctcacggcggcctcccgggaccaagtccctgcctgcctcccagcagcctgtgtgcggcccagctcctccgtcacggtggcctgttcaggcccaactcatgcctctggcaccctttcgagaggcgtgagcccctgcctcacattggcctctctcacgctgagggagttcagcgtgggcccctgtctcacactggcctctctcacgctgagggaggtcagcatgagcccctgcctcacactggtctctctcacgctgagagcaatcctccctcacgctggcctgttgagacccagctcatgcctctgttggcctttccaggcccagcccctgcctgttggcggcctctagatgtccagcctctacctcaacagtgggccctccacgcccacctcttgcctggccgtggcctcttcgggccaggctcccgccttggggcagcccccgcaggcccagctcctgcctcacggccctccggaggccaagctcatgcgtcagggcagcctctcccagcctggcgtttgctcctttgcatgggctccaggccctggacttcctccagtcggcctctccaggcccagctcttcctcccggcagcctctgcaggaccagactgtcgtcaagtaggcctgtccagggacagctccttcctcccggcggcctctgtaggcccagactgtcatcaagtaggcctgtccaaggacagctcctgcctcccggtggcctctgttggcccaagtcgtcctcaagtctgcctccccaggcccagctctggcctctcggcggcctctccaggtgcaaaagttcctcgagtccgtctctccaggctcagctcctcctgtctcccagtggcctctttcagcccagcccagctcatgcctcccggtggccttcccaggccctgcttttgactttccgcggcctctgcaggccccgaacttgaccaccagtcggcctctccaggcctggcctcctgcctgttgacagccactagaggcccagcctctacctcaacagtgtgccctccaggcccacctcttgcctcgccgtggcctcctcgggccaggctcccacctcgggacggcctccgcaggcccagctcctgcctcacggaggccctctggaggccaagctcatgcgtcgtggcggcctctcccggcctggcgtttgctcctttgcatgggctccaggtcctgcacttcctccagtcggcctctccaggcccagctcttcctcccggcagcctctgcaggaccagactgtcgtcaagtaggcctgtccagggacagctcctgcttcccggcggcctctgtaggcccagactgtcatcaagtaggcctgtccagggacagctcctgcctctcggtggcctctgcaggcccaaatcatcctccccaggcccagctccggcctctcggcggcctctccaggtgcaaaagtttgaatcagtatctccaggcccaggtcctcctgtctcccagtggcctcttttggcccagcccagttcatgcctcctggcggccttcccaggccccacttttgactttccgcggcctctgcagattccgaacttgacctccagtcggcctctcctggcccggcctcctgccttccgaaggcctgcacaggcccagtctctgcctcacagcggactctccacgcccagctagctctcgcctcactgcagcctcccgagtccaaagctcctgcctcttggccgcttcggcaggcccagctcccacctgccagtggcctcttctggcccatggggttcattcctcacaacggcctttccaggcccattttttcccttccgactgcctctcaggacccagaacctctgggcccacttgaggagatgcagccaggaggaacagctgggcttgcagaggctgccatgcgggaggcagaggctgggcctcctgaagtcggcctctccagacccacttgcagactcccggcatcctctctgggctcagctcttcctcccggctgcgtctccaggcccgactccggcctcccaacaacctctttggactcagctcccgcccagctcccggtggccctggttggcccacaacttcctgaagccaagctccccagccccagctcaggcctcacggtggcctctccaggctcagctcctgccctctgacagcgtctccaggccccgaacggcctccagtcggtggattcctctatgcccagcttgggcctcccggcagcctctgctggcccaaatcgtcctgaagtcgccctctccaggcccagctccggcctcccggcagcctctccaggcgcaacgcgtcgtcaacgagggcccctccggggtcagctcctgcctctcatcagcctctagaggccagtctggcggcctctgcaggcccagactgcccttgagtcaggctctccagggccagctccagcctcctggcagactctgcaggcccaagtcgtcctcaagtcggcctggaagtgggcctggaagagctgcattttggcctccccgggcccagctccgtcctctcggcggcctctccaggtgcaaaacttcctcgagtcagcctctccaggtccagctcctcctgcctcccagtggcctctttcagcccagcccagctcgtggctgtaggcagccttcccaggccctgcttttgacttttggcggcctcttcaggcccagaacttgatctccagtcagcttttgcaggcccggcatcctgcctcccgaaggcctgcacgggcccggcctcggaatcacagcagactctccacgcccagctagctctcgcctcactgtggcctccccagtccaaagctcctgcctttcggccgcttcggcaggcccagctcccgcctgccagtggcctctttaggcccagctcattcctcacattggcctttccaggccccgtttttcccttccggcagcctcttggcctctaattttttttatcttttgtgtataaatcccaaaatatggaattttggaacatttccaccattatataaatattttggtaggt

SEQ ID NO: 61903 - DNA, 1020 bp, Homo sapiens
gtaggttctcacctacttcgactcctctccctgtcccagggaggggagaaaaggtctgggattcattgccaggaggggcttcccccaggatttcctacttctttctttactgctgtgcttgaagctcacaggagacccctcaagaggtggtcaccggcccacagcccaccccatcccccacccgccacccccaccgtaccaaatgctagctctgccctttcttctgtgtttttcccatcaagagagatggttgtggtcatgaagttcttccgatgggttagacgggcttggcaaaggattatttcctgggttttcttctggaggcaaaaaattaaaccaaccatctcaggacaccctgactccaagaaacactcattgaagaagatggagaagactctccaggtggttgagactttgaggttggtcgagctcccaaaagaggctaagcccaagttgggtgagtcccccgagctggcagatccctgcgtgttggccaagactacagaggagaccgaggtggagctgggccaacagggccaatccctactgcagctgccgaggacggccgtcaagtctgtctccacgctcatggtctctgccctgcagagcggctggcagatgtgcagctggaagtcatcagtgagttctgcctcagtcagctcccaagtgaggacgcagtcacctttgaagactccggaggctgagttgctgtgggaggtgtacctggtgctgtgggccgttcggaaacacctgcgccggctgtaccgcaggcaggagaggcacagacggcaccacgtccgatgccatgctgccccccgacccaacccggctcagtccctgaaactggatgcccaaagtcccctctagggggaaccccagacccttagagagtcctgacctcactcttacctggggtcccatatcagccccttcattccatgtattccagttgtaaaacaagtatcaaaatattgggaaataaatatcagatagttctgagtcagaaaaaaaaaaaaaaaa

SEQ ID NO: 61904 - DNA, 783 bp, Homo sapiens
aaaatgttttaatttttgtgggtacatagtaggtgtaaatatttaccgggtgcatgatacaggcatgcaacgtgtaagaatcacatcagggcaagtggggtatgctcacctcaagcatttatccattgtgttaccaatgatcgaagtatactcttggttattttaaaatgtaaaatcacattactactgactctagtcagactgtataattcttaatacaggatgggttttcttataatttgctatcctttctaggccacccttaagtacaatgttctcctacctaagaaggcatctggattttctctttccttggaaatagtaaagaactactcttcgactgcttttgacctcacagtgaccctcaaatacactggaattcgcaataaatccagtatggtggttatagatgtaaaaatgctatcaggatttactccaaccatgtcatccattgaagagcttgaaaacaagggccaagtgatgaagactgaagtcaagaatgaccatgttcttttctacttggaaaatggttttggtcgagcagacagtttccctttttctgttgagcagagcaaccttgtgttcaacattcagccagccccagccatggtctacgattactatgaaaaagttggagaagcatttcttgtaacaaactgattcttctgtatcaaacctggaaaaaaatcatgaaccatctgacatcgtgaacagtctgcagtgggctatggtttcttgtcaagtcttatttccttatcatcccattaaatgttgtcattttgc

SEQ ID NO: 61905 - DNA, 3056 bp, Homo sapiens
atgactcctgaggcacactggactggtccccccaaccccggtgccttgggctacccccaccaaagttttgtcagtcagccccaccccttcagaaagcagcccagtccttgccctcgccaatcaccccagggtgactttgggtgggtgactcctggggcttcccgctccattactgggctgtcatctcctgccgccccaagcttgatctccgtgggctctttgggctctcatctccaaggagccaggccccaccctcgccagtcatccttgggtgactttgggctggtgactcctgggactccctgctgcagactgtgccctcccctcctgctgcctcaaggtcgacctccctgggttctttgtgctggcgtctccaaggagctgggtcccaaccctgtgcttccctcccccatcgtggagcagcgacttggacatggtgctgacatggtccctccccccgaccaggaggagtggaatgttttaaaagaatattggcagaaaaacagacctagagttccagcaggagtgaacaggaacaggaaaacaaatggcagtatccctgagacagccacttccggtggttgccagccacctggggattcagcaacaggtttccacagggaaggccctacatcatctgctaccctgaaagatctggagagcccgtgccaagaacgagcagtagtcctggattcaacgtccgtaaaaatcagtcgactgaagaacaccatcaaatctttgaaacaacagaagaaacaagtggaacatcagctggaagaagaaaagaaagcaaacaacgagagacagaaagccgaaagggagctagaggttcaaatccagacattgatcatacagaaagaggaactaaatacggacctgtaccacatggaacgttctctcagatactttgaagaagagtccaaggacctggctgtccgcctgcaacattcattgcagtgtaaaggagagttagagagcgctctgtctgctgtcatcgccacagagaagaagaaggcaaaccagttgtccagctgcagcaaagcacatacagagtgggagttagagcagtccctacaggaccaggcactgctgaaagcgcagctgacacagttgaaggagtcatttcaacaactccaattagaaagagatgagtgtgctgaacatatagaaggagagagggcccggtggcatcagaggatgagtaaaatgtcgcaggagatttgcacattaaagaaagagaagcagcaagatatgcgtcgggtagaggagctggagaggagcttgtccaaactcaaaaaccagatggctgaacccttgcccccggagcccccagcagtgccctctgaggtggagctgcagcacctgaggaaggaactagagagagtggcaggagagctccagtcccaggtcaaaaacaatcagcacataagtctcctgaaccggcgacaagaagagaggattcgggaacaggaagagaggcttcggaagcaggaggagaggcttcaggagcagcacgagaagcttcggcagctggccaagccacagagcgtcttcgaggagctgaacaatgagaacaagagcacactgcagttggagcagcaagtaaaggagctacaggagaagcttggcgaggagcacctggaagcggccagccagcagaaccagcagctaacggcccagctgagcctcatggctctccctggggaaggacacggaggagaacatctggacagtgagggggaggaggcacctcggcccatgccgagtgtcccagaggacccggagagcagggaggccatgagcagctttatggaccacctgaaggagaaggcagacctgagtgagctggtgaaaaaacaagaacttcgcttcattcaatactggcaagagagatgccatcagaaaatccatcaccttttatcagaaccagggggccgtgccaaagatgcagcactgggaggaggacaccatcaggctggagctcagggaggagatgaaggtgaagctgctggagctgcagcagatggtattgcggcttacagcaactacaacaatgggcacagaaaattcctggccgctgcccacaactctgctgatgagcccggtccaggagccccagccccccaggagcttggggctgcagacaagcatggtgatcttcgtgaggtgaccctcacctcctctgcccaaggagaggccagggaggatcctctccttgacaagcctactgcacagccgatcgtgcaggaccaccaggagcacccaggcttgggcagcaactgctgtgtgccattattttgttgggcttggctgccaagaagaaggagataaacatcaccatcatcaaacagctgctcaagaaatttttaaataagaaaccaagttatggggttaatctcctacacaattcatttacttcctttgaatgttagactcactcatgattatttgtgtttctaatttatagtttaagtttatttgtaaaaagttaaaagagagtgggtgtctgtggctctcactgatgttcactctggcatcctttagcatttttcttttttaatttcataattgtaggtcattagcgtgcatatcgagtttgcccttacgtggtgggagttcaaacacacaaagacccactctttgcccaaaactgttctctttggtttggaataggctgccatgcttttttaatgttattgcagcatgtatattcactacagcattcagacaaaatttgcctatgttctgctgttgtttgatgtaatcttaatcacagtgagctcttccttagctcaatatgtagtttgcccccaagtgtgcactgtttattactttgtaatacgccactatgagtactgacatttagagttgtttaaaggccaagaattggaaacagcctttcctccattttctgtgtattggtgatgggagtgataaccttttgggggagctttttaaatctcacagaagaggaaagtggcctcctctggcaggtatgtgcaagatagagtgtgtttcatctcttccggtgccaggaattagcggtgtattatggt

SEQ ID NO: 61906 - DNA, 1104 bp, Homo sapiens
atgcggctgcgcttttggctcctcatttggctcctgctgggatttatcagccatcagcccacccctgtgtctttcctgaagactatcttctggtctcgaaatggacatgatggatccatggatgtacagcagagagcctggaggtccaaccrcagtagacagaaagggctgaggtccatttgtatgcacacaaagaaaagagtttcttcctttcgaggaaataaaattggcctgaaagacgtcattactctacggaggcatgtggaaacaaaagttagarctaaaatccgtaagaggaaggtgacaacgaaaatcaaccgtcatgacaaaatcaatggaaagaggaagaccgccagaaaacagaaaatgtttcaacgtgcgcaagagttgcggcggcgggcagaggactaccacaaatgcaaaatccccccttctgcaagaaagcctctttgcaactgggtcagaatggcggcagcggagcatcgtcattcttcaggattgccctactggctctacctcacagctgaaactttaaaaaacaggatgggccgccagccacctcctccaactcaacaacattctataactgataactccctgagcctcaagacacctcctgagtgtctgctcactccccttccaccctcagtggatgataatatcaaggagtgtcctcttgctcctcttccaccctctcctcttccaccctcagtggatgataatctgaaggaatgtctctttgtcccgcttccaccctctcctcttccaccctcagtggatgataatctgaaggaatgtctctttgtcccgcttccaccctctcctcttccaccctcagtggatgataatctcaagactcctcccttagctactcaggaggccgaggtggaaaaaccacccaaacccaagaggtggagggtggatgaggtggaacaatcaccgaaacccaagaggcggagggtggatgaggtggaacaatcgcccaagcccaagaggcagagggaggccgaggcacaacaattacccaaacccaagaggcggaggttgagtaagctgagaacacgccattgcactcaagcctgggcaataagaataaatccgtag

SEQ ID NO: 61907 - DNA, 1291 bp, Homo sapiens
atggggaaggaagatgagcagtcagcatcccagagaagcctatggaattccatggaggagataagtgaagagctgtttaacaggtccaattctacctccttggacaacagacagttgcgccacatcacaaaccatggtcactgctgggcaagcttgagagctcctgcggtggcggccgccgcggctccccaggaccccgcgaccaagagccgggtgggcagcggtgcaccccaagccgcggccccggcgcccgccgccctcgtcgcaggaaacccgggtggggacggggcccccgcagccacgggcaccgcggccgccgcctctttagccaccgccgccgacagcgaagacgcggagaaaaaagttctcgccaccaaagtccttggcactgtcaaatggttcaacgtcagaaatggatatggatttataaatcgaaatgacaccaaagaagatctatttatacatcagactgccatcaagaagaataacccacagaaatatctgcgcagtgtaggagatggagaaactgtagagtttgatgtggtttaaggagagaagggtgcagaagcagccagtgtgactggccggggtggagttcctgtggagggcagtcgttacgcgctgattggcgccgttacagacgtggctactatggaaggcgccatggccctccccgggattacgctgggaggaggaggaagaagggagcggcagcagtgaaggatttgacccccctaccactgataggcagttctctggggcccggaatcggctgcgccgcccccagtatcgcccccagtacaggcagcagcggttcccgccttaccacgtgggacagacgtttgaccgtcgctcaccggtcttaccccatcccaacagaatacaggctgttgagattggagagctgaaggatggagtcccagaaggagcacaacttcagggaccatttcatcgaaatccaacttaccgcccaaggtaccatagcaggggacctcctcgcccacgacctgccccagcagttggagaggctgaagataaagaaaatcagcaagcctccagtggtccaaaccagccgcctgttcgccgtggataccggcgtccctacaattaccggcgtcgcccacgttctcctaacgctccttcacaagatggcaaagaggccacggcaggtgaagcaccaactgagaaccctgctccatccaccgagcagagcagtgctgagtaacaccaggctccccaggcaccttcaccatcggcagggtgacctaaagaattaatgaccatcctagta

SEQ ID NO: 61908 - DNA, 288 bp, Homo sapiens
atgcactgttactaaaaagacgatgcgtcctcctggacctgagatctgtgtgatcgtgggaaagcgacgaaaaacgaacaaaggaacagtaaatggagtaacttggctagaatatggcagtaactacaaggcatgttctgctctggcacgaaggaaaggctatatgaagacagagcaagaaggtagttatctacaagccaggaagagagtcctcaccaaaacacaaccatgctggtaccctgatcttcaacttccagtcttgagctgttgagaaaataaacttttatt

SEQ ID NO: 61909 - DNA, 288 bp, Homo sapiens
atgcactgttactaaaaagacgatgcgtcctcctggagctgagatctgtgtgatcgtgggaaagcgacgaaaaacgaacaaaggaacagtaaatggagtaacttggctagaatatggcagtaactacaaggcatgttctgctctggcacgaaggaaaggctatatgaagacagagcaagaaggtagttatctacaagccaggaagagagtcctcaccaaaacacaaccatgctggtaccctgatcttcaacttccagtcttgagctgttgagaaaataaacttttatt

SEQ ID NO: 61910 - DNA, 5614 bp, Homo sapiens
atggccaaggactcgcccagccccttgggcgcgtcgcccaagaagccgggctgctccagcccggcggcggcagtgctggagaaccagaggcgggagctggagaagctacgggcggagctggaggcggagcgggcaggctggcgggcggaacggcggcgcttcgctgcccgggagcgccagctgcgtgaggaggccgagcgggagcggcggcagctggctgaccgtctgcgctccaagtgggaggcacagcgcagccgggagttgcggcagctgcaagaggagatgcagcgggaacgcgaggccgagatccggcagctgctgcgctggaaggaggccgagcagcggcagctgcagcagctgctgcaccgggagcgcgatggcgtggtgcgccaagcccgggagctgcagcgccagctggccgaggagctggtgaaccgcggccactgtagccgcccgggggcgtccgaggtttccgcggcgcagtgccgctgtcgcctgcaggaagtgttggcgcagcttcgctggcagactgacggcgagcaggcggcgcgcatccgctatctgcaggcggcgctggaggtggagcgccagctcttcctcaagtacatcctggcgcacttccgcgggcacccggctttgtcgggatcaccggacccccaagctgtgcattccttggaagaaccgctgccccagacctccagcggctcttgccacgcccccaaacccgcctgccaactcggatctctagacagcctgagtgctgaagtcggtgtgcgctcccgctcgctaggcctggtgtcctctgcgtgctccagctccccagacggcctgctctccacgcacgccagctcccttgattgcttcgcacctgcgtgttcccgctcgcttgacagcacccggagcctccccaaggcctccaaatccgaggagcggccctcctcaccagacacctccacccctggctcccggaggctctcgccgccaccatcgccactcccgccgccaccaccaccgtcagcccacaggaaactcagcaacccgcggggaggagaaggctctgagagccagccctgcgaagtcctgactccctcacccccgggcctgggccaccacgagctgataaagctgaactggctgctggccaaggcgttgtgggtgctggcgcgccgctgttataccctgcaagaggagaacaagcagctgcggcgtgcaggctgcccctaccaggcagacgagaaggtgaagcggctcaaggtaaagcgcgcggagctgaccgggctcgcgcggcgcctagctgaccgcgcccgcgagctgcaggagaccaacctccgggccgtgagcgcgcctatacccggcgagagttgcgccggcctggagctgtgccaagtctttgcccgccagcgcgctcgggacctgtcggagcaggcgagcgcgccgctggccaaggacaagcagatcgaagagctgcggcaggagtgccacctcctgcaggcgcgtgtcgcctcgggtccctgcagcgacctgcatactggaaggggcggcccctgcacccagtggctcaacgtcagagacttagaccgcctgcagcgcgagtcccagcgggaagtgctgcgcctgcagaggcagttgatgcttcagcagggcaacggtggcgcttggcccgaggcgggcggccagagcgcaacctgcgaggaggtgcgacggcagatgctggcgctggagcgcgagctggaccagcggcggcgcgagtgccaggagctgggcacgcaggcggccccggcgcggcgacgtggcgaggaggccgagacacagctgcaggcggcgctgctcaaaaacgcctggctggcggaggagaatgggcggctgcaggccaagaccgactgggtgcggaaggtggaggctgagaatagcgaagtgcgcggccacctgggccgcgcgtgtcaagagcgcgatgcctccggcttgatcgccgaacagctgctgcagcaggcggcgcgcgggcaggacaggcagcagcagctgcaacgcgacccgcagaaggccctgtgtgacctccatccttcctggaaggagatacaggcgctccagtgtcggcctggtcaccctcctgaacagccctgggagaccagtcaaatgccggagtcccaagttaaaggtagcagaaggcccaagttccacgcacggcctgaagactacgcagtgtcacagcccaacagagacatacaggagaaaagggaagcctccctcgaggagagcccagttgcccttggggagtcagccagtgtcccccaagtttcagagacagtccctgccagccaacctctgtccaagaaaaccagctcccagtcaaactcctcctctgaggggtcgatgtgggccaccgtgccgtcctcccctactctggacagggacacagccagtgaggtggatgacctggagcctgacagcgtgtccctggccctggaaatggggggctcggcggctcctgctgcccccaagctcaagatcttcatggctcagtataactacaacccatttgaggggcccaatgatcaccctgagggtgagctgcccctcacagctggggactacatatatatcttcggggacatggatgaggatggcttctatgagggggagcttgacgatggccggcgggggctggtgccctccaacttcgtggagcagattccggacagctacatcccaggctgcctgcctgccaaatcccctgatcttggccccagtcaactcccagcggggcaggatgaagctctggaggaagacagcttattatctgggaaagcccagggaatggtggacagagggctgtgccagatggtcagggtgggctccaagacagaagtagcaacagagatcctggataccaagacggaagcctgccagctgggcttgctgcagagcatggggaagcagggcctctccagaccccttctggggaccaaaggggtgctccgtatggctcccatgcagctacacctgcagaatgtcacagccacatcagccaacatcacctgggtctacagcagccaccgccacccccatgtggtatatcttgatgaccgagagcatgccctgaccccagcgggcgtgagctgctacaccttccagggcctgtgccccggcacgcactaccgggtgcgggtggaggtgcggctgccatgggacttgctgcaggtgtattggggaactatgtcctccaccgtcaccttcgacacactcttggcaggacctccctacccaccgctggaggtgctggtggagcgccatgcctcgccaggtgtcctggtggtcagctggctccctgtgaccattgactcagctgggtcctccaatggagtccaggtcaccggttatgctgtgtatgcagatgggcttaaggtttgtgaggtcgccgatgccactgctgggagcaccgtattggaattctcccagctacaggtgcccctcacgtggcagaaggtctcagtgagaaccatgtcactctgtggtgagtccctggattcagtgcctgctcagatccccgaggacttcttcatgtgtcaccgatggccagagactccaccctttagctacacttgtggcgacccatccacctacagagtcaccttccccgtctgcccccagaagctgtcactggctcctccgagtgccaaggccagcccccacaaccctggaagctgcggggagccccaggccaagttcctagaagcattctttgaagaacccccaaggaggcaatccccagtgtccaacctgggctcagaaggagaatgtccgagttcaggggctggcagccaagcccaggagcttgcagaggcctgggagggctgtagaaaggacctgctctttcagaagagtccccagaaccacaggccaccttcagtcagtgaccagcctggggagaaggaaaattgctaccagcacatgggcaccagcaaaagccctgctccaggattcatccatctacgcaccgagtgtgggcccaggaaagaaccgtgtcaggaaaaggctgcccttgagagggtacttcggcaaaagcaagatgcccaagggttcacacctccccagctgggcgccagccaacagtatgcatctgacttccataacgttttgaaggaggagcaggaggcactgtgcttggatctgcggggcacagagaggcgagaggagaggagggagcctgagccccacagcaggcaaggacaagctctgggggtgaagagagggtgccagctccatgagcccagctcggcactgtgtccagctccatccgccaaagtcatcaagatgcccaggggtggcccccaacagctggggacgggggccaacactccagccagggtctttgtggccctctctgattacaaccccctggtgatgtctgccaacctcaaggctgcagaggaggagctggtcttccagaaaaggcagttgctaagagtgtggggctctcaggacacccatgatttctacctcagcgagtgcaacaggcaagtgggcaatatccccgggcgcctagtggctgagatggaggtggggacagagcagactgataggaggtggcgttctccggcccaagggcacctgccttctgtggcccacctcgaggactttcaggggctcaccatcccccagggttcctccctggtgctccaggggaactccaagagactcccactgtggactccaaagatcatgatagcagctctggactatgatcctggggatgggcaaatggggggccaggggaagggcaggctggcgctgagggcaggagacgtggtcatggtttacgggcccatggatgaccaaggattctattatggagagttgggcggccacaggggcctggttcctgcccacctgctggatcacatgtccctccatggacactgagcaagcatccttgcccaggtagtggcctctggctgctcacaccctgccagaggagaagcaagcgttcagaccctcacaccagcacccctcctcaccaccataagtagcatgtgctccaagtgccactgtgttaaactgatggtagtccttaagcgtcccctaggctctgaaagtagcaggacttaagcctgagttatttgcaaaagcaaacacaacaagccaacccctgagagtctgagaagccatttcaaagttgctgataactatggcaggtatacggagaagcgcctttttctgtggccaatgtgtgttttctctgggaggttaaggttatctgtccattgccttgtacgaaagtctcaagaaaagtctacatcttaaaaaagaaaaagcaatctgagtgttatttttgggatgtgagggtgatctggctgcgacatgtgtcaccccattgatcatcagggttgattcggctgatctggctgactaggcgggtatccccttcctccctcaccactccatgtgcgtccctccagaagctgtgtgctcaatggaagaggatgaccatccccgatagaggacgatcggtcttcagtcaagagtataagagtagctgcgctcccctgctagaacctccaaacgagctctcagaatgttatttttctgtcttatgtccaacccctcattaaaatgt

SEQ ID NO: 61911 - DNA, 3575 bp, Homo sapiens
atgaactggcggagtaaattaaacgttattctccgatcaaacaggagcttcgggtccacctgtttggaagcacccaggcagcttggagaggtccggccttcgggtgcgacccgcaggggttgccctgcccggctcgcggaacggacgtttacctgtcgcagctacgaacccaccaacgacaccaagcacttgccgggcagaccaggcgtcgtggaggcgccccagcccccccaccccccccgcaacgacgcgtcccaggggagcaagggatacaatgatgatcaaggcagatgcagccgttaccttcaggttgtggagtccggatacagactggaggcaggcagctgtaagatgtgtgagaaatgctgcgctggatcagcccatggtattaggagagcaggcttcggtagattgcaaatgacctgctttctttcggatcccgggctgctttcggacacctgtcgaatagtaaatcccaagtaaggtacctgcggtcgtcggcagatctgaattttcttcttggacacctaatacccacagtcctccagagaccgagaggttgatgtcactcccaatatcggaggaagtatacacccccgtgtgagatggtccttaataatattccacggcggagggggtgatatgactacatacatggcagaaagtggaaacctcccagggatattgttcccacgatcctggagggaagaagatgatgttactttcaatatgacagaaggtggatgaagtggtggactgcccctccacacctgtggacacgcccccactgatattccttctaattgcagcgtgggagaggaggatatgacacgcgatatcgcagggagtagaaacacccctgtgatactgttcttaatattcagggaggaagaggatgatattactcccaatacagacgggtgtacaccctctgtacaccgagggtgtacacctgtctgtgaaagagttcgtaatctccagagggggagatgatattactcacaatatggtaaagaggctgtgagtccacggaggatcctcagagccagcgggggaagaggggctggctctcagtccccgcctcgcgggggtgactccccccagtgcgatgggggtcctaagagccagtgggggaagaggggctggctctgagaccccgcctcgcggggggtgcctccccgccctgtgatgggggtccgaagagccagaaggcttagaggggctggctctcagtccccgcctcgcggggggtgcctcctccccctgcgatgggggtcgtaagagccactgggggaataggggcttgctctcagtcaccgcctcgcggggggtgcctcctttcctttctacatagacacagtgacagtctgatctctctttcttttccctacagatggacacgcccccactgatattgtttttaatgcagcgtgggaggggaggatatgacacgcgatatcgcaggtagtagaaacacccctttgatagtgttcttaatattcagggaggaagaagatgatgttactcccaatacagacggatgtacaccctctgtacaccgagggtgtacacccgtctgtgaaggagttcgtaatctccagaggtggagatgatattactcacaatatggtaaacaggctgtgagtccatcgcggatcctcagagccaggtggggaagaggggctggctgtcagtcccctcctcgcggggggtgcctcccccactgctatggggatcccaagagccagtgggggaagaggtgctggctctcagtctccgcctcgcgaggtgcctccccaccctgcgatcggggtccgaagagccaggggggaagaggggctggctctcttcgtggatgattctttttccattctcaggcagttttcttttttctttctttctttttttttttttttgagactgagtcttgctctgttgcccatgctttgctcgatctcgggtgactgcaaccactgcctcccaggttcaagagattctcctgcctcagcctcctgagtagctgggactagaggcgtgtgtcaccacacccagctaatttttgtatttttagtagagatggggtttcaccatgtttgccaggatggtctctatctcctgcccttgtgatccacccacctcagcctcccaaagtgctgggattgcaggtgcgagccaccgggtccagcctctcaggcgattttcatacctgcatactctggtcactactctgttaaacagtcaaggagggtaagtattatcttcagatttccagagctctgtctctgtacagccctctcctcctcaatattctgccctatgaattctagccacattggccttcccaggctcacagttctgtcttctcaactcaggaagatctctgagttccatctgcattctttcttcctgtgctgtggcctggaaagttttctaaggtgttagggaggtcaattgtggggctagcctcatttgtttctcatctcttgaggatcactgccctttgatgcttgattccagtgattgattccctttgttgcttgagggccatagtttcatatattttgtccagtagttttgttgttttaggtcagaaagtaattttggtctctgttactctatcttggccagaagtgtaagacctaagcatttacacatcaaaatactgcacacataattttagtttaagctactttttaaaaaatctccttcattttccatttagcattctatttagggtattacattggtttttttgaaattctgttattggcagtttctattgcctatcaatcccatttaaagatagtgcatagggtattctaaaatagctgttaagcaaagagaaaattgggcctgatagggtgagaatcacagctctaatacctagagtgaccttataatgtattgtccaaaggagatatttttgacagtgaaagagggtgttgttagtaattatatcaggaccatggcctaaaccaggactatcccaggaagcctgggacatatttgtaccccatctctatttaatgcctttatacaattctttacttaattctaccagcctttattgagcctgctttctttgtctagctgagtgccacgtgctgacgtcactaagatcaatacagcaaactctgaaagatggacagagagacaggagatggtcctttataatgcagtgtgatctgtgctgcaatagagatggaagagtgttctgatcggctggaaaacaacgcacatgggaagctgtacagaaatgagtggggaaagttttggaagctagaagttcaaaacgaggtgttggcagcaccatgctctctctgaagatgctaggaagaatctgctccatgcctttccattcgcttctggggtttcctgcaagccctgacattccttggcttgtagatgcatcaccccagtttccgcccccatcatcacatggcctcctctctgtgtgtgcctctgcgttccctctattcttcttctaaggacaccgacaccagtcatagtggattaagtgtccactcctaaccaattacatctgcaacaaccctatttccaaataaagtcacatt

SEQ ID NO: 61912 - DNA, 2186 bp, Homo sapiens
atgtacttggtatacagcaaggatgccagtgtagcagaaatgagtagcaaggaggttggcagatgcgccttgctactgatggctgtcagtggccaccggcgcactgctctatctgatgtctgtgtctccatctctcttccacttggttgccagcagctgagaggaattcatcctttctgcattccattattttataattttatgacagaggatgtagccaaaactgaaagcgtcacatcagtgaaaattcggatagacacactgccgcatataaatccggtgctttatgatctcacactgcacggatttggaaactactgcatgtgcacgattctcagcctagttccctgcaggctctcgaggatccctgagagtgcccttgagggctccaagcgcggggagcgagggcctggaagtggcggttacagtcccgggtcccgcgccctttcccgctccactgctcagccagttcgggcgcgcccagggcacccgcctcgcgcacccttaagcccacgcgggtctcggctcagactgtcgcgccccacccggcccgcgccacatcccaccggcccatccagtaacggtttctggacccgcggcctctcccctgccccctacttcccagctcacgagagccgcagcgctgcgccgtttggagaggggtcatccgccccggaaccgacccagagcccggcccgccagccgggccggcaggagggcggcggcggcacaaccatgagctttgagggcggccacggcggcaagccggccccggtccccgcggccccgcgctacctgccgccgctgcccgcgtcccccgagacccccgagcgcgccgcggggccaagcgagccgctaggggaggtggccccgcggtgcaggggagcggacgagctgccgcctccgcccctgcccctgcagcccgccggccaggaagtggcggcggccggcgactccggggaaggtccgaggcgcctcccggaggcggcagcagcgaaaggcggccccggggagtctgaggccggcgcgggcggcgagcgcgagcggcggggcgccggagaccagcccgagacgcgctcggtgtgcagcagccgcagcagcagcagtggcggcggcgaccagcgcgctgggcaccagcaccagcaccaccagcccatctgcaagatctgcttccagggcgcggagcagggtgagttgttgaacccctgccgatgtgatgggtcagttcggtatacacatcagctgtgcctgctaaaatggatcagtgagagaggttcctggacctgtgaactttgctgttatagataccatgttatagccattaaaatgaaacaaccttgccagtggcagagcatttctataacactggttgagaaagttcagatgattgctgtaatcctaggatccctgttcttaatagccagtgtgacttggctcctctggtcagccttcagcccctatgcagtgtggcagaggaaggacatcctttttcagatctgctatggaatgtatggttttatggatctagtgtgcataggtctcattgttcatgaaggagctgcagtttacagagtgtttaagcgctggcgagctgtgaatttgcactgggatgtgttaaattatgacaaagccacagacatcgaagaaagcagccggggagagtcttccacaagtaggactttgtggttgccattgacagctctgcggaacagaaacttggtccacccaactcagttaacctcaccaaggtttcagtgtggctatgtgttattgcacctgttcaatcggatgaggccccatgaagacttatcagaagataacagctcgggggaggttgtgatgagagtgacttcagtgtgacaaaagcataagatgatgcagtgtggaccaccctgcacattttgcaatgtaattgcagtgaatggcaaaaccatagcacttctaaaaacacatctatgaactttttaaaatttatgctttttatatgaacatttgaattgcaaatacatttttctgagaaaaagagtcctcttgttcttcgttgtctggtttgtcacatcttttataagttggtacttgaaatcattatacatataatttaactatacttggttaaaagaataatgaaagttatccttaaggccaaaactattttttcttgcttgttttaaatatatttttatgaa

SEQ ID NO: 61913 - DNA, 2186 bp, Homo sapiens
atgtatttggtatacagcaaggatgccagtgtagcagaaatgagtagcaaggaggttggcagatgcgccttgctactgatggctgtcagtggccaccggcgcactgctctatctgatgtctgtgtctccatctctcttccacttggttgccagcagctgagaggaattcatcctttctgcattccattattttataattttatgacagaggatgtagccaaaactgaaagcgtcacatcagtgaaaattcggatagacacactgccgcatataaatccggtgctttatgatctcacactgcacggatttggaaactactgcatgtgcacgattctcagcctagttccctgcaggctctcgaggatccctgagagtgcccttgagggctccaagcgcggggagcgagggcctggaagtggcggttacagtcccgggtcccgcgccctttcccgctccactgctcagccagttcgggcgcgcccagggcacccgcctcgcgcacccttaagcccacgcgggtctcggctcagactgtcgcgccccacccggcccgcgccacatcccaccggcccatccagtaacggtttctggacccgcggcctctcccctgccccctacttcccagctcacgagagccgcagcgctgcgccgtttggagaggggtcatccgccccggaaccgacccagagcccggcccgccagccgggccggcaggagggcggcggcggcacaaccatgagctttgagggcggccacggcggcaagccggccccggtccccgcggccccgcgctacctgccgccgctgcccgcgtcccccgagacccccgagcgcgccgcggggccaagcgagccgctaggggaggtggccccgcggtgcaggggagcggacgagctgccgcctccgcccctgcccctgcagcccgccggccaggaagtggcggcggccggcgactccggggaaggtccgaggcgcctcccggaggcggcagcagcgaaaggcggccccggggagtctgaggccggcgcgggcggcgagcgcgagcggcggggcgccggagaccagcccgagacgcgctcggtgtgcagcagccgcagcagcagcagtggcggcggcgaccagcgcgctgggcaccagcaccagcaccaccagcccatctgcaagatctgcttccagggcgcggagcagggtgagttgttgaacccctgccgatgtgatgggtcagttcggtatacacatcagctgtgcctgctaaaatggatcagtgagagaggttcctggacctgtgaactttgctgttatagataccatgttatagccattaaaatgaaacaaccttgccagtggcagagcatttctataacactggttgagaaagttcagatgattgctgtaatcctaggatccctgttcttaatagccagtgtgacttggctcctctggtcagccttcagcccctatgcagtgtggcagaggaaggacatcctttttcagatctgctatggaatgtatggttttatggatctagtgtgcataggtctcattgttcatgaaggagctgcagtttacagagtgtttaagcgctggcgagctgtgaatttgcactgggatgtgttaaattatgacaaagccacagacatcgaagaaagcagccggggagagtcttccacaagtaggactttgtggttgccattgacagctctgcggaacagaaacttggtccacccaactcagttaacctcaccaaggtttcagtgtggctatgtgttattgcacctgttcaatcggatgaggccccatgaagacttatcagaagataacagctcgggggaggttgtgatgagagtgacttcagtgtgacaaaagcataagatgatgcagtgtggaccaccctgcacattttgcaatgtaattgcagtgaatggcaaaaccatagcacttctaaaaacacatctatgaactttttaaaatttatgctttttatatgaacatttgaattgcaaatacatttttctgagaaaaagagtcctcttgttcttcgttgtctggtttgtcacatcttttataagttggtacttgaaatcattatacatataatttaactatacttggttaaaagaataatgaaagttatccttaaggccaaaactattttttcttgcttgttttaaatatatttttatgaa

SEQ ID NO: 61914 - DNA, 675 bp, Homo sapiens
atggtgcaaactaattgcgttgtctctttgttagccctcgcttaggagttacaggagagaaaagcctgcaagaaaataggtctagtgaagacacccaggatgagaagattgcatcgttgcgtgaatcagttactgatgacctccaggttgatagtagttcatcaaatagtgaactagtatcaggattaagtttgcaccatggtatggccagttctcttctgagctattcagtcacagactcttatgcagaatacaagagttttgaagagagctttccatcacctgaactgttcagaaaatcagattatttagactgggagtgtcccaacttggaagaacacatgcagtggaagaattctactcttctggataccagtaaagcagtagcgatagagaaggcaccacagttttcaaatgtctcagcaattttcagtacctcttcagaagactatcagaaatgccatagaaaaacagtgatgacagtagcagatcaaaatgtttctccaaaagcaaagtgtgcttcaaattcagaatcagataatgcagcttgtgagattttacttgctgagaaaacttgcccttcaacccctgaaaaaacaaagaaaaaagcaagtattgaagcagaataactacataaatcataatacatttcattaataaagaatatacttttaa

SEQ ID NO: 61915 - DNA, 675 bp, Homo sapiens; identical to SEQ ID NO: 61914

SEQ ID NO: 61916 - DNA, 2039 bp, Homo sapiens
cagctctacatcctgtagattctcacacccagggcctccttcggcctcttctcaggggagtctcagagcaggagcctctctcccttgcccagtgaaagtcattctcccctctctcatccacctcacccgcggccacaatcctgagactttcccccgggaggcacacttctcctcgctgccctgctgctctcacggaaaccctgtcctgcttctcacactgacatctgctctctaatcacagaggatcctgtcattaaaagactcctggcctgggacaaagatctgagggtgtcggacaagtatctcctggctatggtcatagcgtatttcagccgggccggcctcccctcctggcaataccaacgcattcatttcttcctggctctctatctggccaatgacatggaggaggacgacgaggcccccaaacaaaacatcttctacttcctgtacgaggagacccgctctcatatacccttgctcagtgagctttggttccagttatgccgttacatgaacccgagggccaggaagaactgctctcagatagccttgttccggaagtatcggttccacttcttttgttccatgcgctgcagggcttgggtttccctggaggagttggaagagatccaggcttatgacccagagcactgggtgtgggcgcgagatcgcgcccacctttcctagagctccagggaccgtggaggcctgaggtcatcggcctgagagaagaacaccggacccaggggagatgtggattttcagcaggaactttattccaatgctaatggcagacatcaggaaggaggagaggaaccatttgtgcagatcatctagaagaacctggaccattcttgacagagctgaatacagtgatcacgttgtcctccaaggagcaggggtggggtggggtacttctaggagtccttggagaaaagtaagaaaccaggagtgtttccagttccaccctttcctgcggcaccacctccctttttatattgctgaatgccaacctccctggggcggaacctggaggtcctgtttcttatggacttggttgccacagtccaggagcatttgaaggcacagtgcaggggctcagattggcacagaattctttgtgaaatatgagtgccacagactgtaacagatagcttcatgcacactatgcattttattggtttgtttggaaaatgttggccattgaattattaataggtttatttcaaatagtttggaaattgttgtacttttgaaaacatgctgttcctgtagagttttttgatgagagttatagttgttatatatacctaaagataattttcttttcatttttaagtgagaattctttttatcctaaatcttttattatctttaattttttttctgtattattatatgtgctcctgaagcgagcactctttttatctatgatacttccataataatctcttctatttatagctattggtagttccccaccagaaaaaaacataattctggtgatagaaatttttatttgctgtttaggtttgtgactgacttgtgagaattcagttgtgatttttaacatgtctcagatatatatactaacacgtctaatatatactatctattttattggtttattttgaaaaacatgggtatagaattatttaaatattattttatttactgaaatatttattaaatatatttatttatttaaatattattattactttaaatattattttaaatattttggaaatactggtatttttgaatagatgctgtttctataaagctgtgtgatgggtattataactgttgtatacacatacatataattttgttttcctttttaagagaggattcttttcatcctaaatcttttacctttcaatctttgtatctattattacacgtgctgctgaagggagcatggtttttatctatgatacttagttaacatatatattacatttatagctatgtggtagttcccctaaattcttgtaaaaataaatttttatttgataaaaaaaaaaaaaaaa

SEQ ID NO: 61917 - DNA, 2875 bp, Homo sapiens
cttccacagcaatgggatttccttccgcattcagtttgtgcctttcccatgagcgagagactcctaggagagccgcagcccgttaggaagccatgtgggaactcatccacagactggactctgaaacgggcatgtacagagaagaggagaccccaacatgcttcaagctttgagtggagaggacacagcctctgctgggacagggaacagagggatgcggagaccctgaagatgcttttggacagtggtctgaggttgggacagtggcaggagataccattcacccaggatctccaggacaagagatcagcctggcagttacatgtgttttttttcaaactggttgccaggttggcatgagcgatgacatcagagattccgaccttcctgattggagggaccggactctgtcggcacctgggagttcagttggacaacagtaacttctcagagctgttctccactcctgacttctcccagcctcgagaattgataacacactcttctggatcccagcagtgtccagaagaagaccaaggacagaacagagactaggtttggtgagatgggacagattttgggaaagatcatgatgagccatcaaccgcagccccaggaagagcggagcccccagcggagcacctcagggtaccccctccaggaggtggtggatgatgaagtgtcgggaccatcagcccctggggtagatcccagccccccacgtaggtcccttggctggaaaaggaagagggaatgtttggatgaatctgatgatgagccagagaaggagctcgcccctgagcctgaggagacctgggtggcggagacgctgtgtggcctcaagatgaaggcgaagcgacggcgagtgtcgctcgtgctccctgagtactacgaggccttcaacaggctgcttgaggatcctgtcattaaaagactcctggcctgggacaaagatctgagggtgtcggacaagtatctcctggctatggtcatagcgtatttcagccgggccggcctcccctcctggcaataccaacgcattcatttcttcctggctctctatctggccaatgacatggaggaggacgacgaggcccccaaacaaaacatcttctacttcctgtacgaggagacccgctctcatatacccttgctcagtgagctttggttccagttatgccgttacatgaacccgagggccaggaagaactgctctcagatagccttgttccggaagtatcggttccacttcttttgttccatgcgctgcagggcttgggtttccctggaggagttggaagagatccaggcttatgacccagagcactgggtgtgggcgcgagatcgcgcccacctttcctagagctccagggaccgtggaggcctgaggtcatcggcctgagagaagaacaccggacccaggggagatgtggattttcagcaggaactttattccaatgctaatggcagacatcaggaaggaggagaggaaccattggtgcagatcatctagaagaacctggaccattcttgacagagctgaatacagtgatcacgttgtcctccaaggagcaggggtggggtggggtacttctaggagtccttggagaaaagtaagaaaccaggagtgtttccagttccaccctttcctgcggcaccacctccctttttatattgctgaatgccaacctccctggggcggaacctggaggtcctgtttcttatggacttggttgccacagtccaggagcatttgaaggcacagtgcaggggctcagattggcacagaattctttgtgaaatatgagtgccacagactgtaacagatagcttcatgcacactatgcattttattggtttgtttggaaaatgttggccattgaattattaataggtttatttcaaatagtttggaaattgttgtacttttgaaaacatgctgttcctgtagagttttttgatgagagttatagttgttatatatacctaaagataattttcttttcatttttaagtgagaattctttttatcctaaatcttttattatctttaaatttttttctgtattattatatgtgctcctgaagcgagcactctttttatctatgatacttccataataatctcttctatttatagctattggtagttccccaccagaaaaaaacataattctggtgatagaaatttttatttgctgtttaggtttgtgactgacttgtgagaattcagttgtgatttttaacatgtctcagatatatatactaacacgtctaatatatactatctattttattggtttattttgaaaaacatgggtatagaattatttaaatattattttatttactgaaatatttattaaatatatttatttatttaaatattattattactttaaatattattttaaatattttggaaatactggtatttttgaatagatgctgtttctataaagctgtgtgatgggtattataactgttgtatacacatacatataattttgttttcctttttaagagaggattcttttcatcctaaatcttttacctttcaatctttgtatctattattacacgtgctgctgaagggagcatggtttttatctatgatacttagttaacatatatattacatttatagctatgtggtagttcccctaaattcttgtaaaaataaatttttatttgatatttagtgtatgtttgaaatgtgagaattcagatggaattttttatcttgttttggcatgtttgtatgttactttaaagaggatgtgtgttctaaaggaggacatgagctgtgtgttttcaagagaacagtgcagtgcatctcttggggaaacataataaagatgaacttttctcacct

SEQ ID NO: 61918 - DNA, 5799 bp, Homo sapiens
tagttttgctcttgttgcccaggctggagtgcaatggtgtgaccttggctcactgcaacctccgcctcccaagtttaagccattctgctgtccccgcctcctgagtggctgggattacaggcacccaccaccatgcctgactaattttttgtatttttagaagagatggggtttcaccatgttggccaggctgctcttaaactcctgacctcaagcgatccacctgctatggcctcccaaagcgctgggattacaggcgtgagccactgtgcctggccggaacccacaggttctttggatggtctctgaatgtcatgaaactcttttatatttaattaaaaaaatttttttgacacaaggtcttgctgtgttgcccagactggagtgcggtgtcacgatcacagctcactgcagcccctaactcctaggctcaagcaatcctcctgccacctcagtctctcaagttgttggaacacaggtgccagccacgacacctggctaattttgttttgttttgttttgttttgttttagagatgggctcttgctatgttgcctatactggtcttgaactgctggcctcaggcagtcttcctcccttggccacccaaagagatgggattacaagcatgagccactgtgcacagctgagatttttcgacttagtctttttgtacacccagtatcttatagaatatccataatatagattcataaataaaccatttccttcaatggtataaataaataaaccactgctataaatggtggaattttctgagttaagagcaatacatatgatacaaaacttgatatatagagtttcttagccaaactggaggggctggctttaggtgatccgtggactccctgaaattggggacaccattggaaatatgtgtgaactcatgggcagtttcctatgatttccagtcctcaaaatatctcttggactcaaagatgccttagggcagaggacgcgtgtacccccagtacagaatctcggacagtgaatgtcagtagacactcggcagaaaacctctgccaaattgagtgctctgatgtgactttttcatcaagtcaatgttcctgggatctcttgtacatgataatctcactcttgtaaggtttcatcgtttctgcttaccctacttttctttcccatcctgatccctctcccaccagactggactctgaaacgggcatgtacagagaagaggagaccccaacatgcttcaagctttgagtggagaggacacagcctctgctgggacagggaacagagggatgcggagaccctgaagatgcttttggacagtggtctgaggttgggacagtggcaggagataccattcacccaggatctccaggacaagagatcagcctggcagttacatgtgttttttttcaaactggttgccaggttggcatgagcgatgacatcagagattccgaccttcctgattggagggaccggactctgtcggcacctgggagttcagttggacaacagtaacttctcagagctgttctccactcctgacttctcccagcctcgagaattgataacacactcttctggatcccagcagtgtccagaagaagaccaaggacagaacagagactaggtttggtgagatgggacagattttgggaaagatcatgatgagccatcaaccgcagccccaggaagagcggagcccccagcggagcacctcagggtaccccctccaggaggtggtggatgatgaagtgtcgggaccatcaggtgaggggactggaggaagaagaggtggcataggattgactaagatgaaggaagggggccaggcgtggtggctcacccctgtaaccccaacactttgggaggctgaggcgggcagatcacctgaggtcaggagttcaagaccagcctggccaacatggtgaaaccccatctctactaaaagtacaaaaattagccaggcggtagtggtgtgtgcctataatcccagctacttgggaggctaagacaggagaatcacttgagcctgggaggaagaggttgcagtgagccgagatcgtgctactgcactccagtctgggtgacagagtgagatgctatctcaaaaaaaaaaaaaaaaaaaaaaaaaaaaaaaaaagaagaaaaaaaagaagggtcagaggtcaggaaggagaacctggggagggtgtgtgggaagaatggagaaattcaggctgggtgcagtggctcacacttgtaatcccagcactttgggaagccaaggcaggcggatcacttgaggccaggagtttgagaccagcctggccaacatggtgaaaccctgtctctattaaaagtacaaaatggagctgggcattatggcaggcacctgtaatcccagctacctgagaggctgaggcaggagaataactggaatccgggagatgcatgttgcagtgagctgagattgcaccactacactccagcctgggtgacaaagcaagattctgtctcgaaacaaaaaaaaaaaaaaaaaagagggactcagagagccagggaccagggaaggatatgaggcagtgttctgaggacagagagagggaagaatggggaggggaaggagtggcacatggggttgagcagaggagaaagtcagaaaggtggcttggagaagccagcagtctgcgaggctggggaggatggagagtggtttggggtttggggtcggggtctaacgtgatcagttgcagaagcattacacggtggcctggtttctttactcagcccctggggtagatcccagccccccacgtaggtcccttggctggaaaaggaagagggaatgtttggatgaatctgatgatgagccagagaaggagctcgcccctgagcctgaggagacctgggtggcggagacgctgtgtggcctcaagatgaaggcgaagcgacggcgagtgtcgctcgtgctccctgagtactacgaggccttcaacaggctgcttgaggatcctgtcattaaaagactcctggcctgggacaaagatctgagggtgtcggacaagtatctcctggctatggtcatagcgtatttcagccgggccggcctcccctcctggcaataccaacgcattcatttcttcctggctctctatctggccaatgacatggaggaggacgacgaggcccccaaacaaaacatcttctacttcctgtacgaggagacccgctctcatatacccttgctcagtgagctttggttccagttatgccgttacatgaacccgagggccaggaagaactgctctcagatagccttgttccggaagtatcggttccacttcttttgttccatgcgctgcagggcttgggtttccctggaggagttggaagagatccaggcttatgacccagagcactgggtgtgggcgcgagatcgcgcccacctttcctagagctccagggaccgtggaggcctgaggtcatcggcctgagagaaggtacatctgcatcctccggggtaaaggcagaatattggggtctatttcggaaatccaaggaacccaattgcttgatctggcttcaagcctgggcaacgtggcgagatcccctctccacaaaaatacaaaaattagccaggcgatgtgggaggcatctctactcccaactactcaggaggctgaggcgggaggatcgctggagcctgggaggtcggggctgcagggagccctgatcctgccactgcactccagcccgggcgacagagtgagaccctgcctcaaaaataatcataaatactgagttcggggaggttcattatgattgatgcacttgagttaccgatttgggtcgagggttcagtgaagctttggtttacatcttgtgcagctaaccatgttgagcacagagcatgagacttcgtcatgaggagggaggattatggattaggcttctggactcgtggttcgtgatgctgtcacgttagaaacagatctagcacggttacaagtttagatctgaagtgacacaaaaggccccagctgtgatgaagtccaaagccacattctctgagggtgccctactccctgggaagacccacccaaagtcctggctatgaagcagatcactggggctgaccttgggtgtattaagttttggagtcagggtcaccaaagtgtgagtttcacagttgaacacgatggttcagaagcagggtatagaatgaaaggcaggagataaaattgcacttctcaattgctctgaactctagctagacttgacatgggacgtgaataaccttcctgtctagagagctgcctccttgaagtgtgacattgtctctctcacttccagaacaccggacccaggggagatgtggattttcagcaggaactttattccaatgctaatggcagacatcaggaaggaggagaggaaccattggtgcagatcatctagaagaacctggaccattcttgacagagctgaatacagtgatcacgttgtcctccaaggagcaggggtggggtggggtacttctaggagtccttggagaaaagtaagaaaccaggagtgtttccagttccaccctttcctgcggcaccacctccctttttatattgctgaatgccaacctccctggggcggaacctggaggtcctgtttcttatggacttggttgccacagtccaggagcatttgaaggcacagtgcaggggctcagattggcacagaattctttgtgaaatatgagtgccacagactgtaacagatagcttcatgcacactatgcattttattggtttgtttggaaaatgttggccattgaattattaataggtttatttcaaatagtttggaaattgttgtacttttgaaaacatgctgttcctgtagagttttttgatgagagttatagttgttatatatacctaaagataattttcttttcatttttaagtgagaattctttttatcctaaatcttttattatctttaaatttttttctgtattattatatgtgctcctgaagcgagcactctttttatctatgatacttccataataatctcttctatttatagctattggtagttccccaccagaaaaaaacataattctggtgatagaaatttttatttgctgtttaggtttgtgactgacttgtgagaattcagttgtgatttttaacatgtctcagatatatatactaacacgtctaatatatactatctattttattggtttattttgaaaaacatgggtatagaattatttaaatattattttatttactgaaatatttattaaatatatttatttatttaaatattattattactttaaatattattttaaatattttggaaatactggtatttttgaatagatgctgtttctataaagctgtgtgatgggtattataactgttgtatacacatacatataattttgttttcctttttaagagaggattcttttcatcctaaatcttttacctttcaatctttgtatctattattacacgtgctgctgaagggagcatggtttttatctatgatacttagttaacatatatattacatttatagctatgtggtagttcccctaaattcttgtaaaaataaatttttatttgatatttagtgtatgtttgaaatgtgagaattcagatggaattttttatcttgttttggcatgtttgtatgttactttaaagaggatgtgtgttctaaaggaggacatgagctgtgtgttttcaagagaacagtgcagtgcatctcttggggaaacataataaagatgaacttttctcacct

SEQ ID NO: 61919 - DNA, 2473 bp, Homo sapiens
tgtctcaaaataaattaataaataaataaaaataaaaatcaaataaagaaaaacaaaatcaaaaatcaaaaaagtggtttcagctgtgccctctgaaacttaatgtttcttactgacttttctaaacctaagtgtctccatccatagtgagggatcccaaggccatggtcacaccctgatgtgtgactgtctcatgaggaaatgatgggaattcctttatgactctgcagtggtccctccgtgtctgctggagggggtcctggctgattcccagctctacatcctgtagattctcacacccagggcctccttcggcctcttctcaggggagtctcagagcaggagcctctctcccttgcccagtgaaagtcattctcccctctctcatccacctcacccgcggccacaatcctgagactttcccccgggaggcacacttctcctcgctgccctgctgctctcacggaaaccctgtcctgcttctcacactgacatctgctctctaatcacagaggatcctgtcattaaaagactcctggcctgggacaaagatctgagggtgtcggacaagtatctcctggctatggtcatagcgtatttcagccgggccggcctcccctcctggcaataccaacgcattcatttcttcctggctctctatctggccaatgacatggaggaggacgacgaggcccccaaacaaaacatcttctacttcctgtacgaggagacccgctctcatatacccttgctcagtgagctttggttccagttatgccgttacatgaacccgagggccaggaagaactgctctcagatagccttgttccggaagtatcggttccacttcttttgttccatgcgctgcagggcttgggtttccctggaggagttggaagagatccaggcttatgacccagagcactgggtgtgggcgcgagatcgcgcccacctttcctagagctccagggaccgtggaggcctgaggtcatcggcctgagagaagaacaccggacccaggggagatgtggattttcagcaggaactttattccaatgctaatggcagacatcaggaaggaggagaggaaccattggtgcagatcatctagaagaacctggaccattcttgacagagctgaatacagtgatcacgttgtcctccaaggagcaggggtggggtggggtacttctaggagtccttggagaaaagtaagaaaccaggagtgtttccagttccaccctttcctgcggcaccacctccctttttatattgctgaatgccaacctccctggggcggaacctggaggtcctgtttcttatggacttggttgccacagtccaggagcatttgaaggcacagtgcaggggctcagattggcacagaattctttgtgaaatatgagtgccacagactgtaacagatagcttcatgcacactatgcattttattggtttgtttggaaaatgttggccattgaattattaataggtttatttcaaatagtttggaaattgttgtacttttgaaaacatgctgttcctgtagagttttttgatgagagttatagttgttatatatacctaaagataattttcttttcatttttaagtgagaattctttttatcctaaatcttttattatctttaaatttttttctgtattattatatgtgctcctgaagcgagcactctttttatctatgatacttccataataatctcttctatttatagctattggtagttccccaccagaaaaaaacataattctggtgatagaaatttttatttgctgtttaggtttgtgactgacttgtgagaattcagttgtgatttttaacatgtctcagatatatatactaacacgtctaatatatactatctattttattggtttattttgaaaaacatgggtatagaattatttaaatattattttatttactgaaatatttattaaatatatttatttatttaaatattattattactttaaatattattttaaatattttggaaatactggtatttttgaatagatgctgtttctataaagctgtgtgatgggtattataactgttgtatacacatacatataattttgttttcctttttaagagaggattcttttcatcctaaatcttttacctttcaatctttgtatctattattacacgtgctgctgaagggagcatggtttttatctatgatacttagttaacatatatattacatttatagctatgtggtagttcccctaaattcttgtaaaaataaatttttatttgatatttagtgtatgtttgaaatgtgagaattcagatggaattttttatcttgttttggcatgtttgtatgttactttaaagaggatgtgtgttctaaaggaggacatgagctgtgtgttttcaagagaacagtgcagtgcatctcttggggaaacataataaagatgaacttttctcacct

SEQ ID NO: 61920 - DNA, 2515 bp, Homo sapiens
agctccgactacagggctgtaccaccacacctggacagttatttatttatttatttatttatcaagacaagagtgttgctgtgtctctcaggctggaatggaggggcccaatcttggctcactgcaacctccgcctcctgggttcacacaattcttatgcttcagcctcctgagtagctaggactaatgggtgtgccaccgcaccaggctgatttttgtatttttagtatagatggggtttctctgtgttgaccaggctggtctcaaactcctggtctcaagcaatccacctgcttcagccttccaaagcgctgggattacaggcatgagccaccacgtctggcgtattttttatatttttaatagagacgagggtcttgctatgttgcccaggcctgtctcaaactcctggcctcaagtgatcctcctgcttcggcctcccagtgtgctgggattccaggcataagccaccactcttggtcaccagttgggtttttgtctccatcctgaaggagtgggagacgcccttgatcaggtctctgtccagcagagccctcctgaggaaggcgtggctctctgcagggtgggtgccagtcctgagctagggacggtcccttaccttcctctctgagaagctgacctcagccggaggtctctcctggtggtgcccctgagcagcaacctgatttctgtcctcagctatctggccaatgacatggaggaggacgacgaggcccccaaacaaaacatcttctacttcctgtacgaggagacccgctctcatatacccttgctcagtgagctttggttccagttatgccgttacatgaacccgagggccaggaagaactgctctcagatagccttgttccggaagtatcggttccacttcttttgttccatgcgctgcagggcttgggtttccctggaggagttggaagagatccaggcttatgacccagagcactgggtgtgggcgcgagatcgcgcccacctttcctagagctccagggaccgtggaggcctgaggtcatcggcctgagagaagaacaccggacccaggggagatgtggattttcagcaggaactttattccaatgctaatggcagacatcaggaaggaggagaggaaccattggtgcagatcatctagaagaacctggaccattcttgacagagctgaatacagtgatcacgttgtcctccaaggagcaggggtggggtggggtacttctaggagtccttggagaaaagtaagaaaccaggagtgtttccagttccaccctttcctgcggcaccacctccctttttatattgctgaatgccaacctccctggggcggaacctggaggtcctgtttcttatggacttggttgccacagtccaggagcatttgaaggcacagtgcaggggctcagattggcacagaattctttgtgaaatatgagtgccacagactgtaacagatagcttcatgcacactatgcattttattggtttgtttggaaaatgttggccattgaattattaataggtttatttcaaatagtttggaaattgttgtacttttgaaaacatgctgttcctgtagagttttttgatgagagttatagttgttatatatacctaaagataattttcttttcatttttaagtgagaattctttttatcctaaatcttttattatctttaaatttttttctgtattattatatgtgctcctgaagcgagcactctttttatctatgatacttccataataatctcttctatttatagctattggtagttccccaccagaaaaaaacataattctggtgatagaaatttttatttgctgtttaggtttgtgactgacttgtgagaattcagttgtgatttttaacatgtctcagatatatatactaacacgtctaatatatactatctattttattggtttattttgaaaaacatgggtatagaattatttaaatattattttatttactgaaatatttattaaatatatttatttatttaaatattattattactttaaatattattttaaatattttggaaatactggtatttttgaatagatgctgtttctataaagctgtgtgatgggtattataactgttgtatacacatacatataattttgttttcctttttaagagaggattcttttcatcctaaatcttttacctttcaatctttgtatctattattacacgtgctgctgaagggagcatggtttttatctatgatacttagttaacatatatattacatttatagctatgtggtagttcccctaaattcttgtaaaaataaatttttatttgatatttagtgtatgtttgaaatgtgagaattcagatggaattttttatcttgttttggcatgtttgtatgttactttaaagaggatgtgtgttctaaaggaggacatgagctgtgtgttttcaagagaacagtgcagtgcatctcttggggaaacataataaagatgaacttttctcacct

SEQ ID NO: 61921 - DNA, 3947 bp, Homo sapiens
tagttttgctcttgttgcccaggctggagtgcaatggtgtgaccttggctcactgcaacctccgcctcccaagtttaagccattctgctgtccccgcctcctgagtggctgggattacaggcacccaccaccatgcctgactaattttttgtatttttagaagagatggggtttcaccatgttggccaggctgctcttaaactcctgacctcaagcgatccacctgctatggcctcccaaagcgctgggattacaggcgtgagccactgtgcctggccggaacccacaggttctttggatggtctctgaatgtcatgaaactcttttatatttaattaaaaaaatttttttgacacaaggtcttgctgtgttgcccagactggagtgcggtgtcacgatcacagctcactgcagcccctaactcctaggctcaagcaatcctcctgccacctcagtctctcaagttgttggaacacaggtgccagccacgacacctggctaattttgttttgttttgttttgttttgttttagagatgggctcttgctatgttgcctatactggtcttgaactgctggcctcaggcagtcttcctcccttggccacccaaagagatgggattacaagcatgagccactgtgcacagctgagatttttcgacttagtctttttgtacacccagtatcttatagaatatccataatatagattcataaataaaccatttccttcaatggtataaataaataaaccactgctataaatggtggaattttctgagttaagagcaatacatatgatacaaaacttgatatatagagtttcttagccaaactggaggggctggctttaggtgatccgtggactccctgaaattggggacaccattggaaatatgtgtgaactcatgggcagtttcctatgatttccagtcctcaaaatatctcttggactcaaagatgccttagggcagaggacgcgtgtacccccagtacagaatctcggacagtgaatgtcagtagacactcggcagaaaacctctgccaaattgagtgctctgatgtgactttttcatcaagtcaatgttcctgggatctcttgtacatgataatctcactcttgtaaggtttcatcgtttctgcttaccctacttttctttcccatcctgatccctctcccaccagactggactctgaaacgggcatgtacagagaagaggagaccccaacatgcttcaagctttgagtggagaggacacagcctctgctgggacagggaacagagggatgcggagaccctgaagatgcttttggacagtggtctgaggttgggacagtggcaggagataccattcacccaggatctccaggacaagagatcagcctggcagttacatgtgttttttttcaaactggttgccaggttggcatgagcgatgacatcagagattccgaccttcctgattggagggaccggactctgtcggcacctgggagttcagttggacaacagtaacttctcagagctgttctccactcctgacttctcccagcctcgagaattgataacacactcttctggatcccagcagtgtccagaagaagaccaaggacagaacagagactaggtttggtgagatgggacagattttgggaaagatcatgatgagccatcaaccgcagccccaggaagagcggagcccccagcggagcacctcagggtaccccctccaggaggtggtggatgatgaagtgtcgggaccatcagcccctggggtagatcccagccccccacgtaggtcccttggctggaaaaggaagagggaatgtttggatgaatctgatgatgagccagagaaggagctcgcccctgagcctgaggagacctgggtggcggagacgctgtgtggcctcaagatgaaggcgaagcgacggcgagtgtcgctcgtgctccctgagtactacgaggccttcaacaggctgcttgaggatcctgtcattaaaagactcctggcctgggacaaagatctgagggtgtcggacaagtatctcctggctatggtcatagcgtatttcagccgggccggcctcccctcctggcaataccaacgcattcatttcttcctggctctctatctggccaatgacatggaggaggacgacgaggcccccaaacaaaacatcttctacttcctgtacgaggagacccgctctcatatacccttgctcagtgagctttggttccagttatgccgttacatgaacccgagggccaggaagaactgctctcagatagccttgttccggaagtatcggttccacttcttttgttccatgcgctgcagggcttgggtttccctggaggagttggaagagatccaggcttatgacccagagcactgggtgtgggcgcgagatcgcgcccacctttcctagagctccagggaccgtggaggcctgaggtcatcggcctgagagaagaacaccggacccaggggagatgtggattttcagcaggaactttattccaatgctaatggcagacatcaggaaggaggagaggaaccattggtgcagatcatctagaagaacctggaccattcttgacagagctgaatacagtgatcacgttgtcctccaaggagcaggggtggggtggggtacttctaggagtccttggagaaaagtaagaaaccaggagtgtttccagttccaccctttcctgcggcaccacctccctttttatattgctgaatgccaacctccctggggcggaacctggaggtcctgtttcttatggacttggttgccacagtccaggagcatttgaaggcacagtgcaggggctcagattggcacagaattctttgtgaaatatgagtgccacagactgtaacagatagcttcatgcacactatgcattttattggtttgtttggaaaatgttggccattgaattattaataggtttatttcaaatagtttggaaattgttgtacttttgaaaacatgctgttcctgtagagttttttgatgagagttatagttgttatatatacctaaagataattttcttttcatttttaagtgagaattctttttatcctaaatcttttattatctttaaatttttttctgtattattatatgtgctcctgaagcgagcactctttttatctatgatacttccataataatctcttctatttatagctattggtagttccccaccagaaaaaaacataattctggtgatagaaatttttatttgctgtttaggtttgtgactgacttgtgagaattcagttgtgatttttaacatgtctcagatatatatactaacacgtctaatatatactatctattttattggtttattttgaaaaacatgggtatagaattatttaaatattattttatttactgaaatatttattaaatatatttatttatttaaatattattattactttaaatattattttaaatattttggaaatactggtatttttgaatagatgctgtttctataaagctgtgtgatgggtattataactgttgtatacacatacatataattttgttttcctttttaagagaggattcttttcatcctaaatcttttacctttcaatctttgtatctattattacacgtgctgctgaagggagcatggtttttatctatgatacttagttaacatatatattacatttatagctatgtggtagttcccctaaattcttgtaaaaataaatttttatttgatatttagtgtatgtttgaaatgtgagaattcagatggaattttttatcttgttttggcatgtttgtatgttactttaaagaggatgtgtgttctaaaggaggacatgagctgtgtgttttcaagagaacagtgcagtgcatctcttggggaaacataataaagatgaacttttctcacct

SEQ ID NO: 61922 - DNA, 2875 bp, Homo sapiens; identical to SEQ ID NO: 61917

SEQ ID NO: 61923 - DNA, 5799 bp, Homo sapiens; identical to SEQ ID NO: 61918

SEQ ID NO: 61924 - DNA, 2515 bp, Homo sapiens; identical to SEQ ID NO: 61920

SEQ ID NO: 61925 - DNA, 2473 bp, Homo sapiens; identical to SEQ ID NO: 61919

SEQ ID NO: 61926 - DNA, 3947 bp, Homo sapiens; identical to SEQ ID NO: 61921

SEQ ID NO: 61927 - DNA, 4405 bp, Homo sapiens
ttttagtattaacaactttgaccaggaaaaacaaaccctgcttttcctttacagtctctcgtcaggtcttcgccgcaaatctctctccagaggatcgtggctgaggcaccatggaatgctgctgttctactggagatgaaatttcatccaaaagaaaaagggaaaagtatccaaaagtctttctagtctccaggcatttagaaaagctttagaacaagatctgcactggcacaagaatttgagtggaaatcaccctgcccagctgtgagccccggggcgggtgagccacacacttggatctcactgcagttgtggcctctgggaagaaggctttgaatgcagattttaaacaggtactcaactcatactgagccacggctactttcaacttaacaatatgtgagaaacccatctgatcactgcagacctgctgaaatctcttacaactaatccttcaatcctcaccagaatgctggctgtcctgcctctgccgtcgcgagagaagataaaagctactgggtggccacagggcagttatgtccccttctctaggttttgtgattctggcagttagaatgggtttccagacttttacaagcagaaacccttatacatgtgattatatgctgtccgtcaacatgtaaaacacgccaagcgtggtgactcacacctgtaatctcaacgttttgggaggccaaggtgggaggaccacttgaggccaggcgtttgagaccagtctgggcaacatagcaagaccctatctcttaaaaaaaaaaaaaaaaagaaagaaagaaaagaaaaagaaaaagaaaaaaaaaagtaagccaggcctggcctcaagtgatctgcccacctcggtctcctcaagtgctaggattacagatgtgagccactgcacctgactgcaaaatgggagagttctgagaagtgtggactggaaaccagtgagaggaggtaacttctagaacctcttcccagctctgattccactaacatggtctaaactttccaaactcaacccacaccaccgttaaagtccttattttctaagccgtttctctttcgggcactttccaggaggcctgggcctgaaactccacaccccaccagctgacacactgtgcgtgacctggaactagaaatgaccttctcacagggcagatggccacccacgggggatgccttgttagaaagcctctccaaagacctgggagagtcaaatcctgacacaaacatatcaaagaaatgttctactttactagaaattttgtttaaaacatacaagttaaaatcagcggctgagcatggtggctcacacctataatcttagctactcgggaggtggagggaagaggatcgcttgaggccaggaggtcaagaccagcctgggcaacacagagagacccccatctctatttattaaaaaaaacggaaaagcaaacaatttggtaatatatgtatcaagaggtttaaaaatgttcacttcctttgatccaataattaagactctaacttcagaaaattatagaaaaatgttgacgtgaagctattcactacagcactgtctctattacataaaacagaagcatagggcaaactccatagaagtcaataaaatgttaacagctgtctttgagtggagaaacgatagaagacctttttttttctttttttttttaaacttgcttcttttcttcttcatatataggagacgttttgtttgacttccttatatatctgaacttttcacattttctaaagtgagaaagtattacttctattatcagaaaaaaactctcctggccaggtgcagtggctcatgcctgtaatccccagcactttggaaggctgaggggggcggatcatctgaggtcaggagtatgagaccagcctggccaacatggtgaaatcccgtctctactaaaaatacaaaaattagctgggcatggtggcatgcacctgtaatcccagctacctgggaggctgaggcaggagaatcccctgaacccaggaggcggaggttgcagtgagccgagaactgcaccattgcactccagcctgggcaacatgagcctcaaaaaacaaaacaaaaaacaaacctccctgaaaatgccaaacacttttaaaaggtcataaatataaaccaaaccaccaccaccgctgtgtcttaccattattactttaaatggctgctgctatcccagtgtagtttcactaacatcaggccctgtcaacttaccatggcacctccctgacaacagacacatccccccatccccgagctccacaaaaatggaagaacaaaccatccatgttcctatgacagtagtcctgtgagcacggcgagatgcggctttgcttgaaaagggatcactcaggccagtgcctcccacatcttactggaagatggcacgaaactagcatgtgatttgtctcttgcacagtgggtggccggaagggaagtgacaactcttctggctggggcctccagggataggtcagagcagaaccttccaaagggcacccatggtgccggccccagtaacctacaattcccttgtggtcaaccagcttctccagaaccaagaacccactggctcctgggtagccaagagcaatctgaccacctgcagccagtcagaaggtggagccctggtttacgggcctacccagagggcaaagtaggggagtaataggggcagcagtggatgtgtaatggtaacagtaatagcaggcctggtgcagtggctcacaccttgtgatcccagcactttgactggctgaggcagaaggactgctttgagcctaggggttcaaagttgcagtgagctatgatcgtgccactacactccaacctgggcaacagagcgagaccctgtctctttaaacaaaaataaataacagccaagcaggaacccgcatccaggaacacagccctttgctcctccctcagaatgaatggaaaccaggctgggcgcggtggctcacacctgtaatcccagcactttgggaggccaaggcgggcggatcacgaggtcaggagatcgagaccatcgtggctaacatggtgaaaccctgtctctactaaaaatacaaaaaattagccgggcgcggtggcgggtgcctgtagtcccggctacttgggaggctgaggcaggagaatggcgtgaacccaggaagtggagtttgcagtgagccaagatcgcgccactgcactccagcctgggcgacagagcaagactccgtctcaaaaaaaaaaaaaaaaaaagaccgaatggaaaccagaaatcagatatttatgcccaagaaaagcaggatttcgttcagcactactcccagatcgttagggtgctgactgaggatgagatggggcacccagagacaggagatgctactgcccggctcaaggaggtcctggagtacaatgccattggaggcaagtatcaccgaggtttgatggtgctagtagcgttccgggagctggtggagccgaggaaactggatgctgatagtctccagtgggcaccgactgtgggctggtatgcgcaactgctgcaagctttcttcctggtggcagatgacattatggattcatcccttacctgccagggacagatctcctggtatcagaagctgggcatgggtttggatgccatcaatgatgctatccttctggaagcatgtatctactgcctgctgaagctgtattgccgggagcagccctattacctgaacctgatggagctcttccagcagaattcttatcagactgagattgggcagaccctcgacctcatcacaaccccccagggcaatgtggatcttcgcagatgcaccgaaaaaaggcacaaatctgttgtcaagtacaagacagctttctactccttctaccttcctgtagctgcagccatgtacatgtcaagaatggatgacaagaaggagcacaccagtgccaagaagatcctgctggagattcaagagttctttcagattcaggatgattaccttgacttctttggggaccccagtgtgactggcagagttggcaatgacttccaggacaacaaatgcagctggctggtggttcagtgtctgctacaggccactccagaacagtaccagatcctgaaggaaaattacaggcagaaggaggccgagaaggtggcccgggtgaaggcactatacgaggagctggatctgccagccgtgttcttgcagtatgagaaagacagttacagccacgttatgggtctcatcgaatagtacgcagagcccctgcccccagccatctttctggggcttgggcacaaaatctacaagtggaaaaagtgacctagagactgcaagggcggggagagaaggctctcaataagtaaattattgtgtaaaataaataaataaatga

SEQ ID NO: 61928 - DNA, 751 bp, Homo sapiens
atgggccccggggacttccgccgctgcagagagagaatttcccaggggctccagggactcccaggtagagcggagctttggttcccacctcgtcccgcgtgcgacttcttcggggacggcaggagcacggacatccaggaggaggccctcgccgccagcccgctgctggaggacctcagacgacggctgacgcgcgccttccagtgggcggtgcagcgcgcgatctcgaggcgcgtgcaggaggcggcggcggcggcggcggcgcgggaggagcagagctggacgggcgttgaggccaccctggccaggctgcgggcggagctggtggaaatgcatttccaaaaccaccagctggctagaactttactggacctaaacatgaaagtgcagcaattgaaaaaggagtatgaactggaaattacatcagactcccaaagcccaaaagatgatgctgcgaatccggaataaagaaatgcacacgcaagggctgggcgcggtggctcacgcctgtaatcccagcactttgggaggccgaggcgggcggatcaagacgtcaggagattgagaccatcctggctaacactgtgaaaccctgcctctactaaaaatacaaaaaattagccagacgtggtggcaggcacctgtagtccctgctactcaggagtctgaggcaggagaatggcgtgaacccaggagacagagcttgcagtgagccgaaatcctgccactgcactccagccctgggtgacag

SEQ ID NO: 61929 - DNA, 285 bp, Homo sapiens
atgaggcatcacagtgatgtcctgactgctctacactgggcctgtgccaatggccacgcagaagtagtaacactactggtagatagaaaacgccaggttgacgtccttgatggtgaaaacaggacacctctgatgaaggctctgcaatgccagagggaggcttgtgcaaatattctcatagattctggtgctgatccaaatattgtagatgtgtatggcaacacagctgtccattatgctgtttatagtgagaacttgtcagtggtggcaaaattgctgtcctaa

SEQ ID NO: 61930 - DNA, 1198 bp, Homo sapiens
gagactctgatgatgaattctgaccagaaggcagtgaaattcctggcaaatttttacatcaatggaggcaaacactggacccatggtcacctgaggcagacacaaccagagcccacccagcccaaggcatctgtgctgttgttgggcccggagccggggatggcctgggatgagacacagcccccaaagatgaaggagatcccagttggcctcaggttacagacgggcaccccccaggagtccctgcccacctacacccagaccctgagggaactattgctggagcaacgccccctgatcacggctgacctggaagtccccagccccaccaggtaccaggtgccaagcccgtccgtacgagagtcctccccacacccccactacagcatcggctgcaagcaccagggccgagagggcggtggccgcagggcatggcagactttgtggttccagagcgaaagccccttcacgcagaaagctgacttcgaccaagagcaaaagtggccctcgccagcccactaccagctgctcagccggccggccttccccgccttcagcttcagaggctgccactccgcttccaagacacctgaaggccacacccacctagggctgcctggggctagggggctgggcctcagggtgcagccccagtccctgcttcaggcctctttgcaggcacctggcaagagatgccctggccccaacacctacaatatccttcctgggagccgcctgcagagcccccgctcgccggccttctcgatgagccgctcccctgcgttcacctcctggctcagcacctggctcccagccttctctttcggcagcccgaacccctggcccagccgcctaccacgtggaggactgcaactcacgcttcccttcggcgcctggcgtggtcatccagggtgtacgcagacccaagcgccacgacacaggccccttctgcacgctctagagccagctgggcacaacctgcttggcccggccaccgagtggaaccatggcctcccccggggctttcccaggcctcccctgggacttggggccccagcctggccttctgaccctctgggcaccccgatgcacccttctggctggccaacccttctatgggctgtggacaaggctggcccagcctggatcccccatctgcccatctccccgctacactgagatgctgttggttttcccg

SEQ ID NO: 61931 - DNA, 441 bp, Homo sapiens
cggcctctttgcacccggcagagtgacgagcttcgccggtgtcttcaacgaagtcctgtcggtccctaccggcacatcacacactcctggaagcatgatcttcactcccttccttccacctgctgacctgaatgtgaaagggctgcaaaacgaccctgaggaatgggtggctgtgtctgacgccacggaggacccatccggtggcacaggcttgcccagggaacctgctcttctgcgagggtcttggaggagccggttccagagagccctggcatgtttcaccaagtgtttcaggggaggataccgggcactcggaatctgagaccaccggagccacagacacagagccatgaacggtgaccaagccccttctgctgctccatgcccctgctcgccgcagtgtcccagtcaccaggcctgaaataaatgctggcacgcttg

SEQ ID NO: 61932 - DNA, 441 bp, Homo sapiens; identical to SEQ ID NO: 61931

SEQ ID NO: 61933 - DNA, 2047 bp, Homo sapiens
attaaggccacgccccttttccgcattctagtgcagccctggtgacgcctcctgtggctcagtcacatagctgtgtggtacatgactggaggcatatcactgtcctcgcctggatcacgccaatgtgaccccaaccccacctccctccccaccccatgatgtccgaaaaaacccaacaaagaaaattggctgggaccaagagaaagttcacagactatcatcagtggaacagtgctggtgttggtactggagcaaccgacaccaaaaagaagaaaataaataatggcactaaccctcagacaaccacttctggggggctgccattcacctgaggataaacaacagaaccgagctcagctgaaagaggaaaagaaggcaagccaccaacatcagcaagccctaaggaggcagctagaggcccaggatcataccatacgaatccttaagtgtcagaaaactgaactggaaacagtgctccatgacagccaggatgctgccaggaaatttgaagaagattccaaggatctggcaggccgcctgcatcattcctggtactttgcaggagagttacagcgggctctctctgctatgtccgcagagcacaagagggcggacaggtacatcaaggagttaacaaaggagagggaagccctgagtctggagctgcacaggaacatgtaggatgggggagcgggggatgggaggtctgagagcccttagcatgggtggtgtgctgggaggtggtgggtacaggtgagcatgctagggggtcatacaggtttacatgtgtgcgcagggaagctccagtgatggctgtgccactgactcatggggtagcctcaggcaactcacgtcttctctctggcctgccacctgggacttttaattcctggggtcccttccaatgccatggttctgtggttgtggggcgagggtagagggtcgatcaccaaagcggtcctttctgttcttcgctcattcctttctctactgcctctggccatggcataaccaatgaggagctgaaggagaaaaatgccgaactacaagaaaaacttcgactggtagaaactgaaaagtctgagatccagctccacatcaaggagctaaaaaggaaactggagacggacaaaatcccgctgccacaggttcaaaccagcactttgcaggagaagatgtggaggcaggaggaggagctacgggatcaggagaagctacggaagcacgaggagaagacgtggagacaggagcagaggctgcgggaccaggagaaggagctgcggaagcaggagaagcagatgctgaagcagaaggagcaaatggcggagcaggaggaacagatgcagaagcaggaggagcaggtgcgaaagcaggaggagcaggtgcggaagcaggaagagcagatgtggaagcaggaggagcagatgcggaagcaggaggagcaaatgcggaagcaggagaagcagatgggggagcaggaggagcagatgcggaaacgggaggagcagatgcggaagcgggaggagcagatcacgcagctgccccctggaatgaagaacacccaggagcacccaggcttaggcagcacctcctgcatcctattcttctaccgaggagacaagaaaaagatcaagatcatcaatatctaaaaagaacggtcaacaaggcctacagaagtgtaagccgccacgtgaccttgtgaatacagtctgagaacaaacttgaaaaaaagaaaatttattttaaattgtggcaaaatactggccgggcatggcggcctgcacctgtaatcacaccactttgggaggcctaggcgggtggatcaccaatcctaggtacgtgggaggctgaggttgcagtgagctgagatcacaccactgcactccagtctgggtgacagagtgaaactcccatttcaaaaaaaaaaaaaaaaatttctacctgaggactctaatatctatgtatgtttctattgttttttttgtttgttttctcctttcgtcttgtcttgtcttatggcgtgcctagtaaagttttatctgcctcc

SEQ ID NO: 61934 - DNA, 1011 bp, Homo sapiens
atgtcagtatgtgaatcctggaactgtgatggctatgtcgtgatgcggaaagaacaacgagctgtgcaccaagccaagtctctcttcggtgccaccggcgggcgaggccggattaatcaccgctgcttcggccgcccatgtgtcctgatgtcctgggacccgaaccccgtgccccgtaccttgcgatgctggcgcctacggagggcatccgaaactgccctacagagcagtcgccgggcagttgaagatcagctaaagatatgtggccacaggagggatgctgatgtctttgagctgttcctttctaaaaaggaactgacagaggtcattgatctttctaggtttaaaaaattaaaatacttatggcttcatcataacaagctccatggaataacatttctaactagaaactattgtctgacagaactatatctaaacaacaatgcaatatttgagatagaaggtctgcattatttgccttcattgcatatactcctgctacaccacaatgagctaaccaacattgatgcaacagtgaaggaattaaagggaatgctaaatctgaagatcctaagtctataccaaaatcctttgtgccaatataacctgtatcgtttatatatcatctaccaccttccaggagtggagctgcttgaccgaaatcaagttacagaaaaagaaagaagatcaatgattaccatttttaaccataaaaaggctcatatcgttcaatcaatagcattcggaggaaaagtggatgcttcatgggatcctaaatcaccatttaagcaaaaaccagcccagagagtaccttcagattttgcatttgcaaataatgtagacaaaactgtgcttgatgacccagaagatgctgtttttgtgaggtccatgaagagatcagtgatgactttgacctctatgaactgggacacagttccaacacgagaggaaaggtaccttgaagaggaaggcacagaaacagctcaaatgctcacagttacactgagataa

SEQ ID NO: 61935 - DNA, 1011 bp, Homo sapiens; identical to SEQ ID NO: 61934

SEQ ID NO: 61936 - DNA, 1011 bp, Homo sapiens; identical to SEQ ID NO: 61934

SEQ ID NO: 61937 - DNA, 1374 bp, Homo sapiens
ggaccagggaaggatatgaggaagtgttctgaggacagagaaacgggagaatggggaggagaaggagcagcacatggagctcagcagaggagacagacagaaggaaagatggcttggagaagccagcagtctgcgaggctggggaggatggagagtggtttggggttttgggttgggctctagtgtgatcaactgcagaagcattacaccatggcctggtttctttactcagcccctggggtagatcccagccccccgcataggtccttttgctggaaaaggaagatggagtggtgggacgaatctgaggagtcgttggaggaggagccacggaaggtgctcgcccctgagcctgaggagatctgggtggcggagatgctgtgtggcctcaagatgaagctgaagcgacggcgagtgtcgctcgtgctccctgagcaccacgaggccttcaacaggctgcttgaggatcctgtcattaaaagattcctggcctgggacaaagatctgagggtgtcggacaagtatctcctggctatggtcatagcgtatttcagccgggccggcttcccctcctggcaataccaacgcattcatttcttcctggctctctacctggccaatgacatggaggaggacgacgaggactccaaacaaaacatcttccacttcctgtatgggaagaaccgctctcgcatacccttgctccgtaagcgttggttccagttaggccgttccatgaacccgagggccaggaagaaccgctctcgcatacccttgctccgtaagcgtcggttccagttaggccgttccatgaacccgagggccaggaagaaccgctctcgcatacccttgctccgtaagcgtcggttccagttaggccgttccatgaacctgagggccaggaagaaccgctctcagatagtcctgttccagaaacgtcggttccagttcttctgttccatgagcggcagggcttgggtttccccggaggagttggaggagatccaggcttatgacccagagcactgggtgtgggcgcgagatcgcgctcgcctttcctagagctccagggaccgtggaggcctgaggtcatcggcctgagagaagaacaccggacccaggggagatgtggattttcagcaggaactttattccaatgctaatggcagacaccaggaaggaggagaggaaccatttgtgcagatcatctagaagaacctggaccattcttgatggagctgaatacagtgatcacgttgtcctcctaggagcaggggtggggggaggggggtggggtccttctaggagtccttggagaaaagtaagaaaccaggagtgtttccagttccaccctttcctgcagcaccaccaccc

SEQ ID NO: 61938 - DNA, 1225 bp, Homo sapiens
ggaccagggaaggatatgaggaagtgttctgaggacagagaaacgggagaatggggaggagaaggagcagcacatggagctcagcagaggagacagacagaaggaaagatggcttggagaagccagcagtctgcgaggctggggaggatggagagtggtttggggttttgggttgggctctagtgtgatcaactgcagaagcattacaccatggcctggtttctttactcagcccctggggtagatcccagccccccgcataggtccttttgctggaaaaggaagatggagtggtgggacgaatctgaggagtcgttggaggaggagccacggaaggtgctcgcccctgagcctgaggagatctgggtggcggagatgctgtgtggcctcaagatgaagctgaagcgacggcgagtgtcgctcgtgctccctgagcaccacgaggccttcaacaggctgcttgaggatcctgtcattaaaagattcctggcctgggacaaagatctgagggtgtcggacaagtatctcctggctatggtcatagcgtatttcagccgggccggcttcccctcctggcaataccaacgcattcatttcttcctggctctctacctggccaatgacatggaggaggacgacgaggactccaaacaaaacatcttccacttcctgtatgggaagaaccgctctcgcatacccttgctccgtaagccgtcggttccagttaggccgttccatgaacctgagggccaggaagaaccgctctcagatagtcctgttccagaaacgtcggttccagttcttctgttccatgagcggcagggcttgggtttccccggaggagttggaggagatccaggcttatgacccagagcactgggtgtgggcgcgagatcgcgctcgcctttcctagagctccagggaccgtggaggcctgaggtcatcggcctgagagaagaacaccggacccaggggagatgtggattttcagcaggaactttattccaatgctaatggcagacaccaggaaggaggagaggaaccatttgtgcagatcatctagaagaacctggaccattcttgatggagctgaatacagtgatcacgttgtcctcctaggagcaggggtggggggaggggggtggggtccttctaggagtccttggagaaaagtaagaaaccaggagtgtttccagttccaccctttcctgcagcaccaccaccc

SEQ ID NO: 61939 - DNA, 2400 bp, Homo sapiens
gcctgggtgacaaagcaagattctgtgtcaaaacaaaacaaaacaaaaaaggagggactcagagagccagagaccagggaaggacatgaagcagtgttcggaggacagagagagagaagaatggggaggggaaggagcggcacatggggttgagcagaggagaaaatcagaaagatggcttagagaagccagcagtctgcgagtctggggaggatggagagtggtttggggttttgggtcggggtctaaggtgatcagatgcagaagcattacacggtggcctggtttctttactcagcccctggggtagatcccagccccccatgtaggtcccttggctggaaaaggaagagggagtggtcagatgaatctgcggaggagccggagaaggagctcgcccctgagcctgaggagacctgggtagtggagatgctgtgtgggctcaagatgaagctgaagcaacagcgagtgtcacccatcctccctgagcaccacaagggcttcaacagtcagcttgaggatcctgtcattaaaagattcctggcctgggacaaagatctgagggtgtcggacaagtatctcctggctatggtcatagcgtatttcagccgggccggcttcccctcctggcaataccaacgcattcatttcttcctggctctctacctggccaatgacatggaggaggacgacgaggactccaaacaaaacatcttccacttcctgtatgggaagaaccgctctcgcatacccttgctccgtaagcgttggttccagttaggccgttccatgaacccgagggccaggaagaaccgctctcgcatacccttgctccgtaagcgtcggttccagttaggccgttccatgaacccgagggccaggaagaaccgctctcgcatacccttgctccgtaagcgtcggttccagttaggccgttccatgaacctgagggccaggaagaaccgctctcagatagtcctgttccagaaacgtcggttccagttcttctgttccatgagcggcagggcttgggtttccccggaggagttggaggaggtaggtggggcctggggaggtggaggaggtggggaggaatcgggtgggctggaggctggatgaggggagagaggggtatcctggcgagtccccgtcttctcaaagcgcgtttgtttttccagatccaggcttatgacccagagcactgggtgtgggcgcgagatcgcgctcgcctttcctagagctccagggaccgtggaggcctgaggtcatcggcctgagagaaggtacatctgcatcctccggggtaaaggcagaatattggggtctatttcggaaatccgaagaacccaattgcttgatccggcttcaagcctgggcaacgtggcgagatcccctctcgacaaaaatacaaaaattagccaggcgatgtgggaggcatctctactcccaactactcaggaggctgaggcgggaggatcgctggagcctggaaggtcggggctgcacggagccctgatcctgccactgcactccagtctgggcgacagagtgagaccctgcctcaaaaataatcataaatactgagtttggggaggttcattatgattgatgcacttgagttaccgatttgggtcgagggttcagtgaagctttggtttacatcttgtgcagctaaccacggtgagcacagagcataagacttcatcatgaggaggtaggattaaggattaggcttctggactcgtggttcgtgatgttgtcacattagaaacacatctagcatggttacaagtctggatcttaagagacacaaaaggccccagctgtgatgaagtccaaagccacattctctgagggtgccctactccctgggcagacccacccaaagtccttgctatgaagcagatcactggggctgaccttgggtgtattaagtgagttttggagtcgtcaccaaagtgtgagtttcacagttgaacaccaaggttcagaagcagggtatagaatgaaaggcagcagataaaattgcatttctcaattgctctgaactctagacttgacatgggacgtgaataaccttcctgtctagagagctgcctccttgaagtgtgacattgtctctctcacttccagaacaccggacccaggggagatgtggattttcagcaggaactttattccaatgctaatggcagacaccaggaaggaggagaggaaccatttgtgcagatcatctagaagaacctggaccattcttgatggagctgaatacagtgatcacgttgtcctcctaggagcaggggtggggggaggggggtggggtccttctaggagtccttggagaaaagtaagaaaccaggagtgtttccagttccaccctttcctgcagcaccaccaccc

SEQ ID NO: 61940 - DNA, 2346 bp, Homo sapiens
ggaccagggaaggatatgaggaagtgttctgaggacagagaaacgggagaatggggaggagaaggagcagcacatggagctcagcagaggagacagacagaaggaaagatggcttggagaagccagcagtctgcgaggctggggaggatggagagtggtttggggttttgggttgggctctagtgtgatcaactgcagaagcattacaccatggcctggtttctttactcagcccctggggtagatcccagccccccgcataggtccttttgctggaaaaggaagatggagtggtgggacgaatctgaggagtcgttggaggaggagccacggaaggtgctcgcccctgagcctgaggagatctgggtggcggagatgctgtgtggcctcaagatgaagctgaagcgacggcgagtgtcgctcgtgctccctgagcaccacgaggccttcaacaggctgcttgaggatcctgtcattaaaagattcctggcctgggacaaagatctgagggtgtcggacaagtatctcctggctatggtcatagcgtatttcagccgggccggcttcccctcctggcaataccaacgcattcatttcttcctggctctctacctggccaatgacatggaggaggacgacgaggactccaaacaaaacatcttccacttcctgtatgggaagaaccgctctcgcatacccttgctccgtaagcgttggttccagttaggccgttccatgaacccgagggccaggaagaaccgctctcgcatacccttgctccgtaagcgtcggttccagttaggccgttccatgaacccgagggccaggaagaaccgctctcgcatacccttgctccgtaagcgtcggttccagttaggccgttccatgaacctgagggccaggaagaaccgctctcagatagtcctgttccagaaacgtcggttccagttcttctgttccatgagcggcagggcttgggtttccccggaggagttggaggaggtaggtggggcctggggaggtggaggaggtggggaggaatcgggtgggctggaggctggatgaggggagagaggggtatcctggcgagtccccgtcttctcaaagcgcgtttgtttttccagatccaggcttatgacccagagcactgggtgtgggcgcgagatcgcgctcgcctttcctagagctccagggaccgtggaggcctgaggtcatcggcctgagagaaggtacatctgcatcctccggggtaaaggcagaatattggggtctatttcggaaatccgaagaacccaattgcttgatccggcttcaagcctgggcaacgtggcgagatcccctctcgacaaaaatacaaaaattagccaggcgatgtgggaggcatctctactcccaactactcaggaggctgaggcgggaggatcgctggagcctggaaggtcggggctgcacggagccctgatcctgccactgcactccagtctgggcgacagagtgagaccctgcctcaaaaataatcataaatactgagtttggggaggttcattatgattgatgcacttgagttaccgatttgggtcgagggttcagtgaagctttggtttacatcttgtgcagctaaccacggtgagcacagagcataagacttcatcatgaggaggtaggattaaggattaggcttctggactcgtggttcgtgatgttgtcacattagaaacacatctagcatggttacaagtctggatcttaagagacacaaaaggccccagctgtgatgaagtccaaagccacattctctgagggtgccctactccctgggcagacccacccaaagtccttgctatgaagcagatcactggggctgaccttgggtgtattaagtgagttttggagtcgtcaccaaagtgtgagtttcacagttgaacaccaaggttcagaagcagggtatagaatgaaaggcagcagataaaattgcatttctcaattgctctgaactctagacttgacatgggacgtgaataaccttcctgtctagagagctgcctccttgaagtgtgacattgtctctctcacttccagaacaccggacccaggggagatgtggattttcagcaggaactttattccaatgctaatggcagacaccaggaaggaggagaggaaccatttgtgcagatcatctagaagaacctggaccattcttgatggagctgaatacagtgatcacgttgtcctcctaggagcaggggtggggggaggggggtggggtccttctaggagtccttggagaaaagtaagaaaccaggagtgtttccagttccaccctttcctgcagcaccaccaccc

SEQ ID NO: 61941 - DNA, 1374 bp, Homo sapiens; identical to SEQ ID NO: 61937

SEQ ID NO: 61942 - DNA, 1225 bp, Homo sapiens; identical to SEQ ID NO: 61938

SEQ ID NO: 61943 - DNA, 2400 bp, Homo sapiens; identical to SEQ ID NO: 61939

SEQ ID NO: 61944 - DNA, 2346 bp, Homo sapiens; identical to SEQ ID NO: 61940

SEQ ID NO: 61945 - DNA, 1876 bp, Homo sapiens
ctcttttgtccaccagcccagcctgactcctggagattgtgaatagctccatccagcctgagaaacaagccgggtggctgagccaggctgtgcacggagcacctgacgggcccaacagacccatgctgcatccagagacctcccctggccgggggcatctcctggctgtgctcctggccctccttggcaccacctgggcagaggtgtggccaccccagctgcaggagcaggctccgatggccggagccctgaacaggaaggagagtttcttgctcctctccctgcacaaccgcctgcgcagctgggtccagccccctgcggctgacatgcggaggctggactggagtgacagcctggcccaactggctcaagccagggcagccctctgtggaatcccaaccccgagcctggcatccggcctgtggcgcaccctgcaagtgggctggaacatgcagctgctgcccgcgggcttggcgtcctttgttgaagtggtcagcctatggtttgcagaggggcagcggtacagccacgcggcaggagagtgtgctcgcaacgccacctgcacccactacacgcagctcgtgtgggccacctcaagccagctgggctgtgggcggcacctgtgctctgcaggccagacagcgatagaagcctttgtctgtgcctactcccccggaggcaactgggaggtcaacgggaagacaatcatcccctataagaagggtgcctggtgttcgctctgcacagccagtgtctcaggctgcttcaaagcctgggaccatgcaggggggctctgtgaggtccccaggaatccttgtcgcatgagctgccagaaccatggacgtctcaacatcagcacctgccactgccactgtccccctggctacacgggcagatactgccaagtgaggtgcagcctgcagtgtgtgcacggccggttccgggaggaggagtgctcgtgcgtctgtgacatcggctacgggggagcccagtgtgccaccaaggtgcattttcccttccacacctgtgacctgaggatcgacggagactgcttcatggtgtcttcagaggcagacacctattacagagccaggatgaaatgtcagaggaaaggcggggtgctggcccagatcaagagccagaaagtgcaggacatcctcgccttctatctgggccgcctggagaccaccaacgaggtgactgacagtgacttcgagaccaggaacttctggatcgggctcacctacaagaccgccaaggactccttccgctgggccacaggggagcaccaggccttcaccagttttgcctttgggcagcctgacaaccacgggctggtgtggctgagtgctgccatggggtttggcaactgcgtggagctgcaggcttcagctgccttcaactggaacgaccagcgctgcaaaacccgaaaccgttacatctgccagtttgcccaggagcacatctcccggtggggcccagggtcctgaggcctgaccacatggctccctcgcctgccctgggagcaccggctctgcttacctgtctgcccacctgtctggaacaagggccaggttaagaccacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcgaaggagaggacaccgccagtggtccaaaaaggctgctctcttccacctggcccagaccctgtggggcagcggagcttccctgtggcatgaaccccacggggtattaaattatgaatcagctgaaaaaaaaaaaaa

SEQ ID NO: 61946 - DNA, 1315 bp, Homo sapiens
ggaggaggagctccaactgtgctctttgatggcagtttttgcacctttgggtgcttgtcatgttcgtttatttttcaaagaagacagcaggtccctgacctcatagaccagctagtttgggaggtggcggcagaataagggctgaggacccagatctgcctggggtcaggctgcttctaaaagtgcagggccaccctcagtagtgtggctgctagggcagcacagttacaatttcgctgaaggctgagtcaggagtggagaggcatggagaggccccatggggaatatactgacctgttgtatcaactcccactgtggctggcccagggggaaggacgcaccctgttatgaatctgatactgatatttatgagactgtggctgctgcaacatcagaatccactactgtagagcctggcaagctggatgtgggagccacggagggccaagacctgcagcacatcagcaaccaaaagatgcccacaggtccccctgaggaccgcctgagtttaaaatttctgccatcaagtgaggaagacaatgatgatgccaagattttaccatcacctgtccagggttcttctgaggacaacctgagtttagtatgcctaccacgaagtgaagatgatgactgtgatgatgatgatgatgatgatgcccagattttaccgtcacgtgtccagggtggctgttaccggtttgatagcagttcttgttcttctgaggacaacctgagtttagtatgcctaccacgaagtgaagatgatgactgtgatgatgatgatgatgatgcccagattttaccgtcacctgtccaggcttgttctgaagatagcctgtttttaagatgctcactgagacacaaagatgaagaagaagaagatgatgatgacatccacataacagctcggatagaaagtgacttgacgctggagagtctaagtgatgaagagattcatccagggtgaagcccttctgtggagctgaccagggtgctgacccaaagggcaggccagcgcgtgctgcagggtccccagctttgcccctggaggtctcaatcctctctacattctgaggaaaactcttggtcccagcagagagaaaaagtccaaggctgcttcccacccaccgccagcactaggtttggcctgtaccatccaggacccagtgcttctgggcctggcatttctcctttggcaagagagtgagaagagacgtgactgtgctccacgagcagaaagtgccattcccacttgaaataaagagactgagtgcatttaaaaaaaaaaaaaaaaaaaaaaaaaaaaaaaaaaaaa

SEQ ID NO: 61947 - DNA, 2763 bp, Homo sapiens
cggggatcccggtggccgcaggcgcaccgggggcagttccgggagccgaccagacacgaaggctgaagccgcgacgccgaagacagggtctgaagagctactcagagccaaccctgcactggagacaggaagccgggcacctggatgagcctctgacccagagccctggagcccataggctcgtctgagaactagacacactcagtcactccagctccacgggcagacacctgcacagagcagccacgtggctctggctggcagggctcttctctgctcaccccaggatctgtgaggatggcgcacctgctgggcagccaggcctgcatggagagcctgcgcgcagacctcaccgacctgcagggtgccatcgtagacgtcttctcccgcgccgggcctgtgcgcttcccctcctggaagttccctgaccgcatggcctgtgacctcgacatggtggccctgctggagcactatgaccatgttccgggtgaccccgagttcacgcagctgtcccatgccgtgctgctggagctggtcatcgacaggctcctgctgctgcttcaaagctgtatgagctacttggagaaccttggctcagagcagatgatgccccctgcacaggctgcggggccctgcatgtccgtggggctcacggtgcggcgcttctgggacagcctgctgaggctgggcacgctccaccagcagccactcccccagaaaggggcaaaccaaagggagactcccacctccaagcccaccaccaagggcgagccagccaggagccctgaatatctgactaccaagttaatcaagccctcctccccagtgctaggcttgccccagacctgccaagagccagagagcatccctgtcagagcctccctgcagttcccagccacgaccttcaagaacaccaggagtgtccactcccagaccattgagacggccctggtgccctgtgacgcatgcgccagcgtccagggaagcctgcagaaggtgggcaaggtggtcatcagcctgtgtcagagccagaacctgccctcgtccttaggccagttccagcaactggtgcaggacagcatggggctcaggccactgccggctgccaccgtgggccgctgggcagcagagcagaggaaagacctgacgcgcctcagtaagcatgtggaggccctcagggcccagctggaggaggctgaagggcagaaggatggcctgaggaagcaggcgggcaagctggagcaggcgctgaaacaggagcagggggcacggcggcgacaggcggaggaggatgagcagtgcctgtctgagtgggagcacgacaaacagcagctgctcacagaaacaagtgacctaaagacaaagatggccaccctggagagagaactgaaacagcagcgggagtccacacaggctgtggaggcaaaggcccagcagctgcaggaggaaggtgagcgcagggcggcagcggagaggcaggtgcagcagctggaggagcaggtgcagcagttggaggcgcaggtgcagctgttggtgggtcggctggagggcgctggccagcaggtctgctgggccagcacggagctggataaggagaaggcccgtgtcgacagcatggtccgccaccaggagtctctgcaggccaagcagcgagccctgctaaagcagctggacagcctggaccaggaacgtgaggagctgcggggcagcctggacgaggctgaggcccagcgggcccgcgtggaggagcagctgcagagcgagcgggagcaggggcaatgccagctcagggcccagcaggagctgctgcagagcctgcagagggagaagcaaggcctggagcaggcgactacggacctgcggctaaccatcctggagctagaacgggagctggaggagctgaaggagcgggagcggctgctggtggccttcccagacctgcacaggcccaccgagacccagatccatggaggcagatccagcagcgtggaatcccagataacatgtcccacagactctggcaacgtcacagatcacatggagaggcaagtgcaggccaacgacatccgcatccgggtcctacaggaggagaacgggcggctccaatcaatgctgtccaaaatccgggaagtggcccagcagggtggcctcaagctgatcccgcaggaccggctctggtccccttccagcaagggaacccagggagcaacaccaccagtccaggccaagagcacatccccagggcctctgggcagacagcaccttcctagcagcaggacgggtaggaccctgctgggccagccctgcacatccccacctcggcagccctgcacatccccacctcggcagccctgcacatccccacctcggcagccctgcacatccccatctcggcagccctgcagccagcccagcaagtccttgctggagggtgtgacccacttggacacctgcacccagaaccccatcaaggtcttggtcaggctgagaaagagactgtcacctggccggggacaggccagctctgcacaccagccccaggagcggcccatgtagcctgtggcccagggctgaggctggatgggaggtggctggcagcccacccactgtaataaagccccagccattggcccacagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 61948 - DNA, 2682 bp, Homo sapiens
gcggccgcttctgcattcccccagcaacggcgctctgctagagagctgccgtaagtcacgctactgccgcaagcctctgccgtcgctaagcacgtctgtaggttcaggctaaggttttccgtcagaaggccgcgcaagtgcacttgcgtgtcaccgttaccgtagcgactgggcttctggactgtatatcctagctgccttgtcaacatcttcgagcatcggcagctccggaggccggggtaactggcagcaggtaggaaactatgtgaaagaatctcctgatgtcataatttccgggtgtcaccggaacatttgatcatcattcctttggcaattccagccttctgtggaaaggccagtagaaagcattgatttattcacctctacaggaatcagactcagcctcttttggttttcagtgaagtatgccttttcaatttggaacccagccaaggaggtttccagtggaaggaggagattcttcaattgagctggaacctgggctgagctccagtgctgcctgtaatgggaaggagatgtcaccaaccaggcaactccggaggtgccctggaagtcattgcctgacaataactgatgttcccgtcactgtttatgcaacaacgagaaagccacctgcacaaagcagcaaggaaatgcatcctaaatagcaccattaagtcttttgtcaaggtctgactaggtcaagggtaatggaccagtatcatctggtgatctggtaaacaaataaaagtggtggcacctttagatgatgacaacagttgagctctttacttttagtaagaccgacagaaatgtagtcagtaaagcacatgtagtgataggctatcagttatgtctgatacataagacagaataatatttcacaattagaaagtaccttagagatcatcttgctcacagtagatcattaatatcaataattaaagatgaagcttaatccaccatggtcatcagtcaggtggggcttattctaaatgcttaatgtgtcttaagctcatttccttgttcatatttgggttgctacttggctaaatcctttcaccttagtaccctaagccagtttcctggcttgatactatttgataatgctctgctcaggaatgattatattgggtgagaaatggagccctggggttgtgtgttttggaacagtattcaagatcaaagaaagttcttagtccatggttaatctgcaaggcatttaagccacttccatagaggagcccagattgttggttaaatatattgataatgaagtcaaagctgtggttccaaccccgatttttccaagaaaaatgacgtctggttatcactttgtacacgaagtgctaaccaggtatcttgataaattgtttacagtaggtattgagaaacctcatgtggattttttaatttggttagatgtgggatcacttttgaggatgaggccagctctctatgttctctttttcttcttgcagtagtccccagaaactcagtctgctttccttttctctcgatggctgtcagcacccatctaatgaaattgtcttctccaaaagactgactttaggatcagatacaattttcaccagtgttttttgtctaccttgctgcttctgaaaatatacatataagccttttaaaatgaaaagtttattaacttataattaaatagacgtagatgcatatgtgttgcattaggtgaaaagaaaaactgccagggagttataagaggaaaaactctcagagctcacactgagctgggagaagtttgaatgccaaccagttaaagtggaaagatcttgaacatgtggggcattgagtagagactcagaaaggttgtactttcataagagatccaaactggagctagactaaaggctaatgtataccaattttaagaaagcttaaaaataagccttgagagactcaagatgatctctaagtaacctcattttatctgccaaataaaaatagaacattccttaaaggaagaaaacaaaatcgaggcaggaaattgcctgaggctggagaaaaaatgacaggaaggagaaaggagtgatgaaaaattcctcagagggctgggcttggtggctcatgcctgtaatcctggcactttgggaggccgaagtggatggattatctgaggtcaggcattcgaagccagcctggccaacatggtgaaaccccgactctactaaaaatacaaaaattagtcgggtatgatgggcaggtgcctgtaattccagctacttgggaggctgaggcaggaaaatagcttgaacccaggaggcagaggttgcagtgagctgagattgcatcactgtgctccagcctaggcaacagagtgagactttgtctcaaaaaaaaagaaaaacaaagaaaaattcctcagagctcatacaaggctgggtagaatatgtgtttcaacaatagtggatcttttaatatagtacatggatcattgagtagagtcttcagcaagatattggcaaagtagggttagggttaggttagggagatgggaatagactgaagactactctggacttgccctaacagagtttaagagcaacatttgaaaggatcaaactgatttcaagtaacttgagtgcatccaaggggagaaaacccatcaaaataaaaataaaaactacaataaaatccaaaaaaaaaaaa

SEQ ID NO: 61949 - DNA, 3522 bp, Homo sapiens
ctcaagcaatcctcctgccacctcagtctctcaagttgttggaacacaggtgccagccacgacacctggctaattttgttttgttttgttttgttttgttttagagatgggctcttgctatgttgcctatactggtcttgaactgctggcctcaggcagtcttcctcccttggccacccaaagagatgggattacaagcatgagccactgtgcacagctgagatttttcgacttagtctttttgtacacccagtatcttatagaatatccataatatagattcataaataaaccatttccttcaatggtataaataaataaaccactgctataaatggtggaattttctgagttaagagcaatacatatgatacaaaacttgatatatagagtttcttagccaaactggaggggctggctttagggaccatttccgtggactccctgaaattggggacaccattggaaatatgtgtgaactcatgggcagtttcctatgatttccagtcctcaaaatatctcttggactcaaagatgccttagggcagaggacgcgtgtacccccagtacagaatctcggacagtgaatgtcagtagacactcggcagaaaacctctgccaaattgagtgctctgatgtgactttttcatcaagtcaatgttcctgggatctcttgtacatgataatctcactcttgtaaggtttcatcgtttctgcttaccctacttttctttcccatcctgatccctctcccaccagactggactctgaaacgggcatgtacagagaagaggagaccccaacacgcttcaagctttgagtggagaggacacagcctctgctgggacagggaacagagggatgcggagaccctgaagatgcttttggacagtggtctgaggttgggacagtggcaggagataccattcacccaggatctccaggacaagagatcagcctggcagttacatgtgttttttttcaaactggttgccaggttggcatgagcgatgacatcagagattccgaccttcctgattggagggaccggactctgtcggcacctgggagttcagttggacaacagtaacttctcagagctgttctccactcctgacttctcccagcctcgagaattgataacacactcttctggatcccagcagtgtccagaagaagaccaaggacagaacagagactaggtttggtgagatgggacagattttgggaaagatcatgatgagccatcaaccgcagccccaggaagagcggagcccccagcggagcacctcagggtaccccctccaggaggtggtggatgatgaagtgtcgggaccatcagcccctggggtagatcccagccccccacgtaggtcccttggctggaaaaggaagagagaatgtttggatgaatctgatgatgagccagagaaggagctcgcccctgagcctgaggagacctgggtggcggagacgctgtgtggcctcaagatgaaggcgaagcgacggcgagtgtcgctcgtgctccctgagtactacgaggccttcaacaggctgcttgaggatcctgtcattaaaagactcctggcctgggacaaagatctgagggtgtcggacaagtatctcctggctatggtcatagcgtatttcagccgggccggcctcccctcctggcaataccaacgcattcatttcttcctggctctctatctggccaatgacatggaggaggacgacgaggcccccaaacaaaacatcttctacttcctgtacgaggagacccgctctcatatacccttgctcagtgagctttggttccagttatgccgttacatgaacccgagggccaggaagaactgctctcagatagccttgttccggaagtatcggttccacttcttttgttccatgcgctgcagggcttgggtttccctggaggagttggaagagatccaggcttatgacccagagcactgggtgtgggcgcgagatcgcgcccacctttcctagagctccagggaccgtggaggcctgaggtcatcggcctgagagaagaacaccggacccaggggagatgtggattttcagcaggaactttattccaatgctaatggcagacatcaggaaggaggagaggaaccatttgtgcagatcatctagaagaacctggaccattcttgacagagctgaatacagtgatcacgttgtcctccaaggagcaggggtggggtggggtacttctaggagtccttggagaaaagtaagaaaccaggagtgtttccagttccaccctttcctgcggcaccacctccctttttatattgctgaatgccaacctccctggggcggaacctggaggtcctgtttcttatggacttggttgtcacagtccaggagcatttgaaggcacagtgcaggggctcagattggcacagaattctttgtgaaatatgagtgccacagactgtaacagatagcttcatgcacactatgcattttattggtttgtttggaaaatgttggccattgaattattaataggtttatttcaaatagtttggaaattgttgtacttttgaaaacatgctgttcctgtagagttttttgatgagagttatagttgttatatatacctaaagataattttcttttcatttttaagtgagaattctttttatcctaaatcttttattatctttaattttttttctgtattattatatgtgctcctgaagcgagcactctttttatctatgatacttccataataatctcttctatttatagctattggtagttccccaccagaaaaaaacataattctggtgatagaaatttttatttgctgtttaggtttgtgactgacttgtgagaattcagttgtgatttttaacatgtctcagatatatatactaacacgtctaatatatactatctattttattggtttattttgaaaaacatgggtatagaattatttaaatattattttatttactgaaatatttattaaatatatttatttatttaaatattattattactttaaatattattttaaatattttggaaatactggtatttttgaatagatgctgtttctataaagctgtgtgatgggtattataactgttgtatacacatacatataattttgttttcctttttaagagaggattcttttcatcctaaatcttttacctttcaatctttgtatctattattacacgtgctgctgaagggagcatggtttttatctatgatacttagttaacatatatattacatttatagctatgtggtagttcccctaaattcttgtaaaaataaatttttatttgatatttagtgtatgtttgaaatgtgagaattcagatggaattttttatcttgttttggcatgtttgtatgttactttaaagaggatgtgtgttctaaaggaggacatgagctgtgtgttttcaagagaacagtgcagtgcatctcttggggaaacataataaagatgaacttttctcacct

SEQ ID NO: 61950 - DNA, 5357 bp, Homo sapiens
ctcaagcaatcctcctgccacctcagtctctcaagttgttggaacacaggtgccagccacgacacctggctaattttgttttgttttgttttgttttgttttagagatgggctcttgctatgttgcctatactggtcttgaactgctggcctcaggcagtcttcctcccttggccacccaaagagatgggattacaagcatgagccactgtgcacagctgagatttttcgacttagtctttttgtacacccagtatcttatagaatatccataatatagattcataaataaaccatttccttcaatggtataaataaataaaccactgctataaatggtggaattttctgagttaagagcaatacatatgatacaaaacttgatatatagagtttcttagccaaactggaggggctggctttagggaccatttccgtggactccctgaaattggggacaccattggaaatatgtgtgaactcatgggcagtttcctatgatttccagtcctcaaaatatctcttggactcaaagatgccttagggcagaggacgcgtgtacccccagtacagaatctcggacagtgaatgtcagtagacactcggcagaaaacctctgccaaattgagtgctctgatgtgactttttcatcaagtcaatgttcctgggatctcttgtacatgataatctcactcttgtaaggtttcatcgtttctgcttaccctacttttctttcccatcctgatccctctcccaccagactggactctgaaacgggcatgtacagagaagaggagaccccaacacgcttcaagctttgagtggagaggacacagcctctgctgggacagggaacagagggatgcggagaccctgaagatgcttttggacagtggtctgaggttgggacagtggcaggagataccattcacccaggatctccaggacaagagatcagcctggcagttacatgtgttttttttcaaactggttgccaggttggcatgagcgatgacatcagagattccgaccttcctgattggagggaccggactctgtcggcacctgggagttcagttggacaacagtaacttctcagagctgttctccactcctgacttctcccagcctcgagaattgataacacactcttctggatcccagcagtgtccagaagaagaccaaggacagaacagagactaggtttggtgagatgggacagattttgggaaagatcatgatgagccatcaaccgcagccccaggaagagcggagcccccagcggagcacctcagggtaccccctccaggaggtggtggatgatgaagtgtcgggaccatcaggtgaggggactggaggaagaagaggtggcataggattgactaagatgaaggaagggggccaggcgtggtggctcacccctgtaaccccaacactttgggaggctgaggcgggcagatcacctgaggtcaggagttcaagaccagcctggccaacatggtgaaaccccatctctactaaaagtacaaaaattagccaggtggtagtggtgtgtgcctataatcccagctacttgggaggctaagacaggagaatcacttgagcctgggaggaagaggttgcagtgagccgagatcgtgctactgcactccagtctgggtgacagagtgagatgctatctcaaaaaaaaaaaaaaaaaaaaaaaaaaaaagaagggtcagaggtcaggaaggagaacctggggagggtgtgtgggaagaatggagaaattcaggctgggtgcagtggctcacacttgtaatcccagcactttgggaagccaaggcaggcggatcacttgaggccaggggtttgagaccagcctggccaacatggtgaaaccctgtctctattaaaagtacaaaatggagctgggcattatggcaggcacctgtaatcccagctacctgagaggctgaggcaggagaataactggaatccgggagatgcatgttgcagtgagctgagattgcaccactacactccagcctgggtgacaaagcaagattctgtctcgaaacaaaaaaaaaaaaaaaaaagagggactcagagagccagggaccagggaaggatatgaggcagtgttctgaggacagagagagggaagaatggggaggggaaggagtggcacatggggttgagcagaggagaaagtcagaaaggtggcttggagaagccagcagtctgcgaggctggggaggatggagagtggtttggggtttggggtcggggtctaacgtgatcagttgcagaagcattacacggtggcctggtttctttactcagcccctggggtagatcccagccccccacgtaggtcccttggctggaaaaggaagagagaatgtttggatgaatctgatgatgagccagagaaggagctcgcccctgagcctgaggagacctgggtggcggagacgctgtgtggcctcaagatgaaggcgaagcgacggcgagtgtcgctcgtgctccctgagtactacgaggccttcaacaggctgcttgaggatcctgtcattaaaagactcctggcctgggacaaagatctgagggtgtcggacaagtatctcctggctatggtcatagcgtatttcagccgggccggcctcccctcctggcaataccaacgcattcatttcttcctggctctctatctggccaatgacatggaggaggacgacgaggcccccaaacaaaacatcttctacttcctgtacgaggagacccgctctcatatacccttgctcagtgagctttggttccagttatgccgttacatgaacccgagggccaggaagaactgctctcagatagccttgttccggaagtatcggttccacttcttttgttccatgcgctgcagggcttgggtttccctggaggagttggaagagatccaggcttatgacccagagcactgggtgtgggcgcgagatcgcgcccacctttcctagagctccagggaccgtggaggcctgaggtcatcggcctgagagaaggtacatctgcatcctccggggtaaaggcagaatattggggtctatttcagaaatccaaggaacccaattgcttgatctggcttcaagcctgggcaacgtggcgagatcccctctccacaaaaatacaaaaattagccaggcgatgtgggaggcatctctactcccaactactcaggaggctgaggcgggaggatcgctggagcctgggaggtcggggctgcagggagccctgatcctgccactgcactccagcccgggcgacagagtgagaccctgcctcaaaaataatcataaatactgagttcggggaggttcattatgattgatgcacttgagttaccgatttgggtcgagggttcagtgaagctttggtttacatcttgtgcagctaaccatgttgagcacagagcatgagacttcgtcatgaggagggaggattatggattaggcttctggactcgtggttcgtgatgttgtcacgttagaaacagatctagcacggttacaagtttagatctgaagtgacacaaaaggccccagctgtgatgaagtccaaagccacattctctgagggtgccctactccctgggaagacccacccaaagtcctggctatgaagcagatcactggggctgaccttgggtgtattaagttttggagtcagggtcaccaaagtgtgagtttcacagttgaacacgatggttcagaagcagggtatagaatgaaaggcaggagataaaattgcacttctcaattgctctgaactctagctagacttgacatgggacgtgaataaccttcctgtctagagagctgcctccttgaagtgtgacattgtctctctcacttccagaacaccggacccaggggagatgtggattttcagcaggaactttattccaatgctaatggcagacatcaggaaggaggagaggaaccatttgtgcagatcatctagaagaacctggaccattcttgacagagctgaatacagtgatcacgttgtcctccaaggagcaggggtggggtggggtacttctaggagtccttggagaaaagtaagaaaccaggagtgtttccagttccaccctttcctgcggcaccacctccctttttatattgctgaatgccaacctccctggggcggaacctggaggtcctgtttcttatggacttggttgtcacagtccaggagcatttgaaggcacagtgcaggggctcagattggcacagaattctttgtgaaatatgagtgccacagactgtaacagatagcttcatgcacactatgcattttattggtttgtttggaaaatgttggccattgaattattaataggtttatttcaaatagtttggaaattgttgtacttttgaaaacatgctgttcctgtagagttttttgatgagagttatagttgttatatatacctaaagataattttcttttcatttttaagtgagaattctttttatcctaaatcttttattatctttaattttttttctgtattattatatgtgctcctgaagcgagcactctttttatctatgatacttccataataatctcttctatttatagctattggtagttccccaccagaaaaaaacataattctggtgatagaaatttttatttgctgtttaggtttgtgactgacttgtgagaattcagttgtgatttttaacatgtctcagatatatatactaacacgtctaatatatactatctattttattggtttattttgaaaaacatgggtatagaattatttaaatattattttatttactgaaatatttattaaatatatttatttatttaaatattattattactttaaatattattttaaatattttggaaatactggtatttttgaatagatgctgtttctataaagctgtgtgatgggtattataactgttgtatacacatacatataattttgttttcctttttaagagaggattcttttcatcctaaatcttttacctttcaatctttgtatctattattacacgtgctgctgaagggagcatggtttttatctatgatacttagttaacatatatattacatttatagctatgtggtagttcccctaaattcttgtaaaaataaatttttatttgatatttagtgtatgtttgaaatgtgagaattcagatggaattttttatcttgttttggcatgtttgtatgttactttaaagaggatgtgtgttctaaaggaggacatgagctgtgtgttttcaagagaacagtgcagtgcatctcttggggaaacataataaagatgaacttttctcacct

SEQ ID NO: 61951 - DNA, 2471 bp, Homo sapiens
tctcaaaataaattaataaataaataaaaataaaaatcaaataaagaaaaacaaaatcaaaaatcaaaaaagtggtttcagctgtgccctctgaaacttaatgtttcttactgacttttctaaacctaagtgtctccatccatagtgagggatcccaaggccatggtcacaccctgatgtgtgactgtctcatgaggaaatgatgggaattcctttatgactctgcagtggtccctccgtgtctgctggagggggtcctggctgattcccagctctacatcctgtagattctcacacccagggcctccttcggcctcttctcaggggagtctcagagcaggagcctctctcccttgcccagtgaaagtcattctcccctctctcatccacctcacccgcggccacaatcctgagactttcccccgggaggcacacttctcctcgctgccctgctgctctcacggaaaccctgtcctgcttctcacactgacatctgctctctaatcacagaggatcctgtcattaaaagactcctggcctgggacaaagatctgagggtgtcggacaagtatctcctggctatggtcatagcgtatttcagccgggccggcctcccctcctggcaataccaacgcattcatttcttcctggctctctatctggccaatgacatggaggaggacgacgaggcccccaaacaaaacatcttctacttcctgtacgaggagacccgctctcatatacccttgctcagtgagctttggttccagttatgccgttacatgaacccgagggccaggaagaactgctctcagatagccttgttccggaagtatcggttccacttcttttgttccatgcgctgcagggcttgggtttccctggaggagttggaagagatccaggcttatgacccagagcactgggtgtgggcgcgagatcgcgcccacctttcctagagctccagggaccgtggaggcctgaggtcatcggcctgagagaagaacaccggacccaggggagatgtggattttcagcaggaactttattccaatgctaatggcagacatcaggaaggaggagaggaaccatttgtgcagatcatctagaagaacctggaccattcttgacagagctgaatacagtgatcacgttgtcctccaaggagcaggggtggggtggggtacttctaggagtccttggagaaaagtaagaaaccaggagtgtttccagttccaccctttcctgcggcaccacctccctttttatattgctgaatgccaacctccctggggcggaacctggaggtcctgtttcttatggacttggttgtcacagtccaggagcatttgaaggcacagtgcaggggctcagattggcacagaattctttgtgaaatatgagtgccacagactgtaacagatagcttcatgcacactatgcattttattggtttgtttggaaaatgttggccattgaattattaataggtttatttcaaatagtttggaaattgttgtacttttgaaaacatgctgttcctgtagagttttttgatgagagttatagttgttatatatacctaaagataattttcttttcatttttaagtgagaattctttttatcctaaatcttttattatctttaattttttttctgtattattatatgtgctcctgaagcgagcactctttttatctatgatacttccataataatctcttctatttatagctattggtagttccccaccagaaaaaaacataattctggtgatagaaatttttatttgctgtttaggtttgtgactgacttgtgagaattcagttgtgatttttaacatgtctcagatatatatactaacacgtctaatatatactatctattttattggtttattttgaaaaacatgggtatagaattatttaaatattattttatttactgaaatatttattaaatatatttatttatttaaatattattattactttaaatattattttaaatattttggaaatactggtatttttgaatagatgctgtttctataaagctgtgtgatgggtattataactgttgtatacacatacatataattttgttttcctttttaagagaggattcttttcatcctaaatcttttacctttcaatctttgtatctattattacacgtgctgctgaagggagcatggtttttatctatgatacttagttaacatatatattacatttatagctatgtggtagttcccctaaattcttgtaaaaataaatttttatttgatatttagtgtatgtttgaaatgtgagaattcagatggaattttttatcttgttttggcatgtttgtatgttactttaaagaggatgtgtgttctaaaggaggacatgagctgtgtgttttcaagagaacagtgcagtgcatctcttggggaaacataataaagatgaacttttctcacct

SEQ ID NO: 61952 - DNA, 2515 bp, Homo sapiens
agctccgactacagggctgtaccaccacacctggacagttatttatttatttatttatttatcaagacaagagtgttgctgtgtctctcaggctggaatggaggggcccaatcttggctcactgcaacctccgcctcctgggttcacacaattcttatgcttcagcctcctgagtagctaggactaatgggtgtgccaccgcaccaggctgatttttgtatttttagtatagatggggtttctctgtgttgaccaggctggtctcaaactcctggtctcaagcaatccacctgcttcagccttccaaagcgctgggattacaggcatgagccaccacgtctggcgtattttttatatttttaatagagacgagggtcttgctatgttgcccaggcctgtctcaaactcctggcctcaagtgatcctcctgcttcggcctcccagtgtgctgggattccaggcataagccaccactcttggtcaccagttgggtttttgtctccatcctgaaggagtgggagacgcccttgatcaggtctctgtccagcagagccctcctgaggaaggcgtggctctctgcagggtgggtgccagtcctgagctagggacggtcccttaccttcctctctgagaagctgacctcagccggaggtctctcctggtggtgcccctgagcagcaacctgatttctgtcctcagctatctggccaatgacatggaggaggacgacgaggcccccaaacaaaacatcttctacttcctgtacgaggagacccgctctcatatacccttgctcagtgagctttggttccagttatgccgttacatgaacccgagggccaggaagaactgctctcagatagccttgttccggaagtatcggttccacttcttttgttccatgcgctgcagggcttgggtttccctggaggagttggaagagatccaggcttatgacccagagcactgggtgtgggcgcgagatcgcgcccacctttcctagagctccagggaccgtggaggcctgaggtcatcggcctgagagaagaacaccggacccaggggagatgtggattttcagcaggaactttattccaatgctaatggcagacatcaggaaggaggagaggaaccatttgtgcagatcatctagaagaacctggaccattcttgacagagctgaatacagtgatcacgttgtcctccaaggagcaggggtggggtggggtacttctaggagtccttggagaaaagtaagaaaccaggagtgtttccagttccaccctttcctgcggcaccacctccctttttatattgctgaatgccaacctccctggggcggaacctggaggtcctgtttcttatggacttggttgtcacagtccaggagcatttgaaggcacagtgcaggggctcagattggcacagaattctttgtgaaatatgagtgccacagactgtaacagatagcttcatgcacactatgcattttattggtttgtttggaaaatgttggccattgaattattaataggtttatttcaaatagtttggaaattgttgtacttttgaaaacatgctgttcctgtagagttttttgatgagagttatagttgttatatatacctaaagataattttcttttcatttttaagtgagaattctttttatcctaaatcttttattatctttaattttttttctgtattattatatgtgctcctgaagcgagcactctttttatctatgatacttccataataatctcttctatttatagctattggtagttccccaccagaaaaaaacataattctggtgatagaaatttttatttgctgtttaggtttgtgactgacttgtgagaattcagttgtgatttttaacatgtctcagatatatatactaacacgtctaatatatactatctattttattggtttattttgaaaaacatgggtatagaattatttaaatattattttatttactgaaatatttattaaatatatttatttatttaaatattattattactttaaatattattttaaatattttggaaatactggtatttttgaatagatgctgtttctataaagctgtgtgatgggtattataactgttgtatacacatacatataattttgttttcctttttaagagaggattcttttcatcctaaatcttttacctttcaatctttgtatctattattacacgtgctgctgaagggagcatggtttttatctatgatacttagttaacatatatattacatttatagctatgtggtagttcccctaaattcttgtaaaaataaatttttatttgatatttagtgtatgtttgaaatgtgagaattcagatggaattttttatcttgttttggcatgtttgtatgttactttaaagaggatgtgtgttctaaaggaggacatgagctgtgtgttttcaagagaacagtgcagtgcatctcttggggaaacataataaagatgaacttttctcacct

SEQ ID NO: 61953 - DNA, 2875 bp, Homo sapiens
cttccacagcaatgggatttccttccgcattcagtttgtgcctttcccatgagcgagagactcctaggagagccgcagcccgttaggaagccatgtgggaactcatccacagactggactctgaaacgggcatgtacagagaagaggagaccccaacacgcttcaagctttgagtggagaggacacagcctctgctgggacagggaacagagggatgcggagaccctgaagatgcttttggacagtggtctgaggttgggacagtggcaggagataccattcacccaggatctccaggacaagagatcagcctggcagttacatgtgttttttttcaaactggttgccaggttggcatgagcgatgacatcagagattccgaccttcctgattggagggaccggactctgtcggcacctgggagttcagttggacaacagtaacttctcagagctgttctccactcctgacttctcccagcctcgagaattgataacacactcttctggatcccagcagtgtccagaagaagaccaaggacagaacagagactaggtttggtgagatgggacagattttgggaaagatcatgatgagccatcaaccgcagccgcaggaagagcggagcccccagcggagcacctcagggtaccccctccaggaggtggtggatgatgaagtgtcgggaccatcagcccctggggtagatcccagccccccacgtaggtcccttggctggaaaaggaagagggaatgtttggatgaatctgatgatgagccagagaaggagctcgcccctgagcctgaggagacctgggtggcggagacgctgtgtggcctcaagatgaaggcgaagcgacggcgagtgtcgctcgtgctccctgagtactacgaggccttcaacaggctgcttgaggatcctgtcattaaaagactcctggcctgggacaaagatctgagggtgtcggacaagtatctcctggctatggtcatagcgtatttcagccgggccggcctcccctcctggcaataccaacgcattcatttcttcctggctctctatctggccaatgacatggaggaggacgacgaggcccccaaacaaaacatcttctacttcctgtacgaggagacccgctctcatatacccttgctcagtgagctttggttccagttatgccgttacatgaacccgagggccaggaagaactgctctcagatagccttgttccggaagtatcggttccacttcttttgttccatgcgctgcagggcttgggtttccctggaggagttggaagagatccaggcttatgacccagagcactgggtgtgggcgcgagatcgcgcccacctttcctagagctccagggaccgtggaggcctgaggtcatcggcctgagagaagaacaccggacccaggggagatgtggattttcagcaggaactttattccaatgctaatggcagacatcaggaaggaggagaggaaccattggtgcagatcatctagaagaacctggaccattcttgacagagctgaatacagtgatcacgttgtcctccaaggagcaggggtggggtggggtacttctaggagtccttggagaaaagtaagaaaccaggagtgtttccagttccaccctttcctgcggcaccacctccctttttatattgctgaatgccaacctccctggggcggaacctggaggtcctgtttcttatggacttggttgccacagtccaggagcatttgaaggcacagtgcaggggctcagattggcacagaattctttgtgaaatatgagtgccacagactgtaacagatagcttcatgcacactatgcattttattggtttgtttggaaaatgttggccattgaattattaataggtttatttcaaatagtttggaaattgttgtacttttgaaaacatgctgttcctgtagagttttttgatgagagttatagttgttatatatacctaaagataattttcttttcatttttaagtgagaattctttttatcctaaatcttttattatctttaaatttttttctgtattattatatgtgctcctgaagcgagcactctttttatctatgatacttccataataatctcttctatttatagctattggtagttccccaccagaaaaaaacataattctggtgatagaaatttttatttgctgtttaggtttgtgactgacttgtgagaattcagttgtgatttttaacatgtctcagatatatatactaacacgtctaatatatactatctattttattggtttattttgaaaaacatgggtatagaattatttaaatattattttatttactgaaatatttattaaatatatttatttatttaaatattattattactttaaatattattttaaatattttggaaatactggtatttttgaatagatgctgtttctataaagctgtgtgatgggtattataactgttgtatacacatacatataattttgttttcctttttaagagaggattcttttcatcctaaatcttttacctttcaatctttgtatctattattacacgtgctgctgaagggagcatggtttttatctatgatacttagttaacatatatattacatttatagctatgtggtagttcccctaaattcttgtaaaaataaatttttatttgatatttagtgtatgtttgaaatgtgagaattcagatggaattttttatcttgttttggcatgtttgtatgttactttaaagaggatgtgtgttctaaaggaggacatgagctgtgtgttttcaagagaacagtgcagtgcatctcttggggaaacataataaagatgaacttttctcacct

SEQ ID NO: 61954 - DNA, 5803 bp, Homo sapiens
tagttttgctcttgttgcccaggctggagtgcaatggtgtgaccttggctcactgcaacctccgcctcccaagtttaagccattctgctgtccccgcctcctgagtggctgggattacaggcacccaccaccatgcctgactaattttttgtatttttagaagagatggggtttcaccatgttggccaggctgctcttaaactcctgacctcaagcgatccacctgctatggcctcccaaagcgctgggattacaggcgtgagccactgtgcctggccggaacccacaggttctttggatggtctctgaatgtcatgaaactcttttatatttaattaaaaaaatttttttgacacaaggtcttgctgtgttgcccagactggagtgcggtgtcacgatcacagctcactgcagcccctaactcctaggctcaagcaatcctcctgccacctcagtctctcaagttgttggaacacaggtgccagccacgacacctggctaattttgttttgttttgttttgttttgttttagagatgggctcttgctatgttgcctatactggtcttgaactgctggcctcaggcagtcttcctcccttggccacccaaagagatgggattacaagcatgagccactgtgcacagctgagatttttcgacttagtctttttgtacacccagtatcttatagaatatccataatatagattcataaataaaccatttccttcaatggtataaataaataaaccactgctataaatggtggaattttctgagttaagagcaatacatatgatacaaaacttgatatatagagtttcttagccaaactggaggggctggctttaggtgatccgtggactccctgaaattggggacaccattggaaatatgtgtgaactcatgggcagtttcctatgatttccagtcctcaaaatatctcttggactcaaagatgccttagggcagaggacgcgtgtacccccagtacagaatctcggacagtgaatgtcagtagacactcggcagaaaacctctgccaaattgagtgctctgatgtgactttttcatcaagtcaatgttcctgggatctcttgtacatgataatctcactcttgtaaggtttcatcgtttctgcttaccctacttttctttcccatcctgatccctctcccaccagactggactctgaaacgggcatgtacagagaagaggagaccccaacacgcttcaagctttgagtggagaggacacagcctctgctgggacagggaacagagggatgcggagaccctgaagatgcttttggacagtggtctgaggttgggacagtggcaggagataccattcacccaggatctccaggacaagagatcagcctggcagttacatgtgttttttttcaaactggttgccaggttggcatgagcgatgacatcagagattccgaccttcctgattggagggaccggactctgtcggcacctgggagttcagttggacaacagtaacttctcagagctgttctccactcctgacttctcccagcctcgagaattgataacacactcttctggatcccagcagtgtccagaagaagaccaaggacagaacagagactaggtttggtgagatgggacagattttgggaaagatcatgatgagccatcaaccgcagccgcaggaagagcggagcccccagcggagcacctcagggtaccccctccaggaggtggtggatgatgaagtgtcgggaccatcaggtgaggggactggaggaagaagaggtggcataggattgactaagatgaaggaagggggccaggcgtggtggctcacccctgtaaccccaacactttgggaggctgaggcgggcagatcacctgaggtcagtagttcaagaccagcctggccaacatggtgaaaccccatctctactaaaagtacaaaaattagccaggcggtagtggtgtgtgcctataatcccagctacttgggaggctaaaacaggagaatcacttgagcctgggaggaagaggttgcagtgagccgagatcgtgctactgcactccagtctgggtgacagagtgagatgctatctcaaaaaaaaaaaaaaaaaaaaaaaaaaaaaaaaaaaaaagaagaaaaaaaagaggggtcagaggtcaggaaggaaaacctggggagggtgtttggaaagaatggaaaaattcaggctgggtgcagtggctcacacttgtaatcccagcactttgggaagccaaggcaggcggatcacttgaggccaggagtttgaaaccagcctggccaacatggtgaaaccctgtctctattaaaagtacaaaatggagctgggcattatggcaggcacctgtaatcccagctacctgagaggctgaggcaggagaataactggaatccgggagatgcatgttgcagtgagctgagattgcaccactacactccagcctgggtgacaaagcaagattctgtctcgaaacaaaaaaaaaaaaaaaaaagagggactcagagagccagggaccagggaaggatatgaggcagtgttctgaggacagagagagggaagaatggggaggggaaggagtggcacatggggttgagcagaggagaaagtcagaaaggtggcttggagaagccagcagtctgcgaggctggggaggatggagagtggtttggggtttggggtcggggtctaacgtgatcagttgcagaagcattacacggtggcctggtttctttactcagcccctggggtagatcccagccccccacgtaggtcccttggctggaaaaggaagagggaatgtttggatgaatctgatgatgagccagagaaggagctcgcccctgagcctgaggagacctgggtggcggagacgctgtgtggcctcaagatgaaggcgaagcgacggcgagtgtcgctcgtgctccctgagtactacgaggccttcaacaggctgcttgaggatcctgtcattaaaagactcctggcctgggacaaagatctgagggtgtcggacaagtatctcctggctatggtcatagcgtatttcagccgggccggcctcccctcctggcaataccaacgcattcatttcttcctggctctctatctggccaatgacatggaggaggacgacgaggcccccaaacaaaacatcttctacttcctgtacgaggagacccgctctcatatacccttgctcagtgagctttggttccagttatgccgttacatgaacccgagggccaggaagaactgctctcagatagccttgttccggaagtatcggttccacttcttttgttccatgcgctgcagggcttgggtttccctggaggagttggaagagatccaggcttatgacccagagcactgggtgtgggcgcgagatcgcgcccacctttcctagagctccagggaccgtggaggcctgaggtcatcggcctgagagaaggtacatctgcatcctccggggtaaaggcagaatattggggtctatttcggaaatccaaggaacccaattgcttgatctggcttcaagcctgggcaacgtggcgagatcccctctccacaaaaatacaaaaattagccaggcgatgtgggaggcatctctactcccaactactcaggaggctgaggcgggaggatcgctggagcctgggaggtcggggctgcagggagccctgatcctgccactgcactccagcccgggcgacagagtgagaccctgcctcaaaaataatcataaatactgagttcggggaggttcattatgattgatgcacttgagttaccgatttgggtcgagggttcagtgaagctttggtttacatcttgtgcagctaaccatgttgagcacagagcatgagacttcgtcatgaggagggaggattatggattaggcttctggactcgtggttcgtgatgctgtcacgttagaaacagatctagcacggttacaagtttagatctgaagtgacacaaaaggccccagctgtgatgaagtccaaagccacattctctgagggtgccctactccctgggaagacccacccaaagtcctggctatgaagcagatcactggggctgaccttgggtgtattaagttttggagtcagggtcaccaaagtgtgagtttcacagttgaacacgatggttcagaagcagggtatagaatgaaaggcaggagataaaattgcacttctcaattgctctgaactctagctagacttgacatgggacgtgaataaccttcctgtctagagagctgcctccttgaagtgtgacattgtctctctcacttccagaacaccggacccaggggagatgtggattttcagcaggaactttattccaatgctaatggcagacatcaggaaggaggagaggaaccattggtgcagatcatctagaagaacctggaccattcttgacagagctgaatacagtgatcacgttgtcctccaaggagcaggggtggggtggggtacttctaggagtccttggagaaaagtaagaaaccaggagtgtttccagttccaccctttcctgcggcaccacctccctttttatattgctgaatgccaacctccctggggcggaacctggaggtcctgtttcttatggacttggttgccacagtccaggagcatttgaaggcacagtgcaggggctcagattggcacagaattctttgtgaaatatgagtgccacagactgtaacagatagcttcatgcacactatgcattttattggtttgtttggaaaatgttggccattgaattattaataggtttatttcaaatagtttggaaattgttgtacttttgaaaacatgctgttcctgtagagttttttgatgagagttatagttgttatatatacctaaagataattttcttttcatttttaagtgagaattctttttatcctaaatcttttattatctttaaatttttttctgtattattatatgtgctcctgaagcgagcactctttttatctatgatacttccataataatctcttctatttatagctattggtagttccccaccagaaaaaaacataattctggtgatagaaatttttatttgctgtttaggtttgtgactgacttgtgagaattcagttgtgatttttaacatgtctcagatatatatactaacacgtctaatatatactatctattttattggtttattttgaaaaacatgggtatagaattatttaaatattattttatttactgaaatatttattaaatatatttatttatttaaatattattattactttaaatattattttaaatattttggaaatactggtatttttgaatagatgctgtttctataaagctgtgtgatgggtattataactgttgtatacacatacatataattttgttttcctttttaagagaggattcttttcatcctaaatcttttacctttcaatctttgtatctattattacacgtgctgctgaagggagcatggtttttatctatgatacttagttaacatatatattacatttatagctatgtggtagttcccctaaattcttgtaaaaataaatttttatttgatatttagtgtatgtttgaaatgtgagaattcagatggaattttttatcttgttttggcatgtttgtatgttactttaaagaggatgtgtgttctaaaggaggacatgagctgtgtgttttcaagagaacagtgcagtgcatctcttggggaaacataataaagatgaacttttctcacct

SEQ ID NO: 61955 - DNA, 2515 bp, Homo sapiens; identical to SEQ ID NO: 61920

SEQ ID NO: 61956 - DNA, 2473 bp, Homo sapiens; identical to SEQ ID NO: 61919

SEQ ID NO: 61957 - DNA, 3947 bp, Homo sapiens
tagttttgctcttgttgcccaggctggagtgcaatggtgtgaccttggctcactgcaacctccgcctcccaagtttaagccattctgctgtccccgcctcctgagtggctgggattacaggcacccaccaccatgcctgactaattttttgtatttttagaagagatggggtttcaccatgttggccaggctgctcttaaactcctgacctcaagcgatccacctgctatggcctcccaaagcgctgggattacaggcgtgagccactgtgcctggccggaacccacaggttctttggatggtctctgaatgtcatgaaactcttttatatttaattaaaaaaatttttttgacacaaggtcttgctgtgttgcccagactggagtgcggtgtcacgatcacagctcactgcagcccctaactcctaggctcaagcaatcctcctgccacctcagtctctcaagttgttggaacacaggtgccagccacgacacctggctaattttgttttgttttgttttgttttgttttagagatgggctcttgctatgttgcctatactggtcttgaactgctggcctcaggcagtcttcctcccttggccacccaaagagatgggattacaagcatgagccactgtgcacagctgagatttttcgacttagtctttttgtacacccagtatcttatagaatatccataatatagattcataaataaaccatttccttcaatggtataaataaataaaccactgctataaatggtggaattttctgagttaagagcaatacatatgatacaaaacttgatatatagagtttcttagccaaactggaggggctggctttaggtgatccgtggactccctgaaattggggacaccattggaaatatgtgtgaactcatgggcagtttcctatgatttccagtcctcaaaatatctcttggactcaaagatgccttagggcagaggacgcgtgtacccccagtacagaatctcggacagtgaatgtcagtagacactcggcagaaaacctctgccaaattgagtgctctgatgtgactttttcatcaagtcaatgttcctgggatctcttgtacatgataatctcactcttgtaaggtttcatcgtttctgcttaccctacttttctttcccatcctgatccctctcccaccagactggactctgaaacgggcatgtacagagaagaggagaccccaacacgcttcaagctttgagtggagaggacacagcctctgctgggacagggaacagagggatgcggagaccctgaagatgcttttggacagtggtctgaggttgggacagtggcaggagataccattcacccaggatctccaggacaagagatcagcctggcagttacatgtgttttttttcaaactggttgccaggttggcatgagcgatgacatcagagattccgaccttcctgattggagggaccggactctgtcggcacctgggagttcagttggacaacagtaacttctcagagctgttctccactcctgacttctcccagcctcgagaattgataacacactcttctggatcccagcagtgtccagaagaagaccaaggacagaacagagactaggtttggtgagatgggacagattttgggaaagatcatgatgagccatcaaccgcagccgcaggaagagcggagcccccagcggagcacctcagggtaccccctccaggaggtggtggatgatgaagtgtcgggaccatcagcccctggggtagatcccagccccccacgtaggtcccttggctggaaaaggaagagggaatgtttggatgaatctgatgatgagccagagaaggagctcgcccctgagcctgaggagacctgggtggcggagacgctgtgtggcctcaagatgaaggcgaagcgacggcgagtgtcgctcgtgctccctgagtactacgaggccttcaacaggctgcttgaggatcctgtcattaaaagactcctggcctgggacaaagatctgagggtgtcggacaagtatctcctggctatggtcatagcgtatttcagccgggccggcctcccctcctggcaataccaacgcattcatttcttcctggctctctatctggccaatgacatggaggaggacgacgaggcccccaaacaaaacatcttctacttcctgtacgaggagacccgctctcatatacccttgctcagtgagctttggttccagttatgccgttacatgaacccgagggccaggaagaactgctctcagatagccttgttccggaagtatcggttccacttcttttgttccatgcgctgcagggcttgggtttccctggaggagttggaagagatccaggcttatgacccagagcactgggtgtgggcgcgagatcgcgcccacctttcctagagctccagggaccgtggaggcctgaggtcatcggcctgagagaagaacaccggacccaggggagatgtggattttcagcaggaactttattccaatgctaatggcagacatcaggaaggaggagaggaaccattggtgcagatcatctagaagaacctggaccattcttgacagagctgaatacagtgatcacgttgtcctccaaggagcaggggtggggtggggtacttctaggagtccttggagaaaagtaagaaaccaggagtgtttccagttccaccctttcctgcggcaccacctccctttttatattgctgaatgccaacctccctggggcggaacctggaggtcctgtttcttatggacttggttgccacagtccaggagcatttgaaggcacagtgcaggggctcagattggcacagaattctttgtgaaatatgagtgccacagactgtaacagatagcttcatgcacactatgcattttattggtttgtttggaaaatgttggccattgaattattaataggtttatttcaaatagtttggaaattgttgtacttttgaaaacatgctgttcctgtagagttttttgatgagagttatagttgttatatatacctaaagataattttcttttcatttttaagtgagaattctttttatcctaaatcttttattatctttaaatttttttctgtattattatatgtgctcctgaagcgagcactctttttatctatgatacttccataataatctcttctatttatagctattggtagttccccaccagaaaaaaacataattctggtgatagaaatttttatttgctgtttaggtttgtgactgacttgtgagaattcagttgtgatttttaacatgtctcagatatatatactaacacgtctaatatatactatctattttattggtttattttgaaaaacatgggtatagaattatttaaatattattttatttactgaaatatttattaaatatatttatttatttaaatattattattactttaaatattattttaaatattttggaaatactggtatttttgaatagatgctgtttctataaagctgtgtgatgggtattataactgttgtatacacatacatataattttgttttcctttttaagagaggattcttttcatcctaaatcttttacctttcaatctttgtatctattattacacgtgctgctgaagggagcatggtttttatctatgatacttagttaacatatatattacatttatagctatgtggtagttcccctaaattcttgtaaaaataaatttttatttgatatttagtgtatgtttgaaatgtgagaattcagatggaattttttatcttgttttggcatgtttgtatgttactttaaagaggatgtgtgttctaaaggaggacatgagctgtgtgttttcaagagaacagtgcagtgcatctcttggggaaacataataaagatgaacttttctcacct

SEQ ID NO: 61958 - DNA, 3518 bp, Homo sapiens
ctcaagcaatcctcctgccacctcagtctctcaagttgttggaacacaggtgccagccacgacacctggctaattttgttttgttttgttttgttttgttttagagatgggctcttgctatgttgcctatactggtcttgaactgctggcctcaggcagtcttcctcccttggccacccaaagagatgggattacaagcatgagccactgtgcacagctgagatttttcgacttagtctttttgtacacccagtatcttatagaatatccataatatagattcataaataaaccatttccttcaatggtataaataaataaaccactgctataaatggtggaattttctgagttaagagcaatacatatgatacaaaacttgatatatagagtttcttagccaaactggaggggctggctttaggtgatccgtggactccctgaaattggggacaccattggaaatatgtgtgaactcatgggcagtttcctatgatttccagtcctcaaaatatctcttggactcaaagatgccttagggcagaggacgcgtgtacccccagtacagaatctcggacagtgaatgtcagtagacactcggcagaaaacctctgccaaattgagtgctctgatgtgactttttcatcaagtcaatgttcctgggatctcttgtacatgataatctcactcttgtaaggtttcatcgtttctgcttaccctacttttctttcccatcctgatccctctcccaccagactggactctgaaacgggcatgtacagagaagaggagaccccaacacgcttcaagctttgagtggagaggacacagcctctgctgggacagggaacagagggatgcggagaccctgaagatgcttttggacagtggtctgaggttgggacagtggcaggagataccattcacccaggatctccaggacaagagatcagcctggcagttacatgtgttttttttcaaactggttgccaggttggcatgagcgatgacatcagagattccgaccttcctgattggagggaccggactctgtcggcacctgggagttcagttggacaacagtaacttctcagagctgttctccactcctgacttctcccagcctcgagaattgataacacactcttctggatcccagcagtgtccagaagaagaccaaggacagaacagagactaggtttggtgagatgggacagattttgggaaagatcatgatgagccatcaaccgcagccccaggaagagcggagcccccagcagagcacctcagggtaccccctccaggaggtggtggatgatgaagtgtcgggaccatcagcccctggggtagatcccagccccccacgtaggtcccttggctggaaaaggaagagggaatgtttggatgaatctgatgatgagccagagaaggagctcgcccctgagcctgaggagacctgggtggcggagacgctgtgtggcctcaagatgaaggcgaagcgacggcgagtgtcgctcgtgctccctgagtactacgaggccttcaacaggctgcttgaggatcctgtcattaaaagactcctggcctgggacaaagatctgagggtgtcggacaagtatctcctggctatggtcatagcgtatttcagccgggccggcctcccctcctggcaataccaacgcattcatttcttcctggctctctatctggccaatgacatggaggaggacgacgaggcccccaaacaaaacatcttctacttcctgtacgaggagacccgctctcatatacccttgctcagtgagctttggttccagttatgccgttacatgaacccgagggccaggaagaactgctctcagatagccttgttccggaagtatcggttccacttcttttgttccatgcgctgcagggcttgggtttccctggaggagttggaagagatccaggcttatgacccagagcactgggtgtgggcgcgagatcgcgcccacctttcctagagctccagggaccgtggaggcctgaggtcatcggcctgagagaagaacaccggacccaggggagatgtggattttcagcaggaactttattccaatgctaatggcagacatcaggaaggaggagaggaaccatttgtgcagatcatctagaagaacctggaccattcttgacagagctgaatacagtgatcacgttgtcctccaaggagcaggggtggggtggggtacttctaggagtccttggagaaaagtaagaaaccaggagtgtttccagttccaccctttcctgcggcaccacctccctttttatattgctgaatgccaacctccctggggcggaacctggaggtcctgtttcttatggacttggttgccacagtccaggagcatttgaaggcacagtgcaggggctcagattggcacagaattctttgtgaaatatgagtgccacagactgtaacagatagcttcatgcacactatgcattttattggtttgtttggaaaatgttggccattgaattattaataggtttatttcaaatagtttggaaattgttgtacttttgaaaacatgctgttcctgtagagttttttgatgagagttatagttgttatatatacctaaagataattttcttttcatttttaagtgagaattctttttatcctaaatcttttattatctttaaatttttttctgtattattatatgtgctcctgaagcgagcactctttttatctatgatacttccataataatctcttctatttatagctattggtagttccccaccagaaaaaaacataattctggtgatagaaatttttatttgctgtttaggtttgtgactgacttgtgagaattcagttgtgatttttaacatgtctcagatatatatactaacacgtctaatatatactatctattttattggtttattttgaaaaacatgggtatagaattatttaaatattattttatttactgaaatatttattaaatatatttatttatttaaatattattattactttaaatattattttaaatattttggaaatactggtatttttgaatagatgctgtttctataaagctgtgtgatgggtattataactgttgtatacacatacatataattttgttttcctttttaagagaggattcttttcatcctaaatcttttacctttcaatctttgtatctattattacacgtgctgctgaagggagcatggtttttatctatgatacttagttaacatatatattacatttatagctatgtggtagttcccctaaattcttgtaaaaataaatttttatttgatatttagtgtatgtttgaaatgtgagaattcagatggaattttttatcttgttttggcatgtttgtatgttactttaaagaggatgtgtgttctaaaggaggacatgagctgtgtgttttcaagagaacagtgcagtgcatctcttggggaaacataataaagatgaacttttctcacct

SEQ ID NO: 61959 - DNA, 5372 bp, Homo sapiens
ctcaagcaatcctcctgccacctcagtctctcaagttgttggaacacaggtgccagccacgacacctggctaattttgttttgttttgttttgttttgttttagagatgggctcttgctatgttgcctatactggtcttgaactgctggcctcaggcagtcttcctcccttggccacccaaagagatgggattacaagcatgagccactgtgcacagctgagatttttcgacttagtctttttgtacacccagtatcttatagaatatccataatatagattcataaataaaccatttccttcaatggtataaataaataaaccactgctataaatggtggaattttctgagttaagagcaatacatatgatacaaaacttgatatatagagtttcttagccaaactggaggggctggctttaggtgatccgtggactccctgaaattggggacaccattggaaatatgtgtgaactcatgggcagtttcctatgatttccagtcctcaaaatatctcttggactcaaagatgccttagggcagaggacgcgtgtacccccagtacagaatctcggacagtgaatgtcagtagacactcggcagaaaacctctgccaaattgagtgctctgatgtgactttttcatcaagtcaatgttcctgggatctcttgtacatgataatctcactcttgtaaggtttcatcgtttctgcttaccctacttttctttcccatcctgatccctctcccaccagactggactctgaaacgggcatgtacagagaagaggagaccccaacacgcttcaagctttgagtggagaggacacagcctctgctgggacagggaacagagggatgcggagaccctgaagatgcttttggacagtggtctgaggttgggacagtggcaggagataccattcacccaggatctccaggacaagagatcagcctggcagttacatgtgttttttttcaaactggttgccaggttggcatgagcgatgacatcagagattccgaccttcctgattggagggaccggactctgtcggcacctgggagttcagttggacaacagtaacttctcagagctgttctccactcctgacttctcccagcctcgagaattgataacacactcttctggatcccagcagtgtccagaagaagaccaaggacagaacagagactaggtttggtgagatgggacagattttgggaaagatcatgatgagccatcaaccgcagccccaggaagagcggagcccccagcagagcacctcagggtaccccctccaggaggtggtggatgatgaagtgtcgggaccatcaggtgaggggactggaggaagaagaggtggcataggattgactaagatgaaggaagggggccaggcgtggtggctcacccctgtaaccccaacactttgggaggctgaggcgggcagatcacctgaggtcaggagttcaagaccagcctggccaacatggtgaaaccccatctctactaaaagtacaaaaattagccaggcggtagtggtgtgtgcctataatcccagctacttgggaggctaagacaggagaatcacttgagcctgggaggaagaggttgcagtgagccgagatcgtgctactgcactccagtctgggtgacagagtgagatgctatctcaaaaaaaaaaaaaaaaaaaaaaaaaaaaaaaaaaaagaagaaaaaaaagaagggtcagaggtcaggaaggagaacctggggagggtgtgtgggaagaatggagaaattcaggctgggtgcagtggctcacacttgtaatcccagcactttgggaagccaaggcaggcggatcacttgaggccaggagtttgagaccagcctggccaacatggtgaaaccctgtctctattaaaagtacaaaatggagctgggcattatggcaggcacctgtaatcccagctacctgagaggctgaggcaggagaataactggaatccgggagatgcatgttgcagtgagctgagattgcaccactacactccagcctgggtgacaaagcaagattctgtctcgaaacaaaaaaaaaaaaaaaaaagagggactcagagagccagggaccagggaaggatatgaggcagtgttctgaggacagagagagggaagaatggggaggggaaggagtggcacatggggttgagcagaggagaaagtcagaaaggtggcttggagaagccagcagtctgcgaggctggggaggatggagagtggtttggggtttggggtcggggtctaacgtgatcagttgcagaagcattacacggtggcctggtttctttactcagcccctggggtagatcccagccccccacgtaggtcccttggctggaaaaggaagagggaatgtttggatgaatctgatgatgagccagagaaggagctcgcccctgagcctgaggagacctgggtggcggagacgctgtgtggcctcaagatgaaggcgaagcgacggcgagtgtcgctcgtgctccctgagtactacgaggccttcaacaggctgcttgaggatcctgtcattaaaagactcctggcctgggacaaagatctgagggtgtcggacaagtatctcctggctatggtcatagcgtatttcagccgggccggcctcccctcctggcaataccaacgcattcatttcttcctggctctctatctggccaatgacatggaggaggacgacgaggcccccaaacaaaacatcttctacttcctgtacgaggagacccgctctcatatacccttgctcagtgagctttggttccagttatgccgttacatgaacccgagggccaggaagaactgctctcagatagccttgttccggaagtatcggttccacttcttttgttccatgcgctgcagggcttgggtttccctggaggagttggaagagatccaggcttatgacccagagcactgggtgtgggcgcgagatcgcgcccacctttcctagagctccagggaccgtggaggcctgaggtcatcggcctgagagaaggtacatctgcatcctccggggtaaaggcagaatattggggtctatttcggaaatccaaggaacccaattgcttgatctggcttcaagcctgggcaacgtggcgagatcccctctccacaaaaatacaaaaattagccaggcgatgtgggaggcatctctactcccaactactcaggaggctgaggcgggaggatcgctggagcctgggaggtcggggctgcagggagccctgatcctgccactgcactccagcccgggcgacagagtgagaccctgcctcaaaaataatcataaatactgagttcggggaggttcattatgattgatgcacttgagttaccgatttgggtcgagggttcagtgaagctttggtttacatcttgtgcagctaaccatgttgagcacagagcatgagacttcgtcatgaggagggaggattatggattaggcttctggactcatggttcgtgatgctgtcacgttagaaacagatctagcacggttacaagtttagatctgaagtgacacaaaaggccccagctgtgatgaagtccaaagccacattctctgagggtgccctactccctgggaagacccacccaaagtcctggctatgaagcagatcactggggctgaccttgggtgtattaagttttggagtcagggtcaccaaagtgtgagtttcacagttgaacacgatggttcagaagcagggtatagaatgaaaggcaggagataaaattgcacttctcaattgctctgaactctagctagacttgacatgggacgtgaataaccttcctgtctagagagctgcctccttgaagtgtgacattgtctctctcacttccagaacaccggacccaggggagatgtggattttcagcaggaactttattccaatgctaatggcagacatcaggaaggaggagaggaaccatttgtgcagatcatctagaagaacctggaccattcttgacagagctgaatacagtgatcacgttgtcctccaaggagcaggggtggggtggggtacttctaggagtccttggagaaaagtaagaaaccaggagtgtttccagttccaccctttcctgcggcaccacctccctttttatattgctgaatgccaacctccctggggcggaacctggaggtcctgtttcttatggacttggttgccacagtccaggagcatttgaaggcacagtgcaggggctcagattggcacagaattctttgtgaaatatgagtgccacagactgtaacagatagcttcatgcacactatgcattttattggtttgtttggaaaatgttggccattgaattattaataggtttatttcaaatagtttggaaattgttgtacttttgaaaacatgctgttcctgtagagttttttgatgagagttatagttgttatatatacctaaagataattttcttttcatttttaagtgagaattctttttatcctaaatcttttattatctttaaatttttttctgtattattatatgtgctcctgaagcgagcactctttttatctatgatacttccataataatctcttctatttatagctattggtagttccccaccagaaaaaaacataattctggtgatagaaatttttatttgctgtttaggtttgtgactgacttgtgagaattcagttgtgatttttaacatgtctcagatatatatactaacacgtctaatatatactatctattttattggtttattttgaaaaacatgggtatagaattatttaaatattattttatttactgaaatatttattaaatatatttatttatttaaatattattattactttaaatattattttaaatattttggaaatactggtatttttgaatagatgctgtttctataaagctgtgtgatgggtattataactgttgtatacacatacatataattttgttttcctttttaagagaggattcttttcatcctaaatcttttacctttcaatctttgtatctattattacacgtgctgctgaagggagcatggtttttatctatgatacttagttaacatatatattacatttatagctatgtggtagttcccctaaattcttgtaaaaataaatttttatttgatatttagtgtatgtttgaaatgtgagaattcagatggaattttttatcttgttttggcatgtttgtatgttactttaaagaggatgtgtgttctaaaggaggacatgagctgtgtgttttcaagagaacagtgcagtgcatctcttggggaaacataataaagatgaacttttctcacct

SEQ ID NO: 61960 - DNA, 2499 bp, Homo sapiens
tgttttgttttgttttagcaagactctgtctcaaaataaattaataaataaataaaaataaaaatcaaataaagaaaaacaaaatcaaaaatcaaaaaagtggtttcagctgtgccctctgaaacttaatgtttcttactgacttttctaaacctaagtgtctccatccatagtgagggatcccaaggccatggtcacaccctgatgtgtgactgtctcatgaggaaatgatgggaattcctttatgactctgcagtggtccctctgtgtctgctggagggggtcctggctgattcccagctctacatcctgtagattctcacacccagggcctccttcggcctcttctcaggggagtctcagagcaggagcctctctcccttgcccagtgaaagtcattctcccctctctcatccacctcacccgcggccacaatcctgagactttcccccgggaggcacacttctcctcgctgccctgctgctctcacggaaaccctgtcctgcttctcacactgacatctgctctctaatcacagaggatcctgtcattaaaagactcctggcctgggacaaagatctgagggtgtcggacaagtatctcctggctatggtcatagcgtatttcagccgggccggcctcccctcctggcaataccaacgcattcatttcttcctggctctctatctggccaatgacatggaggaggacgacgaggcccccaaacaaaacatcttctacttcctgtacgaggagacccgctctcatatacccttgctcagtgagctttggttccagttatgccgttacatgaacccgagggccaggaagaactgctctcagatagccttgttccggaagtatcggttccacttcttttgttccatgcgctgcagggcttgggtttccctggaggagttggaagagatccaggcttatgacccagagcactgggtgtgggcgcgagatcgcgcccacctttcctagagctccagggaccgtggaggcctgaggtcatcggcctgagagaagaacaccggacccaggggagatgtggattttcagcaggaactttattccaatgctaatggcagacatcaggaaggaggagaggaaccatttgtgcagatcatctagaagaacctggaccattcttgacagagctgaatacagtgatcacgttgtcctccaaggagcaggggtggggtggggtacttctaggagtccttggagaaaagtaagaaaccaggagtgtttccagttccaccctttcctgcggcaccacctccctttttatattgctgaatgccaacctccctggggcggaacctggaggtcctgtttcttatggacttggttgccacagtccaggagcatttgaaggcacagtgcaggggctcagattggcacagaattctttgtgaaatatgagtgccacagactgtaacagatagcttcatgcacactatgcattttattggtttgtttggaaaatgttggccattgaattattaataggtttatttcaaatagtttggaaattgttgtacttttgaaaacatgctgttcctgtagagttttttgatgagagttatagttgttatatatacctaaagataattttcttttcatttttaagtgagaattctttttatcctaaatcttttattatctttaaatttttttctgtattattatatgtgctcctgaagcgagcactctttttatctatgatacttccataataatctcttctatttatagctattggtagttccccaccagaaaaaaacataattctggtgatagaaatttttatttgctgtttaggtttgtgactgacttgtgagaattcagttgtgatttttaacatgtctcagatatatatactaacacgtctaatatatactatctattttattggtttattttgaaaaacatgggtatagaattatttaaatattattttatttactgaaatatttattaaatatatttatttatttaaatattattattactttaaatattattttaaatattttggaaatactggtatttttgaatagatgctgtttctataaagctgtgtgatgggtattataactgttgtatacacatacatataattttgttttcctttttaagagaggattcttttcatcctaaatcttttacctttcaatctttgtatctattattacacgtgctgctgaagggagcatggtttttatctatgatacttagttaacatatatattacatttatagctatgtggtagttcccctaaattcttgtaaaaataaatttttatttgatatttagtgtatgtttgaaatgtgagaattcagatggaattttttatcttgttttggcatgtttgtatgttactttaaagaggatgtgtgttctaaaggaggacatgagctgtgtgttttcaagagaacagtgcagtgcatctcttggggaaacataataaagatgaacttttctcacct

SEQ ID NO: 61961 - DNA, 2515 bp, Homo sapiens
agctctgactacagggctgtaccaccacacctggacagttatttatttatttatttatttatcaagacaagagtgttgctgtgtctctcaggctggaatggaggggcccaatcttggctcactgcaacctccgcctcctgggttcacacaattcttatgcttcagcctcctgagtagctaggactaatgggtgtgccaccgcaccaggctgatttttgtatttttagtatagatggggtttctctgtgttgaccaggctggtctcaaactcctggtctcaagcaatccacctgcttcagccttccaaagcgctgggattacaggcatgagccaccacgtctggcgtattttttatatttttaatagagacgagggtcttgctatgttgcccaggcctgtctcaaactcctggcctcaagtgatcctcctgcttcggcctcccagtgtgctgggattccaggcataagccaccactcttggtcaccagttgggtttttgtctccatcctgaaggagtgggagacgcccttgatcaggtctctgtccagcagagccctcctgaggaaggcgtggctctctgcagggtgggtgccagtcctgagctagggacggtcccttaccttcctctctgagaagctgacctcagccggaggtctctcctggtggtgcccctgagcagcaacctgatttctgtcctcagctatctggccaatgacatggaggaggacgacgaggcccccaaacaaaacatcttctacttcctgtacgaggagacccgctctcatatacccttgctcagtgagctttggttccagttatgccgttacatgaacccgagggccaggaagaactgctctcagatagccttgttccggaagtatcggttccacttcttttgttccatgcgctgcagggcttgggtttccctggaggagttggaagagatccaggcttatgacccagagcactgggtgtgggcgcgagatcgcgcccacctttcctagagctccagggaccgtggaggcctgaggtcatcggcctgagagaagaacaccggacccaggggagatgtggattttcagcaggaactttattccaatgctaatggcagacatcaggaaggaggagaggaaccatttgtgcagatcatctagaagaacctggaccattcttgacagagctgaatacagtgatcacgttgtcctccaaggagcaggggtggggtggggtacttctaggagtccttggagaaaagtaagaaaccaggagtgtttccagttccaccctttcctgcggcaccacctccctttttatattgctgaatgccaacctccctggggcggaacctggaggtcctgtttcttatggacttggttgccacagtccaggagcatttgaaggcacagtgcaggggctcagattggcacagaattctttgtgaaatatgagtgccacagactgtaacagatagcttcatgcacactatgcattttattggtttgtttggaaaatgttggccattgaattattaataggtttatttcaaatagtttggaaattgttgtacttttgaaaacatgctgttcctgtagagttttttgatgagagttatagttgttatatatacctaaagataattttcttttcatttttaagtgagaattctttttatcctaaatcttttattatctttaaatttttttctgtattattatatgtgctcctgaagcgagcactctttttatctatgatacttccataataatctcttctatttatagctattggtagttccccaccagaaaaaaacataattctggtgatagaaatttttatttgctgtttaggtttgtgactgacttgtgagaattcagttgtgatttttaacatgtctcagatatatatactaacacgtctaatatatactatctattttattggtttattttgaaaaacatgggtatagaattatttaaatattattttatttactgaaatatttattaaatatatttatttatttaaatattattattactttaaatattattttaaatattttggaaatactggtatttttgaatagatgctgtttctataaagctgtgtgatgggtattataactgttgtatacacatacatataattttgttttcctttttaagagaggattcttttcatcctaaatcttttacctttcaatctttgtatctattattacacgtgctgctgaagggagcatggtttttatctatgatacttagttaacatatatattacatttatagctatgtggtagttcccctaaattcttgtaaaaataaatttttatttgatatttagtgtatgtttgaaatgtgagaattcagatggaattttttatcttgttttggcatgtttgtatgttactttaaagaggatgtgtgttctaaaggaggacatgagctgtgtgttttcaagagaacagtgcagtgcatctcttggggaaacataataaagatgaacttttctcacct

SEQ ID NO: 61962 - DNA, 4405 bp, Homo sapiens; identical to SEQ ID NO: 61927

SEQ ID NO: 61963 - DNA, 1626 bp, Homo sapiens
atggacttcctgtgggacaagcgcacgggcctggccgccagaaagatgcctcatcctcgaaggtaccattcctcagagcgaggcagccgggggagttactgtgaacactatcggagccgaaaacaagcaacgaagaagccgttcctggtcaagaggtgcagccggacatttagccgctcgtcttcgcagcacagcagccggaaagccaagagtgtagaggacgacactgagggccacctcatctaccatgtcggggactggctacaagagcgatatgaaatcgtcagcaccttaggaaaggggaccttcggccgagttgtacaatgtgttgaccatcgcaggcgtggggctcgagttgccctgaagatcattaagaatgtggagaagtataaggaagcagctcgacttgagatcaaagtgctggagaaaatcaacgagaaagaccctggcaagaacctctgtgtccagatgtttgactggttcgactaccatggccacatgtgtatctccttggagcttctgggccttagcaccttcgatttcctcaaagacaacaaccacctgccctaccccatccaccaagtgcaccacatggcctcccagctgtgccaggctgtcaagttcctccatgataacaagctgacacatacagacctcaagcctgaaaatattctgtttgtgaattcagactatgagctcacctacaacctagagaagaagcgacatgagcgcagtgtgaagagcacagctgtgcgggtgggagactttggcagtgccacctttgaccatgagcaccatagcaccattgtctccactcgccattaccgagcaccagaagtcatccttgagttgggttggtcacagccttgtgatgtgtggagtataggctgcatcatctttgagtactatgtgggcttcaccctcttccagacccatgacaacagacagcatctagccacgatggaaaggatcttgggtcctatcccttcccggatgatccgaaagacaagaaaacagaaatatttttaccggggtcgcctggattgggatgagaacacatcagctggacgctatgttcgtgagaactgcaaaccgctgcggcagtatctgacctcagaggcagaggaagaccaccagctcttcgatctgattgaaagcatgctagagtatgaaccagctcagcggctgaccttgggtgaagcccttcagcatcctttcttctcccgcctttgggctgagccacccaacaagttgtgggactccagtcaggatatcagtccgtgaccaccaggccctgggcctccctgcatcttttatagcagtgagtgtccagtccaggacattggtgcttttttataaaagagaacagagccagagttcactccttcctgctgcttctctatatacctgtgaatatgtgaaacagtaaatatgaaagaacttgtacctatcacttcaacccctgcgttgtacataatgctattccatccacacactttccaccctcacctgccccctcatacagagttggatgggggccgagtgaggtaaccaggtggcatctaccccatgttttataaggaattttgtacagtctttgtgaaatgaaataacatgcttcatttg

SEQ ID NO: 61964 - DNA, 2556 bp, Homo sapiens
ctcttcactctgaaagcagagaaacacattttcaatatattttccattacggctccttctagaacactgtgttgtttctcctagtaaaggggctattccttgaaaaataactctaggtttagctgattttattgtttttattaataattgacgatgcctctaagaaaaaggaaatccccagagaggactgcatcttcaaaatcccccgaaatctctaggtcccatgtaaacagtataaaggaaagaacgtcatcagttggtttgcctagtgttattccaaactctacacgccgtgtgagctttgcacctaacctgccttctatgaaaacatctcaggatattggagactctaggatctctctaaagactcttttgaatgctattaaaaccatggagggaagactggaaggcaaaatagagattctagcctcaagacctttaataaatgatgaatcaccaaattttcttaaacaggactcggtgaaatctattcttgaaagaagtaaagaggagctgtcccgaacagtgaagtgtcgtaatgcggccctgaaagagagtcagaagttgaaagaagacctcgaggctgtggaggacagggaaaacaagaaggtgggaaactttcagcgacaattggcagaagctaaagaagacaactgcaaagtcacaatcatgttggagaatgtgctggcttctcacagtaagatgcaaggtgctctggagaaagtacaaatagagcttgggcggagggattcagagattgcaggcctcaagaaagaaagggatctcaatcaacagagggtgcagaagctggaagctgaagtggaccagtggcaggccaggatgcttgtcatggaggaccagcacaacagtgagattgaatctctacaaaaagctctaggtgtagctagagaagacaacaggaaacttgctatgagtctggaacaagctctccagacaaataatcatctgcaaacaaagctagatcacattcaagagcaattggaaagcaaagaacttgagcgacagaatttggaaaccttcaaagaccggatgactgaagagtccaaagtggaagcagaattgcatgctgaacgcatagaagctctaagaaagcagtttcaaaccgagagagaaactacaaagaaagtggcacaacgggaagtggctgagctgaagaaagcccttgatgaagctaacttcagatcagtggaagtgtcccggaccaaccgagagctgcgacagaaacttgcagagctagaaaaaatactagaaagtaacaaggagaaaataaagaatcaaaagacccaaattaagctccacttgtcagctaaggcgaataatgctcagaatatagaaaggatgaaggttgtatgggaaacctcttctcacttcctggataccctgtgaggatgtagtcagtcaatggtgtctagggaagacaggttttagaaccctaccagccccatgtattctctgggaattatagccagttgtctttggggagactttttcagtggagtcactgctgtgtaaatgtttgatttctcatttgctgccagtgtcacattccggctccctatctgtcccttccgtgttgattgtactggactttgctcttttgggatcagtgggctagatgggaaagaaagctcagcaggaactggtaactttgggtctcatattggattctttctgtcatcctataggcaaaaagagcaagccagtttttccactgatcatctttttatgttattttccaattacttttagcaaatagaaaaagaattgaagcaaatggagctaattaaggatcaatatcagaaaaagaactatgaacagtctttgagtatccagagatttgtgtgtgaaatgactaacctgcagaaagagatgcagatgttggctaagagccaatatgatgcctcagtgcggaataaacagcaagagctgcacctagaagcagagcggaaaataaggcaggagctagagaatcggtgccaggaattggaagaaactgtcagacacctgaagaaatgtaaagaggcaacagagaatacgctgaaagaagccagtgtggaatcagaacagataacagctaatctggaagaagctcatcgctggtttaagcacaggtttgatggtctacaacttgagctgacaaaaaaccggttgcagaggccttctggggaagacaggtggcaggaaaaggaccaagatgtaaaacatgatgtcatgtccaaccaatctgttctgcatcgatgggagagaaaacagaatcttaggcccatgcccaagaagtatcattctgaggtacagaggaagtgatgtccttgacaagggagcttctttatgtgtagctacactccatgattccaagagcccagcagccggggctggcctgtttctagagtcataagaacatgaagtctttgatgtgggctgaagattttggacctgagtttatcactttatgaactcttatatcagtacaaaactacccctttttttgtcccttttcacattttccacccaataaatttgtgttaatttgttgta

SEQ ID NO: 61965 - DNA, 1133 bp, Homo sapiens
atgcactgtggaaaacggcagggacctctgccctggaaagccgggactgctctacactgggtctgtgccaatggccatgcagaagtagtaacacctctggtagatagaaagtgccagcttgacatccttgatggtgaaaacaggacacctctgatgaaggctgcgcaatgccagagggaggtttgtgcaaatattctcatagattctggtgctgatccaaatattgtagatgtgtatggcaacacagctgtccattatgctctttatggtgagaatttgtcagtggtggcaaaattgctgtcctgtggtgcagacatcgaagtgaagaacaaggctggccacacaccacttttactggccataaggaaaagaagtgagcaaattgtggaatttttactgacaaaaaatacaaatgcaaatgcagttgataagtttaaatgcattcatcaacaacttttggaatacaaacaaaagatatctaaaaattctcaaaatagcaatccagaaggaacatctgaaggaacacctgacgaggctgcacccttggtggaaagaacacctgacatggctgaaagcttggtggaaagaacacctgacgaataggatacagtgaattcctcttcaaagattttagcctgtaaaaattctttaaaattcaagagggggttaagtacagtgagttctgagttcctcatcaaagaacaaatatgtcagtatgtccagcttctctgttctttgttctccattttaaagtttaacttcctcgttcattatgcctccttgcccctagtttcattaaacaaccccctcctagcctctaacacctgctttgtctttagtcattcttagtcacctgctctgtccttagtcatccttagacacctgctctgtaactgtctttcccgctgaaactactcaccctgccactccagctcatacccctgctctctttgaaatagccaatctgaattagcttagagtgtgcagtccaaccctatccaatagggaaaagacacaacagtagggactagctgcgttaggaataagaacactttccctcccttgtccggtgttatcttgccattactccatctgcaagaccactcttccatagaagtaaatttgccttgctg

SEQ ID NO: 61966 - DNA, 4080 bp, Homo sapiens
atgcccagagctcagttgcttgaaagcaacgcgcctattcacatggagaatcttccctttcctttaaaattacttagtgcctcatcgctaaacgcccccagttccacaccatgggtgttggatatcttcctcactttggtgtttgccctggggttcttcttcctattactcccctacttatcttacttccgttgtgatgacccaccctcaccatcgcctgggaagagaaaggagaactgggcaatcagggtgtggggtggtggaggggctgtggcccgagcacccactctgccctccggccccaccggctcctggctgcagctcgtgcctcctgtctcctgcagcctcctggggccacaccttgacaaaggtgactttggtcagctctccggtccagaccccccaggtgaagtgggcgaaagagcacctgatggagcctcccagtcctctcatgagcctatggaagatgctgctcccattctctccccgttagcttccccagatcctcaagccaagcatcctcaggatctggcctccaccccatcaccaggcccaatgaccacctcagtctcctccctaagtgcctcccagccaccagaaccttcccttcccctagaacacccctcacccgagccacctgcacttttccctcacccaccacacacccctgatcctctggcctgctctccgcctcctccaaaaggcttcactgctcctcccctgcgggactccacactgataactccatctcactgtgactcagtggcacttccactgggcaccgtccctcaaagcttgtctccacatgaggatttggtggcttctgtcccagccatctcaggccttggtggctcaaacagtcatgtttctgcctcctcccggtggcaggagactgccagaacctcgtgcgcctttaactcatcagtccagcaagatcatctttcccgccacccaccagagacctaccagatggaagctggtagcctgtttttgctcagctctgatggccagaatgccgtggggatacaagtcacagaaacagccaaggtcaacatttgggaagaaaaagaaaatgttggatcatttacagatcgaatgaccccagaaaagcacttaaattctttgcggaatttggctaaatcattggatgctgagcaggacaccacaaacccaaaacccttctggaacatgggagagaactcgaaacagctgcccggacctcagaagttctcagatcctaggctctggcaggaaagtttttggaagaattatagccagcttttctggggcctcccctctctgcacagcgagtccctggtggctaacgcctgggtaactgacaggtcttatactttacagtctcctcctttcttgttcaatgaaatgtccaatgtctgcccaattcaaagggagactacaatgtccccactgcttttccaggcccagcccccgtcccatctggggcccgagtgccaaccctttatttcatccacaccccaattccggcccacacctatggctcaggccgaggctcaggcccatcttcaatcttctttcccagtcctatctcctgcttttccatccctgattaagaacactggagtagcttgccctgcatcgcagaataaagtgcaagctctctccctacctgaaactcagcaccctgaatggcctttgttgaggagacaactagaaggtaggttggctttaccctctagggtccaaaaatctcaggacgtctttagtgtctccactcctaaccttccccaggaaagtttgacatccattctgcctgagaactttccagtcagtcctgaactccggagacaactggagcaacacataaaaaagtggatcatccaacactggggcaacctgggaaggatccaagagtctctggatctgatgcagcttcgggacgaatcaccagggacaagtcaggccaagggcaaacccagtccctggcagtcctccatgtccacaggtgaaagcagcaaggaggcacagaaggtgaagttccagctagagagggacccgtgcccacatctggggcaaattctgggtgagaccccacaaaatctatccagggacatgaaaagcttcccacggaaggttctgggggtgacttctgaggagtcggaaaggaacttgaggaagcccttgaggagtgactcgggaagtgatttattaagatgcacagagaggactcatatagaaaacatcctgaaagcccacatgggcaggaacttgggccagaccaacgagggcttgatccccgtgcgtgtgcgtcgatcctggcttgctgtcaaccaggctcttcccgtgtccaacacccatgtgaaaaccagcaatctagcagccccgaaaagtgggaaagcctgtgtgaacacagcccaggtgctttccttcctcgagccgtgtactcagcaggggttgggagcccatattgtgaggttttgggccaaacacaggtggggtctacccctcagggtcctcaagcccattcagtgctttaaactggaaaaggtttcatccttgtcccttacacagcttgctggtccctcctcagccacctgtgaatctggggctggctcagaagttgaggtggacatgttccttagaaagccaccaatggcaagtctgagaaagcaggtgctgaccaaagcatctgatcacatgccagagagtcttctggcctcctcacctgcatggaagcagttccagagggcaccgcgaggaatcccatcttggaatgatcatgggcccttgaagcctcctccagctggacaggagggcaggtggccatctaagcccctcacgtacagcctcacaggcagcacccagcagagcaggagcttaggagcccaatcttcaaaggctggagagacaagggaggcagtgccacaatgcagagtccccttggaaacctgtatgctggcaaacctccaagccacaagtgaggatatgcatggtttcgaggctccagggaccagcaaaagctctctacaccctagagtgtctgtctcccaagatccaagaaagctgtgtcttatggaggaggttgttaatgaatttgagcctggaatggccacaaagtcagagacccagcctcaagtttgtgccgctgttgtgctccttccagatgggcaagcatctgttgtgccccacgcttcagagaatttggtttctcaagtgccccagggccatctccagagcatgcctactgggaacatgcgggcttcccaggagctacatgaccttatggcagccagaaggagcaaactggtgcacgaggagcccagaaacccaaactgtcaaggctcatgcaagagccaaaggccaatgtttccccctattcacaagagtgagaagtctaggaagcccaacttagaaaaacatgaagaaaggcttgaaggattgaggactcctcaacttaccccagtcaggaaaacagaagacacccatcaggatgaaggcgtccagctactgccatcaaagaaacagcctccttcagtaagccactttggaggaaacatcaagcaattttttcagtggattttttcaaagaaaaaaagcaagccagcaccagtcactgctgagagccaaaaaacagtgaaaaacagatcatgtgtgtacagcagcagtgctgaagctcagggtctcatgacggcagttggacaaatgctggacgagaaaatgtcactttgccatgcgcgccatgcctcgaaggtaaatcagcacaaacagaagtttcaagccccagtctgtgggtttccctgcaaccacaggcacctcttctactcagaacacggcagaatactgagctatgcagccagcagtcaacaagccactctcaagagccagggttgtcccaacagagacaggcaaatcagaaatcaacagcccttgaaaagtgtgcggtgcaacaatgagcaatggggcctgcgacatccccaaatcttgcaccccaagaaagctgtatccccagtcagtccccttcagcactggccgaagacatccggtgcctctagccaccatcaccactgtccaaggcactgtcttctttgggaaggtatctga

SEQ ID NO: 61967 - DNA, 629 bp, Homo sapiens
atgtctcaccttttcttcaaactcagtacatctaaacctaagctcatcatttttcctatctgctcccaactcttcactcccctcatcccactctacaccttctcctatattcctggcctgtttctgtcaaaattgccatataagaacccaacacaccttgctcagcagcaggaaccctggagtcggctcaactcaacccccacaattacttccatgaggcaggatgcctactattttgatcccgagataccaaaggatgacctggacttccgcttagcagccttgtacaaccaccacactgggacattcgagaacaaaagtgagatactgttaaaccagaaaaccacgcaggatacctatagaaccaagatccaattccctggagaatttttaacccctcccactccacccatcactttcctggctaacatcagacactggatcaaccctaaaaaggagtccatccacagcatccaaggatccatagtgtcccctcacactgcagccaccaatggaggctactcccgaaagaaagatggtggcttcttctccacctagtgttgacagatccctgaactaattatagtgaaacatactgcggcccacttccattaaatagatttgtgcaa

SEQ ID NO: 61968 - DNA, 3621 bp, Homo sapiens
atggaagatgctgctcccattctctccctgttagcttccccggatcctcaagccaagcatcctcaggatctggcctccaccccatcaccaggcccaatgaccacctcagtctcctccctaagtgcctcccagccaccagaaccttcccttcccctagaacacccctcacccgagccacctgcacttttccctcacccaccacacacccctgatcctctggcctgctctctgcctcctccaaaaggcttcactgctcctcccctgcgggactccacactgataactccatctcactgtgactcagtggcacttccactgggcaccgtccctcaaagcttgtctccacatgaggatttggtggcttctgtcccagccatctcaggccttggtggctcaaacagtcatgtttctgcctcctcccggtggcaggagactgccagaacctcgtgcgcctttaactcatcagtccagcaagatcatctttcccgccacccaccagagacctgtcagatggaagctggtagcctgtttttgctcagctctgatggccagaatgtcgtggggatacaagtcacagaaacagccaaggtcaacatttgggaagaaaaagaaaatgttggatcatttacaaatcgaatgaccccagaaaagcacttaaattctttgcggaatttggctaaatcattggatgctgagcaggacaccacaaacccaaaacccttctggaacatgggagagaactcgaaacagctgcccggacctcagaagctctcagatcctaggctctggcaggaaagtttttggaagaattatagccagcttttctggggcctcccctctctgcacagcgagtccctggtggctaacgcctgggtaactgacaggtcttatactttacagtctcctcctttcttgttcaatgaaatgtccaatgtctgcccaattcaaagggagactacaatgtccccactgcttttccaggcccagcccctgtcccatctggggcccgagtgccaaccctttatttcatccacaccccaattccggcccacacctatggctcaggccgaggctcaggcccatcttcaatcttctttcccagtcctatctcctgcttttccatccctgattcagaacactggagtagcttgccctgcatcgcagaataaagtgcaagctctctccctacctgaaactcagcaccctgaatggcctttgttgaggagacaactagaaggtaggttggctttaccctctagggtccaaaaatctcaggacgtctttagtgtctccactcctaaccttccccaggaaagtttgacatccattctgcctgagaactttccagtcagtcctgaactccggagacaactggagcaacacataaaaaagtggatcatccaacactggggcaacctgggaaggatccaagagtctctggatctgatgcagcttcaggacgaatcaccagggacaagtcaggccaagggcaaacccagtccctggcagtcctccatgtccacaggtgaaagcagcaaggaggcacagaaggtgaagttccagctagagagggacccgtgcccacatctggggcaaattctgggtgagaccccacaaaatctatccagggatatgaaaagcttcccacggaaggttctgggggtgacttctgaggagttggaaaggaacttgaggaagcccttgaggagtgactcgggaagtgatttattaagatgcacagagaggactcatatagaaaacatcctgaaagcccacatgggcaggaacttgggccagaccaacgagggcttgatccccgtgcgtgtgcgtcgatcctggcttgctgtcaaccaggctcttcccgtgtccaacacccatgtgaaaaccagcaatctagcagccccgaaaagtgggaaagcctgtgtgaacacagcccaggtgctttccttcctcgagccgtgtactcagcaggggttgggagcccatattgtgaggttttgggccaaacacaggtggggtctacccctcagggtcctcaagcccattcagtgctttaaactggaaaaggtttcatccttgtcccttacacagcttgctggtccctcctcagccacctgtgaatctggggctggctcagaagttgaggtggacatgttccttagaaagccaccaatggcaagtctgagaaagcaggtgctgaccaaagcatctgatcacatgccagagagtcttctggcctcctcacctgcatggaagcagttccagagggcaccgcgaggaatcccatcttggaatgatcatgaacccttgaagcctcctccagctggacaggagggcaggtggccatctaagcccctcacgtacagcctcacaggcagcacccagcagagcaggagcttaggagcccaatcttcaaaggctggagagacaagggaggcagtgccacaatgcagagtccccttggaaacctgtatgctggcaaacctccaagccacaagtgaggatgtgcatggtttcgaggctccagggaccagcaaaagctctctacaccctagagtgtctgtctcccaagatccaagaaagctgtgtcttatggaggaggttgttagtgaatttgagcctggaatggccacaaagtcagagacccagcctcaagtttgtgccgctgttgtgctccttccagatgggcaagcatctgttgtgccccacgcttcagagaatttggtttctcaagtgccccagggccatctccagagcatgcctactgggaacatgcgggcttcccaggagctacatgacctcatggcagccagaaggagcaaactggtgcacgaggagcccagaaaaccaaactgtcaaggctcatgcaagagccaaaggccaatgtttccccctattcacaagagtgagaagtttaggaagcccaacttagaaaaacatgaagaaaggcttgaaggattgaggactcctcaacttaccccagtcaggaaaacagaagacacccatcaggatgaaggcgtccagctactgccatcaaagaaacagcctccttcagtaagcccctttggagaaaacatcaagcaaatttttcagtggattttttcaaagaaaaaaagcaagccagcaccagtcactgctgagagccaaaaaacagtaaaaaacagatcatgtgtgtacagcagcagtgctgaagctcagggtctcatgacggcagttggacaaatgctggacgagaaaatgtcactttgccatgcgcgccatgcctcgaaggtaaatcagcacaaacagaagtttcaagccccagtctgtgggtttccctgcaaccacaggcacctcttctactcagaacacggcagaatactgagctatgcagccagcagtcaacaagccactctcaagagccagggttgtcccaacagagacagacaaatcagaaatcaacagcccttgaaaagtgtgcggtgcaacaatgagcaatggggcctgcgacatccccaaatcttgcaccccaagaaagctgtatccccagtcagtccccctcagcactggccgaagacatccggtgcctctagccaccatcaccactgtccaaggcactgtcttctttgggaaggtatctga

SEQ ID NO: 61969 - DNA, 441 bp, Homo sapiens
atgcaaattatgcttagtcctgaagaccagggaccactggacattgagtggctgatatcaccagctgataatcagaagatggatcaagtgatgattttatattctggaaacaaaatttatgatgattactatccagaactgaaaggccgagtacattttaagagaaatgatctcaaatctggtgatgcttcaataaatgtaacgaatttacagctgtcagatattggcacagatcagtgcaaagtgaaaaaagctcctggtgttgcaaataagattcagctggtagttcttgttaagccttcagaaaatgcccacttcatggttagcagaaatgacttcatctgttatatctgtaaaaaaaatgcttcttctgagtactctgggacatacagctgtacatcagaaacggagtgggctctgatcagtgcctgttgcgtgtaa

SEQ ID NO: 61970 - DNA, 4037 bp, Homo sapiens
atgaaccaactgatcctcacaactggagagagaattaacaccttccatgggacaaagaaaaagcacattctggcctgctggcaagtcacctgtcgtttccagctcatcttcatcgctctacgtgtaaaatgcctgggtagaggcggcggcggcggcggcggcgggctcggaggcagcggttgggctcgcggcgagcggacggggtcgagtcagtgccgtttgcgccagttggaatcgaagcctcttaaaatggcagatgatttggacttcgagacaggagatgcaggggcctcagccaccttcccaatgcagtgctcagcattacgtaagaatggctttgtggtgctcaaaggctggccatgtaagatcgtggagatgtctgcttcgaagactggcaagcacggccacgccaaggtccatctggttggtattgacatctttactgggaagaaatatgaagatatctgcccgtcaactcataatatggatgtccccaacatcagaaggaatgacttccagctgattggcatccaggatgggtacctatcactgctccaggacagcggggaggtaccagaggaccttcgtctccctgagggagaccttggcaaggagactgagcagaagtacgactgtggagaagagatcctgatcacggtgctgtctgccatgacagaggaggcagctgttgcaatcaaggccatggcaaaataactggctcccaaggtggcagtggtggcagcagtgatcctccgaacctgcagaggccccctcccccagcctggcctggctctggcctggtcctaggctggactcctcctacacaatttatttgacgttttattttggttttccccaccccctcaatctgtcagggagcccctgcccttcacctagctcccttggccaggagcgagcaaagccgtggccttggtgaagctgccctcctcttctcccctcacactacagccctggtgggggagaagggggtgggtgctgcttgtggtttagtttttttttttttttttttttaattcaatctggaatcagaaagcagtggattctggcaaatggtccttgtgccctccccactcatccttggtctggtcccctgttgcccatagccctttaccctgagcaccacccaacagactggggaccagccccctcgcctgcctgtgtctctccccaaacccctttagatggggagggaagaggaggagaggggaggggacctgccccctcctcaggcatctgggaaggccctgcccccatgggctttacccttccctgagggctctctccccgacacatttgttaaaatcaaacctgaataaaactacaagtttaatatgaaaaaaaaagaaagaaagaaagacgtgtaaaatgccaagaactctaggaaacagggacaaaaacacttcaaagagaaagttcatgcacttgtttctgaccacccagggcacccttcagcacacggtgtctggagtggcctgaagcaaggagtgtcttgtgaggtgcagaggatgcaatgggagcagggtcctgtccccaccctaaaggagttcacagtttaacgcaaatgagaagccagtgaggacatcactactcctgctgtgaacttgggaactagaaacacaaaacctgagcctggagggaagctaaggaagcattctgctctggagtagacatgagtgcatgtgaagcttctgatctcccatgagagcaatggggacatggggcagaatctaaaacccatgactgaaagcaccaaattgctaaaatggcaataaagagacatgaggccaagatggagaagaaggaacccaggacgaaggtcagcctcacatttggggctcatttccctcagtttcatcactgaatttcagaagggactaactgagatgtaaagaagcagagcagcttttgcaccatgtggaggactagatggaaaacaagtagactgagggtctgctagtgacggtgacccctactgaagtccactggctttggttgggacccagaagagtcacacgccaggaatagaggtggacaggaaacaccctgacttttgtagggactgaacctcactgataacctcaattgcggatggtatggagggtgtctaggtgtgctaggacccctgcccattccccagaaatagactcccatcttttctgcagcaagataacatgctagtcggcctcaattcattgctaaatatttttaacgagtgtcttacatttagccaaaaagactagtcatgtggcaggaaaaatacaatgtcatatgaccaaaagctaaaagactgtgaaaatgaatcccgaggtgacccaagcattgaatttaacaatgccagtacctggacctccgcttgcccctaaaacattacaatcaagaatgtaggaagggaaaggaaacacgaagattaatcaagcaggaaggacaagctcagttttgcacccactgaatttgccacaaatattgtggaaaatattctcggggacattgcagttgtctactttggttggcacatggttcatacaacagtgtttgtgtcagtgaacatcttactcttcctcggcagtctttctttgcccagagatttcgcaatgactgttgaccttcatcatcaccttttggactttggcttgcactttagcttctgtagatctccataatgtaaagaggtattttgggtccattttaattcctgcaaaggataaaatccttctattcgtgtgcatataagtggacctgagcccttggttagggtgtagagaggagacggggagaaacctgagggccagaagctgttctttcccttaaaagggcaaactcatttccacactatggggactctgacagatagcataccttcctggctacggctattggacctgcaggctttcccctgtaaatccgtgttctgtcattgacattttgtgactgtaagacagacttgagataagacatctagaaaacaataattgaacaatgatgtgaatatatttcacacaactgaactgtacatttcaacaaggttaagatggtaattatcacgttatacatattttaccgcaggttaaaatgtttcacaggttgaaaggaaagcaactaccttcagttctctgagttcaagaatttgtaacatttcaccccctgctccttcctgatcttctgtggagcatcttttttccatccatgctctactcagagcccactttcccttccctgacaccagcttcactgaggctggttggaacctaacacaaaacattctcagtaatgactgaattcccacaaagaattccatatagaccgcatatgagttgaatcttctaagacatgaaatatttgttctcttcttggctaatatgcaatgcaaatcctgttgcaaatgtacgtcatatacctctgaaattcctgatgtattcaatgaaataacatctttaaagttctgtgtagaatgcttttttttctgatttcttcacataggatagaaaaaaaaacccaaaaaaacatgtactaggatttcgatagaagcaatgggtgatctaaaaagatgaaagagcaaccgcatgcgccccacagctaccgctagattttatggggaaagcagctggcccagtttgcagctaggagaaatgtcaaacacatgaagaaatgagaagcaaagaaaaaccgtgaggcatgaacatttcatggcactcacgatgtcctggtttgtgagataatgggatagaggagtagataacaaggagaaagatgagaaggtgcaaagtggttcaagtcaaacagctcaactgaacttttcttaatggaatatttaaaaagtggtacattaaaaaacttcccccagttcacatcaaaaattctctcttcaggactaagttgagtagagactgttcaatgtgcctagatatcttcagaactcatatattttctgttttctacgtatgttgaagggcagtgccaaatgatgtgtaattatctaggttgtaaaaataaaacatactcccccttcccttgaggat

SEQ ID NO: 61971 - DNA, 429 bp, Homo sapiens
tgccttgggtctcatgtcccactgcattgtcatcttgaagatttgtcacactttgagagaaaaacttgttgccatgacaatgggctcagaggctgaaaagaagacttcaaccactgtcagcagcatcattgtggtggccaagtggatcatccccagagtagatgatgttgtgaaatcagtgtaccatctgttaagcaccaagctcctggatgctccatcagcagagagcagagaagagaagcaactggatatccaagagaagcagcttgacttcaaagagacaacttgacaacgtggcttcagagaggagtctggccaaggactgctgaactccaggggaggattgccctcccactccatctgctttccagctcccctccccacagagagccattttcatcagcaataaaatcctccacattcaccacc

SEQ ID NO: 61972 - DNA, 1047 bp, Homo sapiens
atggcgtcgcggccccgcccccggacgcccagccgcggtcccagcgaccttcgctttcgtggggaagccggactgcgccgtgtcttcctgaagaaggctgggggatcagtgtccttcagtgatgtggctgtgggcttcacccaggaggagtggcagcatctggactctgctcagaggaccccgtacagagacatgatgctggagaactacagcctcctcctctcagtgggatattgcattaccaaaccagaggtggtttgcaagttggagcatggacaggtgctgtggatattagaggaagagtccccaagtcagagccacctagactgctgcatagatgatgacctgatggagaagagacaggaaaatcaagaccagcatttgcagaaagttgattttgtcaacaataaaacactgactatggacagaaatggtgtattaggaaaaacattttctcttgacacaaaccccattctatcaagaaaaatacgtggcaactgtgactcatctggaatgaatttgaataatatttcagaattaattattagtaatagaagctcctttgtaaggaaccctgctgagtgtaatgtacgtgggaaatttctcctctgtatgaagcgtgagaatccttatgccagagggaaacctttggaatatgatggaaatgggaaagccgtctctcagaatgaggacttatttaggcatcacagaggatacacagaggagagaaaccctatgaatgcactgaatgtgggaaaacttttggatataggtcatgccttgcagtacatcaaagaacacacacgggacaaaacctatgaatgtaatgaatgtggaaaaaacttctgtgagaagtcaaatcttcatgtacatcagagaacacacacaggagagaaaccctatggatgtaatgaatgtcagaaagcctttggtgataggtcagctctaaaagtacatcagagaatacatactggcgagaaaccctatgagtgtaaggaatgtgggaaaactttctcccagaagccaaacttcattaatcatcagtga

SEQ ID NO: 61973 - DNA, 1716 bp, Homo sapiens; identical to SEQ ID NO: 8782

SEQ ID NO: 61974 - DNA, 1680 bp, Homo sapiens
gcctcagaaaggcagaaaccaggaaagctaagacaaacaaaactacaatggaagaagaaaacgtcctcaactagacatctgccaaaaatgaacatgagcagctgacctactcttccacaaggtccaaagcccccagtgtcatcatcacaggtcttaagccagccaccaaatatgtatttcacatccgagtgagaactgcgacaggatacagtggctacagtcagaaatttgaatttgaaacaggagatgaaagactctccatttcaagtgacaaaactgtactggcttaatgaaaagtgggactttattgcctcagcttctgacatggcagcagaacaaggacagattctcgtgatagccaccgccgctgttggcggattcactctcctcgtcatcctcactttattcttcttgatcactgggagatgtcagtggtacataaaagccaagatgaagtcagaagagaagagaagaaaccacttacagaatgggcatttgcgcttcccgggaattaaaacttacattgatccagatacatatgaagacccatccctagcagtccatgaatttgcaaaggagattgatccctcaagaattcgtattgagagagtcattggggcaggtgaatttggagaagtctgtagtgggcgtttgaagacaccagggaaaagagagatcccagttgccattaaaactttgaaaggtggccacatggatcggcaaagaagagattttctaagagaagctagtatcatgggccagtttgaccatccaaacatcattcgcctagaaggggttgtcaccaaaagatccttcccggccattggggtggaggcgttttgccccagcttcctgagggcagggtttttaaatagcatccaggccccgcatccagtgccagggggaggatctttgccccccaggattcctgctggcagaccagtaatgattgtggtggaatatatggagaatggatccctagactcctttttgcggaagcatgatggccacttcacagtcatccagttggtcggaatgctccgaggcattgcatcaggcatgaagtatctttctgatatgggttatgttcatcgagacctagcggctcggaatatactggtcaatagcaacttagtatgcaaagtttctgattttggtctctccagagtgctggaagatgatccagaagctgcttatacaacaactagacccacaaatcacaacaaagagcaatcagaactggttaaagaagatggtctggaaagcttgtgtgagcagtgcgagtccagctctggttatggtactggactggtcctcatgtggaagagaaacagaagggccatgggagccagtggccagaccagaaagcaatgtgacaagagagataaccctccaacagacctcttccaaactctaacacttaacctctgctattctgcataaattctgagaaaagccaaattttctgtcggtctaagaagacatagcctacacccaactggagataattataaaaaataatgaagcagcatgaggggaaggtatttaatgtgtattttaaagttgggagagattctccttcacctaatttaggtgtttgtgaattggcttgactttttgaagttaatttttaagccttgaacatgtccaactttaagaactttaagaataaatatttta

SEQ ID NO: 61975 - DNA, 1584 bp, Homo sapiens
gctaagacaaacaaaactacaatggaagaagaaaacgtcctcaactagacatctgccaaaaatatcatccagaatgccctggcaagttcacttccatttagtgaagtgagataatttggcaattcacgcaagagactgagaaccaagcctcaagccctgcctctgattctgcaggtatggaacatgagcagctgacctactcttccacaaggtccaaagcccccagtgtcatcatcacaggtcttaagccagccaccaaatatgtatttcacatccgagtgagaactgcgacaggatacagtggctacagtcagaaatttgaatttgaaacaggagatgaaagactctccatttcaagtgacaaaactgtactggcttaatgaaaagtgggactttattgcctcagcttctgacatggcagcagaacaaggacagattctcgtgatagccaccgccgctgttggcggattcactctcctcgtcatcctcactttattcttcttgatcactgggagatgtcagtggtacataaaagccaagatgaagtcagaagagaagagaagaaaccacttacagaatgggcatttgcgcttcccgggaattaaaacttacattgatccagatacatatgaagacccatccctagcagtccatgaatttgcaaaggagattgatccctcaagaattcgtattgagagagtcattggggcaggtgaatttggagaagtctgtagtgggcgtttgaagacaccagggaaaagagagatcccagttgccattaaaactttgaaaggtggccacatggatcggcaaagaagagattttctaagagaagctagtatcatgggccagtttgaccatccaaacatcattcgcctagaaggggttgtcaccaaaagatccttcccggccattggggtggaggcgttttgccccagcttcctgagggcagggtttttaaatagcatccaggccccgcatccagtgccagggggaggatctttgccccccaggattcctgctggcagaccagtaatgattgtggtggaatatatggagaatggatccctagactcctttttgcggaagcatgatggccacttcacagtcatccagttggtcggaatgctccgaggcattgcatcaggcatgaagtatctttctgatatgggttatgttcatcgagacctagcggctcggaatatactggtcaatagcaacttagtatgcaaagtttctgattttggtctctccagagtgctggaagatgatccagaagctgcttatacaacaactgacctcttccaaactctaacacttaacctctgctattctgcataaattctgagaaaagccaaattttctgtcggtctaagaagacatagcctacacccaactggagataattataaaaaataatgaagcagcatgaggggaaggtatttaatgtgtattttaaagttgggagagattctccttcacctaatttaggtgtttgtgaattggcttgactttttgaagttaatttttaagccttgaacatgtccaactttaagaactttaagaataaatattttaacacaa

SEQ ID NO: 61976 - DNA, 515 bp, Homo sapiens
atgcagtctccatgtgaaaccaggtgctgttcccaaaggagaaaacactgccctccagtggtcttcaatgaagaaatggaaatagtttcaggtggaaaccaggcttcttggaagacttcaaactatgccaaatggtctgatttcaccatagagaatgttatactattaattgccaatttgcatatgtgtgcagctgctgttttggctctgaactcaatccgataagcttgctggaggtatcgcagagcacttggcagctttcctatttgaaaagaaagcctctcccctctacagaacagctgatcgtctatcagcgatagaccctgatggcgtgaattacaattacactacttttcacactaaatctgggtgatagctacttggaaagaagtttcatcattttttaccacaaactggaaaaagaattacatggtcatgctgtgcttttaaaggcagtttggttcacttttgtctatttaacacctaattccaagaagtccataggcatctagaga

SEQ ID NO: 61977 - DNA, 1597 bp, Homo sapiens
cgcccactggggatggcaaagacgacatccggtgcgccgaggctgctcacaaaatcactcacctgtggcgcccttggccgctcagtcaaggctctgaatatcctgagactgccccactgcttggaagccccggacaccagagagtttcctgtaggtcctccagccgagcccgatgaccccggcaggcccgggagtgatgtccccctctggatgatcccaaccccttgctgtggattcagccccagccgttgttgtgtcttttggggaccttgtcagttgccttccaagtgctaattctcatgacgagataagaatggctatgactgggtgttgattgatgagtcgaacacattgaatcctggagtttgaggttatcagaactccccacttagaaaatcatcctttatattttagaaaatcatcattgtatgttgaacatacaatgcttcttttttcttcatctccagtgcactggtctagagagcggcagttggaccccagagtgtggcacgtgttcctgtgttcatttgaacattctctgatgacctgtcgctgaggtcctgtgatgatgcgtatcctgtcttccaccccaactgccactgtgtttcaactgtcgctggctgtgtttcaactgccgctgtgttggaactgccagctagactgctcaccaaaatgggaggcagcctctgctgctgtggtgaaggtgaaggcttcttctaccgccagaattggcggtttctctcgctggattcttgggacctgatccaggcagcacactcgacacactcagcgattcagctctacagtatgcactctgggatctcccatttgctaaggaaggatcttagctttgagaaaggtgacactttcctccctacttttgctggagaactaccctggtttgagcttcctgctggaaatgagtggcaagagatcccctcttgaggagactccgcaggaacaccagagatgatagtgacacacaacaactgaaggcagaggtacaggctgaggagaaaggtgtcaagcctgtggcagcagagcttcctggggagtcctcagagcaagtcattgccattgtcgaagtgtcttctaggctttattttggggccattacctcgagcactgtttcttgtctggtttcctaatgtcagcaactgaagaaaagacctgtatacacaggacacagcatggtctgacgctcacagtgttttcctttctctctgcagagggattcagcactttgggcaagtggttgcacagaggatcccgtggaagaattcatatatgaatcagatgagaatgccccaggaccatcgtagataccaacaagccctctcccggcacctgcagaaaaagtggggaaaatccccgaagaggcagaaacattcatccggaagggccgccagccagtggatttcccgggcccctcagccctctggagtgtacgagttttggagaaacctcttcctctgtatatgcttttgactttcctggactgatgtaaaaatactcttttctttgacctgtttatttttaagacacgatgtgattgtgtcagcttatattttattgctgaagtaaattttcaaatgtt

SEQ ID NO: 61978 - DNA, 769 bp, Homo sapiens
aatgggaggcagcctctgctgctgtggtgaaggtgaaggcttcttctaccgccagaattggcggtttctctcgctggattcttgggacctgatccaggcagcacactcgacacactcagcgattcagctctacagtatgcactctgggatctcccatttgctaaggaaggatcttagctttgagaaaggtgtcaagcctgtggcagcagagcttcctggggagtcctcagagcaagtcattgccattgtcgaagtgtcttctaggctttattttggggccattacctcgagcactgtttcttgtctggtttcctaatgtcagcaactgaagaaaagacctgtatacacaggacacagcatggtctgacgctcacagtgttttcctttctctctgcagagggattcagcactttgggcaagtggttgcacagaggatcccgtggaagaattcatatatgaatcagatgagaatgccccaggaccatcgtaggtcaggccacctgcttttgtcaaagaaaaaagataacccctatttgaattaaaatatgagaatctgaccatatgtatcataggtgacttacacagtgtccttggtaaggagaatttagagtgagagtctgttccccactgaggtttgatttaagatggcagaagaaaatgacatcatcagccactcagcagcttgattctctccttggggcaaaatcacttaattgccaagcaacatggacttacaggaaacatcctccaataaaaacttaggttttta

SEQ ID NO: 61979 - DNA, 1175 bp, Homo sapiens
ttcaccactaagaagttccaaatgtcggaggtctctgacacttccgaagaaacccagatacttcgagacacttttgctatagaatcatttagaacatttcagtcccatttcaccaaatataggacaccagtataccaaaccccttacactgatgaaagggcccttctcactctcatgaagccaacaacatcaccatcttctctcactactctactcagaacatcacagatttcacctttggaatggtaccagaaatcccgattccctcctatagacaagccctggatactgagttcagtttcagataccaagaaacccaaagtaatggtgcccccttcctctcctcaagaacttgaagaaaagaggtattttgttgatgtggaggctcagaagaagaacctgatactattaaatcaggctataaaaacttgtggactcccttcacagctacacacaatggctaggactctcataattgagatacttcatatggacacagttcagttgggatacttattccgcaagtacattgcctataggctgatccagcatgccaggaacaacataatgaaacgactaaaagccatccaaaatactgggaaaggctatgaggccaggaacctccacatgatgctgagcagacttgatgactacgggaaaaaggtgatgcaggtctggactgagaagcagaagtctctagggcagaaacggaatcagtgcctgaagaaaatgatacacgtattcaaccagctcaaaaagatacatgaattgaatcttagtcaacctatccccttaatcatcgaagaaaagcagatacctgcctctaccacatttgttcaaaagccattcttaaaattactaatggaagaggacagaacctctgacatatgcaagaaatttaggcaacaagaggaccagacagaggccatctggaatgttgatctgtccacttcaagctacccaatagcagagaagacatctatgcattcactctgggcccagctgggtgggtacccagatattcccaggctgcttcagttagaagtgcagtctaccttccgaaaatctcttgcatccctccaatcacgggttaagaagattcccaaatgactgtaaaattaaatacaagcatgttgaaagtacatttcagtatctttcagtaaaatgcctatttt

SEQ ID NO: 61980 - DNA, 2160 bp, Homo sapiens
catttatttgctgagtgggactggaggcccatagccgcagaagatcctggccccacagcagcagagagcaagctcagagtgctgtcaggtctctcctgctgcctctcgccatgatgatgtagtggaaaaatggtcaacaaagctatttcctactgtgtgctaaatgcccatcatgggaagtcccaggaacaagaagatcatgggtgaggcagctgctcagaaacaaatgtctttcaacaattacccccaggcatgggtgatacatcctcttcgcagacagcagaaaaacatcagatttgtgatttaattgggagttttctgggatcgaacagtggcttcgtttacaggtgggttgccgagcggccatggtaactgatggagcagtcactatggcagtcagtagggctgagtgggaagggtgccctgggagcctggaagcgtgggaaccagcagggccgcagtcgtccatttcccacccagtctttcctgtctctcggggatccctggcagttgctcagctgatgctgaattgagaagcagcctgtgaacatgaagggtatatggcagaggatcccaatttggcttctgcaagaagtagaaccaacaatgagctacctggggaggccctgtgcctccgactcttgctactccttggagcctcgggtctccgagaataaacacccagtatactctagggacctaaccgctaatcccaggagcccgagctaaagagaaatagtgtgttttgcttgtttcatcaagctgaagtctggctcacctgatcctggcttattttttgcttctctgcaacttctgcctgaggggacaggcagtcccagcgtatacacagcctgggcacagccctccaggtcctgctggggccagaaattccttctggctttaccacttctcatcctggtgcttattgcctgagccctttgggaaaggcaccctgtagatgagaattgctgacagtttgggggagtgaaaacgtgcaggaaggcagaggatgttcccgttgcgtttaagatcagctgtatttggagagaattcaaaatgcaagcgtacttatacagtcattggaggtcaagttaatttattgcctcctggttacagcatcagtcccgccccttagaacgagctgaattttggagtctggtggccaggcagaatcctatggaaccttctccagcatcttcttcatggtcgatctcaaggtcactcagggcttgtcttgactagtaataatagaagaagccagcacttttagagtctctcttgcttagtaccctatgaaatgctttacatacaatatctcaatcctcacaagaaccctataaagaaaggattattgctgcctccattctataaatgaaaaaactaagattcagaaaggtcaagtaacaaaccccaagtcacagagctggtaagtggcacgaaaaaaaactcagattcgggcaggcttgcatgtacactctccctgtgagggatactgcctcctgctagcctagccacaaccaaaggaaagtaataatagctcaacccttcatcagtgccaggcactttgctaaggtgtttgcttgcgttcttctaactcttgaatgaggaaactgagaatcagagagattaattcctttccccaaagtcacacagctagtatgacagaaactattttcctctaaaatctaatttctccttattgtacagtagtagaccctcatttttagctgagcatgtggccttctagagttatgactacattctccagactctgttgaagctaggtgtccatgtgactaaattgtgggcaataggatataagcaaaagcggtatgtgcaacttcctggaactctcagccttctctccgctgctgaaatgcagacgtgacagcttgagccagagggtgccagccagtgccatgatgtgaccaaggccatcaacagcagagccgcaagggagcaggagccttggtccctgaggacatgctggagctaacttgggaatcctgaggtggccacctccaaaatgttacatgaaagagaaaagtaaacatctaacttgcttaagctgctattgttttggggtttgtcatttacagccaaacctaatcctcattaaaatagtggtggaactggaatttgaaccagtttactcccaag

SEQ ID NO: 61981 - DNA, 273 bp, Homo sapiens
atgactttcggcaggctccatagaatcttcccgaagatcatgcctgagaagccagcagaggaaggaaatgattcaaaggaagtgctagaagcatctggcccacagaacgatgggaaacagctgtgccccccgggaaaagcaagtagctctgagaagattcacgagagatctggaaccaaaagagggaaacatgcctggatccacagactgcgtgagagaaagcaactggtgatttatgaagagatcagcgaccctgaggaagacgacaagtaa

SEQ ID NO: 61982 - DNA, 842 bp, Homo sapiens
tttaaagagaacacatggaagtaaaccaagaacccagccaatatccccaggcatctgatagagcatgcagtgtggatacactggaaaaagagcagattcacatcccaggtgagaaggagcaggacagtgcaagatttcaccacactgcgcagaatgaaattgacaagatgatcctaaaatttatctagaaacacacgggacacagaacagccaagataattttgaaaaataagaacgaaggactcatacttcttgatttcaaaactgactacaaagctacagtaattaacactgtgtgagactggcataaggatatgcatatagattgataaaataaaactgagaagcccttgagaaataaaccttatatatatggtcaactgatttttgacaataatgacaagaaaattcaataggaaaagaagttatttcaacaaatggtactgggacaactggatacacacatgcaaaaggatgaagttggaaccttacctcataccatatgcaaaaattaatgctaaatgagtcatagacctatatataagaattagaactataaaacttatggaagaaaatataggtgtaagtctttgtgattttggattacacaatggtttcctagaatgactcttaagcacaagcaaccaaatcaataagttggatttcatcaaaattgaaaacttttgtgcctcaaaggacattatcaagacaatgagaagagaacacatagaagaacacacttacaaatcatatatctgatacatatctgctttccaaaataagtaaaaacttttataactcaataataaaaacacaagtaacccagtttaaaaatgggcaaa

SEQ ID NO: 61983 - DNA, 3053 bp, Homo sapiens
atgactcctgaggcacactggactggtccccccaaccccggtgccttgggctacccccaccaaagttttgtcagtcagccccaccccttcagcaagcagcccagtccttgccctcgccaatcaccccagggtgactttgggtgggtgactcctggggcttcccgctccattactgggccctcatctcctgccgccccaagcttgatctccgtgggctctttgggctctcatctccaaggagccaggccccaccctcgccagtcatccttgggtgactttgggctggtgactcctgggactccctgctgcagactgtgccctcccctcctgctgcctcaaggtcgacctccctgggttctttgtgctggcgtctccaaggagctgggtcccaaccctgtgcttccctcccccatcgtggagcagcgacttggacatggtgctgacatggtccctccccccgaccaggaggagtggaatgttttaaaagaatattggcagaaaaacagacctagagttccagcaggagtgaacaggaacaggaaaacaaatggcagtatccctgagacagccacttccggtggttgccagccacctggggattcagcaacaggtttccacagggaaggccctacatcatctgctaccctgaaagatctggagagcccgtgccaagaacgagcagtagtcctggattcaacgtccgtaaaaatcagtcgactgaagaacaccatcaaatctttgaaacaacagaagaaacaagtggaacatcagctggaagaagaaaagaaagcaaacaacgagagacagaaagccgaaagggtgctagaggttcaaatccagacattgatcatacagaaagaggaactaaatacggacctgtaccacatggaacgttctctcagatactttgaagaagagtccaaggacctggctgtccgcctgcaacattcattgcagtgtaaaggagagttagagagggctctgtctgctgtcatcgccacagagaagaagaaggcaaaccagttgtccagctgcagcaaagcacatacagagtgggagttagagcagtccctacaggaccaggcactgctgaaagcgcagctgacacagttgaaggagtcatttcaacaactccaattagaaagagatgagtgtgctgaacatatagaaggagagagggcccggtggcatcagaggatgagtaaaatgtcgcaggagatttgcacattaaagaaagagaagcaggatatgcgttgggtagagcagctggagtggagcttgtccaaactcaaaaaccagacggctgaacccttgcccccggagcccccagcagtgccctctgaggtggagctgcagcacctgaggaaggaactagagagagtggcaggagagctccagtcccaggtcaaaaacaatcagcacataagtctcctgaaccggcgacaagaagagaggattcgggaacaggaagagaggcttcggaagcaggaggagaggcttcaggagcagcacgagaagcttcggcagctggccaagccacagagcgtcttcgaggagctgaacaatgagaacaagagcacactgcagttggagcagcaagtaaaggagctacaggagaagcttggcgaggagcacctggaagtggccagccagcagaaccagcagctaacggcccagctgagcctcatggctctccctggggaaggacacggaggagaacatctggacagtgagggggaggaggcacctcagcccatgccgagtgtcccagaggacccggagagcagggaggccatgagcagctttatggaccacctgaaggagaaggcagacctgagtgagctgctgaaaaaacaagaacttcgcttcattcaatactggcaagagagatgccatcagaaaatccatcaccttttatcagaaccagggggccgtgccaaagatgcagcactgggaggaggacaccatcaggctggagctcagggaggagatgaaggtgaagctgctggagctgcagcagatggtattgcggcttacagcaactacaacaatgggcacagaaaattcctggccgctgcccacaactctgctgatgagcccggtccaggagccccagccccccaggagcttggggctgcagacaagcatggtgatcttcgtgaggtgaccctcacctcctctgcccaaggagaggccagggaggatcctctccttgacaagcctactgcacagccgatcgtgcaggaccaccaggagcacccaggcttgggcagcaactgctgtgtgccattattttgttgggcttggctgccaagaagaaggagataaacatcaccatcatcaaacagctgctcaagaaatttttaaataagaaaccaagttatggggttaatctcctacacaattcatttacttcctttgaatgttagactcactcatgattatttgtgtttctaatttatagtttaagtttatttgtaaaaagttaaaagagagtgggtgtctgtggctctcactgatgttcactctggcatcctttagcatttttcttttttaatttcataattgtaggtcattagcgtgcatatcgagtttgcccttacgtggtgggagttcaaacacacaaagacccactctttgcccaaaactgttctctttggtttggaataggctgccatgcttttttaatgttattgcagcatgtatattcactacagcattcagacaaaatttgcctatgttctgctgttgtttgatgtaatcttaatcacagtgagctcttccttagctcaatatgtagtttgcccccaagtgtgcactgtttattactttgtaatacgccactatgagtactgacatttagagttgtttaaaggccaagaattggaaacagcctttcctccattttctgtgtattggtgatgggagtgataaccttttgggggagctttttaaatctcacagaagaggaaagtggcctcctctggcaggtacgtgcaggatagagtgtgtttcatctgttccggtgccaggaattagcagtgtattatggt

SEQ ID NO: 61984 - DNA, 964 bp, Homo sapiens
tttgacacctaccttactctctccctccactcacactctgagaactgtgctcaggggcagcgctacaacttccacattggtctttacagggcttgagtgattatttcaagaacagaacgctgtgtggaaacctttaccatatttcgttgtatctaagacacattttttttttttgaaatttaacatctctaaggttgggttatgtttcttcatcattgtcaggttggagcttaatcagcagcacttttttttaatgtcacacacagtaatggtgatgcatctcacaattgagatcatcttagacatgatggaatatggaatcgtgtgcctgttacaagccaggctcttgtctgggttctagagacggtggaaaccaagacagcaccatcctctagtggtgttcacatcccaccacagtggagtcaggactttgaagtcctccattggatcttctcggaagatgagggaaatgagagagtgtggagagagattttgtaagtccggtctggaagtggtcattgttcagaatccagccacgtgggtacatggaactgtaaggctatttcaacatgggaaactgaaatcgggcatatccctgcggaagaagctgtctcttagcgaagaataaaactgtggactgacccccacccatttgcgaagaaagtactgggtcttcagctttcattgttcagccggtggtctttgtggacaacaccaggggcccctcctgctgaagactgtctggacttcctgattttcactcctgtataaaccccctcccccattactacctttgtctccttggggaaaaaaaatgtttttcacttaagcaaaataataactacccagtatttgtttctggagtgaaattgtaaacttcattgtacattcttcctggctttgatgcttatcgtgaagagttcagtgaaaataaattgtttttatgaaagcagagaaaccattt

SEQ ID NO: 61985 - DNA, 528 bp, Homo sapiens
tggagaacgccagggagctgtgagggtgtgtggtctcgttcctgtcgtctggaatatttttcctctactgagattcatctgtgtgaaatatgagttggcgaggaagatcgacctatcggtctagaccaagactctatgtagagccccctgaaatgattgggcctatgctgcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctgatagccaggaacaggttcacccaaagactgggtgtgagtgtggagatggtcctgatggccaggagatgggcctgccaaatccagaggaggtgaaaaggcctgaagaaggtgaaaagcaatcacagtgttaaaagaagacacgttgaaatgatgcaggctgctcctatgttggaaatttgttcattaaaattctcccaataaagctttacagccttctgc

SEQ ID NO: 61986 - DNA, 3522 bp, Homo sapiens; identical to SEQ ID NO: 61949

SEQ ID NO: 61987 - DNA, 5357 bp, Homo sapiens; identical to SEQ ID NO: 61950

SEQ ID NO: 61988 - DNA, 2471 bp, Homo sapiens; identical to SEQ ID NO: 61951

SEQ ID NO: 61989 - DNA, 2515 bp, Homo sapiens; identical to SEQ ID NO: 61952

SEQ ID NO: 61990 - DNA, 2473 bp, Homo sapiens; identical to SEQ ID NO: 61919

SEQ ID NO: 61991 - DNA, 2875 bp, Homo sapiens; identical to SEQ ID NO: 61953

SEQ ID NO: 61992 - DNA, 5803 bp, Homo sapiens; identical to SEQ ID NO: 61954

SEQ ID NO: 61993 - DNA, 2515 bp, Homo sapiens; identical to SEQ ID NO: 61920

SEQ ID NO: 61994 - DNA, 3947 bp, Homo sapiens; identical to SEQ ID NO: 61957

SEQ ID NO: 61995 - DNA, 3518 bp, Homo sapiens; identical to SEQ ID NO: 61958

SEQ ID NO: 61996 - DNA, 5372 bp, Homo sapiens; identical to SEQ ID NO: 61959

SEQ ID NO: 61997 - DNA, 2499 bp, Homo sapiens; identical to SEQ ID NO: 61960

SEQ ID NO: 61998 - DNA, 2515 bp, Homo sapiens; identical to SEQ ID NO: 61961

SEQ ID NO: 61999 - DNA, 951 bp, Homo sapiens
ctaggtactccttttggcctaaggacacagtgaaaaatgtaccgagaccttggagagccacgaaccaagaaacttcagaaacctctgatatctgatcaagagttaagagacgtcagaatcatcacaactgacaaaaggtgctcccggattttgctctccagcttccggttcttggtctccaggctcctcactctgtccagaatgttttctctcttcaagattctcttttgaaagacatctaaaaagatcaggaaaagaagacctacaccagcatcacttgtgattctcaatgagcataaccccccagaaatagatgacaagagggggcccaacacacaaggggaattacagaatgcatcccctaagcaaaggaagcagagtgtgtacacaccacccaccataaaaggggttaagcatctgaaaggccagaatgaatcagcattccctgaagaagaagaaggcaccaatgaaagagaggagcagcgggaccattaattactggtctgcagcaagaaggcttcttggaaataactgaactattaacttttctgagtataccatggaattccactgcttgacttccagaagcatcctccatctctgcaccccacactcatacagtagctatgcacatcctggaagtctccttgactgaactttagaactaagtacacattgttccacatcacttataattaaagaataagcatttattttacagtgattcttctttttaactatgtaaaaatttgcatacatgtgactgttctaactttaatactgccagagcttaatccttgatgtcctactgataaggtttgcattctaacaacacatgtaaataacatcactttaagagtaaaaaataaatagtaaacacatttagacatgagtgtgtgtgtgtgtgtgtgtgggtttagcttaaagagaaatatctaataaagcttttag

SEQ ID NO: 62000 - DNA, 876 bp, Homo sapiens
tggcctaaggacacagtgaaaaatgtaccgagaccttggagagccacgaaccaagaaacttcagaaacctctgatatctgatcaagagttaagagacgtcagaatcatcacaactgacaaaaggtgctcccggattttgctctccagcttccggttcttggtctccaggctcctcactctgtccagaatgttttctctcttcaagattctcttttgaaagacatctaaaaagaaatagatgacaagagggggcccaacacacaaggggaattacagaatgcatcccctaagcaaaggaagcagagtgtgtacacaccacccaccataaaaggggttaagcatctgaaaggccagaatgaatcagcattccctgaagaagaagaaggcaccaatgaaagagaggagcagcgggaccattaattactggtctgcagcaagaaggcttcttggaaataactgaactattaacttttctgagtataccatggaattccactgcttgacttccagaagcatcctccatctctgcaccccacactcatacagtagctatgcacatcctggaagtctccttgactgaactttagaactaagtacacattgttccacatcacttataattaaagaataagcatttattttacagtgattcttctttttaactatgtaaaaatttgcatacatgtgactgttctaactttaatactgccagagcttaatccttgatgtcctactgataaggtttgcattctaacaacacatgtaaataacatcactttaagagtaaaaaataaatagtaaacacatttagacatgagtgtgtgtgtgtgtgtgtgtgggtttagcttaaagagaaatatctaataaagcttttag

SEQ ID NO: 62001 - DNA, 5055 bp, Homo sapiens
tcctgagggcagcgaggagggagctgaggcacgcgggctctcaatcgacgccccacagagaccaagaggcctggccttggggggcagctgcttgaaggaggcagagcggaagcgagggagactgctggaggccctgccgcccacccgccctttcctccccctgaggagacgcctgacgcatctgcagtgcaggaggccgtgggcgttagaagtgttgcttttccagtttgcctgattgctgagacactcagtcaggaaagtatgaatgattctaggcagcagtctctgttcttcatcacacttccagatttaaacaaactctgtgctgtcagaataatactgagtaataaggtggcagatactgagattaggactatacaaatgaagatgtgcaggcaattgctgtttttgcatcaagatattcttacatcacctgtgtctggaatattaaaccaaatctgggtggtgatggcgataccattttataaagcaagaaaacttaatgcctatgttgaaaaatatggagctaagatggaggctccacaaagagtaattcctgtaattcttcagaactgcctgtcatattcattcatggctagacttgctccagcctggaatagaactggtcatctcttgatacaaggaagagattttctttctcagatgggaaaacaaagtgctgttgtattaaacatcaatgtaacagaaactcaagtttgtctaagtatagaagcttgcacaatcagactgccagcacctgagctaaaagagtttgagatttcccagagtattataaaggattttcatgctaacaagcatgctgtcattgagagacattccattttaagcaactggtgctacgttttgccaagtatgaaaatgggacaaattataaatatttttcatgccatccccgctgcctgtccttttcactcatatggagatttccagagacactgggatgccctgtatggctataaacttccaggtgattgtggaaaaattaaaatatactgcaacatctatttcaaaatgctcggagaaaggaccttcacatatcctctcagttgcatcagaagtcagcccatgcagttctttccaagggtagattcggaagttgtgttgaaaagttttctttcagatttaaaatctaaactgccccatatatgtggatttcccataaagatgacaagtaaaccatgctactacacacaagaactaactaaacctaatatacaggaacacaaagtcaagccacccaatttgaccactaaaaaaatgcttagggcatctctgactcaagccacttccagaaagcctgcctgtgctcaaagtcttctaccatgttcagtagcagtggaccacaaggtggagctttcagtcagccagccaacatcaggcattttctcagctttgcatctccagccagagtctgttcagggtagaaagaaatccctgtctatcagggctccacaagtacattcagaagtattaatgcccaacagaggaaatactcaagttcagcacacaaatcttagctcccaaagcaacatcacccctaagtttgtaccagttttcaaaaatagattgttacaaatgaacaaaaatacctcagtacttggcagcccaaaaagaaaacagcatgatgtgacacaatctaaattgttttcactcaaaactagtatgatccagcatgacaaactgaatttaggtccagctataaaaaaccgttatagtagtaacattcagatgcaggctgctaacaatttaaatcaggagaattccagacctctgcaagaaaaaaatacagagtcttctgaaaatatgacaaaatttccctcttctcgtggaaaatcgactgtgagtttaaacaaaaataagcaactatctaatagtgcagtatttgtggtgtcaaataacaatttaggggtggtaaaaagtgctgttgacttccaaatgaaaggaaaagaaaatttaacaggcaaaggtataacacaaattttagggaaaagccatgggtcactaaaactgaaaagacagccacacatttttgaatcagatggagaaaccgaagatccacgactgctacagcagcaatcagaaaatcaagctaaagaagttggtacaagtgaccacaggttgatagtaagcaaaatagcccacaggtctaaaagaaaattatgtccagagtcttccaaaacttcaaagaagcatcattccgatactgtgcactatggccaatccagttcttctaagaagcagatacttgactcggataaatcaaaacttaagaaatctctcatcattcataatgcttagaacatggacctgaaagaaggaaatgtctaccagagatgagcattctgaatataggatgaacactcttccagatgcctctcacactcctgtgaccatgaaatcagctctacttactgctgtggaacctcctttttcacttgacagtttctttttattgtttgcatagcatcttgttgtatgtgggtttctgtatttaactagtcccctattgatagacacttcagttcttcccaacttttcactattacaacatcatgtagtctgcagatctttgcaaaatatccaatgatcttatacagtagttttgatagttgaaaatatctttattttgcccttattgaaattatcaaaccacataaagcacagataagagtatgaagaacctctaagtacctatcacccagatctaccagttattaatattttgccactgtttcatctgttcctcacagacatgcttttttttgctataatcttttaaagcaaattcaagacatcatataattttacccataaacaccaaagtgtatatatttctaacataagatatagtatattttttaagaaaaaaagaatgtgtatatatatattacattttggggatctctactatatctctgcaggctcactaaatttcacttttgcttttatatgcaaattaacaggaagccctgaataaatgtaaaagctatttctcaacaaaactggagcctttattggggtggagatttctgtttccaccagtactcattagcatcttctgtgtgccaggcagtggggacaacactgtgtccatggcagaaatggatgagacagccgtggcctgagcccctgagtgctggtggtctagtctcaagcaaattcattctgggttcctggcacagacttagggatatgtatgtattgaagcatatgtccagaatgaccttctagtccatattacaaataaattatctaacatttgaaaaaaagagaaacagaagtggagcttctcagacaatgaatattattctggctttcaaacattttatatgtttgatatacgaaatattatataattgttgtaatatatttaaaagaaaccaaaatcttcattggctattccactgaaacaataattacataaaaatagccactagagatccaagtataagttgaactctgattttgtaaatgtgatttattgtctccaccactttactaaaccattgcaattaaaagcaaaagtaaacaaactctccttcaaacgttaaatgttaactcctgctcctgaaattgtgtttagttaattaatttgctatatacctttattgtaagcatttctgttttccagaattatctctatttcccaattattttaccattttcataaggataagcattttgtctgaagcccattttgagtgtgcttttctcattccaaagtttgtattatagatatctagtagactgttataaagagtggtatgtcattttgtttatgaggctatggtgaaaataacattagtaaatatgcatttttgatgagcacagtcatccacagcatgtaatcattcctaaaaccagccttccccactgttccatacattcccaggccaccttcctgctactgcccagtcactatgcctcaggtaatggacacttactttattattacactgagcaaaataatgaaaaccatacatccactgctgaagtggtattaacatcttccagttctttatataaataatcttgatagcccctcctatactccattagtgtctaaaatttagaatatatagtatagtacttgagtttagatcaatgttaacctacatggcaaaacctgccatgtttagtgtatttttttgtataaagtaggtttgatttttatcttacaatatttatcctaatgaaagttataaaaatatatgcatatatttatatgtgagatttaatatagataggtatatagattgttgatttcatatttcatgttccaagaagaggttctagatcaaatttctgtgttcagaatcaccagagaaatcaattaagattttggttcattttaaacattgcaatttttgaaagccaagataattccaaatctaattagggaaagctacattttacttctttgtgtaagttattggtgatttatatgcagtatggaccatcctccccccagaaattattcttatattccaattgtgcattagttttagaaccattttaattttaaaaccataagaaaataattttatgtttgcctatgtccaggagctgaagaaatcagcgattactttaaaaaatatatggcaatgtcaaaataaatgccaagaatcatatttctaggaatgcaaaagtgcttctcatatactcatatattaggtttcacagtattggttgcttactatatttgtttttatttttattatatatcataattacacatttttatttgcatttgttgcttattgtagtaaaaaggtaaaaaaaaaatgaacttgttaatgattagcttttatttgactaaccagttgaccaattttgctctgttttcaaattgcatatgatggggtattatgctgaaactgctaatatattgggtatttattgatacttaggaatagtcagtatttataaatatttaagaatgtcatggtccttatgttttgatgtttaaaatgttcactttgttgtacgttacatagtgtcttattcaaaattgaaaataataaaggtatttct

SEQ ID NO: 62002 - DNA, 1592 bp, Homo sapiens
gcatccctgggagggccctgtggtagtttcagctccctctgggggcccagaatgaacctggcctgtggtgaggatgtaagcaccaatggccaattgggtccaaaggaagacaccggttcaaacactgaaaccaatcagattctcccacggccttcctgccatcagacgacactggtgcaggggtggttgctatgtacagggcagagccacccaatccccacgcaggagctgtgtcctgccatgctggcctcctcctggccatcacatcaggccaagcaggggagaggaatgggaatgcccatgcacccctatcaactctgcagacacagaaccatgcacagctcttgggaggagtcagatgagctgctcaaagcccgggagggacccacacagtggtcagcatagcagggacggtgctttagccaaggcagggatggcaggtgactcactcaggatcttcaaggaggccgctgcatttccgtgctctttccagataagaaggacatgtcggtgatgatgagcgagacggacatgaacgccatcgcaggcacgctgaagctgtacttccgtgagctgcctgagcccctcttcactgacgagttctaccccagcttcgcagagggcatcgggtggcagagaaggaagcagtcaataagatgtccctgcacaacctcgccactgtctttggccccacgctgctccggccctccgagaaggagagcaagctccctgccaaccccagccagcccatcaccatgactgacagcaggtccttggaggtcatgtctcaggtatgggaagacagtctccagcccatgcaaccccagcctgacagaggtggtctctgcctgccccacccccagtcctgcccatcttccgacttgcattgtatgtggtggtggctgagattcagagagagggacttgcctaggtttgcatggatgggagtgatagggggtgcccaggccacctcctggtcctgctggtgcaccttgctgggggcttaaaaccaccccaagtgttcgggtgtggtggctcatgcctgtaatcccagcactttgggaggccgaggcaggacaactgaacccaggtgtttgagaccagtctgggcaatgtagcaaaccccatctccagaaaaaatacaaagaaaaattaggcaggcattgtggcacacatctgtaatcctaggtatctgggaggctgacacaggaggattgcttgagcccaggagttagaggctgcagtgatccatgatggagccactgtactccagcctgggggacagagcaaggccctgtgcatctctaaaataaataaccaccccccacccaacaagtcatgccttgtcaggaccccaccccacccccgtctcactgtaaggggttcatgacaccagcaggggtttctagcacctgaggtggacttggggacttgggccccaaagacctccccaccagcagctgtgagccccgctctgagccactctcctcttccccactctgcgagggcaggtcgaggtgctgctgtacttcttgcggctggaggccatccctgccctggacagcaagagacagagcatcctgttctccacc

SEQ ID NO: 62003 - DNA, 1551 bp, Homo sapiens
gcatccctgggagggccctgtggtagtttcagctccctctgggggcccagaatgaacctggcctgtggtgaggatgtaagcaccaatggccaattgggtccaaaggaagacaccggttcaaacactgaaaccaatcagattctcccacggccttcctgccatcagacgacactggtgcaggggtggttgctatgtacagggcagagccacccaatccccacgcaggagctgtgtcctgccatgctggcctcctcctggccatcacatcaggccaagcaggggagaggaatgggaatgcccatgcacccctatcaactctgcagacacagaaccatgcacagctcttgggaggagtcagatgagctgctcaaagcccgggagggacccacacagtggtcagcatagcagggacggtgctttagccaaggcagggatggcaggtgactcactcaggatcttcaaggaggccgctgcatttccgtgctctttccagataagaaggacatgtcggtgatgatgagcgagacggacatgaacgccatcgcaggcacgctgaagctgtacttccgtgagctgcctgagcccctcttcactgacgagttctaccccagcttcgcagagggcatcgggtggcagagaaggaagcagtcaataagatgtccctgcacaacctcgccactgtctttggccccacgctgctccggccctccgagaaggagagcaagctccctgccaaccccagccagcccatcaccatgactgacagcaggtccttggaggtcatgtctcagggtcccagggctggtggttgctttgggtctacagctacgtcttacccgcctcctgcctcaacagcctgtgtggtggcaaagccggtgtggggctggggaacgcagcgttctccaggagggggacccggctctccttctgcagtgcaggcgaaggcctagatgccagtgtgacctcccacaaggcgtggcttccagactccccggctggaagtgatgcttttttgcctccggccctgggtttgaagcagcctggctttctcttggtaagtggctggtgtcttagcagctgcaatctgagctcagccacctacacaccaccgtggccgacactttcattaaaaagtttcctgagacgacttgcgtgcatgttgacttcatgatcagcgccgctgggaagaacccctgagccggtggggtggggctggaagcagcaggtgcagtgatggggctgggtgcccaggaggcctcagtgctcaatcaggccaaggtggccaagcccaggctgcagggaaggccggcctgggggttgtgggtgagcacaggcaggcaccagctgggcagtgttaggatgctggagcagcatccgtaaccccactgagtggggtagtctggttggggcagggaccgctgttgctttggcagagagagatgatccccactggggagaggctgttctgactctgcaggtgggacagggacagatggccaccagggtgacccggctggtcttcctttgctatgctaagccctgggacatgga

SEQ ID NO: 62004 - DNA, 1538 bp, Homo sapiens
gaatctgaacaaataggcctcgctgagttccccagattattactattagatcacactcttttgtcctccaattacacttctgcacaactgtccctaaacacacatggttttccctgggtccttggggcttcgttttctgaaggtttctgtgtcactgaaaacttacattaaatataacttttatacttttcccatttaatcttttttttttttctttttatttgttataggggctcagccatgaaccttgtgatggatgaggaaaagatattctttttctccccttacagtttctggcagccaacatggggtggctgtgacaccccactagttccagaacctgcagatgagatcctgggacaaccaataaaaaaacaacaaaaaggagctgcttccacctgtctcctgtgcccttggtttctgctaatcctacattccaagaataaaagtcttcctatgcgttcctaggcagaagccaagtttccctgctttgggcacgttcaaaatagaaggtattttccgcttctcttgcttctgagcacccacgaaatcaacacatccccaaaacacgcgttgagggagtaagggaaagtgtcctgcacccgccaccctcccgcgctaagagcggcagaggaccccacagcttcgtacttccccggaggagctcctggagtaggagacggcttctagcctggaagaaccccgggtgcgacagttgtgccaggaaacttcaagagtattccctcggctgggcgcacgcagtacatccccaatgctccaatttgaactttgactcggccacgaccaccccactccagtctcactctacggtgctttctcccctgttggtgctgagggcttttgagactacctgccccgcgctccctaagtccgagggaccgaggcgaggacctgtcccgctgagctggcacgacccacgcagggcaggcggcacttacgcggcgcagtcggtgctcctccctgagccgcggcgcgcaaggaccccagccggttgtccttgcagcgcttcccaaatcaggcagaagtgaggcagccccacccagtcacgaggaccctgcagaactcgagcctttaagcgctcctctaggctcacatgacccagacccacagggcaaaaagtgcgtcgtcgtgtcccaacctcctggtcccagaaacctggccgcatcaagtcagcgcttcccatgctggaagaagcaagcagccccagggtggaatcttaaaaattaatgaagagcatcggcggggtgccattcaggacttacttgcaagcccaggatttacatttggaaagcgagtggtgtttgattcccactgtttaaaaaggcaacacacgttcgctgatggtctacattccagctgcactagcattcccctgagtgaaatatggcatacattaaccagaagagaaaattacatttattaaaataattaaaacagagtcaaaagaagtaaacgttcaaatgagttttgtaagtttgtagcatttcgacttaagaagttattaaagcttaaaactg

SEQ ID NO: 62005 - DNA, 1655 bp, Homo sapiens
gactcaaagtaaattttctcttcggcaaatcagaaggctctgcataaatactgccaattgttaaacatttacctgcacatactgggctcatcttcattattggtaaaatgagctagatgctattttccattagctcacactccaattccaatcgacctgaccatcagaagagacaaaaagggaaaatcctggccagttctcccctacctgatcaaccagtagcataatcagatttgcaagacctcaagaaaagaaacctgaaaatgccactggaggtgtgtgttttgccaaagaaaaaagaatcaaaaacaaaacctgcaggatgaggacaaacaaacaaagagcaggggctcagccatgaaccttgtgatggatgaggaaaagatattctttttctccccttacagtttctggcagccaacatggggtggctgtgacaccccactagttccagaacctgcagatgagatcctgggacaaccaataaaaaaacaacaaaaaggagctgcttccacctgtctcctgtgcccttggtttctgctaatcctacattccaagaataaaagtcttcctatgcgttcctaggcagaagccaagtttccctgctttgggcacgttcaaaatagaaggtattttccgcttctcttgcttctgagcacccacgaaatcaacacatccccaaaacacgcgttgagggagtaagggaaagtgtcctgcacccgccaccctcccgcgctaagagcggcagaggaccccacagcttcgtacttccccggaggagctcctggagtaggagacggcttctagcctggaagaaccccgggtgcgacagttgtgccaggaaacttcaagagtattccctcggctgggcgcacgcagtacatccccaatgctccaatttgaactttgactcggccacgaccaccccactccagtctcactctacggtgctttctcccctgttggtgctgagggcttttgagactacctgccccgcgctccctaagtccgagggaccgaggcgaggacctgtcccgctgagctggcacgacccacgcagggcaggcggcacttacgcggcgcagtcggtgctcctccctgagccgcggcgcgcaaggaccccagccggttgtccttgcagcgcttcccaaatcaggcagaagtgaggcagccccacccagtcacgaggaccctgcagaactcgagcctttaagcgctcctctaggctcacatgacccagacccacagggcaaaaagtgcgtcgtcgtgtcccaacctcctggtcccagaaacctggccgcatcaagtcagcgcttcccatgctggaagaagcaagcagccccagggtggaatcttaaaaattaatgaagagcatcggcggggtgccattcaggacttacttgcaagcccaggatttacatttggaaagcgagtggtgtttgattcccactgtttaaaaaggcaacacacgttcgctgatggtctacattccagctgcactagcattcccctgagtgaaatatggcatacattaaccagaagagaaaattacatttattaaaataattaaaacagagtcaaaagaagtaaacgttcaaatgagttttgtaagtttgtagcatttcgacttaagaagttattaaagcttaaaactg

SEQ ID NO: 62006 - DNA, 893 bp, Homo sapiens
gcatgagcggacgctgcctatgggttgccgggcgagatgtaaccggctgctgagctggcagttctgtgtcgctaggcttcggcccggccgccgccacacataagctgcgatgaggagctttacgacttcccggtcttcggggccgggcgcagcaagggccagactctgcgctagcaggcgctgcgcgccaaccggccggcacctgtcgcagaaggtgcaaccgatcgcactgtcgcgcagaagctcctcaatggccagcaccagctgcagccccggccgcccactcgcctcacttgagcctgtacgaatctggactgggaaagttgacattaatcaactcattattcctcacagatttgtattctccagagtatccaggtccttctcagagaattaaaaaacctgtacagatggaacaatccaaagttttaatcaaagaaggtggtgttcagttgctgcttacaatagttgataccccaggatttggagatgcagtggataatagtaattgctggcagcctgctatcaattatattgatagtaaatttgaggactacctaaatgcagaatcgcgagtgaacagatgtcagatgcctggtaacagggtgcagtgttgtttatacttcattgctccttcaggacatggactcccaccttcaggcaggattgggtagtacatgtttgtaactacctggcattgccttttgttgaggtggcagacaagaaacatggattattgcgtggagttccattagtaggaataagactcattctacattcttgttgttcttagtgttttttgtttttcatgagaaggaattgtatcagcacaaggcaatattctaacatgacaatgacagcagacagaacctcaataaactctgacttggtac

SEQ ID NO: 62007 - DNA, 731 bp, Homo sapiens
cggaactcatggcggggctgctgggtcttccaggagcgcgcatgagcggacgctgcctatgggttgccgggcgagatgtaaccggctgctgagctggcagttctgtgtcgctaggcttcggcccggccgccgccacacataagctgcgatgaggagctttacgacttcccggtcttcggggccgggcgcagcaagggccagactctgcgctagcaggcgctgcgcgccaaccggccggcacctgtcgcagaaggtgcaaccgatcgcactgtcgcgcagaagctcctcaatggccagcaccagctgcagccccggccgcccactcgcctcacttgagcctgtctggcagcctgctatcaattatattgatagtaaatttgaggactacctaaatgcagaatcgcgagtgaacagatgtcagatgcctggtaacagggtgcagtgttgtttatacttcattgctccttcaggacatggggccagacccaaaggctcaatgtgaaagttcctggactcagaggtgtcacgtaagaaagtgagtggaaacttgggagtatggctgtcccatgaagagctcaccctctggaaaacagaaaagggtcctaatcttggaggtttgacactcatcataatgtgggaatgacagctagaaaaaaacggtgaactccaggaaggcttgaaggcattggagcaaggccagcagcctctccctcccaccatcacttccatga

SEQ ID NO: 62008 - DNA, 664 bp, Homo sapiens
gggttgccgggcgagatgtaaccggctgctgagctggcagttctgtgtcgctaggcttcggcccggccgccgccacacataagctgcgatgaggagctttacgacttcccggtcttcggggccgggcgcagcaagggccagactctgcgctagcaggcgctgcgcgccaaccggccggcacctgtcgcagaaggtgcaaccgatcgcactgtcgcgcagaagctcctcaatggccagcaccagctgcagccccggccgcccactcgcctcacttgagcctgtctggcagcctgctatcaattatattgatagtaaatttgaggactacctaaatgcagaatcgcgagtgaacagatgtcagatgcctggtaacagggtgcagtgttgtttatacttcattgctccttcaggacatggactcccaccttcaggcaggattgggtagtacatgtttgtaactacctggcattgccttttgttgaggtggcagacaagaaacatggattattgcgtggagttccattagtaggaataagactcattctacattcttgttgttcttagtgttttttgtttttcatgagaaggaattgtatcagcacaaggcaatattctaacatgacaatgacagcagacagaacctcaataaactctgacttggtac

SEQ ID NO: 62009 - DNA, 873 bp, Homo sapiens
gcatgagcggacgctgcctatgggttgccgggcgagatgtaaccggctgctgagctggcagttctgtgtcgctaggcttcggcccggccgccgccacacataagctgcgatgaggagctttacgacttcccggtcttcggggccgggcgcagcaagggccagactctgcgctagcaggcgctgcgcgccaaccggccggcacctgtcgcagaaggtgcaaccgatcgcactgtcgcgcagaagctcctcaatggccagcaccagctgcagccccggccgcccactcgcctcacttgagcctgtacgaatctggactgggaaagttgacattaatcaactcattattcctcacagatttgtattctccagagtatccaggtccttctcagagaattaaaaaacctgtacagatggaacaatccaaagttttaatcaaagaaggtggtgttcagttgctgcttacaatagttgataccccaggatttggagatgcagtggataatagtaattgctggcagcctgctatcaattatattgatagtaaatttgaggactacctaaatgcagaatcgcgagtgaacagatgtcagatgcctggtaacagggtgcagtgttgtttatacttcattgctccttcaggacatgggtggcagacaagaaacatggattattgcgtggagttccattagtaggaataagactcattctacattcttgttgttcttagtgttttttgtttttcatgagaaggaattgtatcagcacaaggcaatattctaacatgacaatgacagcagacagaacctcaataaactctgacttggtactgcaaacaccatttcatgataccttaattcaaataaacctttgttt

SEQ ID NO: 62010 - DNA, 740 bp, Homo sapiens
agaatttccactctgaattcacattccgttcagtgttatcgccaccctgtggatttcttggctacctcgctggctttgagcacaacccaggaagaagtttgaaaccaagaaaatggtggttgggaagaccaggatgcgcaatggcaagaattaatcagactgatgaaagaaaacattgtaatatgtatagctcctccacgaaaagtgtgtgctgacaactctggaatacacagtaggcacccaatacatacaagggagtaaatgaatgaattaaagctgtctgtatctgctgatcatccacaatttagacgtcctatactacattccaattgagggcaagcggggtacgtgtcctgaatttatagaatcttttgacacaaagcaagagagccacagtcaagactcaagtcaaaagaaatttagaccccatctgggcaaacaggcctctaagcaacaatctaagatttccacctattgttctggcattccttgtataaatgattatgactgcagagatcttaggaagtgctgtggtacctttagatgtggcctgaggtgcatacatcctcttatgattggccctgtatttttcaattcacctccacaatccaaggcataaatattggatggagaaatggattcagatggaggcatcattgagcttattcttgactcatctcagtccaaacattactctgtcaatcgttgttcttaaaatctgcatattaaaagctcagcat

SEQ ID NO: 62011 - DNA, 554 bp, Homo sapiens
atggcggtttcggctttttggtctttcctgctgccttgtgaagaaggtgcttgtttcttctttgccttctgccatgattgccatgtgaatcgcacccctggaactgtgcagggcccacctgtgtggccacacgcagtgaccctgagcaaaggagtgaccacagaagtgcatggcaaagcagaaaggtgtgacgtcttggaggacgcgggaggaaagcacgcccagcggacaggagccatcacgcggctgcgggctgctgctgagaacctggcgtgggccaccgtcgtcagcagcgtggaggtaactgacgaccttggccaagaagttgggtggcagcgtggaggtcatgctcagagagcctgcaggaccactgtggggccactgccaccctgtggggtggtccggggagccgaggagcatggacaccgtcttctccttccagcaggcacagtcagagtccatctggataatcctggataaatctcatctggagatccttcaccagatcacatcggcaatgacctgttccccaaataaggccctgtgcacaggtt

SEQ ID NO: 62012 - DNA, 633 bp, Homo sapiens
taaagtcttgaaatgtcttgagtgattggaggacctttatttttcacgcctgatgccttatgctgatgagatgactcagcaggggatggccaggccagaaagaccaaaactgtatcctgaggtttgagtttctgagccaggtgatgtcatcctccagcttggccggcctctttctgggagcctctggtgtgaaagagagcagatttattaaaaatcatcaacttcaaattatttggatggaaacattgccaaatcatagagatgtttgctaccacccgcacaccaagcagctgggtaactagaagtgcaggatcagcttattcacctccgaaagcctgcatgcaaccactgaggccgcctctattttttacatagttctacttggtgtatgtaaccccacagagaaacctggaagaatgcatgaaacctagtaaggcaaccagcacatgcaacagaatgaaccgtttctttccatctgaatgcctaaatgtggactctgatcctttctaccaagtcctaagtttgggaaaagaggacaaggacaggggctctgtcccatatcataatgtgcttgtgaatggctaaaattacaatgctgagataagtgtgtgtaataaaataattgcaccccga

SEQ ID NO: 62013 - DNA, 2601 bp, Homo sapiens
agctctgctcaggcttcaacatggcgggccgtttcggttgacttcgcctgtggaaaccgaattccccctccatggtttccccaggatatgagttgggggcctcacctcgcctataagggtcaggcgagctttctggatgctcgagggacctttcggcctgcgcagccggagcagcttgtcccaatgccctgccatttctgtgagggcccacgaggcctggaggagcctcggagcccccgcaggccctcgcgtcactgcctcaagagggtgctcggagccctgctcgggagctggtccccaacgaggtgtggaaccccttcttgctggaactccacggagagactgtcctgctaggacctgcttccagaagagttgatcccagccgtgaaagtgcatgatgccttcagcgaagcaggcaggaaaggctcaagtgatcctcctgtatcaccctgggtatcaaggccattcagtggaaaagaacagtctcttcagcaagtggatgaagttagatctcttcctcacatcatacagaaaaatcagcctcaaatggaagaaatatctaaatgaagccgaacacttgataaaaagttcatcagcgtaaataagaagaatcccctccattacatacaaaagaaaaaataactggagagatcgtctctgctctaagcgtgtttttaagtctctgcagtcttggaccaagctcgttttattccctactctaggagaatctcagagcaccaggattctgtttggggttgccatggacacagagttcttaatccagtactggcttattctcaatacgagagaaggttgtactgaagacacgagacctgagacttgtgtcattttagcggctgaaccgaccccaacttcttctgagcggcagtggcgccagaagcagtctggctttcagtccccatcctgttgacctggtggaagtcatcattgatagagacacccatgacattccccacacaagtgaactgacaggaggaaccaaggaggcacgtatctacgaaaatgtgtcagaacgactttccaggtttgaagattatgaaaatgctgaatatgtcgcttcatatgacagcaggattaagaaaattgttcattcaattgtgtcatcctttgcagttggaatatttggagttttcctgatcttgttggatgtggctctgatctttgctgacctaattttcactgatagcaaagtttatattcctttggagtatcattctatttctctagctattgctttattttttctcatggatgttcttcttcgagtatttgtagaagggagacagcattatttttctgatttacttaacattttagatactgctgttactgtgattattctgctggttgatgtcgtttacattttttttgacgttaagtttcttaaggatattcccagatggacacgtttatttcgacttctacgacttatcattctgataagagtttttcatctggctcatctaaaaagacaacttggaaagctgataagaaggctggtttcaggaaacaaaaggtgatacgaaagtgatggatttgacctagacctcacttatattacagaacatattgtcgctatgtcgtttccatcttcgggaggccagtctttctatcggaatccaattaaggtgaaagagcttatgatcctaagcacttccataatagggtcagtagaatcatgatcgatgatcataatgtccccactctacgggagatggtagcattctccaaggaagtgttggagtggatggctcaagattctgaaaacatcgtagtgattcactgtaaaggaggcaaaggaagaaccggaactatggtttgtgcctgcctgattgccagtgaaatatttttaactgcagaggaaagattgtactattttggagaacggcgaacagataaaaccaatggcactaaatatcagggagtagaaactccttctcagaatagatatgttggatattttgcacaagtgaaacatagctacaactggaatctccctccaagaaaaacactgtttataaaaagattcgttatttattcgattcatggtgttggaacaggcgatggatatgatctaaaagtccaaatagtaatgaagaaaaagattgtcttttcctgtacttccttaaagaattgtcgggtatttcatgacactgaaacagacagggtaataactgatgtgttcaactgtccacctctgtatgatgatgtgaaagtgcaagcttcctcttcagattttcctaaatactatcacaactacccttttttcttctggtttaacacatctttaatacaaaataacgggctttatctacaaagaaatgaattggataatcttcataaacaaaaaacatggaaaatttatcaaccagaatatgcagtagagatatattttaatgagaaatgacttaagttatgttgtaactggtagctgattaagtatagttccctgcaccccttctgggaaagaattatgttctttctaaccctgccacatagttatatgttctaaatcttccttgctggtacatctatattgatatatgtatacacatgttctttataaatctattaaatata

SEQ ID NO: 62014 - DNA, 511 bp, Homo sapiens
ttccttgtgtcttttcctcacaaagtctccaagtctctcgttaaattagctccaggacttgggagaaacagtgcccttcctcggtccgggttgcttggatccccagtggaaaggaagaaccggaactatggtttgtgcctgcctgattgccagtgaaatatttttaactgcagaggtgttggaacaggcgatggatatgatctaaaagtccaaatagtaatgaagaaaaagattgtcttttcctgtacttccttaaagaattgtcgggtatttcatgacactgaaacagacagggtaataactgatgtgttcaactgtccacctctgtatgatgatgtgaaagtgcaagcttcctcttcagctttatctacaaagaaatgaattggataatcttcataaacaaaaaacatggaaaatttatcaaccagaatatgcagtagagatatattttaatgagaaatgacttaagttatgttgtaactggtagctgattaagtatagttccctgcac

SEQ ID NO: 62015 - DNA, 377 bp, Homo sapiens
tggaagctggagaggatgatgaagaagacgacaatggacctgaacataagagatgcgaagaagaggactgctctacactgggcctgtgccaatggccacgcagaagtagtaacactactggtagatagaaaacgccaggttgacgtccttgatggtgaaaacaggacacctctgatgaaggctctgcaatgccagagggaggcttgtgcaaatattctcatagattctggtgctgatccaaatattgtagatgtgtatggcaacacagctgtccattatgctgtttatagtgagaacttgtcagtggtggcaaaattgctgtcctaaggtgcagacatcgaagtgatgaacaagcacagccctcatgcttgccatat

SEQ ID NO: 62016 - DNA, 798 bp, Homo sapiens
atgggccctgagccctgcccagtgcaaggctcattcccgcccaacaaacacaggtgttgctctggtaaggcgttgcccatgtctgtggaggtgcagtcgcgggaagggaaatcgaaactcccagagcaggtggccccagccgacgagggaagagggtcactatttggcccttccagaatctcagggtccggttctcccggaagtttccgggccgccccggaccccattggctttaggggccgcgtctccgagggctccgatttgggccctagattttggaatactgtgttttatattattgataataaggcctctgtaaccatggctagttctgacgtaaaaccaaaatcagtaagtcatgccaaaaaatggtcagaagagatagaaaatctgtacagatttcaacaagcaggatatcgggatgaaaccgaatatagacaagtgaaacaagtttctatggtagatcgttggccggagacaggatatgtgaagaaacttcagagaagggacaatacgttctattactacaacaaacagagggaatgtgatgacaaagaagtccacaaagtgaaaatttatgcttactagcctgtcttctttgtattacttgtcaattatattttaagtattcatcatttccttctacatcatgtgtttgtcatttgatgaaataattcaagatgcagtctgcagtttaatgttttgtgaaacacaaaagccatgagaattggtatctgctaatcaccttgtcctgttctaagaactggctgcagatgcattaaagttgtactttcttgg

SEQ ID NO: 62017 - DNA, 445 bp, Homo sapiens
atggatgtgtttcttgaattgtgtgctccaggaaagtacctgattgacaagatctacatccaatgcccagaaaacacatcctacacaggcacagtgaagcgtggagttgaagaattttccagaaaaccagtttggctattaagggaacctgtcgacacagagcagagcaagataaggccaggtttcagaaagaatagctgtttaccatcaaagcaactgggttccacacagacatggtatattatacacaaagacgaaggatatgggtccactctccgtcaaggaatgttataaatccacgtggtgtccctgggtgtcaggcttggccagaacatctgtggctggagaagccaatgtggctcaggagctccctgctggctgcacatctgaacggcttcaggagtacaagtttccccatcaaaggtttggaataaattacactaaa

SEQ ID NO: 62018 - DNA, 1239 bp, Homo sapiens
atgggctttgtgtctgatttcttgtctgacaaagagaaaaaaaatggcatctattcagaaggcatttatgaggaaactgagccagcagagagacaggaaggagcccacgcagggttacacaggcagttagcagaaacaatatgggaacccaggtctgctcggctgcacagctcaccgtcggacctctcccccaatccccatgggccttgcacctcggatggccgaggggatcctggatttcagcagtcccacgccccttgtgggtttgaagttccttgcgggtttatcttgctttttgttggccagggcagagctaaacccatcccccactttcctgcatctgcagaagccattctgtctgccaaaaaccccgcgttcaaccaggacttccaggaacagcgaagtcacacatttcacacccacatgcaccagataaagcccaagagccagcaactgcatgggtgcctgcaagaccatcaagatgatgcaaatggcctttggagggccctcaagtgggaggcaagagacttgagttcggcagccagatctgaggccatggcaacccagcaagtggacagcagaaggcaggtggcagcagagcaggtggcagcccagctgcttgaacggagaaggggcagccactgtgatgacgagaagcagacgctgttggcattgctgatcttggtgctgtacttgagcacagagatatggggaagcagttgggaggtgtcagaaaggatcagagaatgtaactactaccagaatcttgcagttccccaggggcttgaatatcagaccaacgagccctcagaagaaccgataaagaccatcaggaactggctgaaggagaagttgcatgtcttctcggagaagttagaggaagaggtgcagcagctggagcagctagcgtgggacctggaactgtggctggatgctcttctgggagagccacaccaggaggagcactgctccacatataaaagtcacttgtgggagtgggcctgggccctggggagagagcacaaagacaaagtgcacatcagtggaggtggcatgaagaagttgaaagaaccaggctttgggggtcaaacagacctggtgctagccctgcccctcacccctgcttctccaccatgtgacctcagacaggtggactctacccttctgagtcccattctgctcgcccataaaacgggatatgtctatacatctcccgggcctattgagaggattgtgtaa

SEQ ID NO: 62019 - DNA, 701 bp, Homo sapiens
tctgcccggccccttcgcccacgtgaagaacgccagggagctgtgaggcagtgctgtgtggttcctgccgtccggactctttttcctctactgagattcatctgtgtgaaatatgagttggcgaggaagatcgacctattattggcctagaccaagaccctatgtacagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctgatagccaggaacagggtcacccacagactgggtgtgagtgtgaagatggtcctgatgggcaggagatggacccgccaaatccagaggaggtgaaaacgcctgaagaagagatgaggtctcactgtgttgcccaggcagggtttctctggcttttaatgaacaattgcttcttaaatctttccccacggaaaccttgagtgactgaaataaatatcaaatggcgagagaccgtttagttcctatcatctgtggcatgtaaaaagcaatcacagtgttaaaagaagacacgttgaaatgatgcaggctgctcctatgttggaaatttgttcattaaaattctcccaataaagctttacagccttctgc

SEQ ID NO: 62020 - DNA, 381 bp, Homo sapiens
gcagtgctgtgtggttcctgccgtccggactctttttcctctactgagattcatctgtgtgaaatatgagttggcgaggaagatcgacctattattggcctagaccaagaccctatgtacagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaaggtaaaaagcaatcacagtgttaaaagaagacacgttgaaatgatgcaggctgctcctatgttggaaatttgttcattaaaattctcccaataaagctttacagccttctgc

SEQ ID NO: 62021 - DNA, 554 bp, Homo sapiens
tctgcccggccccttcgcccacgtgaagaacgccagggagctgtgaggcagtgctgtgtggttcctgccgtccggactctttttcctctactgagattcatctgtgtgaaatatgagttggcgaggaagatcgacctattattggcctagaccaagaccctatgtacagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctgatagccaggaacagggtcacccacagactgggtgtgagtgtgaagatggtcctgatgggcaggagatggacccgccaaatccagaggaggtgaaaacgcctgaagaaggtaaaaagcaatcacagtgttaaaagaagacacgttgaaatgatgcaggctgctcctatgttggaaatttgttcattaaaattctcccaataaagctttacagccttctgc

SEQ ID NO: 62022 - DNA, 398 bp, Homo sapiens
aaacttattttctatttgcacacccacacgtattccccagcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctgatagccaggaacagggtcacccacagactgggtgtgagtgtgaagatggtcctgatgggcaggagatggacccgccaaatccagaggaggtgaaaacgcctgaagaaggtaaaaagcaatcacagtgttaaaagaagacacgttgaaatgatgcaggctgctcctatgttggaaatttgttcattaaaattctcccaataaagctttacagccttctgc

SEQ ID NO: 62023 - DNA, 698 bp, Homo sapiens
tctgcccggccccttcgcccacgtgaagaacgccagggagctgtgaggcagtgctgtgtggttcctgccgtccggactctttttcctctactgagattcatctgtgtgaaatatgagttggcgaggaagatcgacctatcggcctagaccaagacgctacgtagagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctgatagccaggaacagggtcacccacagactgggtgtgagtgtgaagatggtcctgatgggcaggagatggacccgccaaatccagaggaggtgaaaacgcctgaagaagagatgaggtctcactgtgttgcccaggcagggtttctctggcttttaatgaacaattgcttcttaaatctttccccacggaaaccttgagtgactgaaataaatatcaaatggcgagagaccgtttagttcctatcatctgtggcatgtgaaaagcaatcacagtgttaaaagaaggcacgttgaaatgatgcaggctgctcctatgttggaaatttgttcattaaaattctcccaataaagctttacagccttctgc

SEQ ID NO: 62024 - DNA, 378 bp, Homo sapiens
gcagtgctgtgtggttcctgccgtccggactctttttcctctactgagattcatctgtgtgaaatatgagttggcgaggaagatcgacctatcggcctagaccaagacgctacgtagagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaaggtgaaaagcaatcacagtgttaaaagaaggcacgttgaaatgatgcaggctgctcctatgttggaaatttgttcattaaaattctcccaataaagctttacagccttctgc

SEQ ID NO: 62025 - DNA, 551 bp, Homo sapiens
tctgcccggccccttcgcccacgtgaagaacgccagggagctgtgaggcagtgctgtgtggttcctgccgtccggactctttttcctctactgagattcatctgtgtgaaatatgagttggcgaggaagatcgacctatcggcctagaccaagacgctacgtagagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctgatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaaggcacgttgaaatgatgcaggctgctcctatgttggaaatttgttcattaaaattctcccaataaagctttacagccttctgc

SEQ ID NO: 62026 - DNA, 398 bp, Homo sapiens
aaacttattttctatttgcacacccacacgtattccccagcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctgatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaaggcacgttgaaatgatgcaggctgctcctatgttggaaatttgttcattaaaattctcccaataaagctttacagccttctgc

SEQ ID NO: 62027 - DNA, 532 bp, Homo sapiens
tctgcccggccccttcgcccacgtgaagaacgccagggagctgtgaggcagtgctgtgtggttcctgccgtccggactctttttcctctattgagattcatctgtgtgaaatatgagttggcgaggaagatcgacctatcggcctagaccaagacgctacgtagagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaaggcacgttgaaatgatgcaggctgctcctatgttggaaatttgttcattaaaattctcccaata

SEQ ID NO: 62028 - DNA, 375 bp, Homo sapiens
aaacttattttctatttgcacacccacacgtattccccagcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaaggcacgttgaaatgatgcaggctgctcctatgttggaaatttgttcattaaaattctccc

SEQ ID NO: 62029 - DNA, 701 bp, Homo sapiens
tctgcccggccccttcgcccacgtgaagaacgccagggagctgtgaggcagtgctgtgtggttcctgccgtccggactctttttcctctactgagattcatctgtgtgaaatatgagttggcgaggaagatcgacctattattggcctagaccaaggcgctatgtacagcctcctgaaatgattgggcctatgcggcccgagcagttcagtgatgaagtggaaccagcaacacctgaagaaggggaaccagcaactcaatgtcaggatcctgcagctgctcaggagggagaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaagagatgaggtctcactgtgttgcccaggcagggtttctctggcttttaatgaacaattgcttcttaaaactttccccacggaaaccttgagtgactgaaataaatatcaaatggcgagagaccgtttagttcgtatcatctgtggcatgtgaaaagcaatcacagtgttaaaagaagacacgttgaaatgatgcaggctgctcctatgttggaaatttgttcattaaaattctcccaataaagctttacagccttctgc

SEQ ID NO: 62030 - DNA, 381 bp, Homo sapiens
gcagtgctgtgtggttcctgccgtccggactctttttcctctactgagattcatctgtgtgaaatatgagttggcgaggaagatcgacctattattggcctagaccaaggcgctatgtacagcctcctgaaatgattgggcctatgcggcccgagcagttcagtgatgaagtggaaccagcaacacctgaagaaggggaaccagcaactcaatgtcaggatcctgcagctgctcaggagggagaggatgagggagcatctgcaggtcaaggtgaaaagcaatcacagtgttaaaagaagacacgttgaaatgatgcaggctgctcctatgttggaaatttgttcattaaaattctcccaataaagctttacagccttctgc

SEQ ID NO: 62031 - DNA, 554 bp, Homo sapiens
tctgcccggccccttcgcccacgtgaagaacgccagggagctgtgaggcagtgctgtgtggttcctgccgtccggactctttttcctctactgagattcatctgtgtgaaatatgagttggcgaggaagatcgacctattattggcctagaccaaggcgctatgtacagcctcctgaaatgattgggcctatgcggcccgagcagttcagtgatgaagtggaaccagcaacacctgaagaaggggaaccagcaactcaatgtcaggatcctgcagctgctcaggagggagaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaagacacgttgaaatgatgcaggctgctcctatgttggaaatttgttcattaaaattctcccaataaagctttacagccttctgc

SEQ ID NO: 62032 - DNA, 398 bp, Homo sapiens
aaacttattttctatttgcacacccacacgtattccccagcccgagcagttcagtgatgaagtggaaccagcaacacctgaagaaggggaaccagcaactcaatgtcaggatcctgcagctgctcaggagggagaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaagacacgttgaaatgatgcaggctgctcctatgttggaaatttgttcattaaaattctcccaataaagctttacagccttctgc

SEQ ID NO: 62033 - DNA, 701 bp, Homo sapiens; identical to SEQ ID NO: 62029

SEQ ID NO: 62034 - DNA, 381 bp, Homo sapiens; identical to SEQ ID NO: 62030

SEQ ID NO: 62035 - DNA, 554 bp, Homo sapiens; identical to SEQ ID NO: 62031

SEQ ID NO: 62036 - DNA, 398 bp, Homo sapiens
aaacttattttttatttgcacacccacacgtattccccagcccgagcagttcagtgatgaagtggaaccagcaacacctgaagaaggggaaccagcaactcaatgtcaggatcctgcagctgctcaggagggagaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaagacacgttgaaatgatgcaggctgctcctatgttggaaatttgttcattaaaattctcccaataaagctttacagccttctgc

SEQ ID NO: 62037 - DNA, 701 bp, Homo sapiens; identical to SEQ ID NO: 62029

SEQ ID NO: 62038 - DNA, 381 bp, Homo sapiens; identical to SEQ ID NO: 62030

SEQ ID NO: 62039 - DNA, 554 bp, Homo sapiens; identical to SEQ ID NO: 62031

SEQ ID NO: 62040 - DNA, 398 bp, Homo sapiens; identical to SEQ ID NO: 62032

SEQ ID NO: 62041 - DNA, 701 bp, Homo sapiens
tctgcccggccccttcgcccacgtgaagaacgccagggagctgtgaggcagtgctgtgtggttcctgccgtccggactctttttcctctactgagattcatctgtgtgaaatatgagttggcgaggaagatcgacctattattggcctagaccaaggcgctatgtacagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaagagatgaggtctcactgtgttgcccaggcagggtttctctggcttttaatgaacaattgcttcttaaaactttccccacggaaaccttgagtgactgaaataaatatcaaatggcgagagaccgtttagttcgtatcatctgtggcatgtgaaaagcaatcacagtgttaaaagaagacacgttgaaatgatgcaggctgctcctatgttggaaatttgttcattaaaattctcccaataaagctttacagccttctgc

SEQ ID NO: 62042 - DNA, 381 bp, Homo sapiens
gcagtgctgtgtggttcctgccgtccggactctttttcctctactgagattcatctgtgtgaaatatgagttggcgaggaagatcgacctattattggcctagaccaaggcgctatgtacagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaaggtgaaaagcaatcacagtgttaaaagaagacacgttgaaatgatgcaggctgctcctatgttggaaatttgttcattaaaattctcccaataaagctttacagccttctgc

SEQ ID NO: 62043 - DNA, 554 bp, Homo sapiens
tctgcccggccccttcgcccacgtgaagaacgccagggagctgtgaggcagtgctgtgtggttcctgccgtccggactctttttcctctactgagattcatctgtgtgaaatatgagttggcgaggaagatcgacctattattggcctagaccaaggcgctatgtacagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaagacacgttgaaatgatgcaggctgctcctatgttggaaatttgttcattaaaattctcccaataaagctttacagccttctgc

SEQ ID NO: 62044 - DNA, 398 bp, Homo sapiens
aaacttattttctatttgcacacccacacgtattccccagcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaagacacgttgaaatgatgcaggctgctcctatgttggaaatttgttcattaaaattctcccaataaagctttacagccttctgc

SEQ ID NO: 62045 - DNA, 701 bp, Homo sapiens
tctgcccggccccttcgcccacgtgaagaacgccagggagctgtgaggcagtgctgtgtggttcctgccgtccggactctttttcctctactgagattcatctgtgtgaaatatgagttggcgaggaagatcgacctattattggcctagaccaaggcgctatgtacagcctcctgaaatgattgggcctatgcggcccgagcagttcagtgatgaagtggaaccagcaacacctgaagaaggggaaccagcaactcaatgtcaggatcctgcagctgctcagaagggagaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaagagatgaggtctcactgtgttgcccaggcagggtttctctggcttttaatgaacaattgcttcttaaaactttccccacggaaaccttgagtgactgaaataaatatcaaatggcgagagaccgtttagttcgtatcatctgtggcatgtgaaaagcaatcacagtgttaaaagaagacacgttgaaatgatgcaggctgctcctatgttggaaatttgttcattaaaattctcccaataaagctttacagccttctgc

SEQ ID NO: 62046 - DNA, 381 bp, Homo sapiens
gcagtgctgtgtggttcctgccgtccggactctttttcctctactgagattcatctgtgtgaaatatgagttggcgaggaagatcgacctattattggcctagaccaaggcgctatgtacagcctcctgaaatgattgggcctatgcggcccgagcagttcagtgatgaagtggaaccagcaacacctgaagaaggggaaccagcaactcaatgtcaggatcctgcagctgctcagaagggagaggatgagggagcatctgcaggtcaaggtgaaaagcaatcacagtgttaaaagaagacacgttgaaatgatgcaggctgctcctatgttggaaatttgttcattaaaattctcccaataaagctttacagccttctgc

SEQ ID NO: 62047 - DNA, 554 bp, Homo sapiens
tctgcccggccccttcgcccacgtgaagaacgccagggagctgtgaggcagtgctgtgtggttcctgccgtccggactctttttcctctactgagattcatctgtgtgaaatatgagttggcgaggaagatcgacctattattggcctagaccaaggcgctatgtacagcctcctgaaatgattgggcctatgcggcccgagcagttcagtgatgaagtggaaccagcaacacctgaagaaggggaaccagcaactcaatgtcaggatcctgcagctgctcagaagggagaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaagacacgttgaaatgatgcaggctgctcctatgttggaaatttgttcattaaaattctcccaataaagctttacagccttctgc

SEQ ID NO: 62048 - DNA, 398 bp, Homo sapiens
aaacttattttttatttgcacacccacacgtattccccagcccgagcagttcagtgatgaagtggaaccagcaacacctgaagaaggggaaccagcaactcaatgtcaggatcctgcagctgctcagaagggagaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaagacacgttgaaatgatgcaggctgctcctatgttggaaatttgttcattaaaattctcccaataaagctttacagccttctgc

SEQ ID NO: 62049 - DNA, 1608 bp, Homo sapiens
tgcgcactcgccacagagggctgaaggtgctgctaatggctctcttggcgttgcgacgtcctggtcagcagttttcttccattctctccctccatttcttgagtgagcagccatgagttggactgtgtctgttgtgcaggccagccggagagtgagctcggcaggagcgaatttcctgtccctgtgtcccagtcaggcagcgcgcatgccgctcaagggcgcctggctcttcacccccgtgaagagtgagcttgttgagcgcttcacttccgaggagcccgctcatcacagtaaggtctccatcataggaactggatcggtgggcatggcctgcgctaccagcatcttattaaaaggcttgagtgatgaacttgcccttgtggatcttgatgaaggcaaactgaagggtgagacaatggatcttcaacatggcagccctttcatgaaaacgccaaatattgtttgtagcaaagattaccttgtcacagcaaactccagcctagtgattatcacagaaggtgcacgtcaagaaaagggagaaacgcgccttaatttagtccagcgaaatgtggccatcttcaagttaatgatttccggtattgtccagtacagccccctctgcaagctgattattgtttccaatccagtggataacttaacttatgtagcctggaagttgagtgcattttccaaaaaccgtgttattggaagcggctgtaatctggatactgctcgtttttgtttcttgtttggacaaaagcttggtatccactctgaaaactgccacggatggatcctaggagagcatggagactcaagtgttcctgtatggagtggagtgaacatagctggtgtcgctttgaagaatctgaactctgatacaggaactgataaagatcctgaacaatggaaaaatgtccacaagtgattgctagtgcctatgagattattaaaatgaaaggttatacttcatgggccattggcctatctgtagctgatttaacagaaagtattttgaagaatcttaggagaacacatccagtttccaccatcattaggggtctctgtggaatagatgaagaagtattcctcaatattccttgtgtcctgggaaagctgacccctgaagaggaggcccccctgaaagagagtgcaaaaacactttgagaaattcagaaggaactgaagctttaaagttgtctaaaactaccattctgaaattattgaagagatcatagatatagggttatatatcaaaattttgaataaacttaaattcctaaaatatggaaacaggaaagtggataaaatgacttacctatttatttagtcctccagctcttttatttagcatccaggtgctgggtgatacttatttacaattcctaaagaaagtgtttttggtacccctgatgtagcagcacttgccttgttatatatgtagttggcatttggttcccaaaaagtaggatgtaagtatttattgtgttctagatattctgattattttcattagatacatgctttcttcttgctggcttatacctatgttcatttatatgctgtaaaaaagtggtaacttcctctacaatgtaaaaataaaagtat

SEQ ID NO: 62050 - DNA, 698 bp, Homo sapiens
tctgcccggccccttcgcccacgtgaagaacgccagggagctgtgaggcagtgctgtgtggttcctgccgtccggactctttttcctctactgagattcatctgtgtgaaatatgagttggcgaggaagatcgacctatcggcctagaccaagacgctacgtagagcctcctgaaatgattgggcctatgcggcccgagcagttcagtgatgaagtggaaccagcaacacctgaagaaggggaaccagcaactcaacgtcaggatcctgcagctgctcaggagggacaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaagagatgaggtctcactgtgttgcccaggcagggtttctctggcttttaatgaacaattgcttcttaaatctttccccacggaaaccttgagtgactgaaataaatatcaaatggcgagagaccgtttagttcgtatcatctgtggcatgtgaaaagcaatcacagtgttaaaagaagacacgttgaaatgatgcaggctgctcctatgttggaaatttgttcattaaaattctcccaataaagctttacagccttctgc

SEQ ID NO: 62051 - DNA, 378 bp, Homo sapiens
gcagtgctgtgtggttcctgccgtccggactctttttcctctactgagattcatctgtgtgaaatatgagttggcgaggaagatcgacctatcggcctagaccaagacgctacgtagagcctcctgaaatgattgggcctatgcggcccgagcagttcagtgatgaagtggaaccagcaacacctgaagaaggggaaccagcaactcaacgtcaggatcctgcagctgctcaggagggacaggatgagggagcatctgcaggtcaaggtgaaaagcaatcacagtgttaaaagaagacacgttgaaatgatgcaggctgctcctatgttggaaatttgttcattaaaattctcccaataaagctttacagccttctgc

SEQ ID NO: 62052 - DNA, 551 bp, Homo sapiens
tctgcccggccccttcgcccacgtgaagaacgccagggagctgtgaggcagtgctgtgtggttcctgccgtccggactctttttcctctactgagattcatctgtgtgaaatatgagttggcgaggaagatcgacctatcggcctagaccaagacgctacgtagagcctcctgaaatgattgggcctatgcggcccgagcagttcagtgatgaagtggaaccagcaacacctgaagaaggggaaccagcaactcaacgtcaggatcctgcagctgctcaggagggacaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaagacacgttgaaatgatgcaggctgctcctatgttggaaatttgttcattaaaattctcccaataaagctttacagccttctgc

SEQ ID NO: 62053 - DNA, 398 bp, Homo sapiens
aaacttattttttatttgcacacccacacgtattccccagcccgagcagttcagtgatgaagtggaaccagcaacacctgaagaaggggaaccagcaactcaacgtcaggatcctgcagctgctcaggagggacaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaagacacgttgaaatgatgcaggctgctcctatgttggaaatttgttcattaaaattctcccaataaagctttacagccttctgc

SEQ ID NO: 62054 - DNA, 1608 bp, Homo sapiens; identical to SEQ ID NO: 62049

SEQ ID NO: 62055 - DNA, 717 bp, Homo sapiens
atgtttctacagtttgctttaggaaaagttgctatccttgctcatttcacgtattttggaaagaatctgtcctttgccaaaggctctagcttccgaagagctgacaacaaactctgggagttgacaagctcctgggggaaaaccagcagacgcgcgaagcgtcgggcccacccggcggcgccgcaggccgtgcaccgccacccccggaccctcccccgcagccgcccgggctgcagcagccgccggatccgccgctgcggccgcctcttaagcgccgcagagccccagagggtgtggattctgcaatgctgcacagaaacctactgcagcctcagaccaacagcagcagcagcagcggcggcggcggcagcagcagcagcagcattagcagcagcagcttctctcaatgctgagtattgaatacagataatcatgaggcccaagaccctaaggaacagtgcagccaggagtcggaaggagcctgggtttctgaatcatcacatggaggggagctgtcttcagctgggagagctgtcttcagttggatactggtggccgtttgggcatcctgggccagcccaaggacatcttccagtggccgtttgggcatcctgggtggtagcaggtatctccattgcactctatttgccacctcaccctgaaggaagacatgcgctctggaaccgtgagccatttgggaggtgcaagaggattcca

SEQ ID NO: 62056 - DNA, 599 bp, Homo sapiens
atggagacgcggccggtcccgcctccctcccagcccggaagatggggagcggggacaggcgacgcggacgaagcgggaggagccactggcagcctttgccaacgaggggccgcttcggccaatcactgctcgggaagcgagggggcggggactgggcagggcctgagcgggttctgtgcctggctgcccaccggctctctgacctggacctcgccgtcgctggcccctgaaatccatcacttttgtcggctgttctgtgacgccacaacgaggagccacctgggctctgctgacccttcgggattcgcggctagctgtgatgtgtccgccaagatctcttctcttgtctgtaaacaacttcactctcaaggaggcagctctggcctctcagcaggagctggggaggagtgactgaataactataggatttggtcttgatgggagaatcccagaagccaaatccacgcggtgaataagctgctgatcttccagagcacacatcccctagagattcttcccaatgctaatatgaaaggttacaaccataacccatcatcaggcccaaatatattacttactgaataaatacacaagttaca

SEQ ID NO: 62057 - DNA, 2036 bp, Homo sapiens
gccacgccccttttccgcattctagtgcagccctggtgacgcctcctgtggctcagtcacatagctgtgtggtacatgactggaggcatatcactgtcctcgcctggatcacgccaatgtgaccccaaccccacctccctccccaccccatgatgtccgaaaaaacccaacaaagaaaattggctgggaccaagagaaagttcacagactatcatcagtggaacagtgctggtgttggtactggagcaaccgacaccaaaaagaagaaaataaataatggcactaaccctcagacaaccacttctggggggttgccattcacctgaggataaacaacagaaccgagctcagctgaaagaggaaaagaaggcaagccaccaacatcagcaagccctaaggaggcagctagaggcccaggatcataccatacgaatccttaagtgtcagaaaactgaactggaaacagtgctccatgacagccaggatgctgccaggaaatttgaagaagattccaaggatctggcaggccgcctgcatcattcctggtactttgcaggagagttacagcgggctctctctgctatgtccgcagagcacaagagggtggacaggtacatcgaggagttaacaaaggagagggaagccctgagtctggagctgcacaggaacatgtaggatgggggagcgggggatgggaggtctgagagcccttagcatgggtggtgtgctgggaggtggtgggtacaggtgagcatgctagggggtcatacaggtttacatgtgtgcgcagggaagctccagtgatggctgtgccactgactcatggggtagcctcaggcaactcacgtcttctctctggcctgccacctgggacttttaattcctggggtctcttccaatgccacggttctgtggttgtggggcgagggtagagggtcgatcaccaaagcggtcctttctgttctttgctcattcctttctctactgcctctggccatagcataaccaatgaggagctgaaggagaaaaatgccgaactacaagaaaaacttcgactggtagaaactgaaaagtctgagatccagctccacatcaaggagctaaaaaggaaactggagacggacaaaatcccgctgccacaggttcaaaccaacactttgcaggagaagatgtggaggcagcaggaggagctacgggatcaggagaagctacggaagcacgaggagaagatgtggagacaggagcagaggctgcgggaccaggagaaggagctgcgggagcaggagagcagatgcggaagcaggaggagcaaatggcggagcaggaggaacagatgcagaagcaggaggagcaggtgcgaaagcaggaggagcaggtgcggaagcaggaagagcagatgcggaagcaggaggagcagatgcggaagcaggaggagcacatgcggaagcaggaggagcagatgcggaagcaggaggagcagatgcggaagcgggaggagcaggtgcggaagcgggaggagcagatcacgcagctgccccctggaatgaagaacacccaggagcacccaggcttaggcagcacctcctgcatcctattcttctaccgaggagacaagaaaaagatcaagatcatcaatatctaaaaagaacggtcaacaaggcctacagaagtgtaagccgccacgtgaccttgtgaatacagtctgagaacaaacttgaaaaaaagaaaatttattttaaattgtggcaaaatactggccgggcatggcggcctgcacctgtaatcacaccactttgggaggcctaggcgggtggatcaccaatcctaggtacgtgggaggctgaggttgcagtgagctgagatcacaccactgcactccagtctgggtgacagagtgaaactcccatttcaaaaaaaaaaaaaaaaaaatttctacctgaggactctaatatctatgtatgtttctattgttttttttgtttgttttctcctttcgtcttgtcttgtcttatggcatgcctagtaaagttttatct

SEQ ID NO: 62058 - DNA, 667 bp, Homo sapiens
gccatcatctatgctgatggaggcacgtgtggatctcatcgacctggacttgtgtaactcgacccagtggtacaatgagcacgttcagccaaccaatgtgtgcgcggggtatcctgtaggcaagatcgacacctgccagggggacagcggcgggcctctcatgtgcaaagacagcaaggaaagcgcctgtgtggtcgtgggaatcacaagctggggggtaggctgtgcccgtgccaagcgccccggaatctacacggccacctggccctatctgaactggatcgcctccaagattggttctaacgctttgcgactttcttttgccaagcgcctacagcagctcatagaggtcttgaaggggaagacctattccgacggaaagaaccattatgacatggagaccacagagctcccagaactgacctcgacctcctgatctgacctggttctcaacagacccagtgagcccttcactcctgagaaaaaggaaagatgaaataaataaataaacatatatatatagatatacacacacacatatccgtatgtatacatgcatatacatcaagagatgctttctggacttcttcctatcccccctcccaacccaaatttcccctataaaatctaccctctctccttcaccctacaataaggcagaattgct

SEQ ID NO: 62059 - DNA, 1023 bp, Homo sapiens
atggcagctgctgaagacgagttcctgccgccgccgcggctccccgagctgttcgattccagcaaacagcttctggacgaagtcgaaggagcgactgaacccaccggttcccgaatagtccaggaaaaggtgttcaagggcctcgacctccttgacaaggttgccaaaatgttatcgcagcttgacttgttcagccgaaatgaagatttggaggagattacttccaccgacctgaagtacctgatggtgccagcgtttcaaggagccctcaccatgaaacaagtcaacccccgtaagcgtctagatcatttgcagcaggctcgcgaacactttataaaatacttaactcagtgccattactatcgtgtggccgagtttgagctgccccaaaccaagaccaactcagctgaaaatcacggtgctattacctccacggcttatcctagcctcgttgctatggcatctcaaagacaggctaaaatagagcgatacaagcagaagaaggtgttggagcataagttgtctacaatgaaatctgctgtggaaagtggtcaagcagataatgagcgtgttcgtgaatattatcttcttcaccttcagaggtggattgatatcagcttagaagagattgagagcattgatcaggaaataaagatcctgggagagaaagactcttcaagagaggcatccacttctaactcatgtcaccagaagaggcctccaatgaaacccttcattctcactcggaacatggcgcaagccaaagtatttggcgctggctatccaagtctggcttccatgacagtgagtgactggtatgatcaacatcagaaacatggagtgttaccagatcagggaatagccaaggcaacaccagaagaattcagaaaagccactcagcaacaggaagatcaagaaaaggaggaagaggatgatgaacaaacactccaaagagctcgagagtgggatgactggaaggacacccaccctaggggctacggcaaccgacagaacatgggctaa

SEQ ID NO: 62060 - DNA, 1813 bp, Homo sapiens
gttaggctgctggggctgtgggtgccatcttgtcaccttggaggaagagcccacctgagaacgacatcaactcagagggaagtcagcagagccaagaggccgggagaggtgattcccggtgacatcatctggctcctgggtgcagccatggtagagttggcctcgaacgttgtccctggcatggaggtgaccagaggtcaccctcacatgtcagcagacacctccagctgtgtcattcttgcttcttgttggcaaagtttgtaggggtagtattctcagttggcattcctagctgagatgtgtagctgggaggtcaccacgccgcagggccttgggaccagttctgcctccgaggagtcccttactgatgatcataggctcctcaaggtcatcagccagggcagctttgcagaagtcaaggcagctggcccagcacattctcactgggaccaagatggctgtggaggtcaccccaacagggcagcagggctcctgcagcccccaggatctgtactgcagggtccatatgatgaaggcccttaatcacccgaagatcatcagacccacgtggctggcaccgagaacaggctgttcctagtcatggattaagccagctcgggagagctatccgacttcaccctccaattctccttgaagggggaagaggcctgaggcaagttccagcaaataggatattccatgcagtgaggcttccagaaggaaattatccacagggatctgaagccagagaacttccctgaggaggctcagcacgacatggaaacaacagactctggctttgataccagattcaccgtaggctgaaagctgatccccttcggtgggagctcctcttacgcagcctcggaactgttcccggaggcaaaagtacgatggactccggtgggcgtgtggagcctgggagtcactgtctacaccatggtggccgaggactgccatctgttgggcagacttttgtggggctgaggaggacactaatactctgtgaacgatgacaggagatcccgtttctcatttccatagaactagaacgcctcataaacacaattctggcccttgactccagggagaggccctcactagaccacatcatggggcgcccatgcgttaacatgggtcaggaggagacataaataaggccatactgggagctgctccccgatcacccggcgtctggaaagctctcgtggtgtccccgggagatgaggccaaccacgtcccatccttgtaggaacaaaaatgtaggaacaaaaatttttagtagagacggggtttctccattttggtcagggtggtctcgaactcctgaccacaggtgatccactcgcctcggcctcccaaagtgctgggattacaggcgtgaaccactgcgcccggcccacaacatggatttttcttactataaacatcaagctacacttgccacagtcttttaccgctgtggtctcatttgtctccaccagagggagaaaggagactcaataaaaactgcatggttctcggccgggcatggtgcctcacgcctgtaatcccagcactttgggaggccgaggcgggtggatcactgacgtcaggagttcgagaccagaccagcctggccaacatggtgaaaccctgtctctacaactactactactaataataataatacaaaaattagctggacgtggtggtgtgcacctgtgatcccagctactcgggaggctgaggcaggagaatcacttgaacccgggaggcaaaggttacagtgatccgaaatcacaccattacactccagccttgggcaacactc

SEQ ID NO: 62061 - DNA, 3165 bp, Homo sapiens
acagcagccttgtaggtgactggaggtgttcgctgatgtggccccaaccctacctccctcccgaccccatgatgccagaagaaactcgatggaacaaattggcagcagtcaagaaaaagctaaaagaatatcagcaaaggaagagccctggtgttccagcaggagcaaagacaaaaaagaaaaaaactggcagtagccctgagacaaccacttctggtggttgccactcacctggggatagccagtaccaagaactagcagtagccctggagtcaagctccgtgacaatcaatcaactcaatgaaaacatagaatcattgaaacagcagaagaaacaagtggaacatcagctggaagaagcaaagaaagcaaacaatgaaatacacaaagcacaaacagagcagttagagacaatcaacatcctcacattggaaaaggcagacttgaagaccaccctttaccatactaaacgtgctgcccgacacttcgaagaagagtccaaggatctggctggccgcctgcaatacgccttgcagcgtattcaagaattggagcgggctctctgtgctgtgtctacacagcagcaggaagaggacaggtcctcgagctgcagagaagcggtcctccagtggcggttacagcagaccataaaggagcaggcactgctgaacgcacacgtgacacaggtgacagagtcactaaaacaagtccagctagagcaggacgaatatgctaaacacataaaaggagagagggcccggtggcaggagaggatgtggaaaatgtcggtggaggctcgaacattaaaggaagagaagaagcgtgacatacatcggatacaggagctgaagaggagcttgtccgaactcaaaaaccagatggctgagcccctatccctggcgcccccagcagtgacctctgtggtggaacagctacaagatgaggccaaacacctgaggcaggaggtggaaggtctggagggaaagctccaatcccaggtggaaaacaatcaggccttgagtgtcctgagcaaggaacaaaagcagagactccaggagcaggaggagatgctccgagagcaggaggcgcagagggtgcgggagctggagagactgtgtgaacaaaacgagaggcttcgggagcagcagaagatgctacaggagcagggtgagaggctgcaaaagcaggagcagaggctacgcaagcaggaggagaggctgcaaaaggaggaggagaggctgcaaaagcaggaaaagaggctgtgggaccaggaggagaggctgtggaagaaggaggacaggctacaaaagcaggaggagaggctcgtgctcttccagaaccacaagctcgacaagcagctggccgagccacagtgcagcttcgaggatctgaacaatgagaaaaagagcgcactgcagttggagcagcaagtaaaggagctgcaggagaagctagacgaggagcacctagaagctgccagccagcggaaccaacagctagagacccggttgagcctcgtggctctccctggagaaggagatggaggagaacatctggacagtgaggaggaggaggcgcctcggcccacgccaaacatcccagaggacctggagagccgggaggccacgagcagctttacggacctcccgaaggagaaggcagatgggacggagcaggtggagagacgagagcttggattcgtccagccttctggagtgacagatggcatgagagagtccttcaccgtatatgaaagccagggggcagtgccaaacacgtggcaccaggagatggaagatgtcatcaggctggcccagaaggaggaggagatgaaggtgaatctgctggagctgcaagagctggtgttgccccttgtgggcaaccatgaggggcatggcaaattcctcaccgctgcccagaaccctgctgatgagcccactccagggcccccagccccccaggaactgggggctgccggtgagcaggatgatttttatgaagtgagcctggacaacaatgtggagcctgcaccaggagcggccagggagggttctccccatgacaaccccactgcacagcagatcgtgcagctgtctcctgtaatgcaggacacctaggagcacccaggcttgcccagcaaaccctgcgtgccattcttttaccaggcagccgagaacagggagataaacatcatcatcttctaagagctggtcaagaaatttaaaacaacaacaacaacaaaaagttacagggttcatctcctacacaattcatttactccatttgaatgctagagccactcacatttatttgtgtttctaatttaccgtttaaatttatttgtaaaaagttaagggagagttggtctttccctgatgttctttctggcatcctttagcatttttattttttacttgataattgtaggtcattagcacgcatatcgagtttgcccttaggtggtgggaattcatacacacaaagacccactatttgcacaaaactattcttgctggtttggaacaggctgccatgctttttaaatgttattgcagcacatatattcattacagaattcagataaaatgtgcttatgttctgctattacgtttgattgaatcctaaccacagtgagctcttcattagctcaatatgtggtttgccctcaagtgcgcactgtttattactttgtaatatgccactgtgagtactgacatttagagttgtttaaaggccgagaactggaaacagcctttcccctattttctgtgtattggggatgggagtcataacattttggggagctttttaaatctcacagaagaggaaagtggcctgctctggcaggtgtgtgcaggatacagtgtgtttcatttgttctggtgccaagaatgagcactgtactatggtagttcccttaggatttgtgtgtgctctgggcttatgaagatattgcatcatgagctgcagcagttgtaccctttctcgatgacctaaaaagggattatttctgaggaatgaaaggctcccatcattgactgtggatgtggaaaaccttttctagcgtagagcatttatatctacaatacattttaaagtcagagttcatgttacctgttttaatcacatgagtatatgtcccagtacacaaaagggcaccggttg

SEQ ID NO: 62062 - DNA, 1801 bp, Homo sapiens
atggaggcaaaccaagagcctgtgtcccgattggttaaagctcaggcacctcgccccacaaagggcgtgctggttggcagacggggaccaatgagaaggctcggcgccggcgtcaagggcgcgaggaagccactcgctgtcccggacatctgctgggcttggctgggctcagctctccgctcccgccgttaccaggacgaccgtctccccgcagcccaggctgcccggactggcgccatgagctcccccgacaaggtgtccgtttgtggggccggtttcgacctggagggtggcaaaaaggctggctcccgcacggccagccccggagccccaggggcccacagccacggcctcgatttgggggtgccgggcagcggcgatggcaagagcgagagcgggttcacagatccagagggcttcagcttcgagtctgagagcgaattgatagagcaaggaagggtggtgctctggggccgggaaggccggccaggcaccccggtggatgaccaaggggacgttgtggactactcattctacctggctgacgaaccagccgccatcgtgccgccgcccagcgtccagggacacccgttcccagaaggtgccgctgccgaagggtcggctgagaattgggcagatgcggaggtcggtcccagtgggagagacgtgctgggccacagccctggaaaatggcagcaggcctctgccggccgtctccacctctgcggtcctgggccagtgcgggcctggaagaacccggaaaggggctcgaagagcagatggagcctccgcgtggatccccagcagccctctgcgaaaggccccaccaggctgcctacccacgactctgattccgcagatgagagcagcgacttaccactgatgaaggtaggcatttgccgcaacgaaggaagccaggccaagcccggcagccccaagaagcgagcagacacatccagacaggcaagcttccactgcaaggagagttacctgcctgtgccgggccgtttcctgacctctgctccccgcggactcactccagtcgcagagaggccggctgtgggagagctggaggactctccccagaagaaaatgcagagcagggcctggggaaaggtggaggggatgtccaagaaaccccaaaagcctaagcacagcagccctgggaagaaaccagcagggaggaagaccagggagtcccaggctgcggccagagaagataatgacccaaatagagatgaggtcccaagagcccaagtgagccaggactgcctcgcctgtctgtgcgtcgtggagaattcagcagtagcgaccccaacatcagagctccccaacttccgggaacttcagagccctcggcctacagcccgggaggcctcgtgcccagacgccatgcaccctccgacaccactaggccctttccacctcactgggaggcttggaagctggattttgtgttctctttcaggtaaccagcagccgcctgtccatcccccaagaccggaaaggcagcagcagcccccgggagcccagggctgtcctcggtgcatctggctgcagagggaaattgaggaccttacacagcagctagcggccatgcagttcctcactgacaagttccaggacctttgaagttggagccagcatcttcctacaagatgaacagctgccacctttggagctccggagctgcagccaagcgggttccctccatatcctgttcagccagggcttcctctcttccgctgcatttgcccccttcccaacgcagttcaaagcaatttgaaataaagtcgttctc

SEQ ID NO: 62063 - DNA, 1825 bp, Homo sapiens
atggaggcaaaccaagagcctgtgtcccgattggttaaagctcaggcacctcgccccacaaagggcgtgctggttggcagacggggaccaatgagaaggctcggcgccggcgtcaagggcgcgaggaagccactcgctgtcccggacatctggtacttccgcctggggcgagggcgctgggcttggctgggctcagctctccgctcccgccgttaccaggacgaccgtctccccgcagcccaggctgcccggactggcgccatgagctcccccgacaaggtgtccgtttgtggggccggtttcgacctggagggtggcaaaaaggctggctcccgcacggccagccccggagccccaggggcccacagccacggcctcgatttgggggtgccgggcagcggcgatggcaagagcgagagcgggttcacagatccagagggcttcagcttcgagtctgagagcgaattgatagagcaaggaagggtggtgctctggggccgggaaggccggccaggcaccccggtggatgaccaaggggacgttgtggactactcattctacctggctgacgaaccagccgccatcgtgccgccgcccagcgtccagggacacccgttcccagaaggtgccgctgccgaagggtcggctgagaattgggcagatgcggaggtcggtcccagtgggagagacgtgctgggccacagccctggaaaatggcagcaggcctctgccggccgtctccacctctgcggtcctgggccagtgcgggcctggaagaacccggaaaggggctcgaagagcagatggagcctccgcgtggatccccagcagccctctgcgaaaggccccaccaggctgcctacccacgactctgattccgcagatgagagcagcgacttaccactgatgaaggtaggcatttgccgcaacgaaggaagccaggccaagcccggcagccccaagaagcgagcagacacatccagacaggcaagcttccactgcaaggagagttacctgcctgtgccgggccgtttcctgacctctgctccccgcggactcactccagtcgcagagaggccggctgtgggagagctggaggactctccccagaagaaaatgcagagcagggcctggggaaaggtggaggggatgtccaagaaaccccaaaagcctaagcacagcagccctgggaagaaaccagcagggaggaagaccagggagtcccaggctgcggccagagaagataatgacccaaatagagatgaggtcccaagagcccaagtgagccaggactgcctcgcctgtctgtgcgtcgtggagaattcagcagtagcgaccccaacatcagagctccccaacttccgggaacttcagagccctcggcctacagcccgggaggcctcgtgcccagacgccatgcaccctccgacaccactaggccctttccacctcactgggaggcttggaagctggattttgtgttctctttcaggtaaccagcagccgcctgtccatcccccaagaccggaaaggcagcagcagcccccgggagcccagggctgtcctcggtgcatctggctgcagagggaaattgaggaccttacacagcagctagcggccatgcagttcctcactgacaagttccaggacctttgaagttggagccagcatcttcctacaagatgaacagctgccacctttggagctccggagctgcagccaagcgggttccctccatatcctgttcagccagggcttcctctcttccgctgcatttgcccccttcccaacgcagttcaaagcaatttgaaataaagtcgttctc

SEQ ID NO: 62064 - DNA, 441 bp, Homo sapiens; identical to SEQ ID NO: 61931

SEQ ID NO: 62065 - DNA, 4467 bp, Homo sapiens
tagaaagcaatgcgcctattcacatggagaatcttccctttcctctaaaattacttagtgcctcatcactaaacacccccagctccacaccatgggtgttggatatcttcctcaccttggtgtttgccctggggttcttcttcctattactcccctacttctcttacctccgttgtgacaacccaccctcaccatcgcctaggaagagaaagaagacaaaaacattgtgtgggaaagccggagttgaggacgaacgagattctgaaaataaaaatccctggtacatagccaaaatttcagagtcaactacagattttcaaaggctatgaaataggtaacctcaagccaccgactccaatagataaaaggaaccagttccacctttccaaatccagtggagacttctgcgatgggaagtctcaggagagaccagaacagcatgcttccagggagaggcagggcagccaggggctgcagtgaaatggagcgataccggctcagtgccacctttgcttccagagttcaagctattctcctgtcttagcgtcctgagtagctggggattacaggcgcccgccaccacgcctggctaatttttgtatttttagtagagatggggtttcaccatggctaggctggtctcaaactcttgacctcaggtgatccacctgcctcagcctcccaaagtgctgggattataggcgtgagccaccgcaccgtgagccactgcacccgaccccctcttcctgtttttctaagaaaagcagtttatcatccatttaaacatgagtgggaggggaggaagcacacagagctccctgagcaagacagacagagccatgcggttcatgagtgcagcgtgctgcggctgggctgggggcagagagggagagccggtcctagctcctcgccatttcttgtctcccagcgtcatcttgtctcccagcgtccagcagggcggagggggaggcccagaggcaggatgaaaaaccacagtctgagagcttgtagagagtgcccgagaggcctggaggagacttgggacctgctttcacaactgcagagcctcctggggccacaccttgaaaaaggtgactttggtcagctctctggtccagacccgccaggtgaggtgggcaaaagaacacctgatggagcctcccggtcctctcatgagcctacggaagacgctgctcccattgtctccccgttagcttccccggatcctcgaaccaagcatcctcaggatctggcctccaccccaccaccaggcccaatgaccacctcagtctcctccctaagtgcctcccagccaccagaaccttcccttctcctagaacatccctcacccgagccacctgcacttttccctcacccaccacgcactcctgatcctctggcctgctctccgcctcctccgaaaggcttcactcctcctcccctgcgggactccactctgttaacaccatctcactgtgactcagtggcacttccactggacaccgtccctcaaagcttgtctccacgtgaggatttggcggcttctgtcccaggcatctcaggccttggcggctcaaacagtcaagtttctgccctctcctggtcgcaggagactaccaaaacctggtgcgtcttcaactcgtcagtccagcaagatcatctttcccgccaaagggacactacaatgtccccactgcttttccaggcccagcccctgtcccatctggagcctgagtcccaaccctttatttcatccacaccccaattctggcccacacctatggctcaggccgaggctcaggcccatcttcaatcctctttcccagtcctatctcctgcttttctatccccgatgaagaacactggagtagcttgccctgcgtcgcagaataaagtgcaagctctctccctacctgaaactcagcaccctgaaaggcctttgttgaagaaacaactagaaggtgggttggctttaccctctagggtccaaaaatctcaggacgtctttagtgtctccactcctaaccttccccaggaaagactgacatccattctgcctgagaactttccagtcagtcctgaactctggagacaactggagcaacacatggggcaacgtggaaggatccaagagtctctggatctgatgcagcttcaggatgaattgccagggacaagtcaggccaagggcaaacccaggccctggcagtcctccacgtccacaggtgaaagcagcaaggaggcacagacggtgaagttccagctagagagggacccatgcccacatctggggcaaattctgggtgagaccccacaaaatctatccaggggcatggaaagcttcccagggaaggttctgggggcgacctctgaggagtcggaaaggaacctgaggaagcccttgaggagtgactcaggaagtgatttattaagacgcacagagaggaatcatatagaaaacatcctgaaagcccacatgagcagaaagttgggccagaccaacgagggcttgatccccgtgagtgtgcgtcgatcctggcttgctgtcaaccaggcttttcccgtctccaacacccacgtgaaaaccagcaatctagcagccccgaaaagcaggaaagcctgtgtgaacacagcccaggtgctttccttccttgagccgtgtactcagcaggtgctgggagcccatattgtgaggttttgggccaaacacaggtggggtctacccctcagggtcctcaagcccattcagtgctttcaactggaaaaggtttcatccttgtcccttatacagcttgctggtccctcctcagacacctgcgaatctggggctggctcaaaagttgaggtggccacgttccttggagagccaccaatggcaagtctgagaaagcaggtgctgaccaaaccatctgttcacatgccagagaggcttcaggcctcctcacctgcatgtaagcagttccagagggccccgcgagggatcccatcttcgaatgatcatgggtccttgaaggctcctacagctggacaggagggcaggtggccatctaagcccctcacatacagcctcacaggcagcacccagcagagcaggagcttaggagcccaatcttcaagggctggagagaccagggaggcagtgccacaacccacagtccccttgggaacctgtatgagagcaaacctccaagccacaagtgaggatgtgcgtggtttcaaggctccaggcgccagcaaaagctctctactccctagaatgtctgtctcccaagacccaagaaagctgtgtctcatggaggaggctgttagtgaatttgagcctggaaaggccacgaagtcagagacccagcctcaagtttctgccactgttgtgctccttccagatgggcaagcatctgttgtgccccatgcttcagagaatttggcttctcaagtgccccagggccatctccagagcatgcctactgggaacatgcaggcttcccaggagctatgtgacctcatgtcagccagaaggagtaacatggggcacaaggagcccaggaacccaaactgtcaaggctcatgcaagagccaaagcccaatgtttccccctactcacaagagggagaactctaggaagcccaacttagaaaaacatgaagaaatgtttcaaggattgaggactcctcaacttaccccaggcaggaaaacagaagacacccgtcagaatgaaggcgtccagctactgccatcaaagaaacagcctccttcaataagccactttggagaaaacatcaagcaattttttcagacgattttttcaaagaaagaaaggaagccagcaccagtcactgctgagagccaaaaaacagtaaaaaacagatcatgcgtgtacggcagcagtgctgaagctgagaggctcatgacagcagttggacagatactggaggagaacatgtcactttgccatgcgcgccatgcctcgaaggtaaatcagcaaagacagcagtttcaagccccagtctgtgggtttccctgcaaccacagacacccgttctactcagaacacagcagaatgctgagctatgcagccagcagtcaacaagccactctcaagaaccagagtcgtcccaacagagacagacaaatcagagatcagtagcccttgaaaagtgtccggtgcaacaatgagcaatggggcctgcgacatccccaactcttgctccccaagaaagctgtatccccagtcagtccccctcagcaccggccgaagacacccagtgcctccagccaccatcaccactgaccaaggcactgtctttttcagggaggtatctaatttggtcagtcacaaattcctttttagccttccctagagaaaaacaagtcaccaagaaaaaattcactctatgtagaggaaaagtattttctctcatgttagtacacgcagaacatttaatattccacaatatatacggtttttta

SEQ ID NO: 62066 - DNA, 1062 bp, Homo sapiens
atgcccagggctcagctgcctgaggacagcagtgcagttgacatggatattctctttcctctgcacagtgttattgagacagagctgtgccccagccccattccccagatcatccatttcgtcctcttcattgtgttcagcctggtgatcctgatcatcttatgcccctacattcccagggagccatcctcagtgcctcccagagaggaggacagcgagaatgatcaagctgaagtgggggaatggctcaggatcggaaataaatatatcactttgaaagactgcagaattctcttgaaagaattggagaaccttgaggtctacactttcctgctggaaaagcgcctgaagaagctctctagggagggcagctcccatcaccttccacgccaagtccgcccagggccagtgtacaaaccagcacctgctaggaaccaccggccacgtggggggcgtgggaaagcttctcccaccagcttccatgtgtccccacgggctcccccggctcctctggcctccatgccgtcatcagtcccgaagacctccatagagtcccttgggtctccatcatccctgagctcctcccaggcatcagagcctctgtgtcccctgaagcacccttcacaccggccacctgcgagcaccctatcaccaaacccgaccagctccacagaatccttggggtatctgtcatccctcagctcctcccagccaccagagcctttgcgtcccctgaagcacccttcacacaagccacatgggcgttcccctccccgacgacggaatcctggctgggtgtcctggtccgactccatgcaggctgattccgaaactgacgccataatatgcccaatgtgcaaggcccctgagcgctcctgtccacacacctggtgggtgccttctagccctcgagtgatccgaggcgttggtcgctgcagtgatcccaacctgggcctctcctggaggcaggaggctgctagagcctggtgccactgcacctcctcacagtacccattcgagcaccctaatcttcccacccacctaccaaaggcttccttctag

SEQ ID NO: 62067 - DNA, 3067 bp, Homo sapiens
actggggggagcaaagagtggggaactgggcaggcagacacccccacagagcactcatggcccccacagaaatacacccacactcatcacagcaaaccaaaacaatcacacgccggtacacaaacacacacacccccgcaccaatccaggcagacacaaagctcacggcgacaggcagatctgattcacacagacacaggcacaggtgcttcctgatgccaccctctcttggtcacgtgccagcacttggagggaggaaagtgcctcaccaggctgagatgcccaagggaccccccagggagggaaagcaggacacactgggacagttgcttccagccctgtccacacccttgtgcccatcaggtatgccgctcacccccaccccacctggaccttggtgtcacctaggattgcagaggccgccttcagcccagagcctggggccttgcccactgcctcacctcccaggatagggcatgctgttcctttctccttccctttctttgctcttgtgtgcctgcctttagcaaacgcccactgggtgtgtgggtacactgcggcctttaaagagaagagaaacacatgaggcttacagcaggaggccctgcctaggttccaagggacatggagcagggtggctgtgtagagctggggagcatcccaagcctgtgccaaggttccaaggacaaaaagggcaaggaggcccagtgcggggtggtgggggagcagctagccagggccaacagtgagcctcgcgcctgggcaggtgtagcctttaaacgcggtgggggaaccatggacagcatctaagcagggacgtgccgtgagtcctgggggtgcaggggtgtctagaggggaagctgggaagcaggggtcacagctttccgactggtggctgagtgtggggaagacaggaggggcaggtgtgagatgtacagcagacacagctgtgtgctggggcatggtgggctgtggtgagagagaggagcaggtcttctccccgcgtgttcagagcagatccaaactcttctcccattccttcctccaccgtgcatcctcagcacccctcagcactggcctgtgtgggcagcgtgagcacagagagcaggagcttgccctcagaggcttcagggggtcgcttgtacccagtggtatggtcagcatcatgtttgaccaaagggaggaaggtggctgtgaccagagcgagggggggtcctgatgcagctggggagtcaggctcgagtgcatgctgtgcatgttctctgcctctcttcctggggggcaggcgagtctccagagcctggaggacaagttagccttgcgaaggatagcagaggacccagcccaggggtccccaaaatggagcaccaaccctccatgcaggccaagccactggtgaatatgctgcaaaaaatatgctggaacttctatgaataccacagggtgtgagaagaaaacattagaacttctattttgtacctgtgttactccacaacaagaaagcaatcagcttgatcaatgcctactgtaaagacggcaccgccctccggaggtcctttctcagccctggtgttcggacagccacatcccctcgcagcagggggaggcctgaagcatagaggggcccatgcaggtctattctgtttcagcgaattgcctgggaaataatccaggatccatttcgtgtggtcatcttgtctccctggtcccctccagcctttcctcatcttttgtgacctggtcactctggaagggcgctggccagttagtccacaggatgggcctcccctggggcttttctgatgcttccttatgatggcactggcatcctgagggggaggaccacagagaggaggtgctcctcatcacaccacatgggggtccatgcaccagtgccactgctttccagggctcttcaccttcatcactggtggaggtggcgtctgccaagaagcagaaagttgaggcttagaaggtgcacggccctacctcttccgaggtgcccctgcgggctgtctacagaccaggcagcacatgcctgatagcagctgcataaggaaaagcaggagccagctcgtgcacagtggcctcaagtgtgcactgggcatgttctctgcctcaccatccctgtgtgacagatgaagcatgacagccctcaacagaagccaaggccaagtcctcgaacttcctagtctgcacaatgacacttctgatgaaactgaaaatgccaccagggagaagcagctgaacttcaaggaccacagagggccaagtgcaggagtaagaggctggcgtgctgacagtggccaagggcattggagggaaggacctgtcatcactgggccaaggaaggaactccagactgcctacttccagagggcctgctgaggaattttagcttgaacttgcctgccttgactagggctttctgagcagcagatgattctgcaatggtgttagtccaggcctggttctgcatgacattgaccatactgtgcaccctggggtcattatgtcttgggcttcaaggggctccatgggctccagggggctccatgtgacactgcacagagctctctctaggtcacctggatgtgtctcttcctaggaaccccaaagagctctctcaacaaacacacccacgagttccaggagtgaggctgcagggaacagcctcactctcagaggggatacagaattgttccactggacaagggctgggatcgtcataggatgccgttggcctgtggtttccaacagaggtgcagttcattgaactgtggtctacagtccattctctaacttggggacccttgaagaagtgtggaatcatgacaacaaccctgttgggagacactattattcccatcacatggatgagcacacggaggcaaaaggaagttatatgattgtctgagatcacccagtgaagactgtgtggctgggagttgtccccagtgttatctgcacgctgcttccttttgatgcctggcccttctttatcaaaagaagcattggcagaatctgggtgtttatgggtcagctcaaaataaattactttatatgt

SEQ ID NO: 62068 - DNA, 1342 bp, Homo sapiens
atggacccacttctgcccatcctttgctgtgaacaaggaaccctggtcagatgctataacatgtgggattttatgcctgtggatcaggaattctggaagcctcagaaaagtggtcctggctcaggctctgtgaacagaattgccaaacccagccctggaataaggatatatccctctgaggatgaaaaggtggtcattcaaggtcaaaagacttgccatataagagtctcattattgatgtatgctgttgaaaagactgctctacactgggtctgtgccaatggccatgcagaagtagtaacacctctggtagatagaaagtgccagcttgacatccttgatggtgaaaacaggacacctctgatgaaggctgcgcaatgccagagggaggtttgtgcaaatattctcatagattctggtgctgatccaaatattgtagatgtgtatggcaacacagctgtccattatgctctttatggtgagaatttgtcagtggtggcaaaattgctgtcctgtggtgcagacatcgaagtgaagaacaaggctggccacacaccacttttactggccataaggaaaagaagtgagcaaattgtggaatttttactgacaaaaaatacaaatgcaaatgcagttgataagtttaaatgcattcatcaacaacttttggaatacaaacaaaagatatctaaaaattctcaaaatagcaatccagaaggaacatctgaaggaacacctgacgaggctgcacccttggtggaaagaacacctgacatggctgaaagcttggtggaaagaacacctgacgaataggatacagtgaattcctcttcaaagattttagcctgtaaaaattctttaaaattcaagagggggttaagtacagtgagttctgagttcctcatcaaagaacaaatatgtcagtatgtccagcttctctgttctttgttctccattttaaagtttaacttcctcgttcattatgcctccttgcccctagtttcattaaacaaccccctcctagcctctaacacctgctttgtctttagtcattcttagtcacctgctctgtctttatcatccttagacacctgctctgtaactgtctttcccgctgaaactactcaccctgccactccagctcatacccctgctctctttgaaatagccaatctgaattagcttagagtgtgcagtccaaccctatccaatagggaaaagacacaacagtagggactagctgcgttaggaataagaacactttccctcccttgtccggtgttatcttgccattactccatctgcaagaccactcttccatagaagtaaatttgccttgctg

SEQ ID NO: 62069 - DNA, 435 bp, Homo sapiens
atgccaaaggggcggcgcggcagccacagccccaccatgagccagcggtcggctccgcccctctatttcccgtccctgtacgaccgcggcatctcctcgtccccgctcagcgacttcaacatctggaagaagctcttcgtgccgctgaaggcgggcggggcgccacctctgcgcttcttctactcaccgccgccggggcctgaggtggttgcctcgcccctggtcccctgcccctcgacccccaggctcgcctctgcctcccacccggaggagctctgcgagctggagatccggattaaggagctggagttgctcaccatcactggggacggcttcgactcccagagctacacattcctgaaggcgctaaaagacgaaaagttacaaggactgaagaccaagcaacctggaaagaagtcggcctctctctcctga

SEQ ID NO: 62070 - DNA, 1215 bp, Homo sapiens
atggcccagctgcgagcctgcgaagtccggcagctgctgcacaacaagttcgtggtggtcatgggggactcggtccagctggccgtgtacaaggacctggtgctcctgcttcagaaggactgcctgctgtcctccagtcagctgaaggccaagggcgaactgagcttcgagcgcgacatgctgctggtgggctgcagcagtggccgcatgcactacgaccgccactaccgcgaggtgcgccagttccgctcgggccaccacctggtgcgcttctacttcctcacgcgcgtgtattcgcactacgcggagcgcgtcgtggaggagctgcgtagggccgagcccgccccggacgtggtggtcatgaactcctgcctctgggacctcgccagggatggccggggcttccccaggagctaccggcgtgacgtggagagcctgttcgtgcggttggactgggcgctgcccacgtcctgccttctgttgtggaacacggccatgcccgtggccgagaccatctcgggaagctgcctcccatgcgcgcgccagctccgccgcgcccgcctgcgcgaagacgtgatggaggccaacttctacagctccgccgaggcggcgaggcgcggctttgacgtgctggacctgcatttccacttccgccacgccacgcggcaccggctccccgacggcgtgcactgggacgagcgcgcgcaccgccacctttcccagctgctgctggcccacctggcagacgcctggggcgtggacctgccccgccgcgaagccgtggacgggtggctcaggcatgaccacgccaacagacgtgcagccccggcgggcagaaggcagccccgagacgaccgaccggacccacacggccgaggggaccgagcgggccgaggagacctccgtgcccctcgatcgctcgcttcgttcttctgggctcgaccgcctttccctccccgccgtcaggtcgcctttctgtcctctgaccggcatttctccagcgactcctccacgcgccacatccgacacagcggcgaagaaaacgccagggttggccgcgagtcgcggccgttccccatccgcacaagctctgctctgcgccgagagaggaggcattccccttaccttccgtggcgccccagcgagccacccctaagccagcgaagccgcacacgcacacacagaggggtcccgagaacacccaggactcagtag

SEQ ID NO: 62071 - DNA, 990 bp, Homo sapiens
agttagtagttggtcccagtcagtaacactctgggagggctcaggccacatcacgaaatgtgacaggatagccttgaactcatcaattgctgggtaagaaagaattttaatgcaatggcaaacaaccaatcaaacaagcaaacaaaaacaataaacccttccttgaggaccaagaagacattgattagctaacctaagagctccaggtggagacctaggtcctgattgggtttctgaatttgaccactaggcagaaaactagcacccaaaaccagttggaataaaattacccacctacagtggagccaaggcccccagatcctttttgtcaggggcacctcaaactcaactccaaaattgatctaatgaactttcccaaaccacattcccttcttgcatttctgagagaatggattcccattcatctgactacagtgctaccctgaaagcagatccagagactaagattcacctgcaggtgattcatttgcaaggtaagctgtcatcagttggaggtaagcagaagacagtagagagtacagagccctggactgtgactcagaggatgagcaccagatccagtttgctgtgccacagtgctcagcatgatgtaaactccactgcggacagatgcagccaagaagacaggtcaccttctaccaactcccaccagaggaaactcttccccaggacccagtacgttggccctctgaccctgcacacagcacatgatgctgaggttcagtgctgaacaagagctactgagagccagagattcacttcttccatggagccccactcatggatggaggctctgtcccgggtccagtgccactgggaacactgggtctctggtttctagctctgtcctatggcagaggttccaccccacaataaccgaagtgctgagaaggtgggaagctcctgcccgaccctccactgagagctcagctcctaggctgaggaataaaacagctcaactttgtctac

SEQ ID NO: 62072 - DNA, 801 bp, Homo sapiens
atgagcgaggtggaggcggcagcggtggcgacagcggtccccgcggcgacggtgcccgcgacggtggcaggggtggtagcggtggtggtaccggtgcccgcaggggagccgcagaaagcaggcggcggggcgggcggctgcggcggggacgcagccgccttggaccccgctgctgggaccccctcgtcctgcctgggcactgccaaacggttcaacgtccggagtggttacggattcaccaacaggaatgacgccaaggaagatgtcttcgttcactggacagctgttaaaagaaacaaccccaggaagtttctgcgcagcgttagagatggggagactgtggaatttgatgtcgtggaaggagagaagggcgcagaagccactaatgttccgctgattcatccccggcctccctcagttgccccaccacccatggtggcagagatcccctctcgggggacagaacctggcggcgaaggggagcgggccgaagactctgggcagcggcccagacgatggcgccccccacccttctacctacggcggtttgtgcgaggcccccggccccccaaccagcagcagcctatagagggcactgatggggtagaaccaaacagacagccccattggaggggcaccaacagcagggagatgagtgggtccccccgcccagattccggcccagacaggcccctgatcctgctccaggaactccccatcactatcacgcccacttccaaggcctccctggggatagtggtggctccttccgaggccctcctcaaccgtccacagtcctag

SEQ ID NO: 62073 - DNA, 3402 bp, Homo sapiens
atgcggacagatgctggctgtgtaagagcagttcttggggcgcggcctcgggaaggcaccgacgcgggcctcccagtgccagcgcgggcggccgccgccagcttcccgcatcgcctccgcacccgccgaccctgccccgcctgcattcctgcagccccgaagcccccgcggcgggaaaggaggcgggaggagggcccgccgcttactggtttgagttatcctgtagatggagaagcaagagaagctgaacaacgcgacggcgaccagggtgatcagcaagttcacctgcttggtcctcatggccctggccaggctgcgggaggccggcgggtggaggcggcggataatgccagggacggggttgagcgcgcagagccccctccccgcggtgccgcgtgggtccccagcacacccgccctgggaagccgccttgccacagaacttctgcaccttttgcttcctgctctagggttcagcgcgtgctataaaccgctggccagggctactggtcgttaaaaacgataaactagggaaagcgccccattgcctggcacgtggtgggtgcgcaataactgttaggtgactttcctcgagtggcttatcaaagctttacccaagctgagaaacactagagcatcagtaggatgagactctctatggactccttgatctctcccctctaagctctcctctcattgaggactcactggcagtctgttataatatctgaacattctacttcaaatcagccctgcacgttggaagggctggcttctgtccccttgaaggggaagaaagatttgaacataccccagcctgaggatgccactatagcctgcgtgttctcatgtgctaatggctaggagctgtgactttccattgagccgggacccagccagatctcaaaacaaggagccaggagagacacctcaactatgttctccttcaccccttcagtctgttgccggtgcttgcctttggctgagctctactgaaaaccagaagacaagaaagttcagcttgatgtactggatggtccaaacctggcttctaggctgtggagcaggttggagaaaacgtagggaagattagggtgggagaaggaagctattcagcataaagagagatctccatactcagcatttcactgccttcttacttgaggtccagtttttgcattttcagttgcctacccagcccttcagcttgaatgtcccacatcagattcaagatgtccaaacttcctcaccaagctattaatagctgttttcccagagtcccttgattttatcagtggcatcatagttcttcttacaatcatttggactctggttcattatatctcattatttataaaatctttagttacctaaaggattgtgtttctgttgctagctactatccccaatactcagatgatcacagtgacattcaaactggtctcactgtctgcaggatctaccctctgcaatccacacttcaataccagatactcttcctagttcaccacagtcagctgtcactgttgtttacgtagctccactcctgaatgaaaatggacccactcaatcgaaggccactcactgctttctcatctcccagggcgcccttacatgcctctggcacctgccagactcttttttcaatcctactctgaacatgtcatgttcacttctctccttctgtgccttttctctttatgtctgccccctgcccacaatgtccagtgtcctctctgaccattgaaattttttccacatcgtcaggtctcatgtttcatctgtttcatgaatcaaaacctggctacagcagaccactctgatttccccttctctgaatttatttagtatgtagggcagggatgtccaatcttttggcttccctgggccacattggaaggaaaattgtcttgggccacaaataaaatacactaacactaatgatagctgatgagctaaaacacacacacacatacacagacacacacacacatttcataatgttttgagaaagtttacgaatttggtttgggccgcattcgaagctgtcttgagctacatgctgcccaccagccatgggttggacaaggtgatgtaaagcctctgcctttcattttgatatatatccctaggtacttgcagataggagcttccaaaatgatcctaagttacacccatggttgagggagaaatatattcaaagcagattgaattactggtagttgtccaaagaaatgtacttacacgtgttagcataaatggttatggaggtctagggaaggatagttgcggtagatgcctgagaaaagagggttccctcattcctttgctgtgtagtcatgcatgatacacaagttctaaaaagacctggctgtgggcagaagctgacatcccatttctacaagggagcatgggaaacagagaaggaaaagctgcttaagaattaaccctcccaacaaagtttcagatggacaggaggaataatttccactgatctcttgcacagcatggtgactatagtcaattataatgtattgtacatttctaaagtcctaaaagagtggacttgaaatgttctcaccacaaagaaataagtatgtgacatgatggatatgttaattagcccgatttgatcattaaacaatgtatacatgcctcaaaacttcacactataccccatacatgtatacaattattgtctattaaaaataaagaaatttctaaaagagaactaatgccatcaagtaaacaataaataattgaaacaagacggcatacataatgtgggtagggtcagtccaaacagtgggaaccaaacaaaattttgataagcttaatcatctcgatagcttacaaggccaatgttgtatgaagaaaaactgcagtgttaaaaggtttactaggacaagtacatatgcctaaaaaaataaagttctgggatcatttccactgctaagttgaggaaaattagtttaataatcaagaggttctggttattaaatctttctaagttgcttcgggaatatcaatagattttctaattgcttctgagtgtcagtagattttcattggtatcagagggagaaaaccagtagaattatctaaagctagtgctttagtttatccacatagtccatctctactggaaaacctgaagagaccatggtgctaagcacagaagaataattaatcaaaccactgagaccttatgtgacaaaactctttaaatgcagagacactagaactggatcaatatttttagatccaaagagtgaaaaggaaagcttactgctttttaaaattttctatacatttggcattttaatataaactatataccattataagtcaaatctttataactaatacaagtcacaaatccaaataaacacgttttcttcat

SEQ ID NO: 62074 - DNA, 480 bp, Homo sapiens
atgattgaccagctccaaggaacatggaagtccatttcttgtgaaaattccgaagactacatgaaggagctgggtataggaagagccagcaggaaactgggccgtttggcaaaacccactgtgaccatcagtacagatggagatgtcatcacaataaaaaccaaaagcatctttaaaaataatgagatctcctttaagctgggagaagagtttgaggaaatcacgccaggtggccacaaaacaaagagtaaagtaaccttagataaggagtccctgattcaagttcaggactgggatggcaaagaaaccaccataacgagaaagctggtggatgggaaaatggtggtggaaagtactgtgaacagtgttatctgtacacgaacatacgagaaagtatcatcaaactcagtctcaaactcttaaggctttctcaagctgtcatccaaactactgaggttgtttaaataaaactccaaagta

SEQ ID NO: 62075 - DNA, 1090 bp, Homo sapiens
atggggatctcaggaagatccacaaagctgcctcccgggccaagcctggaagctggagaggatgatgaagaagacgacaatggacctgaacataagagatgcgaagaagaggctctgcaatgccagagggaggcttgtgcaaatattctcatagattctggtgctgatccaaatattgtaggtgtgtatggcaacacagctgtccattatgctgttaacagtgagaatttgtcagtggtggcaaaattgctgtcctgtggtgcagacattgaattgaagaacaaggctggccacacaccacttttattggccataaggaaaagaagtgagcaaattgtggaatttttactgacaaaaaatgcaaatgcaattgcagttgataagtttaaatgcattcatcaacaacttttggaatataaacaaaagatatctaaaaattctcaaaatagtaatccagaaggaacatctgaaggaacacttgatgaggctgcacccttggcagaaagaacacctgacacggctgaaagcttggtggaaagaacacctgatgaataggatacagtgaattcctcttcaaagattttagcctgtaaatatcctttaaaattcaagagggggaagattaagtacaatgagttctgagttcctcatcaaagaacaaatatgtcagtatgttcagcttctctgttctttgttctccgttttaaagtttaacttcctcgttcgttatgcctccttgcccctagtttcattaaacaacccccttctagcctctaacacctgctttgtctttagtcattcttagtaacctgctctgtccttagtcatccttagacacctgctctgtaactgtctttcccactgaaactactcaccctgccactccagctcatacccctgccctctttgaaatagccaatctgaattggcttagagtgtgcagtccaaccctatccaatagggaaaagacacaacagtagggactagctgagttagaaataagaacactttcccctcccttgtctggtgtgatcttgcctttgctccatctgcaagaccactcttccatagaagtaaatttgccttgctg

SEQ ID NO: 62076 - DNA, 1626 bp, Homo sapiens
atggacttcctgtgggacaagcgcacgggcctggccgccagaaagatgcctcatcctcgaaggtaccattcctcagagcgaggcagccgggggagttactgtgaacactatcggagccgaaaacaagcaacgaagaagccgttcctggtcaagaggtgcagccggacatttagccgctcgtcttcgcagcacagcagccggaaagccaagagtgtagaggacgacactgagggccacctcatctaccatgtcggggactggctacaagagcgatatgaaatcgtcagcaccttaggaaaggggaccttcggccgagttgtacaatgtgttgaccatcgcaggcgtggggctcgagttgccctgaagatcattaagaatgtggagaagtataaggaagcagctcgacttgagatcaaagtgctggagaaaatcaacgagaaagaccctggcaagaacctctgtgtccagatgtttgactggttcgactaccatggccacatgtgtatctccttggagcttctgggccttagcaccttcgatttcctcaaagacaacaaccacctgccctaccccatccaccaagtgcaccacatggcctcccagctgtgccaggctgtcaagttcctccatgataacaagctgacacatacagacctcaagcctgaaaatattctgtttgtgaattcagactatgagctcacctacaacctagagaagaagcgacatgagcgcagtgtgaagagcacagctgtgcgggtgggagactttggcagtgccacctttgaccatgagcaccatagcaccattgtctccactcgccattaccgagcaccagaagtcatccttgagttgggttggtcacagccttgtgatgtgtggagtataggctgcatcatctttgagtactatgtgggcttcaccctcttccagacccatgacaacagacagcatctagccacgatggaaaggatcttgggtcctatcccttcccggatgatccgaaagacaagaaaacagaaatatttttaccggggtcgcctggattgggatgagaacacatcagctggacgctatgttcgtgagaactgcaaaccgctgcggcagtatctgacctcagaggcagaggaagaccaccagctcttcgatctgattgaaagcatgctagagtatgaaccagctcagcggctgaccttgggtgaagcccttcagcatcctttcttctcccgcctttgggctgagccacccaacaagttgtgggactccagtcaggatatcagtccgtgaccaccaggccctgggcctccctgcatcttttatagcagtgagtgtccagtccaggacattggtgcttttttataaaagagaacagagccagagttcactccttcctgctgcttctctatatacctgtgaatatgtgaaacagtaaatatgaaagaacttgtacctatcacttcaacccctgcgttgtacataatgctattccatctacacactttccaccctcacctgccccctcatacagagttggatgggggccgagtgaggtaaccaggtggcatctaccccatgttttataaggaattttgtacagtctttgtgaaatgaaataacatgcttcatttg

SEQ ID NO: 62077 - DNA, 588 bp, Homo sapiens
atgatatcgtatgttctcactcgtaagtgggagctaagctatgaggattgcaaaggactattccctgatataaccaggccctttaaaaagtcatttgatgtcaagcatggagtggcacatcaaatttgggattttggtgattgttttccgacacctccaaattatggaaaatactgtgtgagacctaaaaagccagcacaggaggccctgataaactacagtcgacgagggaaaggtgtcctaaagcatcttcatggacggtgcgattctgaaagcaaggtttgctcatctgaggattcagaagctgatcgatactccgattatggctggggaggaccctcatcgccatttaactgagttggaaaatgaagccacaaggctggaggcgtggagtttgcttaataaacaactttgaggtatggggccctcccaacaccctccccccacccgccccgcccaggaacgtctggaccctggcaggttggctttctgggacaattccatgggcttcatttatcagttttttccctttttaattggtggagagagacaaaagtttttataatctttattaaattttccttttta

SEQ ID NO: 62078 - DNA, 847 bp, Homo sapiens
atggggaagaaggagaggaggcggagcggcgcttccggccccgcctctgaggtcgacggcgacgcgaatctacgcgacgcgacgcggagctcggagcagcgttccttccctctcgtagaggctcaggcgcaggcaccgccccacggcgaggcgcgtcgcttagcagagcccgccctgtctctgcggcagcctatcgacgccagcccgcgggccgatcctgttcccgcccccgaccggagcctttcgggtggctccgcccacagcgggcgtttcctcaagccacgcctgcgcaggtcgtcgggggagactgatgaagagacgactatccccagaccgtattttaactactatggcgctgtgtaagaagcaacctgagaagtgtggatgaaaagctacaggtagagccctgggcccaagacggtggcttggacaacatgctaaataaactataaactagatggtatttgaagctacgagagtagataaaaatgacaggaggaccaaggagaaacttgggaacgccaatgtttaagaaacgggaaagcaaaaaaaaaaaaaaacacacacaaaaaaacaatgtaaccagagccacaaaaaccagaatcacagcaagggattctgatgtttacattatgtcctgtttccatgttgacacattacacaaggacagtttttttctaattgcttaatttttcatcatcttccatccgatttactgaaccatccttaactttaggatgaatcctttcatttaacaaatgtgttttgaatgtccactatgtgccagacactgttctaggtgctaggaaaacagctgtgaacaaaaccaataaaaatctctttcctc

SEQ ID NO: 62079 - DNA, 519 bp, Homo sapiens
atgcaagtcagggagagggctaaagaaacactttttctgagacatctccctgcacagaactctgcttgtgtgagctcaaggcttctctatctcttggtgttctacactcagaactcaggtgtctttatctatcaaggcaagcttctcgatgtctgccaaaacctggaatccaaactgaaagaattactaaagaacttctctgaaattgttgtggttgaaggtcccattcttgattgttggacgtgtcttcgcatgactaacaggtgcttcaaaggagaatattgtggagacgaggatccaagaaaggctgagaatcgagagattgctctatttctcatattgctggcaacagctgtaatactgggaagtgctgtgttactattccatttttgcatctttcatcggaggaaaatgaaggcaatacgaaggtcgctaaaggaatatgtggagaagaaacttgaagaattaatggggaagatagatgagaaggaggagaaagactttagactcagaaaataa

SEQ ID NO: 62080 - DNA, 567 bp, Homo sapiens
gctgaccccacactcctcaagtcctctgtctgcaggatactaggatgctgacctttcatcattccactgacgttatgtggcctaaaatcctcagcctgaagactcaaattatcgaaacttcagaggaaaaatttaaactttcctacaccagaatcagcttgagagaagaacctagttgccaccccagccagacactcccttgcaccatatttgcttgtctaatgatgtacttgcttagaagttccaggggctaatcttgaaataaaccaggcatagagatccagttgtggaagtctcccccacctagaaattgcctcaaggtggttaatcttcaacccaaccattgtcaaaatggccccagttcattctacaggtggacaacaactcaagatagccattggagcaagatatgccgacctccaccctgcaccactcccacatgcttcccataccaagtttcccttcccaacccccttcgcttagcctgaaaatttgagatggttctttgagacctaagtccagccattcttctcaatggctagcctttgaataaaactgctttcctcc

SEQ ID NO: 62081 - DNA, 1641 bp, Homo sapiens
caggggcagagcgctcaggccagggccggcgggggcactgcgcactggccgcctccctcctctggccaatcctcctgccgctgcgcgtctagtccacctcgtccctctctgcaggtccactaacccatctgattaccggatcctgcttgggtatgaccagcaaagccatcccacagagcacagcaagcagatgacagtgaataagatcatggtgcacgctgactataacgagttgcaccgcatggggagtgacatcaccctgctgcagctgcaccatcatgtggaattcagctcccacatcctccccgcctgccttccggaaccaaccacgtggctggcccctgacagctcctgctggatatctggttggggaatggtcaccgaggatgtcttcctgcctgagcccttccaacttcaggaggcagaggtcggtgtcatggacaacactgtctgcggatcctttttccagccccagtaccccggccagccaagcagcagtgactacaccatccacgaggacatgctgtgcgctggggacctcataacaggaaaggccatttgccgatgcggggaactgaggcccagagaggaagtgtatcacccaagcgagactccaggggtcccctcgtctgcccattaaatggcacctggttcctgatggggctgtctagttggagcctcgactgctgctcacccgtcggtcccagggtcttcaccaggctcccctacttcaccaactggatcagccagaagaagagggagagcacccctccagatcccgccttggctcctcctcaggaaacacccccagccctggacagcatgacctctcagggcatcgtccacaagcccgggctctgcgcagcccttctggctgctcacatgttcctcctgctgctgattctcctggggagcctgtgaagggccagggcccctggcctcttaccacaagcatgcccacctcaggccggcctccttgctgagctctgcacactcctgacgtgtttccatctctgagctctcctgtccacccaaggccacccctgcctcaggcctgacaaactaaaaaccacccaagaagcttcttgctctggtttctggcccaccagagccatctcccatgctccactgtgtctccagctcctcagggagggaaggtctccctcctccctgggcagggtccaggctgaccatatgggagccaagtcactctccttgggaagttgggtcgcgcagactcaggccccattcgggtcctccagggcatgcagtcttccagaaaaatggggccagggcctccccacatggaagaagctgcctgtcctcctggagctgggtgttgtgcaccggtcagggatgaagcggcatcttccaggtgcgcaggtcacagaggctctcctcgacagcttgcaagtaaactgtgaagggggctgaggtcttcggtcagcagtaccagagctgtgtcccatgggccagctctcagctgactgccccctgtacccgctgccctgccctctccctgcctccagaaacccagcccccatccctgtggcttgctccagcttgtaggggttgtggcttagctgacccaggacttgctggtccagcactgagcccataaaccagactctgagttgcccc

SEQ ID NO: 62082 - DNA, 1641 bp, Homo sapiens
caggggcagagcgctcaggccagggccggcgggggcactgcgcactggccgcctccctcctctggccaatcctcctgccgctgcgcgtctagtccacctcgtccctctctgcaggtccactaacccatctgattaccggatcctgcttgggtatgaccagcaaagccatcccacagagcacagcaagcagatgacagtgaataagatcatggtgcacgctgactataacgagttgcaccgcatggggagtgacatcaccctgctgcagctgcaccgtcatgtggaattcagctcccacatcctccccgcctgccttccggaaccaaccacgtggctggcccctgacagctcctgctggatatctggttggggaatggtcaccgaggatgtcttcctgcctgagcccttccaacttcaggaggcagaggtcggtgtcatggacaacactgtctgcggatcctttttccagccccagtaccccggccagccaagcagcagtgactacaccatccacgaggacatgctgtgcgctggggacctcataacaggaaaggccatttgccgatgcggggaactgaggcccagagaggaagtgtatcacccaagcgagactccaggggtcccctcgtctgcccattaaatggcacctggttcctgatggggctgtctagttggagcctcgactgctgctcacccgtcggtcccagggtcttcaccaggctcccctacttcaccaactggatcagccagaagaagagggagagcacccctccagatcccgccttggctcctcctcaggaaacacccccagccctggacagcatgacctctcagggcatcgtccacaagcccgggctctgcgcagcccttctggctgctcacatgttcctcctgctgctgattctcctggggagcctgtgaagggccagggcccctggcctcttaccacaagcatgcccacctcaggccggcctccttgctgagctctgcacactcctgacgtgtttccatctctgagctctcctgtccacccaaggccacccctgcctcaggcctgacaaactaaaaaccacccaagaagcttctggctctggtttctggcccaccagagccatctcccatgctccactgtgtctccagctcctcagggagggaaggtctccctcctccctgggcagggtccaggctgaccatatgggagccaagtcactctccttgggaagttgggtcgcgcagactcaggccccattcgggtcctccagggcatgcagtcttccagaaaaatggggccagggcctccccacatggaagaagctgcctgtcctcctggagctgggtgttgtgcaccggtcagggatgaagcggcatcttccaggtgcgcaggtcacagaggctctcctcgacagcttgcaagtaaactgtgaagggggctgaggtcttcggtcagcagtaccagagctgtgtcccatgggtcagctctcagctgactgccccctgtacccgctgccctgccctctccctgcctccagaaacccagcccccatccctgtggcttgctccagcttgtaggggttgtggcttagctgacccaggacttgctggtccagcactgagcccataaaccagactctgagttgcccc

SEQ ID NO: 62083 - DNA, 4038 bp, Homo sapiens
atgaagccatggtgggccagggactgggcgttacccagcagggggcagtgtgtgtgtcctggggagaccaatgcctgcctggatgcggagggggctggtagagagtgcccgagaggcctgcaggagacttcggacctgctttcacaactgcagagcctcctggggccacaccttgacaaaggtgactttggtcagctctccggtccagaccccccaggtgaagtgggcgaaagagcacctgatggagcctcccagtcctctcatgagcctatggaagatgctgctcccattctctccccgttagcttccccggatcctcaagccaagcatcctcaggatctggcctccaccccatcaccaggcccaatgaccacctcagtctcctccctaagtgcctcccagccaccagaaccttcccttcccctagaacacccctcacccgagccacctgcacttttccctcacccaccacacacccctgatcctctggcctgctctccgcctcctccaaaaggcttcactgctcctcccctgcgggactccacactgataactccatctcactgtgactcagtggcacttccactgggcaccgtccctcaaagcttgtctccacatgaggatttggtggcttctgtcccagccatctcaggccttggtggctcaaacagtcatgtttctgcctcctcccggtggcaggagactgccagaacctcgtgcgcctttaactcatcagtccagcaagatcatctttcccgccacccaccagagacctaccagatggaagctggtagcctgtttttgctcagctctgatggccagaatgccgtggggatacaagtcacagaaacagccaaggtcaacatttgggaagaaaaagaaaatgttggatcatttacagatcgaatgaccccagaaaagcacttaaattctttgcggaatttggctaaatcattggatgctgagcaggacaccacaaacccaaaacccttctggaacatgggagagaactcgaaacagctgcccggacctcagaagctctcagatcctaggctctggcaggaaagtttttggaagaattatagccagcttttctggggcctcccctctctgcacagcgagtccctggtggctaacgcctgggtaactgacaggtcttatactttacagtctcctcctttcttgttcaatgaaatgtccaatgtctgcccaattcaaagggagactacaatgtccccactgcttttccaggcccagcccccgtcccatctggggcccgagtgccaaccctttatttcatccacaccccaattccggcccacacctatggctcaggccgaggctcaggcccatcttcaatcttctttcccagtcctatctcctgcttttccatccctgattaagaacactggagtagcttgccctgcatcgcagaataaagtgcaagctctctccctacctgaaactcagcaccctgaatggcctttgttgaggagacaactagaaggtaggttggctttaccctctagggtccaaaaatctcaggacgtctttagtgtctccactcctaaccttccccaggaaagtttgacatccattctgcctgagaactttccagtcagtcctgaactccggagacaactggagcaacacataaaaaagtggatcatccaacactggggcaacctgggaaggatccaagagtctctggatctgatgcagcttcgggacgaatcaccagggacaagtcaggccaagggcaaacccagtccctggcagtcctccatgtccacaggtgaaagcagcaaggaggcacagaaggtgaagttccagctagagagggacccgtgcccacatctggggcaaattctgggtgagaccccacaaaatctatccagggacatgaaaagcttcccacggaaggttctgggggtgacttctgaggagtcggaaaggaacttgaggaagcccttgaggagtgactcgggaagtgatttattaagatgcacagagaggactcatatagaaaacatcctgaaagcccacatgggcaggaacttgggccagaccaacgagggcttgatccccgtgcgtgtgcgtcgatcctggcttgctgtcaaccaggctcttcccgtgtccaacacccatgtgaaaaccagcaatctagcagccccgaaaagtgggaaagcctgtgtgaacacagcccaggtgctttccttcctcgagccgtgtactcagcaggggttgggagcccatattgtgaggttttgggccaaacacaggtggggtctacccctcagggtcctcaagcccattcagtgctttaaactggaaaaggtttcatccttgtcccttacacagcttgctggtccctcctcagccacctgtgaatctggggctggctcagaagttgaggtggacatgttccttagaaagccaccaatggcaagtctgagaaagcaggtgctgaccaaagcatctgatcacatgccagagagtcttctggcctcctcacctgcatggaagcagttccagagggcaccgcgaggaatcccatcttggaatgatcatgggcccttgaagcctcctccagctggacaggagggcaggtggccatctaagcccctcacgtacagcctcacaggcagcacccagcagagcaggagcttaggagcccaatcttcaaaggctggagagacaagggaggcagtgccacaatgcagagtccccttggaaacctgtatgctggcaaacctccaagccacaagtgaggatatgcatggtttcgaggctccagggaccagcaaaagctctctacaccctagagtgtctgtctcccaagatccaagaaagctgtgtcttatggaggaggttgttaatgaatttgagcctggaatggccacaaagtcagagacccagcctcaagtttgtgccgctgttgtgctccttccagatgggcaagcatctgttgtgccccacgcttcagagaatttggtttctcaagtgccccagggccatctccagagcatgcctgctgggaacatgcgggcttcccaggagctacatgaccttatggcagccagaaggagcaaactggtgcacgaggagcccagaaacccaaactgtcaaggctcatgcaagaaccaaaggccaatgtttccccctattcacaagagtgagaagtctaggaagcccaacttagaaaaacatgaagaaaggcttgaaggattgaggactcctcaacttaccccagtcaggaaaacagaagacacccatcaggatgaaggcgtccagctactgccatcaaagaaacagcctccttcagtaagccactttggaggaaacatcaagcaattttttcagtggattttttcaaagaaaaaaagcaagccagcaccagtcactgctgagagccaaaaaacagtgaaaaacagatcatgtgtgtacagcagcagtgctgaagctcagggtctcatgacggcagttggacaaatgctggacgagaaaatgtcactttgccatgcgcgccatgcctcgaaggtaaatcagcacaaacagaagtttcaagccccagtctgtgggtttccctgcaaccacaggcacctcttctactcagaacacggcagaatactgagctatgcagccagcagtcaacaagccactctcaagagccagggttgtcccaacagagacaggcaaatcagaaatcaacagcccttgaaaagtgtgcggtgcaacaatgagcaatggggcctgcgacatccccaaatcttgcaccccaagaaagctgtatccccagtcagtccccttcagcactggccgaagacatccggtgcctctagccaccatcaccactgtccaaggcactgtcttctttgggaaggtatctgatttggtcagtcacaaattcttttttagccttccctggagaaaaagaagtccccaagaaaaaattcactctatgtagagaaaaaatattttctctcatgttagtacatgcagaacatttaatataccacaatatatatggttttttat

SEQ ID NO: 62084 - DNA, 3525 bp, Homo sapiens
atgaccacctcagtctcctccctaagtgcctcccagccaccagaaccttcccttcccctagaacacccctcacccgagccacctgcacttttccctcacccaccacacacccctgatcctctggcctgctctccgcctcctccaaaaggcttcactgctcctcccctgcgggactccacactgataactccatctcactgtgactcagtggcacttccactgggcaccgtccctcaaagcttgtctccacatgaggatttggtggcttctgtcccagccatctcaggccttggtggctcaaacagtcatgtttctgcctcctcccggtggcaggagactgccagaacctcgtgcgcctttaactcatcagtccagcaagatcatctttcccgccacccaccagagacctaccagatggaagctggtagcctgtttttgctcagctctgatggccagaatgccgtggggatacaagtcacagaaacagccaaggtcaacatttgggaagaaaaagaaaatgttggatcatttacagatcgaatgaccccagaaaagcacttaaattctttgcggaatttggctaaatcattggatgctgagcaggacaccacaaacccaaaacccttctggaacatgggagagaactcgaaacagctgcccggacctcagaagctctcagatcctaggctctggcaggaaagtttttggaagaattatagccagcttttctggggcctcccctctctgcacagcgagtccctggtggctaacgcctgggtaactgacaggtcttatactttacagtctcctcctttcttgttcaatgaaatgtccaatgtctgcccaattcaaagggagactacaatgtccccactgcttttccaggcccagcccccgtcccatctggggcccgagtgccaaccctttatttcatccacaccccaattccggcccacacctatggctcaggccgaggctcaggcccatcttcaatcttctttcccagtcctatctcctgcttttccatccctgattaagaacactggagtagcttgccctgcatcgcagaataaagtgcaagctctctccctacctgaaactcagcaccctgaatggcctttgttgaggagacaactagaaggtaggttggctttaccctctagggtccaaaaatctcaggacgtctttagtgtctccactcctaaccttccccaggaaagtttgacatccattctgcctgagaactttccagtcagtcctgaactccggagacaactggagcaacacataaaaaagtggatcatccaacactggggcaacctgggaaggatccaagagtctctggatctgatgcagcttcgggacgaatcaccagggacaagtcaggccaagggcaaacccagtccctggcagtcctccatgtccacaggtgaaagcagcaaggaggcacagaaggtgaagttccagctagagagggacccgtgcccacatctggggcaaattctgggtgagaccccacaaaatctatccagggacatgaaaagcttcccacggaaggttctgggggtgacttctgaggagtcggaaaggaacttgaggaagcccttgaggagtgactcgggaagtgatttattaagatgcacagagaggactcatatagaaaacatcctgaaagcccacatgggcaggaacttgggccagaccaacgagggcttgatccccgtgcgtgtgcgtcgatcctggcttgctgtcaaccaggctcttcccgtgtccaacacccatgtgaaaaccagcaatctagcagccccgaaaagtgggaaagcctgtgtgaacacagcccaggtgctttccttcctcgagccgtgtactcagcaggggttgggagcccatattgtgaggttttgggccaaacacaggtggggtctacccctcagggtcctcaagcccattcagtgctttaaactggaaaaggtttcatccttgtcccttacacagcttgctggtccctcctcagccacctgtgaatctggggctggctcagaagttgaggtggacatgttccttagaaagccaccaatggcaagtctgagaaagcaggtgctgaccaaagcatctgatcacatgccagagagtcttctggcctcctcacctgcatggaagcagttccagagggcaccgcgaggaatcccatcttggaatgatcatgggcccttgaagcctcctccagctggacaggagggcaggtggccatctaagcccctcacgtacagcctcacaggcagcacccagcagagcaggagcttaggagcccaatcttcaaaggctggagagacaagggaggcagtgccacaatgcagagtccccttggaaacctgtatgctggcaaacctccaagccacaagtgaggatatgcatggtttcgaggctccagggaccagcaaaagctctctacaccctagagtgtctgtctcccaagatccaagaaagctgtgtcttatggaggaggttgttaatgaatttgagcctggaatggccacaaagtcagagacccagcctcaagtttgtgccgctgttgtgctccttccagatgggcaagcatctgttgtgccccacgcttcagagaatttggtttctcaagtgccccagggccatctccagagcatgcctgctgggaacatgcgggcttcccaggagctacatgaccttatggcagccagaaggagcaaactggtgcacgaggagcccagaaacccaaactgtcaaggctcatgcaagaaccaaaggccaatgtttccccctattcacaagagtgagaagtctaggaagcccaacttagaaaaacatgaagaaaggcttgaaggattgaggactcctcaacttaccccagtcaggaaaacagaagacacccatcaggatgaaggcgtccagctactgccatcaaagaaacagcctccttcagtaagccactttggaggaaacatcaagcaattttttcagtggattttttcaaagaaaaaaagcaagccagcaccagtcactgctgagagccaaaaaacagtgaaaaacagatcatgtgtgtacagcagcagtgctgaagctcagggtctcatgacggcagttggacaaatgctggacgagaaaatgtcactttgccatgcgcgccatgcctcgaaggtaaatcagcacaaacagaagtttcaagccccagtctgtgggtttccctgcaaccacaggcacctcttctactcagaacacggcagaatactgagctatgcagccagcagtcaacaagccactctcaagagccagggttgtcccaacagagacaggcaaatcagaaatcaacagcccttgaaaagtgtgcggtgcaacaatgagcaatggggcctgcgacatccccaaatcttgcaccccaagaaagctgtatccccagtcagtccccttcagcactggccgaagacatccggtgcctctagccaccatcaccactgtccaaggcactgtcttctttgggaaggtatctga

SEQ ID NO: 62085 - DNA, 2450 bp, Homo sapiens
cgctccagcgggaggcaggatggttgctacctggggcggccgccagctcctcccgcagtgctccgggccgcccctcaccccagggtcgcccgctcctagtgtggcccaggcttcccggcctgcccctcccagccctaggaagacgtcccccgggccccctcagccctccgcctccccttctctccctttctccccgctcctggcaggctgcagccgtctcctcccggtgctcgctccttccttgagctctgtccaccgctgcccactgggggctagagcttcccggctaccctggaagctggaggctgggaccagctcttcaggtgacaggcctctgtgtctccacagtggccagaggggagcctgcctgactgatgagcaaggctccactttgtcaccaaggcagagaaggggcccgggtaaatgaccccggtggcccccacccctgcctggcatgagagtgggtaggggcttcggacttgaggggactggagcgggaataagggtcttctctggcccagcctttgactgaagctggtctggagacaggggcgttagagaagtgactcatagatggcctaaataagcggggccactcaaggacccaggacagggggaagagggccaacccatctggaccgcaggcaaaccccatggcctttgagagaagagagaagaggacccggtgaagtaggctccgagggcctcagcccagcaggagcgcagggtgggcgcgtgatgtcatcgaagggaagacagtgacctgggggagggccgctttgagggagagtgcaggccaccgccagagagctctgggagccgagggcagggaagactttcagatgttgcttgtccaaggggtgggggtggaagggagagagagcagaggctcgagagggatgtaggagagctgatggcactttggggacagcctcagggctgcaattgaggagggctctctccctcatgcaggcttttcctccaggagctgcaccaggaactcacagaggatcagggagaattctgagaacatgctactgtggtgctgcctagagaggaaggataaatgatgacaagtacatctctgagtaacgtatgggcacttgttcatgaaaactgtttttctgaaagcttgtgaaggtcttgaaatactcgctatcagttgaggacaaacatttacaccctccttccacagggagttcaagcaggctggatgggtccatctatggatgatcttccccagccccttcctcttcccagctcatccctggctctctgtgtgaacaggtctcatcagtggaatgtggttgatgaagtgaggtcttcaattttctcatctactgtgtggtcatgttattttcctcatctgaggcttaaaaactcacctgcatgcagcacatgacagcttaaaatctcttgtgaacaaaacagtaacaaagacacccaccagcgttgagcatcccgtgttgatgacagcgaccaccaggggtcaacgtcctcttcacaatcctgtgtcagagcatcacttgactgatttcattagcaacttcccaggagaatcagcttacaaaatacttgtcccattttccatgcagatgtaacccatctattttactgaagaaatgggaagagctgaatgctgaatacactgaatgtctgcaggttgtgcaagtttgtgactttatcactttctaatttctgatctgtgtggaccactctacagatttttctcactggtgtgatcagccttctggatgtcaaatataatagactttcaataatataaaagtcaacacaagctcctcatggtttcagtgctcagtgatgactctaaacttacacaatgtgtttctttattagttttgttttctggtatctctactcggcatcttcaccacacccattttatgtttcttatacaggctttcttctatgaaatgctatgtcatgaatatgcaaataacctgagatccactgaggtaaatttggatgtctgtgccctgagagcatcacccaacaaccacatccctcctctatagaagcccctgagaacacagctcctcaccatggactgtacctgggggatccacttcttggtggcagctgccacaggtgtccattcccaggttcagctgttgcagcctggggctgaggtgaagaagcctgggtcctcagtgaaggtctcctgccaggcttccagatacaccttcaccaaatactttacacggctcacatggaagagacttgcctcatctcaaatgagaccttggactgtggacttttgagttaaggctcaaatgagttaagactttggcagactcttgaacaggcatgattggttttgaaatgcgacagcaatcatgactctagaggaccacatgtgaaatgcaacaagcaggagcagaagacaagtaattcattatttcactgtagtgcattaaaatggtaga

SEQ ID NO: 62086 - DNA, 846 bp, Homo sapiens
atggggaagaaggagaggaggcggagcggcgcttccggccccgcctctgaggtcgacggcgacgcgaatctacgcgacgcgacgcggagctcggagcagcgttccttccctctcgtagaggctcaggcgcaggcaccgccccacggcgaggcgcgtcccttagcagagcccgccctgtctctgcggcagcctatcgacgccagcccgcgggccgatcctgttcccgcccccgaccggagcctttcgggtggctccgcccacagcgggcgtttcctcaagccacgcctgcgcaggtcgtcgggggagactgatgaagagacgactatccccagaccgtattttaactactatggcgctgtgtaagaagcaacctgagaagtgtggatgaaaagctacaggtagagccctgggcccaagacggtggcttggacaacatgctaaataaactataaactagatggtatttgaagctacgagagtagataaaaatgacaggaggaccaaggagaaacttgggaacgccaatgtttaagaaacgggaaagcaaaaaaaaaaaaaaaacacacaaaaaaacaatgtaaccagagccacaaaaaccagaatcacagcaagggattctgatgtttacattatgtcctgtttccatgttgacacattacacaaggacagtttttttctaattgcttaatttttcatcatcttccatccgatttacttaaccatccttaactttaggatgaatcctttcatttaacaaatgtgttttgaatgtccactatgtgccagacactgttctaggtgctaggaaaacagctgtgaacaaaaccaataaaaatctctttcctc

SEQ ID NO: 62087 - DNA, 1007 bp, Homo sapiens
atggcagcagatgacctgttgacatcctacacagaggtcctggcagtgggaatagagaaacagatggtgcttcctgaggccccaggacttgtgccccagtatacagtctggtggccagcatggcatcgtgctcagcagaacttctccctcctcctcgctgttgtggtccagtccaaacatcccagccccaacattccctggttccccagctctgtgacatcacagacagccttctgtctactctgccagctgcagtgcaatggggtcactagagacctgaagttcatacccactggggacaacccaagggccctcttctttggtttctgcttccctctagagggggtcactggacctggaccagctgggatcattggaagccagaaacagcccagcccagtgaactgggctcaaactcaagactggctgattcaacaaggcacccctgcagacaaagctggcagagtagaagtttcaactcctttccatggggactgtcaggagccctatgccatcaatgactccaaggttcccagtcaaacccaggagcacaagccatcgacccaaaatttgcagcttcagaaggatgagcttgacagacaaaatcccaagcgcattaacgcagtctcccatttgccttcgagaacacccctgatccagacaaaaaagagcacttcctccagcagcagtgagtttgaggatctgaatgcatatgcttcccaaagaaatttttacaagagaaacttaaaccgctactgccaggagcactggccattccagccatgcctcactgggaggccctgagcattctagccggcggctgcacagctgctggggcatctccatgaggaagagggcggtggacaggagtcatgaagactaattcggaaactcccctgaaggaggagaagacatctgagccatccttgtgccaccaagcaagagtcactccagctcctaaaaagccaccatgggaagagctgcctccaattaaagttcttgattgc

SEQ ID NO: 62088 - DNA, 429 bp, Homo sapiens; identical to SEQ ID NO: 61971

SEQ ID NO: 62089 - DNA, 1681 bp, Homo sapiens
gcctcagaaaggcagaaaccaggaaagctaagacaaacaaaactacaatggaagaagaaaacgtcctcaactagacatctgccaaaaatgaacatgagcagctgacctactcttccacaaggtccaaagcccccagtgtcatcatcacaggtcttaagccagccaccaaatatgtatttcacatccgagtgagaactgcgacaggatacagtggctacagtcagaaatttgaatttgaaacaggagatgaaagactctccatttcaagtgacaaaactgtactggcttaatgaaaagtgggactttattgcctcagcttctgacatggcagcagaacaaggacagattctcgtgatagccaccgccgctgttggcggattcactctcctcgtcatcctcactttattcttcttgatcactgggagatgtcagtggtacataaaagccaagatgaagtcagaagagaagagaagaaaccacttacagaatgggcatttgcgcttcccgggaattaaaacttacattgatccagatacatatgaagacccatccctagcagtccatgaatttgcaaaggagattgatccctcaagaattcgtattgagagagtcattggggcaggtgaatttggagaagtctgtagtgggcgtttgaagacaccagggaaaagagagatcccagttgccattaaaactttgaaaggtggccacatggatcggcaaagaagagattttctaagagaagctagtatcatgggccagtttgaccatccaaacatcattcgcctagaaggggttgtcaccaaaagatccttcccggccattggggtggaggcgttttgccccagcttcctgagggcagggtttttaaatagcatccaggccccgcatccagtgccagggggaggatctttgccccccaggattcctgctggcagaccagtaatgattgtggtggaatatatggagaatggatccctagactcctttttgcggaagcatgatggccacttcacagtcatccagttggtcggaatgctccgaggcattgcatcaggcatgaagtatctttctgatatgggttatgttcatcgagacctagcggctcggaatatactggtcaatagcaacttagtatgcaaagtttctgattttggtctctccagagtgctggaagatgatccagaagctgcttatacaacaactagacccacaaatcacaacaaagagcaatcagaactggttaaagaagatggtctggaaagcttgtgtgagcagtgcgagtccagctctggttatggtactggactggtcctcatgtggaagagaaacagaagggccatgggagccagtggccagaccagaaagcaatgtgacaagagagataaccctccaacagacctcttccaaactctaacacttaacctctgctattctgcataaattctgagaaaagccaaattttctgtcggtctaagaagacatagcctacacccaacatggagataattataaaaaataatgaagcagcatgaggggaaggtatttaatgtgtattttaaagttgggagagattctccttcacctaatttaggtgtttgtgaattggcttgactttttgaagttaatttttaagccttgaacatgtccaactttaagaactttaagaataaatatttta

SEQ ID NO: 62090 - DNA, 1585 bp, Homo sapiens
gctaagacaaacaaaactacaatggaagaagaaaacgtcctcaactagacatctgccaaaaatatcatccagaatgccctggcaagttcacttccatttagtgaagtgagataatttggcaattcacgcaagagactgagaaccaagcctcaagccctgcctctgattctgcaggtatggaacatgagcagctgacctactcttccacaaggtccaaagcccccagtgtcatcatcacaggtcttaagccagccaccaaatatgtatttcacatccgagtgagaactgcgacaggatacagtggctacagtcagaaatttgaatttgaaacaggagatgaaagactctccatttcaagtgacaaaactgtactggcttaatgaaaagtgggactttattgcctcagcttctgacatggcagcagaacaaggacagattctcgtgatagccaccgccgctgttggcggattcactctcctcgtcatcctcactttattcttcttgatcactgggagatgtcagtggtacataaaagccaagatgaagtcagaagagaagagaagaaaccacttacagaatgggcatttgcgcttcccgggaattaaaacttacattgatccagatacatatgaagacccatccctagcagtccatgaatttgcaaaggagattgatccctcaagaattcgtattgagagagtcattggggcaggtgaatttggagaagtctgtagtgggcgtttgaagacaccagggaaaagagagatcccagttgccattaaaactttgaaaggtggccacatggatcggcaaagaagagattttctaagagaagctagtatcatgggccagtttgaccatccaaacatcattcgcctagaaggggttgtcaccaaaagatccttcccggccattggggtggaggcgttttgccccagcttcctgagggcagggtttttaaatagcatccaggccccgcatccagtgccagggggaggatctttgccccccaggattcctgctggcagaccagtaatgattgtggtggaatatatggagaatggatccctagactcctttttgcggaagcatgatggccacttcacagtcatccagttggtcggaatgctccgaggcattgcatcaggcatgaagtatctttctgatatgggttatgttcatcgagacctagcggctcggaatatactggtcaatagcaacttagtatgcaaagtttctgattttggtctctccagagtgctggaagatgatccagaagctgcttatacaacaactgacctcttccaaactctaacacttaacctctgctattctgcataaattctgagaaaagccaaattttctgtcggtctaagaagacatagcctacacccaacatggagataattataaaaaataatgaagcagcatgaggggaaggtatttaatgtgtattttaaagttgggagagattctccttcacctaatttaggtgtttgtgaattggcttgactttttgaagttaatttttaagccttgaacatgtccaactttaagaactttaagaataaatattttaacacaa

SEQ ID NO: 62091 - DNA, 1047 bp, Homo sapiens
atggcgtcgcggccccgcccccggacgcccagccgcggtcccagcgaccttcgctttcgtggggaagccggactgcgccgtgtcttcctgaagaaggctgggggatcagtgtccttcagtgatgtggctgtgggcttcacccaggaggagtggcagcatctggactctgctcagaggaccccgtacagagacatgatgctggagaactacagcctcctcctctcagtgggatattgcattaccaaaccagaggtggtttgcaagttggagcatggacaggtgctgtggatattagaggaagagtccccaagtcagagccacctagactgctgcatagatgatgacctgatggagaagagacaggaaaatcaagaccagcatttgcagaaagttgattttgtcaacaataaaacactgactatggacagaaatggtgtattaggaaaaacattttctcttgacacaaaccccattctatcaagaaaaatacgtggcaactgtgactcatctggaatgaatttgaataatatttcagaattaattattagtaatagaagctcctttgtaaggaaccctgctgagtgtaatgtacgtgggaaatttctcctctgtatgaagcgtgagaatccttatgccagagggaaacctttggaatatgatggaaatgggaaagccgtctctcagaatgaggacttatttaggcatcacagaggatacacagaggagagaaaccctatgaatgcactgaatgtgggaaaacttttggatataggtcatgccttgcagtacatcaaagaacacacacgggacaaaacctatgaatgtaatgaatgtggaaaaaacttctgtgagaagtcaaatcttcatgtacatcagagaacacacacaggagagaaaccctatggatgtaatgaatgtcagaaagcctttggtgataggtcagctctaaaagtacatcagaggatacatactggcgagaaaccctatgagtgtaaggaatgtgggaaaactttctcccagaagccaaacttcattaatcatcagtga

SEQ ID NO: 62092 - DNA, 1658 bp, Homo sapiens
tcctatgaagctttttgccttaaatatttttctctgtttataagaatgtgctgtttcctaggccagttttgtacacactcttccatagaatagatccagaagaaacacaacaatactgccttcatcatatcaggagatcttgataccaaatacgagtgttgcctccaagatgcaagatcctgagggctccaaagaatccactgtccgtcgcaaatcgacggtccgccagctcagtttcagagacgtggtgctccgctgcaggcctcatcctcaggtgcaccctggcagtcagccatctgaaggtactatggaaattcagttactcactcttgggagcagaaggattccagaccattcctgtgtgcaccctggcagggagccatctgaagatttcagggaccacctggaggggagcggaccagagagacttcctcggaataggctgtggctcttcacaaggtgtcttctatgctttatttgggagccattgccttgagcgttatttcccagatggttttctaatgtcaccaactgaagaaaagacccatgcacacaggacacagcatgatctgatgctcacagcgttttccttcctctctgaaaacggactcagcgattctggcaagcggtacttactctgagatcacccgtttgctaaggaaaaatcttagtactgagaaaggtgacactttcctccctgcttttgctggagagacactttggttatgagttatttctagcataacacagtttatttcagaagtccagctcaatagcagaccaaggcatgaacaacacatgaaaatttatgttgggaaaatatatattgtatgtctgcttgaactgtgggttcttgattaatacaaaactggttgatgaaggttgttaccttcaggaaaatgcaaatctagtggagggacaaaactcacagtaacagtatttcatcatagccaccatgaggcagtacattatgaagcatgtcagtgatgaattactggcaggctggtctgtcattgaagctacactctgtttctagcttctgttgcttctgctgtctctctcctaacatctgcatattcctccactttgtggtggaggaagcattagggctgatataggggatttccagtgagtgtataattcagtgcagaattggcaggaatatattccatggttaggagctggagaaagtaagaaataaaaatagaccttgaagaatgggtaggattttcaaaatcagagataaagacgcaagaaagagaattcactttttcaagtttctaagcaatcatatttacatgcatagacattttgctggtttctgtcttactaatgtatactacactgtgtctaatcactctgagggctggtatttcgggtctgttccagacactcaggaatcatttgttcagcttgttctatatgctgaaaactgttgcagggatggatatatgcagtccttgtcccaaagcagcttatgactccaagagcaagggatagaatatgaacatgtgtctttgggttacttctaggggtaagaatgagttctgtgggcagatgcatacaggaagtggggagagggagaatgagatacaaactatccaggcaggaggcattgcagtaatcaaagtgaactatgagagaagcctggggtgttg

SEQ ID NO: 62093 - DNA, 5060 bp, Homo sapiens
tcctgagggcagcgaggagggagctgaggcacgcgggctctcaatcgacgccccacagagaccaagaggcctggccttggggggcagctgcttgaaggaggcagagcggaagcgagggagactgctggaggccctgccgcccacccgccctttcctccccctgaggagacgcctgacgcatctgcagtgcaggaggccgtgggcgttagaagtgttgcttttccagtttgcctgattgctgagacactcagtcaggaaagtatgaatgattctaggcagcagtctctgttcttcatcacacttccagatttaaacaaactctgtgctgtcagaataatactgagtaataaggtggcagatactgagattaggactatacaaatgaagatgtgcaggcaattgctgtttttgcatcaagatattcttacatcacctgtgtctggaatattaaaccaaatctgggtggtgatggcgataccattttataaagcaagaaaacttaatgcctatgttgaaaaatatggagctaagatggaggctccacaaagagtaattcctgtaattcttcagaactgcctgtcatattcattcatggctagacttgctccagcctggaatagaactggtcatctcttgatacaaggaagagattttctttctcagatgggaaaacaaagtgctgttgtattaaacatcaatgtaacagaaactcaagtttgtctaagtatagaagcttgcacaatcagactgccagcacctgagctaaaagagtttgagatttcccagagtattataaaggattttcatgctaacaagcatgctgtcattgagagacattccattttaagcaactggtgctacgttttgccaagtatgaaaatgggacaaattataaatatttttcatgccatccccgctgcctgtccttttcactcatatggagatttccagagacactgggatgccctgtatggctataaacttccaggtgattgtggaaaaattaaaatatactgcaacatctatttcaaaatgctcggagaaaggaccttcacatatcctctcagttgcatcagaagtcagcccatgcagttctttccaagggtagattcggaagttgtgttgaaaagttttctttcagatttaaaatctaaactgccccatatatgtggatttcccataaagatgacaagtaaaccatgctactacacacaagaactaactaaacctaatatacaggaacacaaagtcaagccacccaatttgaccactaaaaaaatgcttagggcatctctgactcaagccacttccagaaagcctgcctgtgctcaaagtcttctaccatgttcagtagcagtggaccacaaggtggagctttcagtcagccagccaacatcaggcattttctcagctttgcatctccagccagagtctgttcagggtagaaagaaatccctgtctatcagggctccacaagtacattcagaagtattaatgcccaacagaggaaatactcaagttcagcacacaaatcttagctcccaaagcaacatcacccctaagtttgtaccagttttcaaaaatagattgttacaaatgaacaaaaatacctcagtacttggcagcccaaaaagaaaacagcatgatgtgacacaatctaaattgttttcactcaaaactagtatgatccagcatgacaaactgaatttaggtccagctataaaaaaccgttatagtagtaacattcagatgcaggctgctaacaatttaaatcaggagaattccagacctctgcaagaaaaaaatacagagtcttctgaaaatatgacaaaatttccctcttctcgtggaaaatcgactgtgagtttaaacaaaaataagcaactatctaatagtgcagtatttgtggtgtcaaataacaatttaggggtggtaaaaagtgctgttgacttccaaatgaaaggaaaagaaaatttaacaggcaaaggtataacacaaattttagggaaaagccatgggtcactaaaactgaaaagacagccacacatttttgaatcagatggagaaaccgaagatccacgactgctacagcagcaatcagaaaatcaagctaaagaagttggtacaagtgaccacaggttgatagtaagcaaaatagcccacaggtctaaaagaaaattatgtccagagtcttccaaaacttcaaagaagcatcattccgatactgtgcactatggccaatccagttcttctaagaagcagatacttgactcggataaatcaaaacctaagaaatctctcatcattcataatgcttagaacatggacctgaaagaaggaaatgtctaccagagatgagcattctgaatataggatgaacactcttccagatgcctctcacactcctgtgaccatgaaatcagctctacttactgctgtggaacctcctttttcacttgacagtttctttttattgtttgcatagcattttgttgtatgtgggtttctgtatttaactagtcccctattgatagacatttcagttcttcccaacttttcactattacaacatcatgtagtctgcagatctttgcaaaatatccaatgatcttatacagtagttttgatagttgaaaatatctttattttgcccttattgaaattatcaaaccacataaagcacagataagagtatgaagaacctctaagtacctatcacccagatctaccagttattaatattttgccactgtttcatctgttcctcacagacatgcttttttttgctataatcttttaaagcaaattcaagacatcatataattttacccataaacaccaaagtgtatatatttctaacataagatatagtatattttttaagaaaaaaagaatgtgtatatatatattacattttggggatctctactatatctctgcaggctcactaaatttcacttttgcttttatatgcaaattaacaggaagccctgaataaatgtaaaagctatttctcaacaaaactggagcctttattggggtggagatttctgtttccaccagtactcattagcatcttctgtgtgccaggcagtggggacaacactgtgtccatggcagaaatggatgagacagccgtggcctgagcccctgagtgctggtggtctagtctcaagcaaattcattctgggttcctggcacagacttagggatatgtatgtattgaagcatatgtccagaatgaccttctagtccatattacaaataaattatctaacatttgaaaaaaagagaaacagaagtggagcttctcagacaatgaatattattctggctttcaaacattttatatgtttgatatacaaaatattatataattgttgtaatatatttaaaagaaaccaaaatcttcattggctattccactgaaacaataattacataaaaatagccactagagatccaagtataagttgaactctgattttgtaaatgtgatttattgtctccaccactttactaaaccattgcaattaaaagcaaaagtaaacaaactctccttcaaacgttaaatgttaactcctgctcctgaaattgtgtttagttaattaatttgctatatacctttattgtaagcatttctgttttccagaattatctctatttcccaattattttaccattttcataaggataagcattttgtctgaagcccattttgagtgtgcttttctcattccaaagtttgtattatagatatctagtagactgttataaagagtggtatgtcattttgtttatgaggctatggtgaaaataacattagtaaatatgcatttttgatgagcacagtcatccacagcatgtaatcattcctaaaaccagccttccccactgttccatacattcccaggccaccttcctgctactgcccagtcactatgcctcaggtaatggacacttactttattattacactgagcaaaataatgaaaaccatacatccactgctgaagtggtattaacatcttccagttctttatataaataatcttgatagcccctcctatactccattagtgtctaaaatttagaatatatagtatagtacttgagtttagatcaatgttaacctacatggcaaaacctgccatgttaatattagtgtatttttttgtataaagtaggtttgatttttatcttacaatatttatcctaatgaaagttataaaaatatatgcatatatttatatgtgagatttaatatagataggtatatagattgttgatttcatatttcatgttccaagaagaggttctagatcaaatttctgtgttcagaatcaccagagaaatcaattaagattttggttcattttaaacattgcaatttttgaaagccaagataattccaaatctaattagggaaagctacattttacttatttgtgtaagttattggtgatttatatgcagtatggaccatcctccccccagaaattattcttatattccaattgtgcattagttttagaaccattttaattttaaaaccgtaagcaaataattttatgtttgcctatgtccaggagctgaagaaatcagcgattactttaaaaaatatatggcaatgtcaaaataaatgccaagaatcatatttctaggaatgcaaaagtgcttctcatatactcatatattaggtttcacagtattggttgcttactatatttgtttttatttttattatatatcataattacacatttttatttgcatttgttgcttattgtagtaaaaaggtaaaaaaaaaatgaacttgttaatgattagcttttatttgactaaccagttgaccaattttgctctgttttcaaattgcatatgatggggtattatgctgaaactgctaatatattgggtatttattgatacttaggaatagtcagtatttataaatatttaagaatgtcatggtccttatgttttgatgtttaaaatgttcactttgttgtacgctacatagtgtcttattcaaaattgaaaataataaaggtatttct

SEQ ID NO: 62094 - DNA, 3591 bp, Homo sapiens
tgacattctggcactcctggagagacaagtcaaaaaaaggagtgatttcctgatgtggaaagaaaatgaaaataaagcagaatcttttccaaaacaacgtaggccaaactatcaactaaattcttcacagaaaatgttagcctcaattgcagataagcaagacttggcaacctcccttcctttttggggccagtaaagacagactagaacaactgcacatccatcagcagcccccatattctaagtgttttgaggaccatttggagcaaaaatatgtccagctcttctggggtctcccatctttgcacagtgagtctctgcatcctactattcttgtccaacgtggccattcctccatgtttgtattcttcaatggcattacaaatacatctatatcccatgaatccccagtacttccccctccccagactctgtccttgcctagtacccaacctctaccctcgcctcaaaccctgcccagaggtcagtccccacatctcactcaggtccagtcccaggctcaatatcaatctccaatcccagccctactacctagtcctctatttctgtttaggtgtgtggattgtgttttcatagaccccaggatgaggcacggtctcttatgccatctgaaattaatcatctggagtagaacgtgttgcagaaagtgcaggaaagtgtgtggggtttaccctctgtggttcaaaaatcccaggaagacttttgtcctccaggtaccaatgctgtattggtcagaaagtctttcaaggtccatgttcccatctccatcattcctggagattttccactcagctctgaggtaaggaagaaactagagcaacacattcgaaagaggctcatccagcgcagatggggcctgccccgcagaatccatgagtctctgtcattgctacgtcctcagagcaaaatttcagagctatctgtgtcagacagcattcatggaccgttaaatatctctttggttgagggtcagaggtgcaatgttctaaagaagtccgcatcaagcttccctagaagcttccacgagaggagctcaaatatgctttccatggagaatgtggggaattatcagggatacagccaggagactgccccaaaagatcacctattgcatgatccagagacatcttcagacgaggatctgaggtctaactctgagagagacctagaaactcatatgatgcatctgtcagggaatgactcaggggtgagactaggtcagaaacaacttgaaaatgccctgacagtacgtttgagcaagaaatttgagaaaatcaatgagggtcgaatgcctgggactgtgcatagttcatggcactcagtcaagcagacaatgtctcttcctgagaaatcccaaagccaaattaaacatcaaaatctggtagcattggtgagtgaggaccactgcgttgatacttcccaggagatttccttccttagttccaacaaacaaaagatgttggaagcccatattaaaactttccgtatgaggatgctgtggggccttccctgcaaggtccttgaatccatagaaatcttcaaatcggaagaggatatttccaattccttttcccatttctaccttccctcctcagccagctttatttctcagggagattccaaagatggggtctctaagtcttgtagacgaagcacttttcaaggagaaaagttgggaacaacaagctcagtccctgtccttaatcatcctcagcctgtctcctcacctattggcaaagaagggcaggggaccctgagaagacaattttctgatattgaccatgaccttatagagacagatgccaaagatggtgcctccacgccccttagaagaggcactacatattttcaaggagaaaaattagaaacaacaagctcattctccatcttgggtcatcctcacctcgtcacctcacctgttgatcaagaaaagcaggggaccctcagaagagaattcgctgatactgacgaggatcttacagaaagtgtctggacaactgaggatggcagacagacttttctgccccccacatacagcatcatagacgaagtcatcagaaacagactgtacttgccagtagatgcagtgcagagctgcccatactgcaagctggagttggccgtgattcaagggataagagagagagtgccagtaataatgttaacaggcttcagggcagtagaaagacctttcctgtcaccaatgggtcgaaggagatgttcaaggaagaggagatctgtactcttcaatcacaaactaggaacaacttgacaaccagcaagtcaggaagctgcttagtgacaaacgtgaaaagaagcacttctcatgaaactgaaattttcccaccaagaatatcagttcctcaaactcctaaatcatcatatcttaaaaatcagatgttgagccagttaaagttggtccagaggaagcatagccaacctcagagccatttcactggcatgtctcttgccttagataacttgagttccaaggacttactgactcatgcccagggcatctcgaatcaggacttgggaacttcccaggtgctgcatgtccacttggaggtcagaggaatccgtgtggcacagcagcaggagcccagggtccctacgcatgtcttacagaaatgccaagttaagaatttttcaccagctacaaagagagtgagccctctaagacctaatggaggagagcttggtggaggggatgcagggttggggacatcccaactcagaagaaagagccatgctattcataacaagacatcaagggagtcgcttgggagcaaatcttccccaaccttgaaaacacagcctcctcctgaaaaccttttcggaacattgatgaagacctttttgcagcagtctaataaacccatcataacatatggaaaacaagaaagttcctaggaaaagggtagctccttgtcatcatctgtgcagaatagaggtcgagttaaaagtagagctgtctttactgggactattgaagctcagaaaattaggaaagacactggggagttcatagaagagaagctggggcatagacattgaatagatatcacctgtccccaggagcccctttcctccccagtgcagcttgggaaatctcagaatgtgccagaactgcaggtcagagcagagcctgtccagggctatccctgcaactacatggctccctcctgcaaagtgacatgtaccaaatcttgcagccaacaagctatctttgtcggccagaattatcctgcaatgattagacagatcatagacaaggacagatagccccaggaagttggacatttaaggggaagatattgtgtcaaaggcatccccaatccatgccccacaggaagcctgtgccacagccaaaccccacttgcagtgtgaagtcaacctggtgcctccggtcatcctgaccagtgctaaaaacactgtgttcagtgatgtgcctttactaactggacagaaaatacttccaaagcatttgcagggaggaaaatttccccccaaaaaataattaactccttgttgagaatcttgactctccccaataaacgttctaataag

SEQ ID NO: 62095 - DNA, 555 bp, Homo sapiens
atggcggtttcggcttttcggtctttcctgctgccttgtgaagaaggtgcttgtttcttctttgccttctgccatgattgccatgtgaatcgcacccctggaactgtgcagggcccacctgtgtggccacacgcagtgaccctgagcaaaggagtgaccacagaagtgcatggcaaagcagaaaggtgtgacgtcttggaggacgcgggaggaaagcacgcccagcggacaggagccatcacgcggctgcgggctgctgctgagaacctggcgtgggccaccgtcgtcagcagcgtggaggtaactgacgaccttggccaagaagttgggtggcagcgtggaggtcatgctcagagagcctgcaggaccgctgtggggccactgccaccctgtgggggtggtccggggagccgaggagcatggacaccgtcttctccttccagcaggcacagtcagagtccatctggataatcctggataaatctcatctggagatccttcaccagatcacatcggcaatgacctgttccccaaataaggccctgtgcacaggtt

SEQ ID NO: 62096 - DNA, 1175 bp, Homo sapiens
ttcaccactaagaagttccaaatgtcggaggtctctgacacttccgaagaaacccagatacttcgagacacttttgctatagaatcatttagaacatttcagtcccatttcaccaaatataggacaccagtataccaaaccccttacactgatgaaagggcccttctcactctcatgaagccaacaacatcaccatcttctctcactactctactcagaacatcacagatttcacctttggaatggtaccagaaatcccgattccctcctatagacaagccctggatactgagttcagtttcagataccaagaaacccaaagtaatggtgcccccttcctctcctcaagaacttgaagaaaagaggtattttgttgatgtggaggctcagaagaagaacctgatactattaaatcaggctataaaaacttgtggactcccttcacagctacacacaatggctaggactctcataattgagatacttcatatggacacagttcagttgggatacttattccgcaagtacattgcctataggctgatccagtatgccaggaacaacataatgaaacgactaaaagccatccaaaatactgggaaaggctatgaggccaggaacctccacatgatgctgagcagacttgatgactacgggaaaaaggtgatgcaggtctggactgagaagcagaagtctctagggcagaaacggaatcagtgcctgaagaaaatgatacacgtattcaaccagctcaaaaagatacatgaattgaatcttagtcaacctatccccttaatcatcgaagaaaagcagatacctgcctctaccacatttgttcaaaagccattcttaaaattactaatggaagaggacagaacctctgacatatgcaagaaatttaggcaacaagaggaccagacagaggccatctggaatgttgatctgtccacttcaagctacccaatagcagagaagacatctatgcattcactctgggccgagctgggtgggtacccagatattcccaggctgcttcagttagaagtgcagtctaccttccgaaaatctcttgcatccctccaatcacgggttaagaagattcccaaatgactgtaaaattaaatacaagcatgttgaaagtacatttcagtatctttcagtaaaatgcctatttt

SEQ ID NO: 62097 - DNA, 1329 bp, Homo sapiens
atggtagaaagaaagaatgaggtagaggaaacagaggtaaatcagtacaggtctatatttacatatccaaatctagcagccaacatttttggatttcagacccagtgttgcaacaacaagtcgccagtgttagaagtgccctggctatacatggtgatggttacagctttgactgagattactcctgacacaggtcaggcagagcactccaacccaccaccctccactgacttccttcgcactcagcccactcgcacccgggtgaataaacagcctttgttgctcacacttagcctgttcaagttgtctcttcaattagatgctcgcataacatttggtgccgaaagcccgggataggggaactcctccggcagacctctcctctatcctcccggtacccacgttctcccatgcaagagacttccctcgccctcaggacctcagaccagctccgcgagcactccggcctctgtctatggatatggtgttcaataatagggaagagactgcccggcgacagcgcatttcagaactacagatgcttgcctccgccataagacaaaccccagctgcactgcctacctgcaagaacttcaaggcatctaaacgcaacatccaacagcccctctgggactttgcttcaagcgatgaaaacctggccactgggccaaggaatgcctgcagcctgggattcctcctaagccatgccccgcctgtgcgggccctcactggaagtctgactgcccgactctcatcgccacttccggagctcctggagctcaaacccaaagctccccaccgactccttcccagatctcctcggcttggcggctgaagactgacgctgcccgaacgtctcggaggccccttagacaatcgcggatgccgagcttcgggtaactcttagggtggaggcataaaaagacaggaatgttaggtcctctgagcaggcggcgccatggtcaagccatcgtgacccctgtgactcacacgtacacatccagaaggtctcctggagccagaaagtctgggacgacaggaaaaccacaaaagaagaaaaacggctagttcctgtcttagctgatcagccaaccttgtgacattctatcattgtaacaggctgtaccctaactgatcaatcaacctcatgacactgtgctctgtaaccttatgataatgtaccttatgacattcttcccctgccctcaataaacagctccgaactataactttccactgcttacccctaaagtataaaactagctccaaccccaccacttccttttcggactcagcccacccgcacccagtgaataaacaaccttgttg

SEQ ID NO: 62098 - DNA, 1453 bp, Homo sapiens
aaactagccttgctgagagattctttgtctcagtgttgatttttgcaacaccgagcactagttcccaacaatttggtggcccgtatggggaataacattcccctcttggatggtgtttgcccctctctcatggggaggtgccctgccacccgttgttgccgcggccccagcaggagagccgggacctacctggtgtgaggaatatacttggagtctcagcatcggcggggaaagagagaggcttgtgggaccgtggtgaccaggtgactccgtgcgtgggccaaggaaatgtgaaatctcttaggccaagaagaacaacctgaggactctctttctggaggtaattgaactcctttagtaaatccagaggagaaatctgagatcagtacatcttttgtatctatgatagctaaggatacatcacttgaaagattcactgtactaactactttcttcagcatttgactcttggtccttgtgttgtgagctccttgttcctgcaaagctggctggggtcaccatagtgggtcaaaaaaaaattcatcaatgaaaaagatagggaatctccaatctctatcccaagacatgttctcgatgacttgagcacatcacacatcagcagatgctcaggatacagaagagagatttcatctatgggaaaaagaccctctgaaaagaagtgtgaaatcatcaaaagagccattggaggggacaccagagagtcgtgtggctgaggtttcacatgatcccgccatgcttccagtccagaggagaaagctagacccactcctcaaaaagtataggcatcataagaaggccacaaggacaaaaagaaggaggaaggagaaaatggaggcccagtgctcccctgttcctccaacaccttcaacaccaccacaaagtgaagaagatgaggctgtagacaaaaagccaactctactcagtgcccaggaagatactcctgaccttctccatgaggacagattacagtatctgcaggaagagggttccggtgtgatgcatcaggaatgtcagatccagtcctgtgagctctcggtggctcagaagcccaggccctcttctcctgcagtgacatccttggcatcaccaccactctgctttggcagtttcctaagctgtgtctgccagaccttctcaaggtctaggaagcagaagcctcccagaagaaagggtaacaaccaggctgaggcaggaggtgatgctgaggtcctgagacctggcccggcaaaaccagagttgagcctcagcaaaacgtgtagccacttgaaattgatagagctttcctttgtgtttagttttatagttctctctgtatgtcattgttcctcttagttgagtttttgcctgtcaaagagatagagagctgcttttatgctgagatcctcaagccaaaacccacagtaaacgcaaagtaaaactttgaggctttgaa

SEQ ID NO: 62099 - DNA, 1208 bp, Homo sapiens
ctgccccatacctctactggagctttcaatagtagtaaaggaaatgtgaaatctcttaggccaagaagaacaacctgaggactctctttctggaggtaattgaactcctttagtaaatccagaggagaaatctgagatcagtacatcttttgtatctatgatagctaaggatacatcacttgaaagattcactgtactaactactttcttcagcatttgactcttggtccttgtgttgtgagctccttgttcctgcaaagctggctggggtcaccatagtgggtcaaaaaaaaattcatcaatgaaaaagatagggaatctccaatctctatcccaagacatgttctcgatgacttgagcacatcacacatcagcagatgctcaggatacagaagagagatttcatctatgggaaaaagaccctctgaaaagaagtgtgaaatcatcaaaagagccattggaggggacaccagagagtcgtgtggctgaggtttcacatgatcccgccatgcttccagtccagaggagaaagctagacccactcctcaaaaagtataggcatcataagaaggccacaaggacaaaaagaaggaggaaggagaaaatggaggcccagtgctcccctgttcctccaacaccttcaacaccaccacaaagtgaagaagatgaggctgtagacaaaaagccaactctactcagtgcccaggaagatactcctgaccttctccatgaggacagattacagtatctgcaggaagagggttccggtgtgatgcatcaggaatgtcagatccagtcctgtgagctctcggtggctcagaagcccaggccctcttctcctgcagtgacatccttggcatcaccaccactctgctttggcagtttcctaagctgtgtctgccagaccttctcaaggtctaggaagcagaagcctcccagaagaaagggtaacaaccaggctgaggcaggaggtgatgctgaggtcctgagacctggcccggcaaaaccagagttgagcctcagcaaaacgtgtagccacttgaaattgatagagctttcctttgtgtttagttttatagttctctctgtatgtcattgttcctcttagttgagtttttgcctgtcaaagagatagagagctgcttttatgctgagatcctcaagccaaaacccacagtaaacgcaaagtaaaactttgaggctttgaa

SEQ ID NO: 62100 - DNA, 2413 bp, Homo sapiens; identical to SEQ ID NO: 61505

SEQ ID NO: 62101 - DNA, 627 bp, Homo sapiens
atggaaaaagaaaatcagcaaatgcttactctgattttggaagaatcgaaagaatcagagcgtgcgtactctgtggaaaaatcgagagagagagaaagtcagagcatgcgcataaaggcatatctggttccagaagaagatggtgaaccagcaatagctgctggcttccttcccaaacccaaccctgcagatgccacagaagaggtgggaagtggttggagttcagaacagttccttggactcataacctctgctgcagaatgccctcatgcaacagaagtctctctagagtttggaaatcttcaccaacaaagaaaaattctgatgtattctctttcagttgaacatcctcagatgactttcggcaggctccatagaatcttcccgaagatcatgcctgagaagccagcagaggaaggaaatgattcaaaggaagtgctagaagcatctggcccacagaacgatgggaaacagctgtgccccccgggaaaagcaagtagctctgagaagattcacgagagatctggaaccaaaagagggaaacatgcctggatccacagactgcgtgagagaaagcaactggtgatttatgaagagatcagcgaccctgaggaagacgacaagtaa

SEQ ID NO: 62102 - DNA, 351 bp, Homo sapiens
tagcctatgggaagcatggcctctgtgtgaattggtggtggattcaaagcacagcatctggggtcctgtgtcaattacgctctcctcaacagaagatctgagtggtggtgcatcttcatggctgctggaaggccccgctgtgtaattacgtctggaattggtgggttcttggtctcaccgacttcaagaatgaagccgtggatcctcgtgctgacagaatcaagttttaaagatccagttaaatgcctggctatcaacttgccaagagctgatccagatggaagccatcatcctaagagtcagacaactcattaactctaaagggactgccatgtattaaaaattctcttt

SEQ ID NO: 62103 - DNA, 1626 bp, Homo sapiens; identical to SEQ ID NO: 61963

SEQ ID NO: 62104 - DNA, 965 bp, Homo sapiens
cctgtcagtcgcctgtgagctcctgctccttcctgggcctgcagccctggagaatttgctcaccgaggtaggagtgccgctgtgggcagtgggcggcggcagcggacgagcggccaggctgaccacctctgcctgactcagatgcctaagggccgggccggcagcctgcccacgacctccatcggctggcgcttccagctctggttcctaggactcacctgcccggagcgccacctggccagacgcctcaagaacaatagcttctacccatttgtgcagcaggagccaaacatcttcgtgctcgaatactacctggacacactgtggaaggggatgctgctcttcatcatcagcgtggtcctggtcagcttcagctccctgagagaggtgcagaagcaagagacctgggtcttcctcgtgtacggcgtgggcgtgggcctgtggctcgtgatctcgtcgctgccgcggcgccgcctggtgctgaaccacacgcgcggcgtgtaccacttctccatccagggccgcaccgtgtgccagggccccttgcatctggtctacgtgcgcctggcgctcagctccgatgcccacggaaggtgcttcttccacctggtcctcggcggccacaggttggagcccctggtgctggtgcagctgtcggagcactacgagcaaatggaatacttgggccgttacatcgcccggaaactcaacatcaactacttcgactacctggccacctcctaccggcacgtggttcgccactggccaccccctggcgctggcactgtgatgggcaagagccccatgggtcacaagcccagctcctctcagtccagcctggaggtgtgactctgagggcctcccccacctcgggactgtgttctcggtaacctcccagccccactctggggcagatcaaatgtgagtcccactcactggccttcctttcaataaagctgcctcag

SEQ ID NO: 62105 - DNA, 3398 bp, Homo sapiens
atgcggacagatgctggctgtgtaagagcagttcttggggcgcggcctcgggaaggcaccgacgcgggcctcccagtgccagcgcgggcggccgccgccagcttcccgcatcgcctccgcacccgccgaccctgccccgcctgcattcctgcagccccgaagcccccgcggcgggaaaggaggcgggaggagggcccgccgcttactggtttgagttatcctgtagatggagaagcaagagaagctgaacaacgcgacggcgaccagggtgatcagcaagttcacctgcttggtcctcatggccctggccaggctgcgggaggccggcgggtggaggcggcggataatgccagggacggggttgagcgcgcagagccccctccccgcggtgccgcgtgggtccccagcacacccgccctgggaagccgccttgccacagaacttctgcaccttttgcttcctgctctagggttcagcgcgtgctataaaccgctggccagggctactggtcgttaaaaacgataaactagggaaagcgccccattgcctggcacgtggtgggtgcgcaataactgttaggtgactttcctcgagtggcttatcaaagctttacccaagctgagaaacactagagcatcagtaggatgagactctctatggactccttgatctctcccctctaagctctcctctcattgaggactcactggcagtctgttataatatctgaacattctacttcaaatcagccctgcacgttggaagggctggcttctgtccccttgaaggggaagaaagatttgaacataccccagcctgaggatgccactatagcctgcgtgttctcatgtgctaatggctaggagctgtgactttccattgagccgggacccagccagatctcaaaacaaggagccaggagagacacctcaactatgttctccttcaccccttcagtctgttgccggtgcttgcctttggctgagctctactgaaaaccagaagacaagaaagttcagcttgatgtactggatggtccaaacctggcttctaggctgtggagcaggttggagaaaacgtagggaagattagggtgggagaaggaagctattcagcataaagagagatctccatactcagcatttcactgccttcttacttgaggtccagtttttgcattttcagttgcctacccagcccttcagcttgaatgtcccacatcagattcaagatgtccaaacttcctcaccaagctattaatagctgttttcccagagtcccttgattttatcagtggcatcatagttcttcttacaatcatttggactctggttcattatatctcattatttataaaatctttagttacctaaaggattgtgtttctgttgctactatccccaatactcagatgatcacagtgacattcaaactggtctcactgtctgcaggatctaccctctgcaatccacacttcaataccagatactcttcctagttcaccacagtcagctgtcactgttgtttacgtagctccactcctgaatgaaaatggacccactcaatcgaaggccactcactgctttctcatctcccagggcgcccttacatgcctctggcacctgccagactcttttttcaatcctactctgaacatgtcatgttcacttctctccttctgtgccttttctctttatgtctgccccctgcccacaatgtccagtgtcctctctgaccattgaaattttttccacatcgtcaggtctcatgtttcatctgtttcatgaatcaaaacctggctacagcagaccactctgatttccccttctctgaatttatttagtatgtagggcagggatgtccaatcttttggcttccctgggccacattggaaggaaaattgtcttgggccacaaataaaatacactaacactaatgatagctgatgagctaaaacacacacacacatacacagacacacacacacatttcataatgttttgagaaagtttacgaatttggtttgggccgcattcgaagctgtcttgagctacatgctgcccaccagccatgggttggacaaggtgatgtaaagcctctgcctttcattttgatatatatccctaggtacttgcagataggagcttccaaaatgatcctaagttacacccatggttgagggagaaatatattcaaagcagattgaattactggtagttgtccaaagaaatgtacttacacgtgttagcataaatggttatggaggtctagggaaggatagttgcggtagatgcctgagaaaagagggttccctcattcctttgctgtgtagtcatgcatgatacacaagttctaaaaagacctggctgtgggcagaagctgacatcccatttctacaagggagcatgggaaacagagaaggaaaagctgcttaagaattaaccctcccaacaaagtttcagatggacaggaggaataatttccactgatctcttgcacagcatggtgactatagtcaattataatgtattgtacatttctaaagtcctaaaagagtggacttgaaatgttctcaccacaaagaaataagtatgtgacatgatggatatgttaattagcccgatttgatcattaaacaatgtatacatgcctcaaaacttcacactataccccatacatgtatacaattattgtctattaaaaataaagaaatttctaaaagagaactaatgccatcaagtaaacaataaataattgaaacaagacggcatacataatgtgggtagggtcagtccaaacagtgggaaccaaacaaaattttgataagcttaatcatctcgatagcttacaaggccaatgttgtatgaagaaaaactgcagtgttaaaaggtttactaggacaagtacatatgcctaaaaaaataaagttctgggatcatttccactgctaagttgaggaaaattagtttaataatcaagaggttctggttattaaatctttctaagttgcttcgggaatatcaatagattttctaattgcttctgagtgtcagtagattttcattggtatcagagggagaaaaccagtagaattatctaaagctagtgctttagtttatccacatagtccatctctactggaaaacctgaagagaccatggtgctaagcacagaagaataattaatcaaaccactgagaccttatgtgacaaaactctttaaatgcagagacactagaactggatcaatatttttagatccaaagagtgaaaaggaaagcttactgctttttaaaattttctatacatttggcattttaatataaactatataccattataagtcaaatctttataactaatacaagtcacaaatccaaataaacacgttttcttcat

SEQ ID NO: 62106 - DNA, 1215 bp, Homo sapiens; identical to SEQ ID NO: 62070

SEQ ID NO: 62107 - DNA, 1804 bp, Homo sapiens
atggttcggtcactccagagcagtagccgtacccagcctcctggccagccctcctccccagaccaaggcccaggtggcatctcccagggcagtgccagtgccagcctcccgccctcccctgctgtgggggccgaggcagcagttggaggtgggggctccacctccccagcctccatcattccctctcagagcttcggctgggtggattcctccgccgcagcccccgagaaccacctggcctgctctgggcactgcttctgcaggggcatggtgccatctggtggtgagactgggaactgcaccacagctccaaccggctccactgtccgactagaagcccatccctgggcagcggaggaggggcaagggcatagggcggcccctctgaaccaggctcctcgaggccatctggacgccctggcaacatgggcaggaagcggcttccatggcaactggcgtccagggaggcgctgcctggcaacggggccatggcccccccagcacgctgcgctggccacactttccgccctcgaggccgggagttccggcttccagccagtgcccccaccgcaaccgcgccctgtcctgcacgacatcccggagcctggacctgaggcgaacccccacgcccaccccaatccaggacaccgcttggcagggcgcttggcctttgttagcgtatctgacccccttcagtgcgggctgctgggctctgcagaacagtccttcctgcagctggagcaggagaaccacagcctgaaaaggcagaatcaggaacttcgggagcagctgggggccctcctggggccggggcagcagttcctgcccctgtgtcccgaacactcaagctgcactgctctggcctggccccccgacccggctggcacgcagcccttggggaacagggcacctctgcagctgctgcggcgggagctgtgccaggggcaagaggctttcgtgcaacagtcccaggtgggcctgggggaggggctgtggggggggaggaagcttcgtaacagcactccaggtgggcctgagggattcattagggagggaggtcttcgtgcagtaggccagtgggcccagcggggaggtactggccaccctgctgatgctgcccaagcccatcctgggccccaccctcagaacgagctgcagcagatccgcctgtgctttgagaggaagaagatggtcatcacagaggtgtgggacaacgtggctgagatgcacatggccctgaacaaccaggccaccgggctcctgaacctcaagaaggacatccggggcgtgctggaccagatggaggacatccagctggagattctcagggagcgggcccagtgccgcactcgagccaggaaggagaagcagatggcaagcatgtcgaaagggaggccaaagctgggaagctccaagggcctggcaggccagctctggctgctgaccctgaggctgctgctgggcgccctgctggtctggaccgctgcctacgtgtacgtggtgaaccccacacctttcgaggggctggtgccacccctgctgagccgtgccaccgtctggaagctccgggccctgctggaccccttcctgcgcctcaaagtggacggcttcctgcccttctaggccagaggcccagcggccccagcaaggaggccaggcgaccagcactgccccggatgcccagtggccgtgccagccccctgcacatggcaccactgtgcaccatccttgccagaagctgcagagaagggtggaggtggggtctgtcctgagggctgggcctgtggctggacatagaatcatg

SEQ ID NO: 62108 - DNA, 1592 bp, Homo sapiens
gcatccctgggagggccctgtggtagtttcagctccctctgggggcccagaatgaacctggcctgtggtgaggatgtaagcaccaatggccaattgggtccaaaggaagacaccggttcaaacactgaaaccaatcagattctcccacggccttcctgccatcagacgacactggtgcaggggtggttgctatgtacagggcagagccacccaatccccacgcaggagctgtgtcctgccatgctggcctcctcctggccatcacatcaggccaagcaggggagaggaatgggaatgcccatgcacccctatcaactctgcagacacagaaccatgcacagctcttgggaggagtcagatgagctgctcaaagcccgggagggacccacacagtggtcagcatagcagggacggtgctttagccaaggcagggatggcaggtgactcactcaggatcttcaaggaggccgctgcatttccgtgctctttccagataagaaggacatgtcggtgatgatgagcgagacggacatgaacgccatcgcaggcacgctgaagctgtacttccgtgagctgcctgagcccctcttcactgacgagttctaccccagcttcgcagagggcatcgggtggcagagaaggaggcagtcaataagatgtccctgcacaacctcgccactgtctttggccccacgctgctccggccctccgagaaggagagcaagctccctgccaaccccagccagcccatcaccatgactgacagcaggtccttggaggtcatgtctcaggtatgggaagacagtctccagcccatgcaaccccagcctgacagaggtggtctctgcctgccccacccccagtcctgcccatcttccgacttgcattgtatgtggtggtggctgagattcagagagagggacttgcctaggtttgcatggatgggagtgatagggggtgcccaggccacctcctggtcctgctggtgcaccttgctgggggcttaaaaccaccccaagtgttcgagtgtggtggctcatgcctgtaatcccagcactttgggaggccgaggcaggacaactgaacccaggtgtttgagaccagtctgggcaatgtagcaaaccccatctccagaaaaaatacaaagaaaaattaggcaggcattggggcacatatctgtaatcctaggtatctgggaggctgacacaggaggattgcttgagcccaggagttagaggctgcagtgatccatgatggagccactgtactccagcctgggggacagagcaaggccctgtgcatctctaaaataaataaccaccccccacccaacaagtcatgccttgtcaggaccccaccccacccccgtctcactgtaaggggttcatgacaccagcaggggtttctagcacctgaggtggacttggggacttgggccccaaagacctccccaccagcagctgtgagccccgctctgagccactctcctcttccccactctgcgagggcaggtcgaggtgctgctgtacttcttgcggctggaggccatccctgccctggacagcaagagacagagcatcctgttctccacc

SEQ ID NO: 62109 - DNA, 1551 bp, Homo sapiens
gcatccctgggagggccctgtggtagtttcagctccctctgggggcccagaatgaacctggcctgtggtgaggatgtaagcaccaatggccaattgggtccaaaggaagacaccggttcaaacactgaaaccaatcagattctcccacggccttcctgccatcagacgacactggtgcaggggtggttgctatgtacagggcagagccacccaatccccacgcaggagctgtgtcctgccatgctggcctcctcctggccatcacatcaggccaagcaggggagaggaatgggaatgcccatgcacccctatcaactctgcagacacagaaccatgcacagctcttgggaggagtcagatgagctgctcaaagcccgggagggacccacacagtggtcagcatagcagggacggtgctttagccaaggcagggatggcaggtgactcactcaggatcttcaaggaggccgctgcatttccgtgctctttccagataagaaggacatgtcggtgatgatgagcgagacggacatgaacgccatcgcaggcacgctgaagctgtacttccgtgagctgcctgagcccctcttcactgacgagttctaccccagcttcgcagagggcatcgggtggcagagaaggaggcagtcaataagatgtccctgcacaacctcgccactgtctttggccccacgctgctccggccctccgagaaggagagcaagctccctgccaaccccagccagcccatcaccatgactgacagcaggtccttggaggtcatgtctcagggtcccagggctggtggttgctttgggtctacagctacgtcttacccgcctcctgcctcaacagcctgtgtggtggcaaagccggtgtggggctggggaacgcagcgttctccaggagggggacccggctctccttctgcagtgcaggcgaaggcctagatgccagtgtgacctcccacaaggcgtggcttccagactccccggccggaagtgatgcttttttgccgcgggccctgggtttgaagcagcctggctttctcttggtaagtggctggtgtcttagcagctgcaatctgagctcagccacctacacaccaccgtggccgacactttcattaaaaagtttcctgagacgacttgcgtgcatgttgacttcatgatcagcgccgctgggaagaacccctgagccggtggggtggggctggaagcagcaggtgcagtgatggggctgggtgcccaggaggcctcagtgctcaatcaggccaaggtggccaagcccaggctgcagggaaggccggcctgggggttgtgggtgagcacaggcaggcaccagctgggcagtgttaggatgctggagcagcatccgtaaccccactgagtggggtagtctggttggggcagggaccgctgttgctttggcagagagagatgatccccactggggagaggctgttctgactctgcaggtgggacagggacagatggccaccagggtgacccggctggtcttcctttgctatgctaagccctgggacatgga

SEQ ID NO: 62110 - DNA, 588 bp, Homo sapiens; identical to SEQ ID NO: 62077

SEQ ID NO: 62111 - DNA, 2160 bp, Homo sapiens; identical to SEQ ID NO: 61980

SEQ ID NO: 62112 - DNA, 1077 bp, Homo sapiens
atgttcagctgcccgaaggagtcggaccccatccaggctctgaggaaactcactgagctgtgccatctgtggctgaggcccgacctccacaccaaagagcagatcctggacatgctggtgatggagcagttcatgatctccatgccccaggagctccaggtcttagtcatgatgaacggtgtgcagagctgcaaagacctggaggacctgctacgaaataacagaagacccaagaaatggtctgtagtcagttttcttggcaaggaatatcttatgcaggaatcagatgtggagatggctgaagcccccgccagtgtcagagatgatccgagacacgtgtccagccagcggacctcctctgtgaaccagatgtgtccggaggaaggccaggccagccaagagctgcagaccctgcccagggtccctgcactgttcaggaggcaggaagaggacttcctgctgccagagactactgtcatgaaaggtgacccaaaggctctgagacccaagccgaccttggagaaggacctggaggaagacagggaggagaacccaggacttacatccccagagcctcagcttccaaacagtcccagccctgcgggcccagtcagtcaccccagtggccaagaagtcaaggaactgctgccctttgcatgtgaggtgtgcggcaagaggtttaagtatcgcggcaagttagccgtccacacgagatcacacacaggcgagagactctttcagtgtaatctctgcgggaagcgcttcatgcagcgcataggcctgcaatttcaccagcgaacccacactggcgagaggccctacacgtgtgacatctgccagaagcagttcacccagaagtcctacttgaagtgtcacaagagaagccacacaggggagaagcccttcgaatgtaaagactgcaagaaagttttcacctacaaggcaaatctgaaggagcaccagcgcatccactctggagagaaaccccacaaatgttccaagtgtccaagagccttcggtcggccggcgaccttaagacgccaccagaaaacacatcgagaagccacttcacagtga

SEQ ID NO: 62113 - DNA, 842 bp, Homo sapiens; identical to SEQ ID NO: 61982

SEQ ID NO: 62114 - DNA, 1597 bp, Homo sapiens
cgcccactggggatggcaaagacgacatccggtgcgccgaggctgctcacaaaatcactcacctgtggcgcccttggccgctcagtcaaggctctgaatatcctgagactgccccactgcttggaagccctggacaccagagagtttcctgtaggtcctccagccgagcccgatgaccccggcaggcccgggagtgatgtccccctctggatgatcccaaccccttgctgtggattcagccccagccgttgttgtgtcttttggggaccttgtcagttgccttccaagtgctaattctcatgacgagataagaatggctatgactgggtgttgattgatgagtcgaacacattgaatcctggagtttgaggttatcagaactccccacttagaaaatcatcctttatattttagaaaatcatcattgtatgttgaacatacaatgcttcttttttcttcatctccagtgcactggtctagagagcggcagttggaccccagagtgtggcacgtgttcctgtgttcatttgaacattctctgatgacctgtcgctgaggtcctgtgatgatgcgtatcctgtcttccaccccaactgccactgtgtttcaactgtcgctggctgtgtttcaactgctgctgtgttggaactgccagctagactgctcaccaaaatgggaggcagcctctgctgctgtggtgaaggtgaaggcttcttctaccgccagaattggcggtttctctcgctggattcttgggacctgatccaggcagcacactcgacacactcagcgattcagctctacagtatgcactctgggatctcccatttgctaaggaaggatcttagctttgagaaaggtgacactttcctccctacttttgctggagaactaccctggtttgagcttcctgctggaaatgagtggcaagagatcccctcttgaggagactccgcaggaacaccagagatgatagtgacacacaacaactgaaggcagaggtacaggctgaggagaaaggtgtcaagcctgtggcagcagagcttcctggggagtcctcagagcaagtcattgccattgtcgaagtgtcttctaggctttattttggggccattacctcgagcactgtttcttgtctggtttcctaatgtcagcaactgaagaaaagacctgtatacacaggacacagcatggtctgacgctcacagtgttttcctttctctctgcagagggattcagcactttgggcaagtggttgcacagaggatcccgtggaagaattcatatatgaatcagatgagaatgccccaggaccatcgtagataccaacaagccctctcccggcacctgcagaaaaagtggggaaaatccccgaagaggcagaaacattcatccggaagggccgccagccagtggatttcccgggcccctcagccctctggagtgtacgagttttggagaaacctcttcctctgtatatgcttttgactttcctggactgatgtaaaaatactcttttctttgacctgtttatttttaagacacgacgtgattgtgtcagcttatattttattgctgaagtaaattttcaaatgtt

SEQ ID NO: 62115 - DNA, 769 bp, Homo sapiens; identical to SEQ ID NO: 61978

SEQ ID NO: 62116 - DNA, 567 bp, Homo sapiens
gctgaccccacactcctcaagtcctctgtctgcaggatactaggatgctgacctttcatcattccactgacgttatgtggcctaaaatcctcagcctgaagactcaaattatcgaaacttcagaggaaaaatttaaactttcctacaccagaatcagcttgagagaagaacctagttgccaccccagccagacactcccttgcaccatatttgcttgtctaatgatgtacttgcttagaagttccaggggctaatcttgaaataaaccaggcatagagatccagttgtggaagtctcccccacctagaaattgcctcaaggtggttaatctacaacccaaccattgtcaaaatggccccagttcatactacaggtggacaacaactcaagatagccattggagcaagatatgccgacctccatcctgcaccactcccacatgcttcccataccaagtttcccttcccaacccccttcgcttagcctgaaaatttgagatggttctttgagacctaagtccagccattcttctcaatggctagcctttgaataaaactgctttcctcc

SEQ ID NO: 62117 - DNA, 951 bp, Homo sapiens; identical to SEQ ID NO: 61999

SEQ ID NO: 62118 - DNA, 876 bp, Homo sapiens; identical to SEQ ID NO: 62000

SEQ ID NO: 62119 - DNA, 1822 bp, Homo sapiens
gtagtcccagcctcagcacaggggagccaccttgaagctctcaaatatcactgttgtgaatacagagagggaaaaccaactgtaacgtgccacccaaatgtaagttttactcatattttgatgttaggatggatagcttggaaaaagttggagggtacggcctttactatgaggcatctatgaaggatcaggaatggatgtagacaaggaactaggaatggaaagtgttaaagctggagcctctggaaaaccagaaatgaggctgggcactcaggaagaaacaagtgaaggtgatgctaatgaaagctcattactagtcctgtccagcaacgtgcctctcctggccctagagttcttggaaatagcccaggccaaagagaaggcctttctccccatggtcagccacacgttccacatgcgcacagaggagtctgatgcctcacaggagggcgatgacctacccaagtcctcagcaaacaccagccatcccaagcaggatgacagccccaagtcctcagaagaaaccatccagcccaaggagggtgacatccccaaggccccagaagaaaccatccaatccaagaaggaggacctccccaagtcctcagaaaaagccatccagcccaaagagagtaacatccccaagtcctcagcaaaacccatccagcccaagctgggcaatattcccaaggcctcagtgaagcccagccagcccaaggagggtgacatccccaaggccccagaagaaaccatccaatccaagaaggaggacctccccaagtcctcagaagaagccatccagcccaaagagggtgacatccccaagtcctcagcaaaacccatccagcccaagctgggcaatattgccaagacctcagtgaagcccagccagcccaaggagagtgatatccccaagtccccagaagaaaccatccagcccaaggagggtgacatccccaagtcctcagcaaagcccatccagcccaagctgggcaatattcccaaggcctcagtgaagcccagccagcccaaggagggtgacatctccaagtccccagaagaagccatccagcccaaggagggtgacctccccaagtccctagaggaagccatccagcccaaggagggtgacatccccaagtccctagaggaagccatccagcctaaggagggtgacatccccaagtccccagaagaaaccatccagcccaagaagggtgacatccccaagtccccagaagaagccatccagcccaaggagggtgacattcccaagtctccaaaacaagccatccagcccaaggagggtgacattcccaagtccctagaggaagccatcccacccaaggagattgacatccccaagtccccagaagaaaccatccagcccaaggaggatgacagccccaagtccctagaagaagccaccccatccaaggagggtgacatcctaaagcctgaagaagaaacaatggagttcccggagggggacaaggtgaaagtgatcctgagcaaggaggactttgaggcatcactgaaggaggccggggagaggctggtggctgtggacttctcggccacgtggtgtgggccctgcaggaccatcagaccattcttccatgccctgtctgtgaagcatgaggatgtggtgttcctggaggtggacgctgacaactgtgaggaggtggtgagagagtgcgccatcatgtgtgtcccaacctttcagttttataaaaaagaagaaaaggtggatgaactttgcggcgcccttaaggaaaaacttgaagcagtcattgcagaattaaagtaaacatgtattctg

SEQ ID NO: 62120 - DNA, 1823 bp, Homo sapiens
gattcacagaacccaggctggacgggacttgtggcgagcagtccagcacagcctcacagtgcagagcatgagctttggagcctgcccccaccctagctttgtgaccttaagtgagctacatagcttctcatgtgtaaactactcatcataatggttctgacctcagtggtttgttgtgttctaggaaatgatgccagtgaatgcgtagtcccagcctcagcacaggggagccaccttgaagctctcaaatatcactgttgtgaatacagagagggaaaaccaactgtaacgtgccacccaaataaagctcattactagtcctgtccagcaacgtgcctctcctggccctagagttcttggaaatagcccaggccaaagagaaggcctttctccccatggtcagccacacgttccacatgcgcacagaggagtctgatgcctcacaggagggcgatgacctacccaagtcctcagcaaacaccagccatcccaagcaggatgacagccccaagtcctcagaagaaaccatccagcccaaggagggtgacatccccaaggccccagaagaaaccatccaatccaagaaggaggacctccccaagtcctcagaaaaagccatccagcccaaagagagtaacatccccaagtcctcagcaaaacccatccagcccaagctgggcaatattcccaaggcctcagtgaagcccagccagcccaaggagggtgacatccccaaggccccagaagaaaccatccaatccaagaaggaggacctccccaagtcctcagaagaagccatccagcccaaagagggtgacatccccaagtcctcagcaaaacccatccagcccaagctgggcaatattgccaagacctcagtgaagcccagccagcccaaggagagtgatatccccaagtccccagaagaaaccatccagcccaaggagggtgacatccccaagtcctcagcaaagcccatccagcccaagctgggcaatattcccaaggcctcagtgaagcccagccagcccaaggagggtgacatctccaagtccccagaagaagccatccagcccaaggagggtgacctccccaagtccctagaggaagccatccagcccaaggagggtgacatccccaagtccctagaggaagccatccagcctaaggagggtgacatccccaagtccccagaagaaaccatccagcccaagaagggtgacatccccaagtccccagaagaagccatccagcccaaggagggtgacattcccaagtctccaaaacaagccatccagcccaaggagggtgacattcccaagtccctagaggaagccatcccacccaaggagattgacatccccaagtccccagaagaaaccatccagcccaaggaggatgacagccccaagtccctagaagaagccaccccatccaaggagggtgacatcctaaagcctgaagaagaaacaatggagttcccggagggggacaaggtgaaagtgatcctgagcaaggaggactttgaggcatcactgaaggaggccggggagaggctggtggctgtggacttctcggccacgtggtgtgggccctgcaggaccatcagaccattcttccatgccctgtctgtgaagcatgaggatgtggtgttcctggaggtggacgctgacaactgtgaggaggtggtgagagagtgcgccatcatgtgtgtcccaacctttcagttttataaaaaagaagaaaaggtggatgaactttgcggcgcccttaaggaaaaacttgaagcagtcattgcagaattaaagtaaacatgtattctg

SEQ ID NO: 62121 - DNA, 1931 bp, Homo sapiens
tctcaaatatcactgttgtgaatacagagagggaaaaccaactgtaacgtgccacccaaatgtaagttttactcatattttgatgttaggatggatagcttggaaaaagttggagggtacggcctttactatgaggcatctatgaaggatcaggaatggatgtagacaaggaactaggaatggaaagtgttaaagctggagcctctggaaaaccagaaatgaggctgggcactcaggaagaaacaagtgaaggtgatgctaatgattaatacatcattcatcagacttcattcgtgatctcgaagagtgacatcagtcttccttggaatatgaagagaatttctttggttcttcttttgcatttctatttgatttattttattttattttattttatgttttttggtacagaaagctcattactagtcctgtccagcaacgtgcctctcctggccctagagttcttggaaatagcccaggccaaagagaaggcctttctccccatggtcagccacacgttccacatgcgcacagaggagtctgatgcctcacaggagggcgatgacctacccaagtcctcagcaaacaccagccatcccaagcaggatgacagccccaagtcctcagaagaaaccatccagcccaaggagggtgacatccccaaggccccagaagaaaccatccaatccaagaaggaggacctccccaagtcctcagaaaaagccatccagcccaaagagagtaacatccccaagtcctcagcaaaacccatccagcccaagctgggcaatattcccaaggcctcagtgaagcccagccagcccaaggagggtgacatccccaaggccccagaagaaaccatccaatccaagaaggaggacctccccaagtcctcagaagaagccatccagcccaaagagggtgacatccccaagtcctcagcaaaacccatccagcccaagctgggcaatattgccaagacctcagtgaagcccagccagcccaaggagagtgatatccccaagtccccagaagaaaccatccagcccaaggagggtgacatccccaagtcctcagcaaagcccatccagcccaagctgggcaatattcccaaggcctcagtgaagcccagccagcccaaggagggtgacatctccaagtccccagaagaagccatccagcccaaggagggtgacctccccaagtccctagaggaagccatccagcccaaggagggtgacatccccaagtccctagaggaagccatccagcctaaggagggtgacatccccaagtccccagaagaaaccatccagcccaagaagggtgacatccccaagtccccagaagaagccatccagcccaaggagggtgacattcccaagtctccaaaacaagccatccagcccaaggagggtgacattcccaagtccctagaggaagccatcccacccaaggagattgacatccccaagtccccagaagaaaccatccagcccaaggaggatgacagccccaagtccctagaagaagccaccccatccaaggagggtgacatcctaaagcctgaagaagaaacaatggagttcccggagggggacaaggtgaaagtgatcctgagcaaggaggactttgaggcatcactgaaggaggccggggagaggctggtggctgtggacttctcggccacgtggtgtgggccctgcaggaccatcagaccattcttccatgccctgtctgtgaagcatgaggatgtggtgttcctggaggtggacgctgacaactgtgaggaggtggtgagagagtgcgccatcatgtgtgtcccaacctttcagttttataaaaaagaagaaaaggtggatgaactttgcggcgcccttaaggaaaaacttgaagcagtcattgcagaattaaagtaaacatgtattctg

SEQ ID NO: 62122 - DNA, 515 bp, Homo sapiens; identical to SEQ ID NO: 61976

SEQ ID NO: 62123 - DNA, 740 bp, Homo sapiens; identical to SEQ ID NO: 62010

SEQ ID NO: 62124 - DNA, 519 bp, Homo sapiens; identical to SEQ ID NO: 62079

SEQ ID NO: 62125 - DNA, 1104 bp, Homo sapiens
atggggagcgcgcaggtggggatgggagtagcaggcagggcgggggcccacgggcttctcactgacccagtcccgccgtcggcagccgccccggcgcccgtgacgctcctgcgggttcacccgaccgccaactgcagcacctcccttgttcctcggcgacggctggcgtcacttccggcggcgttgccaagcaaccgcgtggtacgagtaacaactccaccggctggcgtccgcggcgcttggcgccacagtcacttttccagatctaggagcaccatggacacctcgtcagagatgctggtacggtttggacggcgctgtggacgggcgaaggaaagtacagaaataagaaactctgaagaagatcaagttctctatctgcctcttctacctagcaaagtagatctccagcaggtcaccataattccacacgatgagtggaaaaggattcaagatagccttgacaggttgacaagagaagcagcatgcctccgtgcagaaagaaaggcaaagaaagaaatgcatttgcgatctcaagaagtggtaaaacactggactaatacatatgcagggatgaaagaacagaaacttgaagccaaaaagaagcgtgatgaagaaatagaggcagaaagacaaattcttgatctggaagaagaaatatacaaacaaggaaaaagaaaaaaggccattgaaaatgcaaagcaatatcaattttaccagacagaaagagtgaaaaactttcattcgggacttcttcttagtagagttatgaaagaacgtgatgcccagattgaattccgaaagagtaagataaaatcagataaaaaatgggaggaacagttgaaactcaacattgaaaaagcttttaaagaagaacaagaaaaagcagaaaaacgacacagagaaagggtggctcttgccaaagatcatctaaaacaaataaaggaacatgaggaagaagaggaaagaaggaaaaaatatgaagaaaaagatgctgaggaaataaagcgacagaatgcattatatgaaattgaaatgagaaaaaaactagaaaagaaaagagaagagatgcatgaaagcaggagacggtttcttgtaagttga

SEQ ID NO: 62126 - DNA, 798 bp, Homo sapiens
atgggccctgagccctgcccagtgcaaggctcattcccgcccaacaaacacaggtgttgctctggtaaggcgttgcccatgtctgtggaggtgcagtcgcgggaagggaaatcgaaactcccagagcaggtggccccagccgacgagggaagagggtcactatttggcccttccagaatctcagggtccggttctcccggaagtttccgggccgccccggaccccattggctttaggggccgcgtctccgagggctccgatttgggccctagattttggaatactgtgttttatattattgataataaggcctctgtaaccatggctagttctgacgtaaaaccaaaatcagtaagtcatgccaaaaaatggtcagaagagatagaaaatctgtacagatttcaacaagcaggatatcgggatgaaaccgaatatagacaagtgaaacaagtttctatggtagatcgttggccggagacaggatatgtgaagaaacttcagagaagggacaatacgttctattactacaacaaacagagggaatgtgatgacaaagaagtccacaaagtgaaaatttatgcttactagcctgtcttctttgtattacttgtcaattatattttaagtattcatcatttccttctacatcatgtgtttgtcatttgatgaaataattcaagatgcagtctgcagtttaatgttttgtgaaacacaaaagccatgagaattggtatctgctaatcaccttgtcctgttctaagaactggctgcagatgcattaaagttgtactctcttgg

SEQ ID NO: 62127 - DNA, 964 bp, Homo sapiens; identical to SEQ ID NO: 61984

SEQ ID NO: 62128 - DNA, 717 bp, Homo sapiens; identical to SEQ ID NO: 62055

SEQ ID NO: 62129 - DNA, 1023 bp, Homo sapiens; identical to SEQ ID NO: 62059

SEQ ID NO: 62130 - DNA, 285 bp, Homo sapiens
atgatggtggcaattgactctgagatggtgggcacaggacccaaggggcatgttagtttcttggctcaatgtagcattgtcaactacaacggagatgtgctttatgatgagtacatccttcccccctgccacactgtggactactggaccagatggagtggtatccagaagcagcacatggtgaatgccacacccttcaagattgctcggggccagatcttgaagatactcacagggaagatagtggtggggcatgccatccacgacgacctcaaagccctttag

SEQ ID NO: 62131 - DNA, 3067 bp, Homo sapiens
actggggggagcaaagagtggggaactgggcaggcagacacccccacagagcactcatggcccccacagaaatacacccacactcatcacagcaaaccaaaacaatcacacgccggtacacaaacacacacacccccgcaccaatccaggcagacacaaagctcacggcgacaggcagatctgattcacacagacacaggcacaggtgcttcctgatgccaccctctcttggtcacgtgccagcacttggagggaggaaagtgcctcaccaggctgagatgcccaagggaccccccagggagggaaagcaggacacactgggacagttgcttccagccctgtccacacccttgtgcccatcaggtatgccgctcacccccaccccacctggaccttggtgtcacctaggattgcagaggccgccttcagcccagagcctggggccttgcccactgcctcacctcccaggatagggcatgctgttcctttctccttccctttctttgctcttgtgtgcctgcctttagcaaacgcccactgggtgtgtgggtacactgcggcctttaaagagaagagaaacacatgaggcttacagcaggaggccctgcctaggttccaagggacatggagcagggtggctgtgtagagctggggagcatcccaagcctgtgccaaggttccaaggacaaaaagggcaaggaggcccagtgcggggtggtgggggagcagctagccagggccaacagtgagcctcgcgcctgggcaggtgtagcctttaaacgcggtgggggaaccatggacagcatctaagcagggacgtgccgtgagtcctgggggtgcaggggtgtctagaggggaagctgggaagcaggggtcacagctttccgactggtggctgagtgtggggaagacaggaggggcaggtgtgagatgtacagcagacacagctgtgtgctggggcatggtgggctgtggtgagagagaggagcaggtcttctccccgcgtgttcagagcagatccaaactcttctcccattccttcctccaccgtgcatcctcagcacccctcagcactggcctgtgtgggcagcgtgagcacagagagcaggagcttgccctcagaggcttcagggggtcgcttgtacccagtggtatggtcagcatcatgtttgaccaaagggaggaaggtggctgtgaccagagcgagggggggtcctgatgcagctggggagtcaggctcgagtgcatgctgtgcatgttctctgcctctcttcctggggggcaggcgagtctccagagcctggaggacaagttagccttgcgaaggatagcagaggacccagcccaggggtccccaaaatggagcaccaaccctccatgcaggccaagccactggtgaatatgctgcaaaaaatatgctggaacttctatgaataccacagggtgtgagaagaaaacattagaacttctattttgtacctgtgttactccacaacaagaaagcaatcagcttgatcaatgcctactgtaaagacggcaccgccctccggaggtcctttctcagccctggtgttcggacagccacatcccctcgcagcagggggaggcctgaagcatagaggggcccacgcaggtctattctgtttcagcgaattgcctgggaaataatccaggatccatttcgtgtggtcatcttgtctccctggtcccctccagcctttcctcatcttttgtgacctggtcactctggaagggcgctggccagttagtccacaggatgggcctcccctggggcttttctgatgcttccttatgatggcactggcatcctgagggggaggaccacagagaggaggtgctcctcatcacaccacatgggggtccatgcaccagtgccactgctttccagggctcttcaccttcatcactggtggaggtggcgtctgccaagaagcagaaagttgatgcttagaaggtgcatggccctacctcttctaaggtgcccctgcgggctgtctacagaccaggcagcacatgcctgatagcagctgcataaggaaaagcaggagccagctcgtgcacagtggcctcaagtgtgcgctgggcatgttatctgcctcaccatccctgtgtgacagatgaagcatgacagccctcaacagaagccaaggccaagtcctcgaacttcctagtctgcacaatgacacttctgatgaaactgaaaatgccaccagggagaagcagctgaacttcaaggaccacagagggccaagtgcaggagtaagaggctggcgtgctgacagtggccaagggcattggagggaaggacctgtcatcactgggccaaggaaggaactccagactgcctacttccagagggcctgctgaggaattttagcttgaacttgcctgccttgactagggctttctgagcagcagatgattctgcaatggtgttagtccaggcctggttctgcatgacattgaccatactgtgcaccctggggtcattatgtcttgggcttcaaggggctccatgggctccagggggctccatgtgacactgcacagagctctctctaggtcacctggatgtgtctcttcctaggaaccccaaagagctctctcaacaaacacacccacgagttccaggagtgaggctgcagggaacagcctcactctcagaggggatacagaattgttccactggacaagggctgggatcgtcataggatgccgttggcctgtggtttccaacagaggtgcagttcattgaactgtggtctacagtccattctctaacttggggacccttgaagaagtgtggaatcatgacaacaaccctgttgggagacactattattcccatcacatggatgagcacacggaggcaaaaggaagttatatgattgtctgagatcacccagtgaagactgtgtggctgggagttgtccccagtgttatctgcacgctgcttccttttgatgcctggcccttctttatcaaaagaagcattggcagaatctgggtgtttatgggtcagctcaaaataaattactttatatgt

SEQ ID NO: 62132 - DNA, 957 bp, Homo sapiens
atgagtgggaagcggcagaaaccaagtcaggtgcagctcccaacgctgacccgggtttctggggtggaagcagcagaggcgcccccacccccactcccgcgctccaccgagccggagggcagcccaggggcagcagccccacagtggggcctgaacagcgtccgcggacccgacccgcgctgcggccgcgctgccccgctcctctgggcgcctccccgagggcctcgctcgtctgacccgcagtactctccgccctgctcctcgtgcctttggtgggcgcgtggcttccggcctgcggaggctgtgcctcctcgccaaggagccgttcacagccgcgcgttcgaaaacccagccgccggccgcgcgtcctggagaaggggcacggtcaactcgcacgccctaagggccgggccaccggggtcactgcccggcctgcgggggccgtgcctggggcgtaggagcagcgctcctccgcaggcgctatgcatgcctgcgccctcctgcaggatgggccacgagcccaactgccaggcgatcggccgagacccagaaggatgcggctcagcggcccctcccaacccgcccgcgccagttgggaaagtgactcccccgctccccgccagttgggaaagtgactccttcctgtgggcagaaggcagcggacctggagggagccctcgggctctgagagtcacgcggggggcggcctgctctcccgcgccccctagcggagcatcggctcacacgcacctgagagtgccatccgaagggactctgcggccttcggcttcctgggaggtagcacagatggaaggctgcaaggacgcagagggaacacgtctatcaaaacggccggcttctgatgctgggccctggggtcccaagccctccaaagataagagaatcaggcgagaaacaagagcccagcacttttccgcagaaacaaaaggtcagtga

SEQ ID NO: 62133 - DNA, 2005 bp, Homo sapiens
atggaggcaaaccaagagcctgtgtcccgattggttaaagctcaggcacctcgccccacaaagggcgtgctggttggcagacggggaccaatgagaaggctcggcgccggcgtcaagggcgcgaggaagccactcgctgtcccggacatctgctgggcttggctgggctcagctctccgctcccgccgttaccaggacgaccgtctccccgcagcccaggctgcccggactggcgccatgagctcccccgacaaggtgtccgtttgtggggccggtttcgacctggagggtggcaaaaaggctggctcccgcacggccagccccggagccccaggggcccacagccacggcctcgatttgggggtgccgggcagcggcgatggcaagagcgagagcgggttcacagatccagagggcttcagcttcgagtctgagagcgaattgatagagcaaggaagggtggtgctctggggccgggaaggccggccaggcaccccggtggatgaccaaggggacgttgtggactactcattctacctggctgacgaaccagccgccatcgtgccgccgcccagcgtccagggacacccgttcccagaaggtgccgctgccgaagggtcggctgagaattgggcagatgcggaggtcggtcccagtgggagagacgtgctgggccacagccctggaaaatggcagcaggcctctgccggccgtctccacctctgcggtcctgggccagtgcgggcctggaagaacccggaaaggggctcgaagagcagatggagcctccgcgtggatccccagcagccctctgcgaaaggccccaccaggctgcctacccacgactctgattccgcagatgagagcagcgacttaccactgatgaaggtaggcatttgccgcaacgaaggaagccaggccaagcccggcagccccaagaagcgagcagacacatccagacaggcaagcttccactgcaaggagagttacctgcctgtgccgggccgtttcctgacctctgctccccgcggactcactccagtcgcagagaggccggctgtgggagagctggaggactctccccagaagaaaatgcagagcagggcctggggaaaggtggaggtcaggcccagctgctcaggagctgccgctgcaggggccctgccccagggcctttcgaggaggaagatggccggggggaagaagtccctagggggtgcctctcaactggccctggggagaggctttcctgcctgcggagagagactctcagccgctcccccggagccggccaccttcccgccattctctggtgtgcggccacaggggatgtccaagaaaccccaaaagcctaagcacagcagccctgggaagaaaccagcagggaggaagaccagggagtcccaggctgcggccagagaagataatgacccaaatagagatgaggtcccaagagcccaagtgagccaggactgcctcgcctgtctgtgcgtcgtggagaattcagcagtagcgaccccaacatcagagctccccaacttccgggaacttcagagccctcggcctacagcccgggaggcctcgtgcccagacgccatgcaccctccgacaccactaggccctttccacctcactgggaggcttggaagctggattttgtgttctctttcaggtaaccagcagccgcctgtccatcccccaagaccggaaaggcagcagcagcccccgggagcccagggctgtcctcggtgcatctggctgcagagggaaattgaggaccttacacagcagctagcggccatgcagttcctcactgacaagttccaggacctttgaagttggagccagcatcttcctacaagatgaacagctgccacctttggagctccggagctgcagccaagcgggttccctccatatcctgttcagccagggcttcctctcttccgctgcatttgcccccttcccaacgcagttcaaagcaatttgaaataaagtcgttctc

SEQ ID NO: 62134 - DNA, 961 bp, Homo sapiens
atgaaaccctgcaaggaaaactttactggatctgagaccctaaagcatttagtcctgcaattcctgcagcagtattactcgatctatgactctggagatcgacagggtctcctcggtgcttaccacgatgaggcctgcttctccttggctattcccttcgaccccaaggactcagccccgagcagcttgtgcaagtactttgaggatagcaggaatatgaaaacactcaaggacccctacctgaagggggaactgctgaggcgcacaaaacgtgacattgtggactccctcagtgcgttgcccaaaactcagcatgacctcagctccatcctggtggacgtgtggtgccagacggaaaggatgctctgcttttctgtcaatggggttttcaaggaagtggaaggacagtctcagggttctgttctcgccttcacccggaccttcattgctacccctggcagcagttccagtctgtgcatcgtgaatgacgagctgtttgtgagggatgccagcccccaagagactcagagtgccttctccatcccagtgtccacactctcctccagctctgagccctccctctcccaggagcagcaggaaatggtgcaggctttctctgcccagtctgggatgaaactggagtggtctcagaagtgccttcaggacaatgagtggaactacactagagctggccaggccttcactatgctccagaccgagggcaagatccccgcggaggccttcaagcaaatctcctaaaaggagccctccgatgtcttctttgtcttcgttcacatcctctttgtttcctcttttcaccagcctaaggcctggctgaccaggaagccaacgttaacttgcaggccacgtgacataaccacccaaagagccagttgctctgtgtattcgccccactcatgatcaccattttattttcataataaagagtgacgttacacgt

SEQ ID NO: 62135 - DNA, 480 bp, Homo sapiens; identical to SEQ ID NO: 62074

SEQ ID NO: 62136 - DNA, 445 bp, Homo sapiens; identical to SEQ ID NO: 62017

SEQ ID NO: 62137 - DNA, 6089 bp, Homo sapiens
atggaggggaaccagcgggcccacgaagagccagcagcaactgccagacatgcaatggctgggcctgcggccctccctgcaccggcggacgctcctctcagtcttggagtctcttcgcccaggtggctgtggatccggtacgggagttgccgccgcggtccaactccccgctgccgcccagcgcatccgctcgcaggagcgccggcggccagcagtgcgctctgcagcatgtcgctacatgcctgggagtgggaagaggaccccgcaagcatagagcccatctcctccatcactagcttttaccagtccacgagcgagtgtgacgtggaggaacacctgaaggccaaggccagggcccaggagtctgactctgaccgcccgtgcagcagcatcgagtcctcatctgagcctgccagcactttcagctccgacgtgccccacgtggtcccctgcaaattcaccatctcactggccttccctgtgaatatgggtcagaagggaaaatatgcaagtttgattgaaaaatataagaaacaccctaaaacagacagttctgttacaaagatgcgtcgtttttaccacattgagtatttccttctgccggacgatgaagaacctaaaaaagttgacatattgctatttccaatggtggccaaagtattcctggagtcaggagtaaagactgtgaagccgtggcacgaaggtgacaaagcctgggtgtcgtgggagcagacttttaatatcactgtgacaaaggaattattaaagaaaataaatttccacaaaatcaccttgaggctctggaacactaaagacaagatgtcaagaaaagtcagatattaccgattaaagactgccggcttcacagacgacgtgggagcttttcataagtcagaagtgagacatttggttttaaatcagagaaaattatctgaacagggcattgagaataccaacattgtcagagaagagtcgaaccaggaacatccgccaggaaaacaagaaaaaacagaaaaacacccaaagtctttgcaaggttctcaccaagcagagcccgaaacttcttccaagaacagtgaggaatatgagaagtccctcaaaatggacgattcttccacgattcaatggagtgtttcaagaacaccaaccatttctttggcaggagcaagcatgatggagatcaaggaattaattgagagtgaatcacttagcagcttaacaaacatattagacagacaaaggtctcaaattaaagggaaagattcagagggaagaaggaaaatccagaggagacataagaagcccctggcagaagaagaggcagaccccacgctgacaggccccaggaagcagagcgctttctccatccagctggccgtcatgccgctccttgccggtacccactgcttgccctgttcccagcagctcctgcttgtcttgtggccagaacggccataagcggatgctcctaatgacaaccctgctgcgtgccacctcatttcatcctcacagccacctcaggaaactcaggggaattggcttcatagtacagggggaaacaaaggcccagagagggtagctaccttgcctgagatcacacagctaggaaatgtgaagcctggacttgaacccagctctgtttgattccaaaatccaaggaagcctatgggaatattaaatgtcatcattgtgtttgttaagaagatgctgcttttaataaatgctttcctacagatttttacaaaaacatctagtaaagggaatgaggaaagggaaccctttttgactgagcccctctgggtgcaggcacttcccgtgtgacacatcacttacttctcagaccaaattctgacccactcagccaacctgtggtgtggtggtggctgtggtggttatcatagttaccatttttttcagtgaggaaaagaactcaaagaggttaagtaactttcctaatcccacacagctcagtggccaaacagggatttaattattttgctttataagatctaccacaatttatgaactggacttcatacatactggtaaatcataactaaatattatatcaatatgttttgatgattgaaagctcagcatatattttggtaaaattatgttgctttgttccaaaaaagagtaatatggggtgaactccccccctttttttttctttttagagaaaattcagactttgttcgtttttttgccatcacgtgtcttgtgcgccctctcctggctactctgcagaagcgcgtgcgttggtcttttctgagctggaaccagcattcatagagaagggggcaaaaaccccgtaagtcagagcctccagttcagttccacaggtgccagtcgtcatcctcctctcgcgctcttgggttggtgtcaattcagtttgagaaagtgctattaacttttcagtttgcactttttttttttttgagatagggtcttgctctctcacccaggctggagtgtaagtgacatgatcatagctcactccagcctgaagcaagcctcccgcctctgccacccgcatagctaagactacaggtgcacaccaccacacctggctattttttttattttctgtagagacaaggtcttgctatgttgcccaggctggtctcaaactcctggtcacaagtaatcctcctgcttcagcctctcagagttctagaattacaggcatgagctgccgcatttggcagtttgcagttttaaatgactttttgaaaatgatacttcacctacagcttgtccttcctgatcaccttcactttctcgtagcatcagaacctcttgagaggcaacagtgacagagagtaaactttcagagggtcttaccccaccccacgctccagcctgaccctccagcatacctattgcacacagtagctttgagcgaacgcctttgctagctgcttccttcgtcctacagtcccaaggaggaacccatgatcctcctgggggagcgtaccatgggacctgccccgctttggattttactgtgagaggaaaaagaagttcaaccatttgggcctgcctggcatgactgtttccagcagaatgaagccaggacatggtcccctctctcttttttttttttcgagatggagtcttgctctgtcgcccaggctggagtgcagtggcgcgatctcggctcactacagcctctgcccccccaggtttaagcaattctcctgcctcaacctctagagtagctgggattacaggcgcatgccaccatgccaggctaatttttgtattttttgtagagatggggtttcacaattttggccaggctggtcttgaactcctgacctcgtgattgtcttacatgtccgtgtgaagagaccaaacaggctttgtgtaagtaacaaggctgtttatttcacctgggtgcaggcaggctgagtctgaaaagagagtcagcaaagggtggtgggattatcattagttcttacaggttttgggataggcagtggagttaagagcaatgttttgggggcagggggtggatctcacaaagtacattctcaagggtggggagaattacaaaaaaaccttcttaagggtgggggagattataaagaaccttcttaagtgtgggggagattacaaagtacattgatagttagggtggggcagaaacaaatcacaatggtggaatgtcatcagttaaggctattttcacttcttttgtggatcttcagttgcttcaggccatctggatgtatacatgcaggtcactggggatatgatggcttagcttgggctcagaggcctgacagtgatccacctgcctcagcctcccaaagtgctgggattacaggcgtgagctaccgcactggacctagcctcccctctctataacctgccccgtcatgtacaatgctgtacagtgcaggggttcacatgtaagaactttggtgaccaaaacactttgatcatggctcagccacttaccagcaagttacctactttctctgagtctcactttcctcctctgtgaaatgggggtgattactcctacctcagagcgttgttttaaggatcacaggagctgacgtgtgtaaactgcttagcacagtgggacccagggggtgcaggtgtggaggcagcagctgtcctgaggccatgtgtgtgggccgctccattatacccatgacatagcctatggtcatcgacagagaacgggtcagctcagcaggccagttgtatgtctggttttgccagaaactaatagcataagattatttactgtaagcccagcataattatttttggtaatcatcttcaatttcaaattaggccatagatcatgtatgtataccttattagtaaatattggttggctagtaacccagtaagattctagaaagattctgtgtctgggaatgagctcttattttaaaaggatagtattgcatagcggaggggccccacttagcccaacagaactggtttggatgctggttctacaacgtattttctaagagaccttggatgattgcgtcagaactctgggcctcatttcccccatctgtaatgtggagatgacagcaaccacacaaggttaaggatgaaatgacattagcgcatgtttgggactggctgttggaggagcacaaacattcccttacaccattccactcttaaccagggctcttaactcagggggcttgtgtctgctggggacacttggctgtgtgtggaggcattttggttggcacgactgagagtgggatgccactggcatctagtaagatactgttaaacatgccataatgcacaggactgtcccctgagcaaagaatggtctgccccaactgtcagcagtgtggaggctgtgagcccgcagcctggaattctgttctggtgtatgtctccctgactctgatgatttgagcactttttttttatttttatttttgcaatggggattccttctaccttgagtagtcttttttttttttttgagacggagttttgctcttgttgcccaggctggagtacaatggcgcgatctcagctcaccgcaacctccgcctcccgggttcaagcgattctcctgcattagccttcctgagtagttgggaatacaggcatgcgctaccacgtccggctgattttgtatttttggtagagacgaggtttctccattttggtcaggctggtctcaaactcccgacttcaggtgatccgcctgcctcggcctgccaaactgctgggattataggcgtgagccaccgtacccggcctacccttgggtagtctttcatgtgaaaaggctcacaaaattatagaacacaggcgtaatgggtgacagcttttatgaatcagctttgttaaagaggatcctgcgggagcatgagggctacccccaggagctgtgcacgcctctgttcacagcctgtgcagatggctgtgcacacctggcccgggacttgttttagaagtgcctactctttctgaatgtgagcgacttggcttttacatgccctagaaatacatttacaggcatgttgaaaggaatagactgatctttttgagcaccatctcatatatcatctttcttaatcctttaaacccaaggaaggtggtgtctatccccattttgaagatgaaattgagccttggagactctagcttatcacatgacaaagagtcagatctgggattcaaacccaggtcaatcctgcctccaaaacttgaggtgattttttttgtttatttgttttgttttttccttacctagtacatctctgactggtgaaatacatggataccttttatagaaaaagcattctgggctgggtgtggtggctcacgcctgtaatccctacactttgggaggccgaggcgggtggatcacgaggtcaggagatcgagaacagcctggctaacacggtgaaaccccgtctttactaacaatacaaaaaattagccaggcatgttgtcgggcacctgtagtcccagctacttgggaggctgaggcaggagaatggcgtgaacccaggaggcgtagctagcagtgagccaagaccgtgccactgtactccagcctgggcagcagagcaagactc

SEQ ID NO: 62138 - DNA, 1608 bp, Homo sapiens; identical to SEQ ID NO: 62049

SEQ ID NO: 62139 - DNA, 3365 bp, Homo sapiens
ggtggatgcgtttcggttgtagctaggctttttcttttctttctcttttaaaacatatctagacaaggaaaaacaagcctcggatctgattttttgctcctcgttcttgtgcttggttcttactgtgtttgtgtattttaaaggcgagaagacgaggggaacaaaaccagctggatccatccatcaccgtgggtggttttaattttcgtttttctcattaattttttttaaacaaccattcttcacaatgaacaaaccgtatatcagaaacctcagcgagaacgccgcccccttggacctagaaggtatcttcaaggacgccaagatccccgtgtcgggacccttcctggtgaagattggctacgcgttcgtggactgcccagacgagatctgggccctcaaggccattgaggcgctttcaggtaaaatagaactgcacgggaaacccatagaagttgagcactcggtcccaaaaaggcaaaggattcggaaacttcagatacgaaatatccctcctcacttacagtgggaggtgctggatagttgactagtccagtatggagtggtggagagctgtcagcaagtgaacactgactcggaaactgcagttgtaaatgtaacctattccagtaaggaccaagctagacaagcgctagacaagcactagacaaactgaatggatttcagttagagaatttcaccttgaaagtagcctatatccctgatgaaatggccacccagcaaaacccctttctgcagccccgaggtcgccgggggcttgggcagaggggctcctcaaggcaggggtctccaggatccgtgtccaagcagaaaccatgtgatttgcctctgtgcctgctggttcccacccaatttgttggagccattataggaaaagaaggtgccaccattcggaacatcaccaaacagacccagtctaaaatcgatgtccaccgtaaagaaaatgcaggggctgctgagaagtcgattactatcctctctactcctgaaggcacctctgcggcttgtaagtctattctggagattatgcgtaaggaaactcaagatgtaaaattcacagaagagatccccttgaagattttagctcaaaataactttgttggccgtcttattggtaaagaaggaagaaatcttaaaaaaattgagcaagacacagacactaaaatcacgatatctccattgcaggaactgatgcagtataatccagaacacaccattacagctaaaggcaatgttgagacatgtgccaaagctgaggaagagatcatgaagaaaatcagggagcgttaggaaaatgatatcacttctatgatttcaagcacatttaattcctggattaaatctgaacgccttgggtctgttcccacccacttcagggatgccacctcccacctcagggcccccttcagccatgactcctccctccccgcagtctgagcaatcagaatccgagactgttcatctgtttatcccggctctatcagtcagagccctcatcagcaagcagggccagcacatcaagcagctttctcgctttgctggagcttcaagtaagattgctccagtggaagcaccagatgctaaggtgaggatggtgatgatcgctggatcaccagaggctcggttcaaggctcagggaagaattatggaaaaatgaaagaagaaaacttcgttagtcctaaagaagaggtgaaacttgaagctcatatcagagtgccatcctttgctgctggcagttactggaaaaggaggcaaaacggtgaatgaacttcagaatttgtcaagtgcagaagttgttgtcccttgtgaccagacacctgatgagaatgaccaagtggttgtcaaaataactggtcacttctatgcttgccaggttgcccagagaaaaattcaggaaattctgactcaggtaaagcagcagcaacaacagaaggctctgcaaagtggaccacctcagtcaagacggaagtaaggctcaggaaacagcccaccacggaggcagatgccaaaccaaagacagattgcttaacaaacagacaggcgctgaccccctatccagaatcacatgcacaagtttttacctagccacttgtttctgaggaccaggcaacttttgaactcctgtctctgtgagaatgtgtactttatgctctctgaaatgtatgacacccagctttaaaacaaacacacaaaaaaagggtggcagaggggggaaagagaagagctctgcacttccctttgttgtagtctcacagtataacagatattctaattattcttaatattcccccataatgccagaaattggcttaatgatgctttcactaaattcatcaaatagattgttcctaaatccaattgttaaaattggagcagaataattattacaggaacttaaatgttaagccattagcatggaaaaactgttctcagttttatttttacttaacactaacatgagtaacctaagggaagtgctgaacggtgttgacaggggtataaaacgtgcatttttactcaactacctcgggtattcagtaatacaatgaaaagcaaaattgttcttttttttttgaaaattttatatactttataatgatagaagtccaaccgttttttaaaaaataaatttaaaatttaacagcaacagctaataggcaaattaagaattttacttctggctggtgacagtaaagctggaaaattaattccagggttttttgaggcttttgacacagttatgagttaaaaaaatcaaatgttcaaagatacagagcagtgccttatatctggagagcagcactaccatttattctttcatttatagttgagaaagtttctgatggtactaacaaagtggtggcagaagattttggaacggctggtttaaatggcttcaggagactgcagttttttgtttagctacatgattgaatgcataataaatgctttgtgcttttgactatcaatacctaaagaaagtgcatcaatgaagagatgcaggactttcaactgattggcaaaaagcaagctttagcttgtcttacaggatgcttagtttgccagtacacttcagaccaatgggacagtcatagatggtgtgacagtgtttaaaggcaacaaaaggctacatttccatgtggccagcactgtcatgagcctcactaagctattttgaagatttttaagcactgataaattaaaaacaaaaaattagactccacctaaagtagtaaaatatagcaggatttctgtatactgtgcaatcagttctttggaaaaaaaagtcaaaagatagagaatacaagacaagtttttgggatataattcgaatgactgtgaaa

SEQ ID NO: 62140 - DNA, 3231 bp, Homo sapiens
ggtggatgcgtttcggttgtagctaggctttttcttttctttctcttttaaaacatatctagacaaggaaaaacaagcctcggatctgattttttgctcctcgttcttgtgcttggttcttactgtgtttgtgtattttaaaggcgagaagacgaggggaacaaaaccagctggatccatccatcaccgtgggtggttttaattttcgtttttctcattaattttttttaaacaaccattcttcacaatgaacaaaccgtatatcagaaacctcagcgagaacgccgcccccttggacctagaaggtatcttcaaggacgccaagatccccgtgtcgggacccttcctggtgaagattggctacgcgttcgtggactgcccagacgagatctgggccctcaaggccattgaggcgctttcaggtaaaatagaactgcacgggaaacccatagaagttgagcactcggtcccaaaaaggcaaaggattcggaaacttcagatacgaaatatccctcctcacttacagtgggaggtgctggatagttgactagtccagtatggagtggtggagagctgtcagcaagtgaacactgactcggaaactgcagttgtaaatgtaacctattccagtaaggaccaagctagacaagcgctagacaagcactagacaaactgaatggatttcagttagagaatttcaccttgaaagtagcctatatccctgatgaaatggccacccagcaaaacccctttctgcagccccgaggtcgccgggggcttgggcagaggggctcctcaaggcaggggtctccaggatccgtgtccaagcagaaaccatgtgatttgcctctgtgcctgctggttcccacccaatttgttggagccattataggaaaagaaggtgccaccattcggaacatcaccaaacagacccagtctaaaatcgatgtccaccgtaaagaaaatgcaggggctgctgagaagtcgattactatcctctctactcctgaaggcacctctgcggcttgtaagtctattctggagattatgcgtaaggaaactcaagatgtaaaattcacagaagagatccccttgaagattttagctcaaaataactttgttggccgtcttattggtaaagaaggaagaaatcttaaaaaaattgagcaagacacagacactaaaatcacgatatctcctttcaagcacatttaattcctggattaaatctgaacgccttgggtctgttcccacccacttcagggatgccacctcccacctcagggcccccttcagccatgactcctccctccccgcagtctgagcaatcagaatccgagactgttcatctgtttatcccggctctatcagtcagagccctcatcagcaagcagggccagcacatcaagcagctttctcgctttgctggagcttcaagtaagattgctccagtggaagcaccagatgctaaggtgaggatggtgatgatcgctggatcaccagaggctcggttcaaggctcagggaagaattatggaaaaatgaaagaagaaaacttcgttagtcctaaagaagaggtgaaacttgaagctcatatcagagtgccatcctttgctgctggcagttactggaaaaggaggcaaaacggtgaatgaacttcagaatttgtcaagtgcagaagttgttgtcccttgtgaccagacacctgatgagaatgaccaagtggttgtcaaaataactggtcacttctatgcttgccaggttgcccagagaaaaattcaggaaattctgactcaggtaaagcagcagcaacaacagaaggctctgcaaagtggaccacctcagtcaagacggaagtaaggctcaggaaacagcccaccacggaggcagatgccaaaccaaagacagattgcttaacaaacagacaggcgctgaccccctatccagaatcacatgcacaagtttttacctagccacttgtttctgaggaccaggcaacttttgaactcctgtctctgtgagaatgtgtactttatgctctctgaaatgtatgacacccagctttaaaacaaacacacaaaaaaagggtggcagaggggggaaagagaagagctctgcacttccctttgttgtagtctcacagtataacagatattctaattattcttaatattcccccataatgccagaaattggcttaatgatgctttcactaaattcatcaaatagattgttcctaaatccaattgttaaaattggagcagaataattattacaggaacttaaatgttaagccattagcatggaaaaactgttctcagttttatttttacttaacactaacatgagtaacctaagggaagtgctgaacggtgttgacaggggtataaaacgtgcatttttactcaactacctcgggtattcagtaatacaatgaaaagcaaaattgttcttttttttttgaaaattttatatactttataatgatagaagtccaaccgttttttaaaaaataaatttaaaatttaacagcaacagctaataggcaaattaagaattttacttctggctggtgacagtaaagctggaaaattaattccagggttttttgaggcttttgacacagttatgagttaaaaaaatcaaatgttcaaagatacagagcagtgccttatatctggagagcagcactaccatttattctttcatttatagttgagaaagtttctgatggtactaacaaagtggtggcagaagattttggaacggctggtttaaatggcttcaggagactgcagttttttgtttagctacatgattgaatgcataataaatgctttgtgcttttgactatcaatacctaaagaaagtgcatcaatgaagagatgcaggactttcaactgattggcaaaaagcaagctttagcttgtcttacaggatgcttagtttgccagtacacttcagaccaatgggacagtcatagatggtgtgacagtgtttaaaggcaacaaaaggctacatttccatgtggccagcactgtcatgagcctcactaagctattttgaagatttttaagcactgataaattaaaaacaaaaaattagactccacctaaagtagtaaaatatagcaggatttctgtatactgtgcaatcagttctttggaaaaaaaagtcaaaagatagagaatacaagacaagtttttgggatataattcgaatgactgtgaaa

SEQ ID NO: 62141 - DNA, 3045 bp, Homo sapiens
atgagcttctcactcacgttcaccgagctggccaacatcgccatcccacagtgcggggtgctgaacttcaaggccctgcacctcctgctgcacggcatcttggagcacatccacatggccgagctcaagaaagtcctctcaggcgatgaggacttcctgcagacctcgcaggtggtcatcatgcccagggaaggagacgcccagcctatcctcaaccccatgaagaggctcagcaatgtcttcgaccacgtggtgagccgcctcgacaagttggagaaccagctggccctgctgcaggacctgccctccactgcccagctgctggaagccagccagggcactgcccggcccgtccaggacctgtggcatctgatcaagctccggaagatggtggagggtcatgatgaagtcatggccaagtcaatgcagaccctgcaggacttgctcactgatcttcatgcactccaggtcaccatcacagccctcagaaaagaagtggacatgctgaagaacatgcttgacaaggtacacccagaaagaatggacatctttgctgaagacttcaaaatacagaactggaagatggttgcactgcagcgggaagtggcttctctccagaataagtttaaaaccatccccaaaaccgaggacatggtgctctggagtggccttcatgatgccatgttcacctcagaaattggttcatcaccactggacctgtggcagtctgtagagcagctcccagaggctgccctggcccagaccaccaagtaccttgaagctactcgtgccgtccaggtctccgagcccgtccaaaacccccagctactgcagactgtctggcattatgaggtcccagagctcctcccggagggctcatctgcccaagcagtttcactcagcagagcccaggagccagcgcagcctccggccctcacgcctgagtctgcacctgggtgcacaactgaatttgcacctgggcctgcacctgggactgaacctgtgccaggactggagctggggctggagctggagcctgtgcctgccctggggcctgtcccagggcccagtccatatcagtctcgccagggagaagccctccagctcgcagctgtccaagtaaagggggaggaaaatgatgtccccagcctaaggggccttcgggagagggcccgcaaggatggggcccccaaggatagaactcgcaaggatggggtccccaaagatagaggtggcaaggatgtggaccccaaggatagagctcacaaggatgatgtccccaaagatagaggtggcaaggatgtggaccccaaggatagagctcacaaggatgatgtccccaaagatagaggtggcaaagatggggaccccaaggatagagcagccaaagttgctgccaagtttgtcaaggatgccccagccaccaaaatggccgccattgcaacagacacggctgcagctgggcccctaggggtctttgcagatgtcctgggtgcagggccttcccggggagccacagaatcccagatcttgggcgatgattccgaaatctacgaaatcctctctccctcctactctgctgccagcatcggtcccgatccagccctgtcccaggccatggtggctaccaagcaggccatgagccctgaagacaagaagagggctgtcaagtattccatgagccacatagcccagatacctgtcaaacacgactctctgaaggaagaatttgcccagctgtcctgtaacctgaaccagcgcttgagttatctagccaatatgggaggtccttccagcctcgggacaacagtggacatattgcagaaaaagattggcagcctccagaaatctaggctcaaggaggaagaacttgagagaatttggggcaaccaaatagagatgatgaaggatcgctacatcactttggacaaggcggtggagaacctgcagattcgcatggatgagttcaagactctccaggctcaaatcaaaagactggaaatgaacaaggtgaataagagcacgatggaggaggagctgagagagaaagctgacaggagtgccctggcaggcaaggcaagccgcgttgacctggagactgtggccttggagctgaacgagatgattcagggcatactcttcaaggtcacgatccatgaggacagctggaagaaggctatggaggagctcagcaaggacgtgaacaccaagttagtccacagtgatctggatcccttgaagaaagaaatggaagaggtctggaaaatcgtccggaagctgctgattgagggcttaagactggatcctgacagtgctgctggctttaggaggaagctgttcaagcgcgtgaagtgcatctcctgtgaccggcctgtggagatgatgactggcccacagctgatcaccatccgcaaagcccacctgctgtcccggctgcggccagccagcgccaacagctgcgagtacttgcagcggcaacagatgagggaacagcagtggctgcagctccaggacctcggtatccaggaggattgtcagcaggactggggtgatggcccccaaaacgccaccagcctcaagtgcaagtcctgcaacctgttgacgctctatccctacggggatccccacgtgatcgactatgacagcgccgaggtggacatcctgggcgtggatgggatcctgtacaaaggccgcgtgaacagccagcgtggggctcagcccttggccgtcgcaaaggagctggcagctgtgaaggctccatctcccccgtcacaaagcctgtatgaccgtgtgcactccagtgccctatttggcgccatctgcccccccctgtgcccccgctccagtgcctgctcagctgcctcgggccctcacctgacgatgccagctcgaccaccttccctgccacctctgctgctgctgccaccgctgattccatccctaagggacccccagcaggccccagggtccaccaggctctcaagagctccacacattgagtcccgagtcggcaggaagccccccgaggagcccgccaacccgtga

SEQ ID NO: 62142 - DNA, 1400 bp, Homo sapiens
gaggcgggaggacttggggacagctgtggggacacggcccagatgctctggtcccagcagaagtgactggcggggaccaggatgctggagggtcagctcgaggccagggagcccaaggagggcacccacccagaggacccgtgcccgggagctggggctgccatggagaagacacctgcagcagccgaggtccccagggaggacagcaatgccggggagatgccgtcattacagcagcagatcaccagcctccaccaagagctcgggagacagcagtcgctgtgggctgatattcacagaaaactccagagtcatatggatgccttgaggaagcagaaccgggagctccgagaagagctgagaggcctgcagcggcagcagtgggaagccgggaagaaacccgcagcgtccccacacgcggggcgagaatcacacactctggcattggaacctgcttttggaaaaatttcacctctgtcagctgatgaagagacaacacccaaatacgctggccgcaagagtcagagtgccactctcctgggacaaagatggtcatctaaccacttagctcctccaaagccaatgagtttaaagacagaaagaattaactcggggaaaacaccaccacaggaagatagagagaaaagtcctcccgggagacgtcaagacagaagtccagcacccactggaaggccgactcccggtgcagaaagacgggaggtgtctgaagacggaaagattatgcatccatcttcccgaagtccgcaaaactccggtggcagaaaatcaccagtgcaggcttcccaggccaccacgctgcaggagcagacggcagcagccagaggagctgacagaagctcatcagtcttagggagttctgaaggcggatttctcagccgcgttcaagctgacgagttcgccagttcttccccagacagtgcagagcggcaggtaggtggctgagtggcttctgtgagggcggcccacccggttcccctcagggagacctgagaaggtgaccttttcgtcctggggaagtgagattcggagccggtgtcatgagatggttgcatcttcccatcttctcaacaagaacagaaaattaagatgattccaaatgtctctttatttcctgaagttcagcctttcaaacagagacttttttttatagatttaagttggttgcatttagcccaaacaagattaatgttttttatgacttaagagttcccctagtcagagtttcattttttatcattttgatttacagttctcagttgacattaatagactcgaaggcaagaatagcaaacatacttctaagccctagctaggggcccacttgtaacatgctatattttacaaaaaaaaaaagtcaataaaataaaattattttctct

SEQ ID NO: 62143 - DNA, 1813 bp, Homo sapiens
gttaggctgctggggctgtgggtgccatcttgtcaccttggaggaagagcccacctgagaacgacatcaactcagagggaagtcagcagagccaagaggccgggagaggtgattcccggtgacatcatctggctcctgggtgcagccatggtagagttggcctcgaacgttgtccctggcatggaggtgaccagaggtcaccctcacatgtcagcagacacctccagctgtgtcattcttgcttctcgttggcaaagtttgtaggggtagtattctcagttggcattcctagctgagatgtgtagctgggaggtcaccacgccgcagggccttgggaccagttctgcctccgaggagtcccttactgatgatcataggctcctcaaggtcatcagccagggcagctttgcagaagtcaaggcagctggcccagcacattctcactgggaccaagatggctgtggaggtcaccccaacagggcagcagggctcctgcagcccccaggatctgtactgcagggtccatatgatgaaggcccttaatcacccgaagatcatcagacccacgtggctggcaccgagaacaggctgttcctagtcatggattaagccagctcgggagagctatccgacttcaccctccaattctccttgaagggggaagaggcctgaggcaagttccagcaaataggatattccatgcagtgaggcttccagaaggaaattatccacagggatctgaagccagagaacttccctgaggaggctcagcacgacatggaaacaacagactctggctttgataccagattcaccgtaggctgaaagctgatccccttcggtgggagctcctcttacgcagcctcggaactgttcccggaggcaaaagtacgatggactccggtgggcgtgtggagcctgggagtcactgtctacaccatggtggccgaggactgccatctgttgggcagacttttgtggggctgaggaggacactaatactctgtgaacgatgacaggagatcccgtttctcatttccatagaactagaacgcctcataaacacaattctggcccttgactccagggagaggccctcactagaccacatcatggggcgcccatgcgttaacatgggtcaggaggagacataaataaggccatactgggagctgctccccgatcacccggcgtctggaaagctctcgtggtgtccccgggagatgaggccaaccacgtcccatccttgtaggaacaaaaatgtaggaacaaaaatttttagtagagacggggtttctccattttggtcagggtggtctcgaactcctgaccacaggtgatccactcgcctcggcctcccaaagtgctgggattacaggcgtgaaccactgcgcccggcccacaacatggatttttcttactataaacatcaagctacacttgccacagtcttttaccgctgtggtctcatttgtctccaccagagggagaaaggagactcaataaaaactgcatggttctcggccgggcatggtgcctcacgcctgtaatcccagcactttgggaggccgaggcgggtggatcactgacgtcaggagttcgagaccagaccagcctggccaacatggtgaaaccctgtctctacaactactactactactaataataatacaaaaattagctggacgtggtggtgtgcacctgtgatcccagctactcgggaggctgaggcaggagaatcacttgaacccgggaggcaaaggttacagtgatccgaaatcacaccattacactccagccttgggcaacactc

SEQ ID NO: 62144 - DNA, 1965 bp, Homo sapiens
atgcggctcccaagttccccaccccttcttgagagagccctggctccccagtgggccacactctccccacagcagcaggaggaccacccaggaactgggcagcacgttgccctgagccccacacggccgccacacctctgggccctccctcctctctcagcagtgggtgtgcaggctgcactggccttgaggagcgactcctgtcccagtgggtcacatgggaatgcagacttttctcacaggttgggctgggagtcctccacattggtcaccagacattgccacttctcctcagggcaggtcctcagcaggagccccccaccaggccacatcataagcaactgtggctcagacggtggtgagaaggttccaggagcagagtctgggaaggagtgggaggaggcatggagacccgtggagctgaaagcagatgcccaagaccagaccgaccaccttcctcaccactttgcagggaaacttccatcagaaaatgcatcccacagctctgctgaatcccagaatacagtcgagggtatgggcatattcacccatgagtttatggcacagatgtgtgctcaaggtcccagtcacatggctgggggaccaaaaggaggaagcccaagcactgccgcctgggacctcatattttctactgatgccaagagactcctttgggccatggtcagggtccagggcctcgtgaaggctatcaagagagccctgggatccttcaaggagcgagaacccctttcactgaaacaggggagaagctgggaacatggtggtgtgtggggagtggcaggtgagtccagcgccacagagagaggagcagacgtcccaggccagccacatgagctgcatcatggcatcagtgggacagcccctgagggccacccagactctgacagccaggggagccaggagagcagaccttgccaaaaggagatggcccaaggatgtgctgttgtgactggcctcagccacttctccctggagcagtggatgggctacactgagtcctgggcaaggcgatggccagccctagccctgcatgactctctaggaccagagggagaatgcactttgtcctgccaagagaatgtggttgccaaggggacagaacaccagtgttccacgtggaacttccaggcagggcactggggcacagtaggaggaacccagaagatgctgcctctcctgatcatctgtctcctgcctgccattgaagggaagaactgcctccgctgctggccagaactgtctgccttgatagactatgacctgcagatcctctgggtgaccccagggccacccacagaactttctcaaagtattcactccttgttcctagaggataataattttctcaaaccctggtaccttgatcgtgaccatttggaagaagaaacagccaaattcttcactcaagtacaccaagccattaaaacgttacgagatgataaaacagtacttctggaagagatctacacgcacaagaatctctttactgagaggctgaataagatatctgatgggctgaaggagaaggacatacagtccacactgaaggtcaccagctgtgctgactgcaggactcacttcctctcctgcaatgaccccactttctgcccagccaggaaccggcggacctccctgtgggctgtgagtctcagcagtgctctactcctggccatagctggagatgtttcttttactggcaaaggaagaaggaggcagtaaagcaggaacagggcagcccgcatgtcttccagaagtgaacagaggccgcagctaccaccgtcacaaagttcactcatctctgggtcccggtgaccccatccccccataccctccatcctgggtcctggggccccaaagctctgaggcctaggagactgcgctgtctcgtggtttgcctactcctacacctttgtaaagagtctcttcattaaaacccctcttcat

SEQ ID NO: 62145 - DNA, 1571 bp, Homo sapiens
atgttgaaatgtaaggaccctagactaacaaaatcacacaacaccagtaaagtgtataaaactctggtccccattaaggagacactccagtcctcagggaaaatcagacctggcactgtcgtccatgagtatgagacgggaagagctgtggtccaggatggaacggaagtcatactgcacataccaggtgttcaaatcaacaacacttccttgctgatcaatagtcccagaactggtggcacagccaggaccgacgctgatgcttacctccccctctcctgcagcagagacgcccccgtccctgtggcccagggaagtgccagggatccctgggaaggcgggagatggggaaggggcagggtgagcgaagaggagcaggctgcgtctgcacgcgggctgggaagcggggcttccgggccgcagggtcgcggggacgggtgtgatgcaatcgcgccacagccgctgcgtcaaggggcggctccgggatgcgggcactgcggtagagcccgtcctgcccccgccgcccgccgcccgccgcccgcctccgctgctaaacccgcggacaaccgccgggacgaccacccagagccaccagagccccctgacacccgccccgaggcaccggtaacccacggcacccgccccggtgcgtgccatgaagtcggccgcgagctcgcgcgggggcgcggcgggcggcgtgccaagagcaagagccgccgcaggaagggcgccatggtggtgtcggtggagccgcaccggcacgagggcgtcttcatctaccgcggggcggaggacgcgctggtcacgctgaacatggtgccgggccagtctgtgtacggcgagaggcgcgtcacggtgaccgagggcggcgtgaagcaggagtaccgcacgtggaacccgttccgctctaagctggccgcggccatcctgggcggggtggaccagatccacatcaagcccaagtccaaggtgctgtacctgggcgccgcgtcgggcaccaccgtctcccatgtctccgacatcattggcccagacggcctggtctacgccgtcgagttctcccaccgcgccggccgcgatctggtcaacgtggccaagaagcgcaccaacatcattccggtcctggaggacgcgcggcacccgctcaagtaccgcatgctcatcgggatggtggacgtgatcttcgccgacgtggcccagccggaccagtcccgcatcgtggccctgaacgcccacaccttcctgcgcaatgggggccactttctcatctccatcaaggccaactgcatcgactccaccgcatccgccgaggctgtgtttgcttctgaggtgaggaagttgcagcaggagaacttgaagcctcaagagcagctgaccctggagccctatgagcgggaccacgctgtggtggtcggggtctaccgacctcttcccaagagcagcagcaaatagcacccagctcaggctcgcctgccatctccccaaggctgcgttgtgtttgctattattttctgtgtgttttctttgtgagtgttttgttttgttgtttttctattaaactgcataaagaa

SEQ ID NO: 62146 - DNA, 1239 bp, Homo sapiens; identical to SEQ ID NO: 62018

SEQ ID NO: 62147 - DNA, 435 bp, Homo sapiens; identical to SEQ ID NO: 62069

SEQ ID NO: 62148 - DNA, 2045 bp, Homo sapiens
atggcacggacgcagggcgcatgcgcccgcgcccccccacccccagctccgcggtcctcccggcagcctgcgcccctcgcgccgcgcccgtggagctcccgggcccggctgccccgctcccgccccagcgccatccctcctggctggggccgcgcgggaggcaaggactccgcgggctggtgtgccgggggtccggcgccgcgggccacccacgcccccagccagcaactcggcgcggacggccccgaggccgtggcgcaggacacgcggcggcgcctcgggcccccgacggcgctgtggccccgagcggaacggcccggaagaggagacgcgtccccgggaacccagtgcccgccctggcccagccccgatccagcctgcgcctcacctcgggttgtagacagagcggcggggatcccagaggggttcgcgggtcggacctggagtaccggcccggcgaagcgcgcggctgtcgcccgcacgtgactggctcggacaagatggcatgagcggagaagcggccggatcccagatgcgcgcgtgccgccgccgcgggcactgcgcccgtttgcctgcccctcgtcggggatcgggcgctccctctgagacctgaaagggcacccaagtgccccctgtctgcgaagtccggcgcgggcccttcggcgcccccgatgtctctaggcttccgcaggaggcgccctgtaaatcttgagtcttcctgcagcgagggggcacaggacagctgcgaattgggacgaacgagcccagagccccgggaaggatcagaacctcgaaggcggcttcaagtcggccccgcagcccgaggtgaccgtgggcggttacgttgcccgagctcgccccctcctcctgagcgcaggtgcccgtgggacatacacccgcccacctgctccggaaagttccctccagaagggagttcccgcgccaccgagacccgggagctcccgatcagactcccaggccgtgaaaggcgttatcggacagggcccagaggcgcccccacagcaagaagaaagtctggggttctcaccgtgtgccaggtgcgagctcaagccacctccctcaaccgctctgagaaatatcccacttcacaaacttgctcaaagtcacgctgctggctggatttgaatccagattttttttagcaccactgaaaaaacaatatgacaaccggagaaagaaaaatctaaaaagaatacagtaatccatattgttacaaagaaatgcaacttttcacgacatgaaacatatatatactgtgtatagttgcaaccacactttttttgttactactttcactaccatttttatttgttcacgattcatttttaaggtgtgcaggtgtccttaactattcactcagccccctaatgtttttggttctttacggttgtttgctaacgtatccttgaattctgcacttgggacaaatacctgggagtggaaaggctcccaggtagaaggctatgaatggccaagtggtcttggcttacagcgtcatatttttcccaagagctgccccaattattctaccgcctccaaggaacaagtgtaaggagtttaacacacttataaacattgagtgccatttcccccctactttaatagtctattgctagttcaaggttacttagcatttcttaggtgacacaacattcaaaaatgaatgtttttccatgcatttactatatgcattccctctcctgtgaataatctattcatatccatcttctggggacttgaacctcttctaactttgaacaagcatttttttatgttacagatattacttctttgtcgtcattgatgcaaatattttctagcctgttgttctttcttgttttattctaatgttcagtgtgtcattctaatgttttaattgcttcagtgctgacaaagtgagctttctgctgcccatctgatagtcttttttctgctagttttgtacaatttcatttcatatttcattctctgatgactatcccgattttattttggcttatttatttggagtaaaatatggacat

SEQ ID NO: 62149 - DNA, 380 bp, Homo sapiens
atgggggtctgtgggaatcttcctacatactatgacaattgctcattttacttctggttgcacacatcttttattgaaaataacaggctttatctaccaaaaaatgaattggataatctacataaacaaaaagcacggagaatttatccatcagattttgccgtggagatactttttggcgagaaaatgacttccagtgatgttgtagctggatccgattaagtatagctcccccttccccttctgggaaagaattatgttctttccaaccctgccacatgttcatatatcctaaatctatcctaaatgttccttgaagtatttatttatgtttatatatgtttatatatgttcttcataaatctattacatatatatag

SEQ ID NO: 62150 - DNA, 2637 bp, Homo sapiens
tgttcttcgccattaactgtggccccgacaggcctgggttactgcggccaccgccacagcagccttggcgctatggaggagcccggggctacccctcagccttactgggggctggtcctggaggagccacgcagggttgtggcagcactgcctgaaggcaggagaccagattcgaatccttatggatttccatgggaattggtgatatgtgcagctgtccttggatttgttgctgttccctttttcttgtggagaagttttagatcggttaggagtcggctttatgtgggaagagagaaagagcttgctgtagcgctttctggactaattgaagaaaaatgtagactacttgaaaaatttagccttgttcaaaaagagtatgaaggctatgaagcagagtcacctttagaggatgccagctttgagaaggaggcaacagaagcacaaagtttggaggcaaactgtgaaaagctgaacaggtccaattctgaactggagcatgaaatactctgtctagaaaaggagttaaaagaagataaatctaaacattctgaacaagatgaggtgatggcggatatttccaaaaggatacagtctctagaagatgagtcaaaatccctaaaatcactgctagctgaagccaaaatgaccttcaagagatttcaaatgaatgaagaacaaatgaagatagcaatacaagatgctttgaatgaaaattctcaacttcaggaaagccagaaacagcttttgcaagaagctgaagtatggaaagaacaagtgagtgaacttaataaacagaaaataacatttgaagactccaaagtacacgcagaacaagttctaaatgataaagaaaatcacatcgagactctgactgaacgcttgctaaagatcaaagatcgggctgctatgctggaagaagacataacagatgatgaaaacttggaattagaaatgaacagtgaatcggaagatggtgcttacttagataatcctccaaaaggagctttgaagaaactgattcatactgctaagttaaatgcttctttaacaaccttagaaggagtaagaaaccaaatctatattcagttatctgaagttgataaaaccaaggaagagcttagagagcatattaaaaatcttcagacggaacaagcatctttgcagtcagaaaacacatattttgaaagtgagaatcagaagcttcaacagaaacttaaggtaatgactgaattatatcaagaaaatgaaatgaaactctacaggaaattaatagtagaggaaaataaccggctagagaaagagaaattttctaaagtagacgaaatgatcagccatgccactgaggagctggagacctacagaaagcgagccaaatatcttgaagaagaacttgagagaactattcatttttatcaagggaagattatataccatgagaaaaaagcacatgataattgtttggcagcacagaccgctgaaagaaacctcaatgatttaaggaaagaaaatgctcacaacagacaaaaattaattgaaacagactttaaaattaaatttttagaaaaagatccttatgcacttgatgttccaaacacagcatttggcagagagcattcctcatatggtccctcaccattgggtcggccttcatctgaaacgagagcttttctctatcctccaactttgtcggagggtccactcagactctcacctttccctccagggggaggaggaagaggcccaagaggcccagggaatcctctggaccaccagattaccagtgaaagaggagaatcaagctgtaataggtttactgatcctcacaaggctccttctgacactgggcccctgtcacctccgtgggaacaggaccgtaggatgatgtttcctccaccaggacaatcatatcctgattcagctcttcctccacaaaggcaagacagattttattctaattgtgctagacgctctggaccagcagaactcagaagttttaatatgccttctttggataaaatggatgggtcagtgcattcagaaatggaattcagtggaaatgataccaaagataatcttggtaatttaaatgtgcctgattcatctctccccgctgaaagtgaagcaactggccctggctttgttcctccacctcttgctccaatcagaggtccgttgtttccagtggatacgaggggcccgttcatgagaagaggacctcctttccctccacctcctccaggaaccatgtttggagcttctccagattattttccaccaagggatgtcccaggtccaccacgtgctccatttgcaatgagaaatgtctgtccactgaggggttttcctccttaccttcccccaagacctggattttccccccctacccgcacattctgaaggtagagtgagttccctttagggttgagtctgccttcaaatgagcctgctgctgaagatccagaaccacggcaagaaacttgacaatatttttgctctcttcaaaagtcattttgactattctcattttcagttgaagtaactgttgttacttcagtgattacacttttgctcatattcaaacttaatggaattataattctcaggatagtattttgtaaataaagatgatttaaa

SEQ ID NO: 62151 - DNA, 599 bp, Homo sapiens; identical to SEQ ID NO: 62056

SEQ ID NO: 62152 - DNA, 633 bp, Homo sapiens; identical to SEQ ID NO: 62012

SEQ ID NO: 62153 - DNA, 507 bp, Homo sapiens
atggccccaaagagtagtgatgctggcaatttgaatatgccaaagggaagctatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaacagataccgagatattcttccatttatagaagaactagctgaccagggacatgctgacactgctactgctcaaaagaccctagagctgcagcctaaggcacctgtggaaggggaacttaccgacatgaatgaccaaagtgcttgtgaggaaaaggataaaggcaacctaggggaagcaatgatggtagaaaacttgacattaaagaaactttggagctatttcacaacaatataa

SEQ ID NO: 62154 - DNA, 5614 bp, Homo sapiens
atggccaaggactcgcccagccccttgggcgcgtcgcccaagaagccgggctgctccagcccggcggcggcagtgctggagaaccagaggcgggagctggagaagctacgggcggagctggaggcggagcgggcaggctggcgggcggaacggcggcgcttcgctgcccgggagcgccagctgcgtgaggaggccgagcgggagcggcggcagctggctgaccgtctgcgctccaagtgggaggcacagcgcagccgggagttgcggcagctgcaagaggagatgcagcgggaacgcgaggccgagatccggcagctgctgcgctggaaggaggccgagcagcggcagctgcagcagctgctgcaccgggagcgcgatggcgtggtgcgccaagcccgggagctgcagcgccagctggccgaggagctggtgaaccgcggccactgtagccgcccgggggcgtccgaggtttccgcggcgcagtgccgctgtcgcctgcaggaagtgttggcgcagcttcgctggcagactgacggcgagcaggcggcgcgcatccgctatctgcaggcggcgctggaggtggagcgccagctcttcctcaagtacatcctggcgcacttccgcgggcacccggctttgtcgggatcaccggacccccaagctgtgcattccttggaagaaccgctgccccagacctccagcggctcttgccacgcccccaaacccgcctgccaactcggatctctagacagcctgagtgctgaagtcggtgtgcgctcccgctcgctaggcctggtgtcctctgcgtgctccagctccccagacggcctgctctccacgcacgccagctcccttgattgcttcgcacctgcgtgttcccgctcgcttgacagcacccggagcctccccaaggcctccaaatccgaggagcggccctcctcaccagacacctccacccctggctcccggaggctctcgccgccaccatcgccactcccgccgccaccaccaccgtcagcccacaggaaactcagcaacccgcggggaggagaaggctctgagagccagccctgcgaagtcctgactccctcacccccgggcctgggccaccacgagctgataaagctgaactggctgctggccaaggcgttgtgggtgctggcgcgccgctgttataccctgcaagaggagaacaagcagctgcggcgtgcaggctgcccctaccaggcagacgagaaggtgaagcggctcaaggtaaagcgcgcggagctgaccgggctcgcgcggcgcctagctgaccgcgcccgcgagctgcaggagaccaacctccgggccgtgagcgcgcctatacccggcgagagttgcgccggcctggagctgtgccaagtctttgcccgccagcgcgctcgggacctgtcggagcaggcgagcgcgccgctggccaaggacaagcagatcgaagagctgcggcaggagtgccacctcctgcaggcgcgtgtcgcctcgggtccctgcagcgacctgcatactggaaggggcggcccctgcacccagtggctcaacgtcagagacttagaccgcctgcagcgcgagtcccagcgggaagtgctgcgcctgcagaggcagttgatgcttcagcagggcaacggtggcgcttggcccgaggcgggcggccagagcgcaacctgcgaggaggtgcgacggcagatgctggcgctggagcgcgagctggaccagcggcggcgcgagtgccaggagctgggcgcgcaggcggccccggcgcggcgacgtggcgaggaggccgagacacagctgcaggcggcgctgctcaaaaacgcctggctggcggaggagaatgggcggctgcaggccaagaccgactgggtgcggaaggtggaggctgagaatagcgaagtgcgcggccacctgggccgcgcgtgtcaagagcgcgatgcctccggcttgatcgccgaacagctgctgcagcaggcggcgcgcgggcaggacaggcagcagcagctgcaacgcgacccgcagaaggccctgtgtgacctccatccttcctggaaggagatacaggcgctccagtgtcggcctggtcaccctcctgaacagccctgggagaccagtcaaatgccggagtcccaagttaaaggtagcagaaggcccaagttccacgcacggcctgaagactacgcagtgtcacagcccaacagagacatacaggagaaaagggaagcctccctcgaggagagcccagttgcccttggggagtcagccagtgtcccccaagtttcagagacagtccctgccagccaacctctgtccaagaaaaccagctcccagtcaaactcctcctctgaggggtcgatgtgggccaccgtgccgtcctcccctactctggacagggacacagccagtgaggtggatgacctggagcctgacagcgtgtccctggccctggaaatggggggctcggcggctcctgctgcccccaagctcaagatcttcatggctcagtataactacaacccatttgaggggcccaatgatcaccctgagggtgagctgcccctcacagctggggactacatatatatcttcggggacatggatgaggatggcttctatgagggggagcttgaggatggccggcgggggctggtgccctccaacttcgtggagcagattccggacagctacatcccaggctgcctgcctgccaaatcccctgatcttggccccagtcaactcccagcggggcaggatgaagctctggaggaagacagcttattatctgggaaagcccagggagtggtggacagagggctgtgccagatggtcagggtgggctccaagacagaagtagcaacagagatcctggataccaagacggaagcctgccagctgggcttgctgcagagcatggggaagcagggcctctccagaccccttctggggaccaaaggggtgctccgtatggctcccatgcagctacacctgcagaatgtcacagccacatcagccaacatcacctgggtctacagcagccaccgccacccccatgtggtatatcttgatgaccgagagcatgccctgaccccagcgggcgtgagctgctacaccttccagggcctgtgccccggcacgcactaccgggcgcgggtggaggtgcggctgccacgggacttgctgcaggtgtattggggaactatgtcctccaccgtcaccttcgacacactcttggcaggacctccctacccaccgctggatgtgctggtggagcgccatgcctcgccaggtgtcctggtggtcagctggctccctgtgaccattgactcagctgggtcctccaatggagtccaggtcaccggttatgctgtgtatgcagatgggcttaaggtttgtgaggtcgccgatgccactgctgggagcaccctattggaattctcccagctacaggtgcccctcacgtggcagaaggtctcagtgagaaccatgtcactctgtggtgagtccctggattcagtgcctgctcagatccccgaggacttcttcatgtgtcaccgatggccagagactccaccctttagctacacttgtggcgacccatccacctacagagtcaccttccccgtctgcccccagaagctgtcactggctcctccgagtgccaaggccagcccccacaaccctggaagctgcggggagccccaggccaagttcctagaagcattctttgaagaacccccaaggaggcaatccccagtgtccaacctgggctcagaaggagaatgtccgagttcaggggctggcagccaagcccaggagcttgcagaggcctgggagggctgtagaaaggacctgctctttcagaagagtccccagaaccacaggccaccttcagtcagtgaccagcctggggagaaggaaaattgctaccagcacatgggcaccagcaaaagccctgctccaggattcatccatctacgcaccgagtgtgggcccaggaaagaaccgtgtcaggaaaaggctgcccttgagagggtacttcggcaaaagcaagatgcccaagggttcacacctccccagctgggcgccagccaacagtatgcatctgacttccataacgttttgaaggaggagcaggaggcactgtgcttggatctgtggggcacagagaggcgagaggagaggagggagcctgagccccacagcaggcaaggacaagctctgggggtgaagagagggtgccagctccatgagcccagctcggcactgtgtccagctccatccgccaaagtcatcaagatgcccaggggtggcccccaacagctggggacgggggccaacactccagccagggtctttgtggccctctctgattacaaccccctggtgatgtctgccaacctcaaggctgcagaggaggagctggtcttccagaaaaggcagttgctaagagtgtggggctctcaggacacccatgatttctacctcagcgagtgcaacaggcaagtgggcaatatccccgggcgcctagtggctgagatggaggtggggacagagcagactgataggaggtggcgttctccggcccaagggcacctgccttctgtggcccacctcgaggactttcaggggctcaccatcccccagggttcctccctggtgctccaggggaactccaagagactcccactgtggactccaaagatcatgatagcagctctggactatgatcctggggatgggcaaatggggggccaggggaagggcaggctggcgctgagggcaggagacgtggtcatggtttacgggcccatggatgaccaaggattctattatggagagttgggcggccacaggggcctggttcctgcccacctgctggatcacatgtccctccatggacactgagcaagcatccttgcccaggtagtggcctctggctgctcacaccctgccagaggagaagcaagcgttcagaccctcacaccagcacccctcctcaccaccataagtagcatgtgctccaagtgccactgtgttaaactgatggtagtccttaagcgtcccctaggctctgaaagtagcaggacttaagcctgagttatttgcaaaagcaaacacaacaagccaacccctgagagtctgagaagccatttcaaagttgctgataactatggcaggtatacggagaagcgcctttttctgtggccaatgtgtgttttctctgggaggttaaggttatctgtccattgccttgtacgaaagtctcaagaaaagtctacatcttaaaaaagaaaaagcaatctgagtgttatttttgggatgtgagggtgatctggctgcgacatgtgtcaccccattgatcatcagggttgattcggctgatctggctgactaggcgggtatccccttcctcccgcaccactccatgtgcgtccctccagaagctgtgtgctcaatggaagaggatgaccatccccgatagaggacgatcggtcttcagtcaagagtataagagtagctgcgctcccctgctagaacctccaaacgagctctcagaatgttatttttctgtcttatgtccaacccctcattaaaatgt

SEQ ID NO: 62155 - DNA, 429 bp, Homo sapiens
atgctgaccccaaggctgcaccaggagctggtctctgaaggccattccctctcacaagaaaagtcttcctcaatgtcatcactcaatattgcgaagcacatgccccatcgagcctactgggcagagcagcagagcaggctgccactgcccctgatggaactcatggagaatgaagctctggaaatcctcaccaaagccctccggagctaccagttagggatcggcagggaccacttcctgactaaggagctgcagcgatacatcgaagggctcaagaagcgccggagcaagaggctgtacgtgaattaaaaacgccaccttgggctcgagcagcgacccgaaccagccccgtgccagcccggtccccagacccaagcctgaccccatccgagtggaatttgagtcctaaagaaataaaagagtcgatgc

SEQ ID NO: 62156 - DNA, 747 bp, Homo sapiens
atgtctggtggcgactcctcttccattgctagcccctgcattctgctctgcctctggttgttagcaggcaactccgcctgcagcaaccccgtgggaagtccaccagtctgtactgcctgccaactgtacttctccccagtgatacagggagtagaatcttctgctaacacagacatacatactgcctccacaggtggccaccctcgttgctgtgggacatctgtgcaaatgtcttctcccactttccaaaagagcaagcagcactccacccaccagtgtgactctcaacccatagcctcgggacctccggccaaggccaaggagacaggaaagaggaagtcctcctctcagccgagccccagtggcccgaagaagaagactaccaaggtggccgagaagggagaagcagttcgtggagggagacgcgggaagaaaggggctgcgacaaagatggcggccgtgacggcacctgaggcggagagcgggccagcggcacccggccccagcgaccagcccagccaggagctccctcagcacgagctgccgccggaggagccagtgagcgaggggacccagcacgaccccctgagtcaggagagcgagctggaggaaccactgagtaaggggcgcccatctactcccctatctccctgagcagcaactaagtttaggcccagctgccagacctcagagatctcaccagcagggtgcttcccatgttgatgacaataaaatgaatgtgttgca

SEQ ID NO: 62157 - DNA, 1203 bp, Homo sapiens
atggaagaattccggcggaagcatgggaaggacctgagcgggaacaagcgtgccctgcgcaggctgcgcacagcctgtgagcgcgccaagcgcaccctgtcctccagcacccaggccaccctggagatagactccctgttcgagggcgtggacttctacacgtccatcactcgtgcccgctttgaggaactgtgctcagacctcttccgcagcaccctggagccggtggagaaggccctgcgggatgccaagctggacaaggcccagattcatgacgtcgtcctggtggggggctccactcgcatccccaaggtgcagaagttgctgcaggacttcttcaacggcaaggagctgaacaagagcatcaaccctgatgaggctgtggcctatggggctgctgtgcaggcggccgtgttgatgggggacaaatgtgagaaagtgcaggatctcctgctgctggatgtggctcccctgtctctggggctggagacagcaggtggggtgatgaccacgctgatccagaggaacgccactatccccaccaagcagacccagactttcaccacctactcggacaaccagcctggggtcttcatccaggtgtatgagggtgagagggccatgaccaaggacaacaacctgctggggcgttttgaactcagtggcatccctcctgccccacgtggagtcccccagatagaggtgacgtttgacattgatgctaatggcatcctgagcgtgacagccactgacaggagcacaggtaaggctaacaagatcaccatcaccaatgacaagggccggctgagcaaggaggaggtggagaggatggttcatgaagccgagcagtacaaggctgaggatgaggcccagagggacagagtggctgccaaaaactcgctggaggcccatgtcttccatgtgaaaggttctttgcaagaggaaagccttagggacaagattcccgaagaggacaggcgcaaaatgcaagacaagtgtcgggaagtccttgcctggctggagcacaaccagctggcagagaaggaggagtatgagcatcagaagagggagctggagcaaatctgtcgccccatcttctccaggctctatggggggcctggtgtccctgggggcagcagttgtggcactcaagcccgccagggggaccccagcaccggccccatcattgaggaggttgattga

SEQ ID NO: 62158 - DNA, 789 bp, Homo sapiens
cgcggggagcctaggacctggagcgagagccgcctacctgcagccgccgcccacggcacggcagccaccatggcgctcctgctgcgcttcgtgctcctgtgcagagccgcggatttcatcagaggttggagtatcactactcctgagcagatgattgaaaaagccaaaggggaaactgcctatctgccatgcaaatttacgcttagtcctgaagaccagggaccactggacatcgagtggctgatatcaccagctgataatcagaaggtggatcaagtgattattttatattctggagacaaaatttatgatgactactatccagatctgaaaggccgagtacattttaagagtaatgatctcaaatctggtgatgcatcaataaatgtaacgaattttcagctgtcagatattggcacagatcagtgcaaagtgaaaagagctcctggtgttgcaaataggaagattcagctggtagttcttggtaagccttcaggtacaagatgttacgttgatggatcagaagaaattggaagtgactttaaattaaaatgtgaaccaaaagaaggttcacttccattacagtatgagtggcaaaaattgtctgactcacagaaaatgcccacttcatggttagcagaaatgacttcatctgttatatctataaaaatgcttcttctgagtactctgggacatacagctgtacatcagaaacagagtgggctctgatcagtgcctgttgcgtgtaaacgttgtccctccttcaataaagctggactaattgcagga

SEQ ID NO: 62159 - DNA, 769 bp, Homo sapiens
gcggcggagctgtgagccggcgactcgggtccctgaggtctggattctttctccgctactgagacacggcgggtaggtccacaggcagatccaactgggagttgaagtgtgagtgagagtgaagaggaaccagcaggcttccggagggttgtgtggtcagtgactcagagtgagaaggccctcgaagtcgtcgtccctctcatgcggtgccacgcccatggaccttcttgtctcgtcacggccataactagggaggaaggagggccgaggagtggaggggctcaggcgaagctggggtgctgttgggggtatccgagtcccagaagcacctggaaccccgacagaagattctggactccccagacgggaccaggagagggacggcatgagcgacacacacaaacacagaaccacacagccagtcccaggagcccagtaatggagagccccaaaaagaagaaccagcagctgaaagtcgggatcctacacctgggcagcagacagaagaagatcaggatacagctgagatcccagtgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaaatgaagacaagctgaaacaacgcaagctggttttatattagatatttgacttaaactatctcaataaagttttgcagctttcacc

SEQ ID NO: 62160 - DNA, 605 bp, Homo sapiens
gggaaggagcataggacagggcaaggcgggataaggaggggcaccacagcccttaaggcacgagggaacctcactgcgcatgctcctttggtgcccacctcagtgcgcatgttcactgggcgtcttcccatcggccccttcgccagtgtggggaacgcggcggagctgtgagccggcgactcgggtccctgaggtctggattctttctccgctactgagacacggcggacacacacaaacacagaaccacacagccagtcccaggagcccagtaatggagagccccaaaaagaagaaccagcagctgaaagtcgggatcctacacctgggcagcagacagaagaagatcaggatacagctgagatcccagtgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaaatgaagacaagctgaaacaacgcaagctggttttatattagatatttgacttaaactatctcaataaagttttgcagctttcacc

SEQ ID NO: 62161 - DNA, 766 bp, Homo sapiens
gcggcggagctgtgagccggcgactcgggtccctgaggtctggattctttctccgctactgagacacggcgggtaggtccacaggcagatccaactgggagttgaagtgtgagtgagagtgaagaggaaccagcaggcttccggagggttgtgtggtcagtgactcagagtgagaaggccctcgaagtcgtcgtccctctcatgcggtgccacgcccatggaccttcttgtctcgtcacggccataactagggaggaaggagggccgaggagtggaggggctcaggcgaagctggggtgctgttgggggtatccgagtcccagaagcacctggaaccccgacagaagattctggactccccagacgggaccaggagagggacggcatgagcgacacacacaaacacagaaccacacagccagtcccaggagcccagtaatggagagccccaaaaagaagaaccagcagctgaaagtcgggatcctacacctgggcagcagacagaagaagatcaggatacagctgagatcccagtgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaaatgaagacaagctgaaacaacgcaagctggttttatattagatatttgacttaaactatctcaataaagttttgcagctttc

SEQ ID NO: 62162 - DNA, 602 bp, Homo sapiens
gggaaggagcataggacagggcaaggcgggataaggaggggcaccacagcccttaaggcacgagggaacctcactgcgcatgctcctttggtgcccacctcagtgcgcatgttcactgggcgtcttcccatcggccccttcgccagtgtggggaacgcggcggagctgtgagccggcgactcgggtccctgaggtctggattctttctccgctactgagacacggcggacacacacaaacacagaaccacacagccagtcccaggagcccagtaatggagagccccaaaaagaagaaccagcagctgaaagtcgggatcctacacctgggcagcagacagaagaagatcaggatacagctgagatcccagtgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaaatgaagacaagctgaaacaacgcaagctggttttatattagatatttgacttaaactatctcaataaagttttgcagctttc

SEQ ID NO: 62163 - DNA, 1004 bp, Homo sapiens
ctctgctgcagaataccctgatgcgacagaagtctctctagagtttggaaacctttaccaacaaagaaaaattctgatgtattctctttcagttgaacgtcctcagatgactttcggcaggctccagggaatctccccgaagatcatgcccaagaagccagcagaggaaggaaatgattcggaggaagtgccagaagcatctggcccacaaaatgatgggaaagagctgtgccccccgggaaaaccaactacctctgagaagattcacgagagatctggacccaaaaggggggaacatgcctggacccacagactgcgtgagagaaaacagctggtgatttatgaagagatcagcgaccctgaggaagatgacgagtaactcccctcagggatacgacacatgcccatgatgagaagcagaacgtggtgacctttcacgaacatgggcatggctgcggacccctcgtcatcaggtgcatagcaagtgaaagcaagtgttcacaacagtgaaaagttgagcgtcatttttcttagtgtgccaagagttcgatgttagcgtttacgttgtattttcttacactgtgtcattctgttagatactaacattttcattgatgagcaagacatacttaatgcatattttggtttgtgtatccatgcacctaccttagaaaacaagtattgtcggttacctctgcatggaacagcattaccctcctctctccccagatgtgactactgagggcagttctgagtgtttaatttcagattttttcctctgcatttacacacacacgcacacaaaccacaccacacacacacacacacacacacacacacacacacacacacacacaccaagtaccagtataagcatctgccatctgcttttcccattgccatgcgtcctggtcaagctcccctcactctgtttcctggtcagcatgtactcccctcatccgattcccctgtagcagtcactgacagttaataaacctttgcaa

SEQ ID NO: 62164 - DNA, 1771 bp, Homo sapiens
ccaggacgcggcctcgggggagccctaccgggacggagccgcggggcctgcgacttcccccggagctggcctgagggattctcctgtccatggctgccaccaaaactgcgagttatgatgaacatttcaggccagaaaagttaagagaatggccggagcccgagtccgtttctttaatggaggtattagctagagaagacattgatgaagcagtatgtgcaatattatttaaagaaaattccattgtgaaggttacagtcccaccatttgttgatcctctgtttcaaagacagcaagaggtggatgaagagaggagaactggtcttcagtgtgagacaggaaaacgacattccataaaagaacttgaagaaatagagaaggccaggctgcatgccagctcgccctacttcactttcacttcacactgtgtgattccaaaagagtggcataaagcctctgcaagagccaggagtaaaacttacaaatacagtcctgaaaagctcatctatgcagacaagaaacagaaaagaaaagagaaaaagacggccgacctaagtcaggctgcgtttgaaaggcagttcctttcctcaaagctcagccagaagaacaaagtgggtgaaagaaagggtctggtgagcagaggcctggggcggggctggcatgcagggctttgcagcacccacgagcagcacatactggttccagaatgagccaccgccacagccctccctgtcagacaggcacccaagggcggaggaggcatggcccaagaagaagggtgtgaagaggaggagggagaaatggcggtggcctcaggctcagcactgcagctctgacagggcccctcgggcggggaagccttgcatgaagaaactcagacaagtggtaaatgtgggacctggaccccactttccggagacatcctgtccttccgaggtgagggccaacctggccacaggggcttttccccctgagatttcttcagcgccttcgcccgggcctttgcccttctgccactttcctaccattttccacttactccatccaaactgcaccaaagatggtgttctccttagtccacacacaactggtgggaagtttttgaaatgaaatttataccaaaaaattagggcaagatgagattttttgatatttaaaaggtatttttatatgtaggaattttctgagtatggatttcttatccagagctcatggttcatttgacacagttttcagctcctggtctatttccccttccattctctccgccacgccctgtgccctgaggcctgaggcgcaggaccctcccagggaaggcctagggggcttggtgggccaccgctcagctcaggacctgacagcgtcactcccaccctcaccaccacacacacaggatgggggactgctgctgctttccagcctgtgagcctggataggtattttgtgacccagctcctgctcagtcccatcgctgtccccggtctctccagggagtaagggattctccgtctgtggtaagttacctgtgactcttcagcagtttcctctgagcataattatatctgagagcacagggagctcctcattccatgtatttttcaaatattcaagatgtacaacgtgatgatttgctataggtattcattgtgaaatgtttgccacagtcaagcttgttgacatacccaccagctcacatttactgttttcgtgtgtgtggtgagaatactcacaatctactctctgagcaaactgcaaatatatgttattagta

SEQ ID NO: 62165 - DNA, 1111 bp, Homo sapiens
gggctcctttctccgtcgccgctccaggacgcggcctcgggggagccctaccgggacggagccgcggggcctgcgacttcccccggagctggcctgagggattctcctgtccatggctgccaccaaaactgcgagttatgatgaacatttcaggccagaaaagttaagagaatggccggagcccgagtccgtttctttaatggaggtattagctagagaagacattgatgaagcagtatgtgcaatattatttaaagaaaattccattgtgaagagattggatatgtattttcagcatgtggatacttttaaggaaagaagaaaagagatgttacataaaaaatgggttgaaaatgttgcagagcctcttcagcagagaattatggaaaaagtaatttcatataaagagcttaaaatgaaacgagaatgttgaatattatttacagcacagacataaaatggttacagtcccaccatttgttgatcctctgtttcaaagacagcaagaggtggatgaagagaggagaactggtcttcagtgtgagacaggaaaacgacattccataaaagaacttgaagaaatagagaaggccaggctgcatgccagctcgccctacttcactttcacttcacactgtgtgattccaaaagagtggcataaagcctctgcaagagccaggagtaaaacttacaaatacagtcctgaaaagctcatctatgcagacaagaaacagaaaagaaaagagaaaaagacggccgacctaagtcaggctgcgtttgaaaggcagttcctttcctcaaagctcagccagaagaacaaagtgggtgaaagaaagggtctggttttaggaaccagacagcagagaccccgttcctgggctgctggggacagccaacagcacaggggtccccagcctgtgggaaaaagagtgatgacagctgaggtgctggggcagcacctggcctccctgcagaaggtggccaggcagggccacccttggtactgaagcttcgtggacttgacttggcagtgtctgtacagcagttaaaatactctaaacatattttcttcctccagaagtggaaataaattgcaagaaatacccaaatc

SEQ ID NO: 62166 - DNA, 901 bp, Homo sapiens
ccaggacgcggcctcgggggagccctaccgggacggagccgcggggcctgcgacttcccccggagctggcctgagggattctcctgtccatggctgccaccaaaactgcgagttatgatgaacatttcaggccagaaaagttaagagaatggccggagcccgagtccgtttctttaatggaggtattagctagagaagacattgatgaagcagtatgtgcaatattatttaaagaaaattccattgtgaaggttacagtcccaccatttgttgatcctctgtttcaaagacagcaagaggtggatgaagagaggagaactggtcttcagtgtgagacaggaaaacgacattccataaaagaacttgaagaaatagagaaggccaggctgcatgccagctcgccctacttcactttcacttcacactgtgtgattccaaaagagtggcataaagcctctgcaagagccaggagtaaaacttacaaatacagtcctgaaaagctcatctatgcagacaagaaacagaaaagaaaagagaaaaagacggccgacctaagtcaggctgcgtttgaaaggcagttcctttcctcaaagctcagccagaagaacaaagtgggtgaaagaaagggtctggttttaggaaccagacagcagagaccccgttcctgggctgctggggacagccaacagcacaggggtccccagcctgtgggaaaaagagtgatgacagctgaggtgctggggcagcacctggcctccctgcagaaggtggccaggcagggccacccttggtactgaagcttcgtggacttgacttggcagtgtctgtacagcagttaaaatactctaaacatattttcttcctccagaagtggaaataaattgcaagaaatacccaaatc

SEQ ID NO: 62167 - DNA, 1167 bp, Homo sapiens
tcgcgcgcagtcccttagggggcgcctggaagcccggcgcatgcgccctgagggctcgctgacctaccgggtgccagagaggctgcggcagggtttctgtggcgtgggtcgggcagcacaggccttggtgtgtgcgagtgccaaggagggcaccgccttcaggatggaggctgtacaggagggggcggccggggtggagagtgagcaggcggctttgggggaggaggcggtgctgctgttggatgacataatggcggaggtggaggtggtggcggaggtggaggtggtggcggaggaggagggcctcgtggagcggcgggaggaggcccagcgggcacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccagctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcctgttcatctctgcaagatcatgttgttctttcggagtaacccctacttccagaataaagtgattaccaaggaatatctggtgaacatcacagaatacagggcttctcattccactccaattgagtggtatccggattatgaagtggaggcctatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattct

SEQ ID NO: 62168 - DNA, 1907 bp, Homo sapiens
atgcgccctgagggctcgctgacctaccgggtgccagagaggctgcggcagggtttctgtggcgtgggtcgggcagcacaggccttggtgtgtgcgagtgccaaggagggcaccgccttcaggatggaggctgtacaggagggggcggccggggtggagagtgagcaggcggctttgggggaggaggcggtgctgctgttggatgacataatggcggaggtggaggtggtggcggaggtggaggtggtggcggaggaggagggcctcgtggagcggcgggaggaggcccagcgggcacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccagctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcctgttcatctctgcaagatcatgttgttctttcggagtaacccctacttccagaataaagtgattaccaaggaatatctggtgaacatcacaggtgacaggtggctcccaggatgggtagtggaaggaagatggtgggtggatcattgccaacgggatccagcccccttcccacaaaaactcctgtctctgtagaatacagggcttctcattccactccaattgagtggtatccggattatgaagtggaggcctatcgccgcagacaccacaacagcagccttaacttcttcaactggttctctgaccacaacttcgcaggatctaacaagattgctgaggtgagtcctcactgggaaacatgaggaatgaccccatgtgttcccagctgcttgggtcacctttctgagccctgatgaggcctttcccgattgagtcccctgacagatcctatgtaaggacctgtggcgcaatcccctgcaatactacaagaggatgaagccacctgaagagggaacagagacgtcagaaattccttgagaggaagacagagagtgacagaatccaggacgttcatggcattgggctgaaaaggcacgttagagactgcactgcaaagcgggtgatagctgtggagtcttaagcccagtgaagaatcgtccatttccagaatcaatgagaagtaaagctgaaaatcattcagttcagtctgtggcacttgattccacggctgtcaaccccaccggcagtcatcccaccaaccccatgagattgggctccctgaatgtgcgtcctggtcatccttgccccaaaccacaaaggactgtttagattgatggatttccttaagctgttgccccatcagacttgtgtgtgcttttagggcccagtgcatcttgttagctgactcccctcacagacaatactgggaatggggcagggattgcgcagaacagtttgtaacacgtggtaggaggaagtttaagggatcacaaatggggaagggatatccttttctcagcgggccccacaattgaaacatttcaaagtatggctcagagaaaatgcgttttaacatgagtttgtgtttctctaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattctcaagga

SEQ ID NO: 62169 - DNA, 579 bp, Homo sapiens
tccagaataaagtgattaccaaggaatatctggtgaacatcacaggtgacaggtggctcccaggatgggtagtggaaggaagatggtgggtggatcattgccaacgggatccagcccccttcccacaaaaactcctgtctctgtagaatacagggcttctcattccactccaattgagtggtatccggattatgaagtggaggcctatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattct

SEQ ID NO: 62170 - DNA, 1149 bp, Homo sapiens
tcgcgcgcagtcccttagggggcgcctggaagcccggcgcatgcgccctgagggctcgctgacctaccgggtgccagagaggctgcggcagggtttctgtggcgtgggtcgggcagcacaggccttggtgtgtgcgagtgccaaggagggcaccgccttcaggatggaggctgtacaggagggggcggccggggtggagagtgagcaggcggctttgggggaggaggcggtgctgctgttggatgacataatggcggaggtggaggtggtggcggaggaggagggcctcgtggagcggcgggaggaggcccagcgggcacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcctgttcatctctgcaagatcatgttgttctttcggagtaacccctacttccagaataaagtgattaccaaggaatatctggtgaacatcacagaatacagggcttctcattccactccaattgagtggtatccggattatgaagtggaggcctatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaacagatcgagtcacaaaaattcaggaagagggggtaaatgtggattgtatggaatgaaaaataaacattct

SEQ ID NO: 62171 - DNA, 1889 bp, Homo sapiens
atgcgccctgagggctcgctgacctaccgggtgccagagaggctgcggcagggtttctgtggcgtgggtcgggcagcacaggccttggtgtgtgcgagtgccaaggagggcaccgccttcaggatggaggctgtacaggagggggcggccggggtggagagtgagcaggcggctttgggggaggaggcggtgctgctgttggatgacataatggcggaggtggaggtggtggcggaggaggagggcctcgtggagcggcgggaggaggcccagcgggcacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcctgttcatctctgcaagatcatgttgttctttcggagtaacccctacttccagaataaagtgattaccaaggaatatctggtgaacatcacaggtgacaggtggctcccaggatgggtagtggaaggaagatggtgggtggatcattgccaacgggatccagcccccttcccacaaaaactcctgtctctgtagaatacagggcttctcattccactccaattgagtggtatccggattatgaagtggaggcctatcgccgcagacaccacaacagcagccttaacttcttcaactggttctctgaccacaacttcgcaggatctaacaagattgctgaggtgagtcctcactgggaaacatgaggaatgaccccgtgtgttcccagctgcttgggtcacctttctgagccctgatgaggcctttcccgattgagtcccctgacagatcctatgtaaggacctgtggcgcaatcccctgcaatactacaagaggatgaagccacctgaagagggaacagagacgtcagaaattccttgagaggaagacagagagtgacagaatccaggacgttcatggcattgggctgaaaaggcacgttagagactgcactgcaaagcgggtgatagctgtggagtcttaagcccagtgaagaatcgtccatttccagaatcaatgagaagtaaagctgaaaatcattcagttcagtctgtggcacttgattccacggctgtcaaccccaccggcagtcatcccgccaaccccatgagattgggctccctgaatgtgcgtcctggtcatccttgccccaaaccacaaaggactgtttagattgatggatttccttaagctgttgccccatcagacttgtgtgtgcttttagggcccagtgcatcttgttagctgactcccctcacagacaatactgggaatggggcagggattgcgcagaacagtttgtaacacgtggtaggaggaagtttaagggatcacaaatggggaagggatatccttttctcagcgggccccacaattgaaacatttcaaagtatggctcagagaaaatgcgttttaacatgagtttgtgtttctctaggggactcccagttgttgagttgaatatgatggagcatcagattttacctaatacagcagaactcctaaaaagttacagccatatgcaggacggcagtactcagcatggtcttatgcacaggaactaaaggaaaaacagatcgagtcacaaaaattcaggaagagggggtaaatgtggattgtatggaatgaaaaataaacattctcaagga

SEQ ID NO: 62172 - DNA, 579 bp, Homo sapiens
tccagaataaagtgattaccaaggaatatctggtgaacatcacaggtgacaggtggctcccaggatgggtagtggaaggaagatggtgggtggatcattgccaacgggatccagcccccttcccacaaaaactcctgtctctgtagaatacagggcttctcattccactccaattgagtggtatccggattatgaagtggaggcctatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaacagatcgagtcacaaaaattcaggaagagggggtaaatgtggattgtatggaatgaaaaataaacattct

SEQ ID NO: 62173 - DNA, 696 bp, Homo sapiens
agctccatgaggagatgtttcattgtcgagagcagtcatgatggcctgcactccacacaatgcaacagagtgaaagagcaggttctgcttctttggtgtagtcctgaagcttcctaagaaacttcacatcaggtgatggataggagcaaccctgtaaaaccagccttagactatttttcaaacaggctggtgaattaccagatctccgtcaagtgcagtaaccagttcaagttggaagtgtgtcttttgaatgcagaaaacaaagtcgtggacaaccaggctgggacccagggccagctgaaggtgctgggtgccaacctctggtggccgtacctgatgcacgaacaccccgcctccctgtactcgtgggaggatggtgattgctcacaccaaagccttggacccctcccagcctgtgacctttgtgaccaactccacctacgcagcagacaagggggctctgtatgtggatgtgatccgtgtgaacagctactactcttggtatcgcaactacgggcacctggagttgattcagctgcagctggccgcccagtttgagaattggtgtaagacatcacaatcccattattcagagcgcgtatggagtggaaacgcttgtaaggcttcaccaggtaagcggtgttgaactttctgcttgtgtattctctctgggcagagatgccacttgcctccccc

SEQ ID NO: 62174 - DNA, 633 bp, Homo sapiens
aaaaaaaaaaaagcaacagaagcaaatgagagtgcctgggagtggtcattgtggggccttcccgtttgtgtgacccaggtcatgtccctccctaagccctggtctctcttgcctcctgcagggctggtgaattaccagatctccgtcaagtgcagtaaccagttcaagttggaagtgtgtcttttgaatgcagaaaacaaagtcgtggacaaccaggctgggacccagggccagctgaaggtgctgggtgccaacctctggtggccgtacctgatgcacgaacaccccgcctccctgtactcgtgggaggatggtgattgctcacaccaaagccttggacccctcccagcctgtgacctttgtgaccaactccacctacgcagcagacaagggggctctgtatgtggatgtgatccgtgtgaacagctactactcttggtatcgcaactacgggcacctggagttgattcagctgcagctggccgcccagtttgagaattggtgtaagacatcacaatcccattattcagagcgcgtatggagtggaaacgcttgtaaggcttcaccaggtaagcggtgttgaactttctgcttgtgtattctctctgggcagagatgccacttgcctccccc

SEQ ID NO: 62175 - DNA, 1379 bp, Homo sapiens
acttcagtgtgcatgttccttggacacctgcctcagtgtgcatgttcactgggcatcttcccttcgacccctttgcccacgtggtgaccgctggggagctgtgagagtgtgaggggcacgttccagccgtctggactctttctctcctactgagacgcagcctataggtccgcaggccagtcctcccaggaactgaaatagtgaaatatgagttggcgaggaagatcaacatataggcctaggccaagaagaagtttacagcctcctgagctgattggggctatgcttgaacccactgatgaagagcctaaagaagagaaaccacccactaaaagtcggaatcctacacctgatcagaagagagaagatgatcagggtgcagctgagattcaagtgcctgacctggaagccgatctccaggagctatgtcagacaaagactggggatggatgtgaaggtggtactgatgtcaaggggaagattctaccaaaagcagagcactttaaaatgccagaagcagtagagacgaggtttcgccatgttggacaagctgttctcgaactcctgacctcgggtgatccacttgccttggcctcccaaagtgctgggattacagatgtgagccaccacgcccagctgaaagtgaatacgttcttaaactctaatattttcggaatatagatgaaatggttgataagctaggaatgcatgcattattaaatatatcccagtagtacctgaatatctattcatcacaaagactgtgcatgaacttgtgaaatttgctagttgtcccttgataatatttacttttagaaataaatatttagttattctagatgtcttcctctacatctccatttccctttccgtttcttttttttcgtgccatactgttcatgatatatacctctttcatattttgatatcaataatgataatgatagattaaaagtaatgcgatcatataattaattatacaaaggggaattttttcaagtgtaaaaagagatatttgtattaacatcaggactataggtgaaaactggggacagatgtttaccataccttaatatctacagaagggtaaactaacccaaagcaacatttttgcactttggcacaatagaggaaaaaacaaatgcaatactgtcctttctattcaccacgcatatgcagcttctaatgtgacattaactcttttcttaaaagatagttttcatactatttccaggagcctatttgacatccagaccatagtttcaagccaaaatattaaattgtacattttttataaattcctttgtttcttagtttttttgtgtgtatttgttatatttttagtaaaattatacacaatttttgctttatacattaaa

SEQ ID NO: 62176 - DNA, 769 bp, Homo sapiens; identical to SEQ ID NO: 62159

SEQ ID NO: 62177 - DNA, 605 bp, Homo sapiens; identical to SEQ ID NO: 62160

SEQ ID NO: 62178 - DNA, 769 bp, Homo sapiens; identical to SEQ ID NO: 62159

SEQ ID NO: 62179 - DNA, 605 bp, Homo sapiens; identical to SEQ ID NO: 62160

SEQ ID NO: 62180 - DNA, 5006 bp, Homo sapiens
ctgagaaacaaaacaagcaaattaattttccacttttgcacctgcaaaaaaatgtctcaagaaccagaactgagtaagaattgtgataaagagtgtttatctgtatattcagggcttcctttaaaattaattacaagaaagttcaactgaaaattggtgaaagttttgaaaaatccaaaattactgtttgtcctgaggaagagctcttacatagttactctaaagagggacaaaattaaaggaagtgccctctaacccaatgaatcatgtccctgactgcaaggaagcagatgcatcttggagtgtcgaactctgtagtatcccaggcattgcctgaacaggaggagaacatcacaaacctgtcttttcattgtatttatactctgggtccctcaaacacacctgccagtcatcttctaagctttattcaaatgaaaataaatcagactgtaaaacttgtaactatccagacatgtagcctgtttctcagagatgaagagaattgttgtaatgatacagaaatagaaaaattagggaacccagtagttatggttgaaatgaaagaggaccaagagtttgatatgcaaatgacaaaaaaatataaaccaaaataccgttaattggaaattagacattagacattggcctcagtctagagatccaaaaagtctgtttgatttgtggtttgtttactctaaagaaatgaagcatgtgatacagatagaaagccacagtatttctgctgttacagacacttacaaaaacaaaaatccagtaagcacttgttccacaagccatatggaacttagaagctcttctaaagcttagaagatgactggcaagtatgtttcagggagccacataagacagttccactgctaatagctataaaagcatgaaacctgcatgagaaaatgtgagttattctccaccccatagtgacagaacatcaaaagcatatctagaagaagacttacagcaagatatgcaaaggcttaagaatgaggtgggcatgttacaagtagagttcctggctttgaagaaagaaagcttaactataaaaagaaagaggttcacttgctgcttctctttttataaattatctgattcattctggttttctactcaagaaaatctcatgtgtctagttacagtgtggttatctaaatgcataattatgtgtctaagtagatcagtgctgctatctaaatgacagttctggaaaacactctcataatctttgttcattagtcaacctgagtctcactatcagtcttccaagtggcacatgggctgggaaaataatttagccatatgccatgtgaccttctgaatcagctaaacataaagaaaattgctaaagaaataagctctagattcttcttactgtattcatttaaagatgacttacatttatttaaatgataaaatggtaacacgatgggagggaaacaatgactgagaagagacatgaaaatgtatctagcctggagacttgtaacaaatattatcagccaaaggcgtctgtttaatgtgctttcatgcatgcaagtttatttgtctgactcaagctgtttaaacttataattccataatggccattttaaatatttttggaaacaaatacatatacttttgcatatttaaaaaaaatcaccactctccaatgtttctgttgaatcacacttttacattatgttgtttaataaaatatggtaagttttgacatgtatgattttatcatgtaagtagcataacttctcagccaaatatttatcatttgactctatagtggaaagctgagttctgtacattgtgttctaaagatagacaaaaatctagagattttcttaaaagcagatgaggcctcctgccatcctctgaggcattaaattgctttgccaaagtcacgcttttaatttatttgactaatttgatatatttatctggtaatttatgtaatgcagcaatatgtaattgtatcttcccttttggtgccatgaagtgctaggtaatgccaccttaggagctttgggtgaattatttaatatttattggttttacttctattatcaagtagataatggggctagagtagacaactattctgtatatcttccagctataaacttttgtggtgattgaatgtaaacttggggaacatctcattttctaggattctgcactagcaactcagcagtgtcactctgctccttgagttgtggtaaactttggttcctctatttcagtgagcaccttcacttttttgatatcccaggatccaagtgaaaaaataaggataaaagacagtggggaaaataacagcttagtgcagaacagggaaagcttcttttctgtttctgaagccccacaaggtcacctcctctcaatctggctatttcatggagaatccaggtgacaaagacagaagacacattttatgtctgtgtctttttgtttctctgtttttgtgttgatatatttacaccacagaagtaactgtgatctggtggagaactagaagtagagtcagaagccctgggaacatcctgcagcttgcttatatttttaacctctctttttaagaattgtgataagaaattcatcaatgtatgtacgtagaagtgcttagtacaatgtctagatttatgatttagtaaatgaaattcttataactgactaaaaatgttgagtcaaatcacaatagaatattatcagggaaacagaacttctaaaactttgagaaattttatcggtccaaatacacgtggaggtaaagctcttactacagggtggtatctgggttagatatcagagtataaatgcaatttcctttttccaatattttaatttagtcaaatttgttaatattttactttatgctttgagtttgttgtaattcagagaaaggcttttccaattctgatattcttaacagttctctagtgtgtatgtgtgtgtttttagttttatggattcattgacttcaaataaagttttgaactttttgaaatttatgctctttaaggttcaaggttttgcttcaactttttctccagttggatatccacttacagcaacttttaattgcatgaatgtacaggttgttctttcacttcagagataaacatgatatgttattttattgagtgctagctgaaaatttcttttgttttatttaagattttcaaagttatagaaaaaagaaggatgtgatatatacaaattgcatattgaagggagatattgccacactcaaacaggaataatacacaataaaaaatgacagtgtcaaaaaggaaaaggaatatattcaggaaattaagagtattagagaaataaatgctaactttgaaaaaagtgcaagactcaatgaggaaatgacaacaaaaacgatgtcccagtattgtcaacagcttaatggcctcaaagctgagaatacaaggctgaattcaaaattggagaaggaagaacaccacacagatggactggaagctgaagttgaattcttccattctaggctggctgctgctataaatgagcacaatgaaagtttagaaacgaaagacctagaacttgttttacagagagcacataatttttccgtacataaaaaaataagttctactgtttctcaactaaaagataaaaatgagttgcttactgaacaattttctaaagctcagatgaagttcaataccttaaaaggtaagctccatgagataagagatgctctcagggaaaagacattggctttagaaagtgtacagatggaccaaaggcaagcacagcatcgaataaaggaaatggagcagattcatccaaatgaggaaactaaaggagtcgatccaccggaaagcacaactgtgtagaggagagactatgtcaactagaatgtgacagtctcttgcttcaacgacaactagagggtgctcataaggaaggcaatgataaagagatagtaattaatatccaaggaggctgtcttgagagtggaaagatcttctagaagagaaaaataagaaactaatgaatgaatataattctataaaagaaaaactgtttcagtatgtaaaagaagaaggagaagtaagtatgaagaaagataaatatatttaaccttccagaaagaaaatttaaacatttcattgtggctatatgttgaatctagttcaatataataataaatagatgaaaatgtatttaccatactgtataattccattaacatgaaacatccagaaaagacatgtatagggacagaaagaagatgaatgtttctgtagggctggggctggaaatgggtcgtgactgctgatgggcatgagggatcatcctggagtgatgaaaatgttctaaagctggattgtaaagatgactgcacgactggtaaatttactaaaaatctttgaactgtatgttaaaacagataaattctgtagtatgtaaatcatattttagcaaagctgttttaataaaaaaacaaaaaaaatatgtttactgtatcagcttggaaacataccttgtttccaggaaataaaaggtagagctgacagatgctttcctttgagtaaacacattatgtcacctatgaaattttagtagctacagagtaatgttcatacagtatgtagtcttatactgctgaaataataaatttaatgtctttatgttgtcacattttaagaccataatgaagcagataaattgatatcttgtacctgaaataagtattttgaaattaagattcaattaagtgagccactttgacacttaattctagatttcccagatgaactgaagtgtgttgctctgtcttgtggtgcttttccttcagtggctcttttatgtattttagttggcataactttattttgattcatatcaatgtgacttaagtctgaaaatatgtcagtctcacattatgtatttttctgaccacttaatattttaaagacatctacttgttataaaatcacaatttggaataaatgtggtaaatttta

SEQ ID NO: 62181 - DNA, 1795 bp, Homo sapiens
gtcagagagaagggagaggcctccttctgaggggcggcttgataccggtggaggagctccaggaagcaggcaggccttggtctgagacagtgtcctcaggtcgcagagcagaggagacccaggcagtgtcagcagtgaaggttctcgggacaggctaaccaggaggacaggagccccaagaggccccagagcagcactgacgaagacctgcctgtgggtctccatcgcccagctcctgcccacgctcctgactgctgccctgaccagagtcatcatgtctctcgagcagaggagtccgcactgcaagcctgatgaagaccttgaagcccaaggagaggacttgggcctgatgggtgcacaggaacccacaggcgaggaggaggagactacctcctcctctgacagcaaggaggaggaggtgtctgctgctgggtcatcaagtcctccccagagtcctcagggaggcgcttcctcctccatttccgtctactacactttatggagccaattcgatgagggctccagcagtcaagaagaggaagagccaagctcctcggtcgacccagctcagctggagttcatgttccaagaagcactgaaattgaaggtggctgagttggttcatttcctgctccacaaatatcgagtcaaggagccggtcacaaaggcagaaatgctggagagcgtcatcaaaaattacaagcgctactttcctgtgatcttcggcaaagcctccgagttcatgcaggtgatctttggcactgatgtgaaggaggtggaccccgccggccactcctacatccttgtcactgctcttggcctctcgtgcgatagcatgctgggtgatggtcatagcatgcccaaggccgccctcctgatcattgtcctgggtgtgatcctaaccaaagacaactgcgcccctgaagaggttatctgggaagcgttgagtgtgatgggggtgtatgttgggaaggagcacatgttctacggggagcccaggaagctgctcacccaagattgggtgcaggaaaactacctggagtaccggcaggtgcccggcagtgatcctgcgcactacgagttcctgtggggttccaaggcccacgctgaaaccagctatgagaaggtcataaattatttggtcatgctcaatgcaagagagcccatctgctacccatccctttatgaagaggttttgggagaggagcaagagggagtctgagcaccagccgcagccggggccaaagtttgtggggtcagggccccatccagcagctgccctgccccatgtgacatgaggcccattcttggctctgtgtttgaagagagcaatcagtgttctcagtggcagtgggtggaagtgagcacactgtatgtcatctctgggttccttgtctattgggtgatttggagatttatccttgctcccttttggaattgttcaaatgttcttttaatggtcagtttaatgaacttcaccatcgaagttaatgaatgacagtagtcacacatattgctgtttatgttatttaggagtaagattcttgcttttgagtcacatggggaaatccctgttattttgtgaattgggacaagataacatagcagaggaattaataatttttttgaaacttgaacttagcagcaaaatagagctcataaagaaatagtgaaatgaaaatgtagttaattcttgccttatacctctttctctctcctgtaaaattaaaatatatacatgtatacctggatttgcttggcttctttgagcatgtaagagaaataaaaattgaaa

SEQ ID NO: 62182 - DNA, 1755 bp, Homo sapiens
gtgaggaggcaaggagctccaggaagcaggcaggccttggtctgagacagtgtcctcaggtcgcagagcagaggagacccaggcagtgtcagcagtgaaggttctcgggacaggctaaccaggaggacaggagccccaagaggccccagagcagcactgacgaagacctgcctgtgggtctccatcgcccagctcctgcccacgctcctgactgctgccctgaccagagtcatcatgtctctcgagcagaggagtccgcactgcaagcctgatgaagaccttgaagcccaaggagaggacttgggcctgatgggtgcacaggaacccacaggcgaggaggaggagactacctcctcctctgacagcaaggaggaggaggtgtctgctgctgggtcatcaagtcctccccagagtcctcagggaggcgcttcctcctccatttccgtctactacactttatggagccaattcgatgagggctccagcagtcaagaagaggaagagccaagctcctcggtcgacccagctcagctggagttcatgttccaagaagcactgaaattgaaggtggctgagttggttcatttcctgctccacaaatatcgagtcaaggagccggtcacaaaggcagaaatgctggagagcgtcatcaaaaattacaagcgctactttcctgtgatcttcggcaaagcctccgagttcatgcaggtgatctttggcactgatgtgaaggaggtggaccccgccggccactcctacatccttgtcactgctcttggcctctcgtgcgatagcatgctgggtgatggtcatagcatgcccaaggccgccctcctgatcattgtcctgggtgtgatcctaaccaaagacaactgcgcccctgaagaggttatctgggaagcgttgagtgtgatgggggtgtatgttgggaaggagcacatgttctacggggagcccaggaagctgctcacccaagattgggtgcaggaaaactacctggagtaccggcaggtgcccggcagtgatcctgcgcactacgagttcctgtggggttccaaggcccacgctgaaaccagctatgagaaggtcataaattatttggtcatgctcaatgcaagagagcccatctgctacccatccctttatgaagaggttttgggagaggagcaagagggagtctgagcaccagccgcagccggggccaaagtttgtggggtcagggccccatccagcagctgccctgccccatgtgacatgaggcccattcttggctctgtgtttgaagagagcaatcagtgttctcagtggcagtgggtggaagtgagcacactgtatgtcatctctgggttccttgtctattgggtgatttggagatttatccttgctcccttttggaattgttcaaatgttcttttaatggtcagtttaatgaacttcaccatcgaagttaatgaatgacagtagtcacacatattgctgtttatgttatttaggagtaagattcttgcttttgagtcacatggggaaatccctgttattttgtgaattgggacaagataacatagcagaggaattaataatttttttgaaacttgaacttagcagcaaaatagagctcataaagaaatagtgaaatgaaaatgtagttaattcttgccttatacctctttctctctcctgtaaaattaaaatatatacatgtatacctggatttgcttggcttctttgagcatgtaagagaaataaaaattgaaa

SEQ ID NO: 62183 - DNA, 1728 bp, Homo sapiens
ggagaggcctccttctgaggggcggcttgataccggtggaggtaagctggccgaggctctgtgaggagtcaaggttctcgggacaggctaaccaggaggacaggagccccaagaggccccagagcagcactgacgaagacctgcctgtgggtctccatcgcccagctcctgcccacgctcctgactgctgccctgaccagagtcatcatgtctctcgagcagaggagtccgcactgcaagcctgatgaagaccttgaagcccaaggagaggacttgggcctgatgggtgcacaggaacccacaggcgaggaggaggagactacctcctcctctgacagcaaggaggaggaggtgtctgctgctgggtcatcaagtcctccccagagtcctcagggaggcgcttcctcctccatttccgtctactacactttatggagccaattcgatgagggctccagcagtcaagaagaggaagagccaagctcctcggtcgacccagctcagctggagttcatgttccaagaagcactgaaattgaaggtggctgagttggttcatttcctgctccacaaatatcgagtcaaggagccggtcacaaaggcagaaatgctggagagcgtcatcaaaaattacaagcgctactttcctgtgatcttcggcaaagcctccgagttcatgcaggtgatctttggcactgatgtgaaggaggtggaccccgccggccactcctacatccttgtcactgctcttggcctctcgtgcgatagcatgctgggtgatggtcatagcatgcccaaggccgccctcctgatcattgtcctgggtgtgatcctaaccaaagacaactgcgcccctgaagaggttatctgggaagcgttgagtgtgatgggggtgtatgttgggaaggagcacatgttctacggggagcccaggaagctgctcacccaagattgggtgcaggaaaactacctggagtaccggcaggtgcccggcagtgatcctgcgcactacgagttcctgtggggttccaaggcccacgctgaaaccagctatgagaaggtcataaattatttggtcatgctcaatgcaagagagcccatctgctacccatccctttatgaagaggttttgggagaggagcaagagggagtctgagcaccagccgcagccggggccaaagtttgtggggtcagggccccatccagcagctgccctgccccatgtgacatgaggcccattcttggctctgtgtttgaagagagcaatcagtgttctcagtggcagtgggtggaagtgagcacactgtatgtcatctctgggttccttgtctattgggtgatttggagatttatccttgctcccttttggaattgttcaaatgttcttttaatggtcagtttaatgaacttcaccatcgaagttaatgaatgacagtagtcacacatattgctgtttatgttatttaggagtaagattcttgcttttgagtcacatggggaaatccctgttattttgtgaattgggacaagataacatagcagaggaattaataatttttttgaaacttgaacttagcagcaaaatagagctcataaagaaatagtgaaatgaaaatgtagttaattcttgccttatacctctttctctctcctgtaaaattaaaatatatacatgtatacctggatttgcttggcttctttgagcatgtaagagaaataaaaattgaaa

SEQ ID NO: 62184 - DNA, 1819 bp, Homo sapiens
gaagggagaggcctccttctgaggggcggcttgataccggtggaggtaagctggccgaggctctgtgaggagtcaaggagctccaggaagcaggcaggccttggtctgagacagtgtcctcaggtcgcagagcagaggagacccaggcagtgtcagcagtgaaggttctcgggacaggctaaccaggaggacaggagccccaagaggccccagagcagcactgacgaagacctgcctgtgggtctccatcgcccagctcctgcccacgctcctgactgctgccctgaccagagtcatcatgtctctcgagcagaggagtccgcactgcaagcctgatgaagaccttgaagcccaaggagaggacttgggcctgatgggtgcacaggaacccacaggcgaggaggaggagactacctcctcctctgacagcaaggaggaggaggtgtctgctgctgggtcatcaagtcctccccagagtcctcagggaggcgcttcctcctccatttccgtctactacactttatggagccaattcgatgagggctccagcagtcaagaagaggaagagccaagctcctcggtcgacccagctcagctggagttcatgttccaagaagcactgaaattgaaggtggctgagttggttcatttcctgctccacaaatatcgagtcaaggagccggtcacaaaggcagaaatgctggagagcgtcatcaaaaattacaagcgctactttcctgtgatcttcggcaaagcctccgagttcatgcaggtgatctttggcactgatgtgaaggaggtggaccccgccggccactcctacatccttgtcactgctcttggcctctcgtgcgatagcatgctgggtgatggtcatagcatgcccaaggccgccctcctgatcattgtcctgggtgtgatcctaaccaaagacaactgcgcccctgaagaggttatctgggaagcgttgagtgtgatgggggtgtatgttgggaaggagcacatgttctacggggagcccaggaagctgctcacccaagattgggtgcaggaaaactacctggagtaccggcaggtgcccggcagtgatcctgcgcactacgagttcctgtggggttccaaggcccacgctgaaaccagctatgagaaggtcataaattatttggtcatgctcaatgcaagagagcccatctgctacccatccctttatgaagaggttttgggagaggagcaagagggagtctgagcaccagccgcagccggggccaaagtttgtggggtcagggccccatccagcagctgccctgccccatgtgacatgaggcccattcttggctctgtgtttgaagagagcaatcagtgttctcagtggcagtgggtggaagtgagcacactgtatgtcatctctgggttccttgtctattgggtgatttggagatttatccttgctcccttttggaattgttcaaatgttcttttaatggtcagtttaatgaacttcaccatcgaagttaatgaatgacagtagtcacacatattgctgtttatgttatttaggagtaagattcttgcttttgagtcacatggggaaatccctgttattttgtgaattgggacaagataacatagcagaggaattaataatttttttgaaacttgaacttagcagcaaaatagagctcataaagaaatagtgaaatgaaaatgtagttaattcttgccttatacctctttctctctcctgtaaaattaaaatatatacatgtatacctggatttgcttggcttctttgagcatgtaagagaaataaaaattgaaa

SEQ ID NO: 62185 - DNA, 2315 bp, Homo sapiens
caagattctgaggggaagtgtagctcccaggttggttccaagtcttcttccaattaggatcttatccaggacgcttcattgcatttggtcttcatttctccttagtctcctccaggctgacatttcctcaatctttattggtcttccacagccctgacacttttggagataccagtcagcatttccaagttcgttctgtgagactgtagtgtcaggacaaagcaacaacaaaatgtgctctactctaaagaagtgtgggacatacagaactgaagttgcagaatgccatgaccatggtagcacttttcaaggaagaaagaaaggtgggagttctttccgggataattttgacaagaggagctgtcattatgaacatggtgggtatgagcgcccgccttcacactgccaggagaatgatggaagcgtggagatgagggatgtccacaaggaccaacaactaagacacactccttatagcatccgatgcgaaagaagaatgaaatggcatagtgaagacgaaatccgtattaccacgtggagaaatagaaaacctccggagagaaaaatgagtcagaacacacaggatggatacacaaggaactggtttaaggtcacaattccttacgggataaagtatgacaaggcatggctaatgaattcaatccagagccattgcagtgaccgcttcactccggttgatttccactacgtccgaaatcgggcatgcttctttgtccaggatgctagcgctgcctccgcattgaaggatgtcagttataagatttatgatgatgagaaccaaaagatatgtatatttgtcaatcattctactgcgccctactctgtgaagaataagttgaagccaggccaaatggagatgctaaagctgaccatgaacaaacggtacaatgtctcccagcaagctcttgatctccagaatctccgctttgacccagacttgatgggccgtgacattgatataatcctgaatcgaagaaactgcatggctgccaccctgaagatcattgaaagaaatttccctgagctgttgtctttgaacttgtgcaacaacaagctgtaccagctggatggcctttctgacattacagagaaggctcccaaagtcaagaccctgaatctctccaaaaataagctggagtcggcgtgggagttgggcaaggtgaaagggctgaagctcgaagagctatggctagaagggaacccgttgtgcagcaccttctcggaccagtccgcctatgtaagtgccatccgggattgtttccccaagttgttacgcctggacggccgagagttatccgcaccagtgattgttgacattgacagctctgagacaatgaaaccctgcaaggaaaactttactggatctgagaccctaaagcatttagtcctgcaattcctgcagcagtattactcgatctatgactctggagatcgacagggtctcctcggtgcttaccacgatgaggcctgcttctccttggctattcccttcgaccccaaggactcagccccgagcagcttgtgcaagtactttgaggatagcaggaatatgaaaacactcaaggacccctacctgaagggggaactgctgaggcgcacaaaacgtgacattgtggactccctcagtgcgttgcccaaaactcagcatgacctcagctccatcctggtggacgtgtggtgccagacggaaaggatgctctgcttttctgtcaatggggttttcaaggaagtggaaggacagtctcagggttctgttctcgccttcacccggaccttcattgctacccctggcagcagttccagtctgtgcatcgtgaatgacgagctgtttgtgagggatgccagcccccaagagactcagagtgccttctccatcccagtgtccacactctcctccagctctgagccctccctctcccaggagcagcaggaaatggtgcaggctttctctgcccagtctgggatgaaactggagtggtctcagaagtgccttcaggacaatgagtggaactacactagagctggccaggccttcactatgctccagaccgagggcaagatccccgcggaggccttcaagcaaatctcctaaaaggagccctccgatgtcttctttgtcttcgttcacatcctctttgtttcctcttttcaccagcctaaggcctggctgaccaggaagccaacgttaacttgcaggccacgtgacataaccacccaaagagccagttgctctgtgtattcgccccactcatgatcaccattttattttcataataaagagtgacgttacacgt

SEQ ID NO: 62186 - DNA, 375 bp, Homo sapiens
ggaggagcagcaggaaatggtgcaggctttctctgcccagtctgggatgaaactggagtggtctcagaagtgccttcaggacaatgagtggaactacactagagctggccaggccttcactatgctccagaccgagggcaagatccccgcggaggccttcaagcaaatctcctaaaaggagccctccgatgtcttctttgtcttcgttcacatcctctttgtttcctcttttcaccagcctaaggcctggctgaccaggaagccaacgttaacttgcaggccacgtgacataaccacccaaagagccagttgctctgtgtattcgccccactcatgatcaccattttattttcataataaagagtgacgttacac

SEQ ID NO: 62187 - DNA, 3181 bp, Homo sapiens
tcacctagctcctcctgcagcatggcgtgttcacttccaagcggggcagactctgctgatggacagaatccggctccaggaactggcattccagttgcaccagttaactgtcctggcctcagtcttgctagtggccagaagcttctctggtgaagttttattcagatcacctgaatttgtggatagactgaaatgcaccaccaaggccctaactgaggaatttatctccaggcctgaagagactatgctgagtgtgagtgaacaggtgtctcaggaagtccatcaaggccttaaggacatgggcctcactactctgagcagtgaaaacacagcatctcttctaggccaactccagaacatcaccaagaaagagaactgcattcgtagcattgttgatcagtggatccgtttttttctcaaatgctgtttgcttcatggcatgcaggagtctctgctacactttcctggaggcctcattctcattgaaaaggagttggcagaactgggctggaagtttctcaatctgatgcatcataatcagcagagtcatttttcacaaaacgaaatctttccagaagatcacgaataagagagatcaaagctaggcagcttgagttgaagtagagctggaagaaggagttttgaggactgtttcaaaaccactggactagatgatctctaaagtggtgacatggacataggataatggttatagacagtccccctcccaacgggaaaaaatgaaagcaagcaaaaagttaccagctccaagccaacttgaaatccaatcaggatcttatccaggacgcttcattgcatttggtcttcatttctccttagtctcctccaggctgacatttcctcaatctttattggtcttccacagccctgacacttttggagataccagtcagcatttccaagttcgttctgtgagactgtagtgtcaggacaaagcaacaacaaaatgtgctctactctaaagaagtgtgggacatacagaactgaagggatgatgcttcctgtctgtcacaaggctgagtgaacacaacatgcctgtaggtccagaacattcttcctacagagaccagatgtccagaaagccctatctgctggattcagggaacgcctctcctcatttctgtcagcactatttgcaaaagcctccttctctgagatcttcaaagctgcagttctagccacagtctgcagggagttgcagaatgccatgaccatggtagcacttttcaaggaagaaagaaaggtgggagttctttccgggataattttgacaagaggagctgtcattatgaacatggtgggtatgagcgcccgccttcacactgccaggagaatgatggaagcgtggagatgagggatgtccacaaggaccaacaactaagacagtaagtgaccaggcagcctggtttgcacgtagcagcccccgggactgtgcaaccctttcattctctgtggtcttccttttcttctctcattagagaactgacgaatgctggaagtggaatagtggctgagcagtcctaattgtagccctggcgtcagtgagtggagcatgtataggagactttcttagatttaatggatacccgccttctctcctcttccccacagcactccttatagcatccgatgcgaaagaagaatgaaatggcatagtgaagacgaaatccgtattaccacgtggagaaatagaaaacctccggagagaaaaatgagtcagaacacacaggatggatacacaaggaactggtttaaggtcacaattccttacgggataaagtatgacaaggcatggctaatgaattcaatccagagccattgcagtgaccgcttcactccggttgatttccactacgtccgaaatcgggcatgcttctttgtccaggatgctagcgctgcctccgcattgaaggatgtcagttataagatttatgatgatgagaaccaaaagatatgtatatttgtcaatcattctactgcgccctactctgtgaagaataagttgaagccaggccaaatggagatgctaaagctgaccatgaacaaacggtacaatgtctcccagcaagctcttgatctccagaatctccgctttgacccagacttgatgggccgtgacattgatataatcctgaatcgaagaaactgcatggctgccaccctgaagatcattgaaagaaatttccctgagctgttgtctttgaacttgtgcaacaacaagctgtaccagctggatggcctttctgacattacagagaaggctcccaaagtcaagaccctgaatctctccaaaaataagctggagtcggcgtgggagttgggcaaggtgaaagggctgaagctcgaagagctatggctagaagggaacccgttgtgcagcaccttctcggaccagtccgcctatgtaagtgccatccgggattgtttccccaagttgttacgcctggacggccgagagttatccgcaccagtgattgttgacattgacagctctgagacaatgaaaccctgcaaggaaaactttactggatctgagaccctaaagcatttagtcctgcaattcctgcagcagtattactcgatctatgactctggagatcgacagggtctcctcggtgcttaccacgatgaggcctgcttctccttggctattcccttcgaccccaaggactcagccccgagcagcttgtgcaagtactttgaggatagcaggaatatgaaaacactcaaggacccctacctgaagggggaactgctgaggcgcacaaaacgtgacattgtggactccctcagtgcgttgcccaaaactcagcatgacctcagctccatcctggtggacgtgtggtgccagacggtgccttcaggacaatgagtggaactacactagagctggccaggccttcactatgctccagaccgagggcaagatccccgcggaggccttcaagcaaatctcctaaaaggagccctccgatgtcttctttgtcttcgttcacatcctctttgtttcctcttttcaccagcctaaggcctggctgaccaggaagccaacgttaacttgcaggccacgtgacataaccacccaaagagccagttgctctgtgtattcgccccactcatgatcaccattttattttcataataaagagtgacgttacac

SEQ ID NO: 62188 - DNA, 3949 bp, Homo sapiens
agaggcgaggccgccagtcgaggacgaggaggagataacatcaagatgccgaagactgaggaaactgtgctccagaatgatcccagtgtagcagagaatggggcccctgagcctaaaacaccagggcagagccagaaaagcaagagtttctgtttagatgaccagtctcctgacctgatgtcttttctgtcacagatctgatagagacagttaatgaagtttccaagctgagcatttcacatgaaattgtagtaaaccaagatttctatgtggaagagaccattttgcctccaaacagtgtagaaggcaggtttgcggaggcaatgtacaatgctttttggaaccatctgaaagaacagctattgagtactcctcctgacttcacttgtgcccttgaacttctaaaagatgttaaggagaccttgctatcactgctattaccatggcagaaccgcctaagaaatgagatagaagaagctctggacacagatctcctcaagcaggaagcagaacatggggccctggatgtccctcatctttctaactacattctcaatttgatggctctgctatgtgcaccggttcgagatgaagcgatacagaaactagagaccataagagatccagtgcagttactgaggggcatcctccgtgttctgggcctaatgaaaatggacatggtgaactataccatccagagctttcgaccctacctgcaggaacattccatccagtatgaacaagctaaattccaggaactccttgataaacagcccagtctcctcgattataccacaaaatggctaaccaaagcagccacagacatcactacactatgtccgagttctcctgactcacctagctcctcctgcagcatggcgtgttcacttccaagcggggcaggtaacaattcagagccccccagtccaacaatggtgctataccaaggctacctgaacctcctcctctgggatcttgaaaacgtagaattcccagagactctgctgatggacagaatccggctccaggaactggcattccagttgcaccagttaactgtcctggcctcagtcttgctagtggccagaagcttctctggtgaagttttattcagatcacctgaatttgtggatagactgaaatgcaccaccaaggccctaactgaggaatttatctccaggcctgaagagactatgctgagtgtgagtgaacaggtgtctcaggaagtccatcaaggccttaaggacatgggcctcactactctgagcagtgaaaacacagcatctcttctaggccaactccagaacatcaccaagaaagagaactgcattcgtagcattgttggagtctctgctacactttcctggaggcctcattctcattgaaaaggagttggcagaactgggctggaagtttctcaatctgatgcatcataatcagcagagtcatttttcacaaaacgaaatctttccagaagatcacgaataagagagatcaaagctaggcagcttgagttgaagtagagctggaagaaggagttttgaggactgtttcaaaaccactggactagatgatctctaaagtggtgacatggacataggataatggttatagacagtccccctcccaacgggaaaaaatgaaagcaagcaaaaagttaccagctccaagccaacttgaaatccaatcaggatcttatccaggacgcttcattgcatttggtcttcatttctccttagtctcctccaggctgacatttcctcaatctttattggtcttccacagccctgacacttttggagataccagtcagcatttccaagttcgttctgtgagactgtagtgtcaggacaaagcaacaacaaaatgtgctctactctaaagaagtgtgggacatacagaactgaagttgcagaatgccatgaccatggtagcacttttcaaggaagaaagaaaggtgggagttctttccgggataattttgacaagaggagctgtcattatgaacatggtgggtatgagcgcccgccttcacactgccaggagaatgatggaagcgtggagatgagggatgtccacaaggaccaacaactaagacacactccttatagcatccgatgcgaaagaagaatgaaatggcatagtgaagacgaaatccgtattaccacgtggagaaatagaaaacctccggagagaaaaatgagtcagaacacacaggatggatacacaaggaactggtttaaggtcacaattccttacgggataaagtatgacaaggcatggctaatgaattcaatccagagccattgcagtgaccgcttcactccggttgatttccactacgtccgaaatcgggcatgcttctttgtccaggatgctagcgctgcctccgcattgaaggatgtcagttataagatttatgatgatgagaaccaaaagatatgtatatttgtcaatcattctactgcgccctactctgtgaagaataagttgaagccaggccaaatggagatgctaaagctgaccatgaacaaacggtacaatgtctcccagcaagctcttgatctccagaatctccgctttgacccagacttgatgggccgtgacattgatataatcctgaatcgaagaaactgcatggctgccaccctgaagatcattgaaagaaatttccctgagctgttgtctttgaacttgtgcaacaacaagctgtaccagctggatggcctttctgacattacagagaaggctcccaaagtcaagaccctgaatctctccaaaaataagctggagtcggcgtgggagttgggcaaggtgaaagggctgaagctcgaagagctatggctagaagggaacccgttgtgcagcaccttctcggaccagtccgcctatgtaagtgccatccgggattgtttccccaagttgttacgcctggacggccgagagttatccgcaccagtgattgttgacattgacagctctgagacaatgaaaccctgcaaggaaaactttactggatctgagaccctaaagcatttagtcctgcaattcctgcagcagtattactcgatctatgactctggagatcgacagggtctcctcggtgcttaccacgatgaggcctgcttctccttggctattcccttcgaccccaaggactcagccccgagcagcttgtgcaagtactttgaggatagcaggaatatgaaaacactcaaggacccctacctgaagggggaactgctgaggcgcacaaaacgtgacattgtggactccctcagtgcgttgcccaaaactcagcatgacctcagctccatcctggtggacgtgtggtgccagacggaaaggatgctctgcttttctgtcaatggggttttcaaggaagtggaaggacagtctcagggttctgttctcgccttcacccggaccttcattgctacccctggcagcagttccagtctgtgcatcgtgaatgacgagctgtttgtgagggatgccagcccccaagagactcagagtgccttctccatcccagtgtccacactctcctccagctctgagccctccctctcccaggagcagcaggaaatggtgcaggctttctctgcccagtctgggatgaaactggagtggtctcagaagtgccttcaggacaatgagtggaactacactagagctggccaggccttcactatgctccagaccgagggcaagatccccgcggaggccttcaagcaaatctcctaaaaggagccctccgatgtcttctttgtcttcgttcacatcctctttgtttcctcttttcaccagcctaaggcctggctgaccaggaagccaacgttaacttgcaggccacgtgacataaccacccaaagagccagttgctctgtgtattcgccccactcatgatcaccattttattttcataataaagagtgacgttacacgt

SEQ ID NO: 62189 - DNA, 3217 bp, Homo sapiens
aagtttcttccttgggcaaggggtagggagaaggaatgtttctctaagatagaaagatctacaaaatcacttctttatagaccaagagtatgtctcagagccatcatctttaagccttggaattttaagatgcatattcccttctcgtcgtaggtctcctcgattataccacaaaatggctaaccaaagcagccacagacatcactacactatgtccgagttctcctgactcacctagctcctcctgcagcatggcgtgttcacttccaagcggggcaggtaacaattcagagccccccagtccaacaatggtgctataccaaggctacctgaacctcctcctctgggatcttgaaaacgtagaattcccagagactctgctgatggacagaatccggctccaggaactggcattccagttgcaccagttaactgtcctggcctcagtcttgctagtggccagaagcttctctggtgaagttttattcagatcacctgaatttgtggatagactgaaatgcaccaccaaggccctaactgaggaatttatctccaggcctgaagagactatgctgagtgtgagtgaacaggtgtctcaggaagtccatcaaggccttaaggacatgggcctcactactctgagcagtgaaaacacagcatctcttctaggccaactccagaacatcaccaagaaagagaactgcattcgtagcattgttggagtctctgctacactttcctggaggcctcattctcattgaaaaggagttggcagaactgggctggaagtttctcaatctgatgcatcataatcagcagagtcatttttcacaaaacgaaatctttccagaagatcacgaataagagagatcaaagctaggcagcttgagttgaagtagagctggaagaaggagttttgaggactgtttcaaaaccactggactagatgatctctaaaggatcttatccaggacgcttcattgcatttggtcttcatttctccttagtctcctccaggctgacatttcctcaatctttattggtcttccacagccctgacacttttggagataccagtcagcatttccaagttcgttctgtgagactgtagtgtcaggacaaagcaacaacaaaatgtgctctactctaaagaagtgtgggacatacagaactgaagttgcagaatgccatgaccatggtagcacttttcaaggaagaaagaaaggtgggagttctttccgggataattttgacaagaggagctgtcattatgaacatggtgggtatgagcgcccgccttcacactgccaggagaatgatggaagcgtggagatgagggatgtccacaaggaccaacaactaagacacactccttatagcatccgatgcgaaagaagaatgaaatggcatagtgaagacgaaatccgtattaccacgtggagaaatagaaaacctccggagagaaaaatgagtcagaacacacaggatggatacacaaggaactggtttaaggtcacaattccttacgggataaagtatgacaaggcatggctaatgaattcaatccagagccattgcagtgaccgcttcactccggttgatttccactacgtccgaaatcgggcatgcttctttgtccaggatgctagcgctgcctccgcattgaaggatgtcagttataagatttatgatgatgagaaccaaaagatatgtatatttgtcaatcattctactgcgccctactctgtgaagaataagttgaagccaggccaaatggagatgctaaagctgaccatgaacaaacggtacaatgtctcccagcaagctcttgatctccagaatctccgctttgacccagacttgatgggccgtgacattgatataatcctgaatcgaagaaactgcatggctgccaccctgaagatcattgaaagaaatttccctgagctgttgtctttgaacttgtgcaacaacaagctgtaccagctggatggcctttctgacattacagagaaggctcccaaagtcaagaccctgaatctctccaaaaataagctggagtcggcgtgggagttgggcaaggtgaaagggctgaagctcgaagagctatggctagaagggaacccgttgtgcagcaccttctcggaccagtccgcctatgtaagtgccatccgggattgtttccccaagttgttacgcctggacggccgagagttatccgcaccagtgattgttgacattgacagctctgagacaatgaaaccctgcaaggaaaactttactggatctgagaccctaaagcatttagtcctgcaattcctgcagcagtattactcgatctatgactctggagatcgacagggtctcctcggtgcttaccacgatgaggcctgcttctccttggctattcccttcgaccccaaggactcagccccgagcagcttgtgcaagtactttgaggatagcaggaatatgaaaacactcaaggacccctacctgaagggggaactgctgaggcgcacaaaacgtgacattgtggactccctcagtgcgttgcccaaaactcagcatgacctcagctccatcctggtggacgtgtggtgccagacggaaaggatgctctgcttttctgtcaatggggttttcaaggaagtggaaggacagtctcagggttctgttctcgccttcacccggaccttcattgctacccctggcagcagttccagtctgtgcatcgtgaatgacgagctgtttgtgagggatgccagcccccaagagactcagagtgccttctccatcccagtgtccacactctcctccagctctgagccctccctctcccaggagcagcaggaaatggtgcaggctttctctgcccagtctgggatgaaactggagtggtctcagaagtgccttcaggacaatgagtggaactacactagagctggccaggccttcactatgctccagaccgagggcaagatccccgcggaggccttcaagcaaatctcctaaaaggagccctccgatgtcttctttgtcttcgttcacatcctctttgtttcctcttttcaccagcctaaggcctggctgaccaggaagccaacgttaacttgcaggccacgtgacataaccacccaaagagccagttgctctgtgtattcgccccactcatgatcaccattttattttcataataaagagtgacgttacacgt

SEQ ID NO: 62190 - DNA, 1308 bp, Homo sapiens
caaccagaatctttcccaacttgtctaagtcctctcaggccagccttggtgggaggtttctaggattcgctccctgcccttcccatcttagggtgtcgtctgagacagactcttattccctcaataaagagagagactcttattccctcagcggccagctcctcgcctcccctcggccgtagccacctcagtggtcaccgtcttcaccgtggtcgcctcagcccgctcgccaccccagttgaggcgctgctggtgtcatgtctgccacaggggaccgacacccgacccaaggggaccaggaggccccggtaagccaggagggagcacaggccgaggcggccggagctggtaaccaggagggcggcgactccggccccgacagcagcgacgtggtgcctgcggccgaggtggtcggagtcgcagggcccgtggaaggcctcggggaggaggagggtgagcaggcggcaggcctggccgcagtcccccggggcgggagcgccgaggaggactcagatatcgggcccgcgacggaggaagaggaggaggaagaggggaacgaggcggccaacttcgacttggcggtggtcgcccgtcgctacccggcgtcgggcattcacttcgtgctcctggacatggtccactcccttctccaccgcctctctcacaacgaccacatcctcatagagaaccgtcaactcagccgcctgatggtggggccacacgctgctgcgcgcaacctctggggcaacctccccccgctgctgctgccccagaggctgggtgcaggggccgcagcccgggcgggcgagggcctgggcctgatccaggaggccgcatcggtcccagagcctgcagtgccagctgacctggccgagatggccagggagcccgcggaggaggccgcagaggagaagctctcagaggaggccacagaggaaccagacgcagaggaaccggccacagaagaaccgaccgcacaggaggccacggccccagaggaagtcactaaatctcagcccgaaaagtgggatgaagaggcccaagatgctgcaggcgaggaagagaaagaacaagaaaaagagaaggatgcggaaaacaaggtgaagaactccaaagggacctagacgcagcagaggtgaagccaagaaaatccagatgcctgtgggaattgtaacacatatcattccaaagttcgttacatcaaaagtgatatccagtgacatctaactttcatggatgtatgtgacagtgttcaagttaaaaaataaaagtttgttttaaatgaataaactgaaacgtgggaagatt

SEQ ID NO: 62191 - DNA, 1167 bp, Homo sapiens
tcgcgcgcagtcccttagggggcgcctggaagcccggcgcatgcgccctgagggctcgctgacctaccgggtgccagagaggctgcggcagggtttctgtggcgtgggtcgggcagcacaggccttggtgtgtgcgagtgccaaggagggcaccgccttcaggatggaggctgtacaggagggggcggccggggtggagagtgagcaggcggctttgggggaggaggcggtgctgctgttggatgacataatggcggaggtggaggtggtggcggaggtggaggtggtggcggaggaggagggcctcgtggagcggcgggaggaggcccagcgggcacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcctgttcatctctgcaagatcatgttgttctttcggagtaacccctacttccagaataaagtgattaccaaggaatatctggtgaacatcacagaatacagggcttctcattccactccaattgagtggtatccggattatgaagtggaggcctatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattct

SEQ ID NO: 62192 - DNA, 1907 bp, Homo sapiens
atgcgccctgagggctcgctgacctaccgggtgccagagaggctgcggcagggtttctgtggcgtgggtcgggcagcacaggccttggtgtgtgcgagtgccaaggagggcaccgccttcaggatggaggctgtacaggagggggcggccggggtggagagtgagcaggcggctttgggggaggaggcggtgctgctgttggatgacataatggcggaggtggaggtggtggcggaggtggaggtggtggcggaggaggagggcctcgtggagcggcgggaggaggcccagcgggcacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcctgttcatctctgcaagatcatgttgttctttcggagtaacccctacttccagaataaagtgattaccaaggaatatctggtgaacatcacaggtgacaggtggctcccaggatgggtagtggaaggaagatggtgggtggatcattgccaacgggatccagcccccttcccacaaaaactcctgtctctgtagaatacagggcttctcattccactccaattgagtggtatccggattatgaagtggaggcctatcgccgcagacaccacaacagcagccttaacttcttcaactggttctctgaccacaacttcgcaggatctaacaagattgctgaggtgagtcctcactgggaaacatgaggaatgaccccatgtgttcccagctgcttgggtcacctttctgagccctgatgaggcctttcccgattgagtcccctgacagatcctatgtaaggacctgtggcgcaatcccctgcaatactacaagaggatgaagccacctgaagagggaacagagacgtcagaaattccttgagaggaagacagagagtgacagaatccaggacgttcatggcattgggctgaaaaggcacgttagagactgcactgcaaagcgggtgatagctgtggagtcttaagcccagtgaagaatcgtccatttccagaatcaatgagaagtaaagctgaaaatcattcagttcagtctgtggcacttgattccacggctgtcaaccccaccggcagtcatcccgccaaccccatgagattgggctccctgaatgtgcgtcctggtcatccttgccccaaaccacaaaggactgtttagattgatggatttccttaagctgttgccccatcagacttgtgtgtgcttttagggtccagtgcatcttgttagctgactcccctcacagacaatactgggaatggggcagggattgcgcagaacagtttgtaacacgtggtaggaggaagtttaagggatcacaaatggggaagggatatccttttctcagcgggccccacaattgaaacatttcaaagtatggctcagagaaaatgcgttttaacatgagtttgtgtttctctaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattctcaagga

SEQ ID NO: 62193 - DNA, 579 bp, Homo sapiens; identical to SEQ ID NO: 62169

SEQ ID NO: 62194 - DNA, 1308 bp, Homo sapiens; identical to SEQ ID NO: 62190

SEQ ID NO: 62195 - DNA, 1308 bp, Homo sapiens; identical to SEQ ID NO: 62190

SEQ ID NO: 62196 - DNA, 1149 bp, Homo sapiens
tcgcgcgcagtcccttagggggcgcctggaagcccggcgcatgcgccctgagggctcgctgacctactgggtgccagagaggctgcggcagggtttctgtggcgtgggtcgggcagcacaggccttggtgtgtgcgagtgccaaggagggcaccgccttcaggatggaggctgtacaggagggggcggccggggtggagagtgagcaggcggctttgggggaggaggcggtgctgctgttggatgacataatggcggaggtggaggtggtggcggaggaggagggcctcgtggagcggcgggaggaggcccagcgggcacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcctgttcatctctgcaagatcatgttgttctttcggagtaacccctacttccagaataaagtgattaccaaggaatatctggtgaacatcacagaatacagggcttctcattccactccaattgagtggtatctggattatgaagtggaggcctatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattct

SEQ ID NO: 62197 - DNA, 1889 bp, Homo sapiens
atgcgccctgagggctcgctgacctactgggtgccagagaggctgcggcagggtttctgtggcgtgggtcgggcagcacaggccttggtgtgtgcgagtgccaaggagggcaccgccttcaggatggaggctgtacaggagggggcggccggggtggagagtgagcaggcggctttgggggaggaggcggtgctgctgttggatgacataatggcggaggtggaggtggtggcggaggaggagggcctcgtggagcggcgggaggaggcccagcgggcacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcctgttcatctctgcaagatcatgttgttctttcggagtaacccctacttccagaataaagtgattaccaaggaatatctggtgaacatcacaggtgacaggtggctcccaggatgggtagtggaaggaagatggtgggtggatcattgccaacgggatccagcccccttcccacaaaaactcctgtctctgtagaatacagggcttctcattccactccaattgagtggtatctggattatgaagtggaggcctatcgccgcagacaccacaacagcagccttaacttcttcaactggttctctgaccacaacttcgcaggatctaacaagattgctgaggtgagtcctcactgggaaacatgaggaatgaccccgtgtgttcccagctgcttgggtcacctttctgagccctgatgaggcctttcccgattgagtcccctgacagatcctatgtaaggacctgtggcgcaatcccctgcaatactacaagaggatgaagccacctgaagagggaacagagacgtcagaaattccttgagaggaagacagagagtgacagaatccaggacgttcatggcattgggctgaaaaggcacgttagagactgcactgcaaagcgggtgatagctgtggagtcttaagcccagtgaagaatcgtccatttccagaatcaatgagaagtaaagctgaaaatcattcagttcagtctgtggcacttgattccacggctgtcaaccccaccggcagtcatcccgccaaccccatgagattgggctccctgaatgtgcgtcctggtcatccttgccccaaaccacaaaggactgtttagattgatggatttccttaagctgttgccccatcagacttgtgtgtgcttttagggcccagtgcatcttgttagctgactcccctcacagacaatactgggaatggggcagggattgcgcagaacagtttgtaacacgtggtaggaggaagtttaagggatcacaaatggggaagggatatccttttctcagcgggccccacaattgaaacatttcaaagtatggctcagagaaaatgcgttttaacatgagtttgtgtttctctaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattctcaagga

SEQ ID NO: 62198 - DNA, 579 bp, Homo sapiens
tccagaataaagtgattaccaaggaatatctggtgaacatcacaggtgacaggtggctcccaggatgggtagtggaaggaagatggtgggtggatcattgccaacgggatccagcccccttcccacaaaaactcctgtctctgtagaatacagggcttctcattccactccaattgagtggtatctggattatgaagtggaggcctatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattct

SEQ ID NO: 62199 - DNA, 1304 bp, Homo sapiens
cagaatctttcccgccttatctaagtcctctcaggccagacttggtgggaggttcctaggattcgctccctgcccttcccaccttagggtgtcctctgagacagactcttatttcctcaataaagagaaagactcttattccctcagcggccagctcctcgcctcccctcggccgtagccacctcagtggtcaccgtcttcaccgtggtcgcctcagcccgctcgccaccccagttgaggcgctgctggtgtcatgtctgccacaggggaccgacacccgacccaaggggaccaggaggccccggtaagccaggagggagcacaggccgaggcggccggagctggtaaccaggagggcggcgactccggccccgacagcagcgacgtggtgcctgcggccgaggtggtcggagtcgcagggcccgtggaaggcctcggggaggaggagggtgagcaggcggcaggcctggccgcagtcccccggggcgggagcgccgaggaggactcagatatcgggcccgcgacggaggaagaggaggaggaagaggggaacgaggcggccaacttcgacttggcggtggtcgcccgtcgctacccggcgtcgggcattcacttcgtgctcctggacatggtccactcccttctccaccgcctctctcacaacgaccacatcctcatagagaaccgtcaactcagccgcctgatggtggggccacacgctgctgcgcgcaacctctggggcaacctccccccgctgctgctgccccagaggctgggtgcaggggccgcagcccgggcgggcgagggcctgggcctgatccaggaggccgcatcggtcccagagcctgcagtgccagctgacctggccgagatggccagggagcccgcggaggaggccgcagaggagaagctctcagaggaggccacagaggaaccagacgcagaggaaccggccacagaagaaccgaccgcacaggaggccacggccccagaggaagtcactaaatctcagcccgaaaagtgggatgaagaggcccaagatgctgcaggcgaggaagagaaagaacaagaaaaagagaaggatgcggaaaacaaggtgaagaactccaaagggacctagacgcagcagaggtgaagccaagaaaatccagatgcctgtgggaattgtaacacatatcattccaaagttcgttacatcaaaagtgatatccagtgacatctaactttcatggatgtatgtgacagtgttcaagttaaaaaataaaagtttgttttaaatgaataaactgaaacgtgggaagatt

SEQ ID NO: 62200 - DNA, 1308 bp, Homo sapiens
caaccagaatctttcccaacttgtctaagtcctctcaggccagccttggtgggaggtttctaggattcgctccctgcccttcccatcttagggtgtcgtctgagacagactcttattccctcaataaagagagagactcttattccctcagcggccagctcctcgcctcccctcggccgtagccacctcagtggtcaccgtcttcaccgtggtcgcctcagcccgctcgccaccccagttgaggcgctgctggtgtcatgtctgccacaggggaccgacacccgacccaaggggaccaggaggccccggtaagccaggagggagcacaggccgaggcggccggagctggtaaccaggagggcggcgactccggccccgacagcagcgacgtggtgcctgcggccgaggtggtcggagtcgcagggcccgtggaaggcctcggggaggaggagggtgagcaggcggcaggcctggccgcagtcccccggggcgggagcgccgaggaggactcagatatcgggcccgcgacggaggaagaggaggaggaagaggggaacgaggcggccaacttcgacttggcggtggtcgcccgtcgctacccggcgtcgggcattcacttcgtgctcctggacatggtccactcccttctccaccgcctctctcacaacgaccacatcctcatagagaaccgtcaactcagccgcctgatggtggggccacacgctgctgcgcgcaacctctggggcaacctccccccgctgctgctgccccagaggctgggtgcaggggccgcagcccgggcgggcgagggcctgggcctgatccaggaggccgcatcggtcccagagcctgcagtgccagctgacctggccgagatggccagggagcccgcggaggaggccgcagaggagaagctctcagaggaggccacagaggaaccagacgcagaggaaccagccacagaagaaccgaccgcacaggaggccacggccccagaggaagtcactaaatctcagcccgaaaagtgggatgaagaggcccaagatgctgcaggcgaggaagagaaagaacaagaaaaagagaaggatgcagaaaacaaggtgaagaactccaaagggacctagacgcagcagaggtgaagccaagaaaatccagatgcctgtgggaattgtaacacatatcattccaaagttcgttacatcaaaagtgatatccagtgacatctaactttcatggatgtatgtgacagtgttcaagttaaaaaataaaagtttgttttaaatgaataaactgaaacgtgggaagatt

SEQ ID NO: 62201 - DNA, 1308 bp, Homo sapiens; identical to SEQ ID NO: 62190

SEQ ID NO: 62202 - DNA, 1308 bp, Homo sapiens; identical to SEQ ID NO: 62190

SEQ ID NO: 62203 - DNA, 1149 bp, Homo sapiens
tcgcgcgcagtcccttagggggcgcctggaagcccggcgcatgcgccctgagggctcgctgacctaccgggtgccagagaggctgcggcagggtttctgtggcgtgggtcgggcagcacaggccttggtgtgtgcgagtgccaaggagggcaccgccttcaggatggaggctgtacaggagggggcggccggggtggagagtgagcaggcggctttgggggaggaggcggtgctgctgttggatgacataatggcggaggtggaggtggtggcggaggaggagggcctcgtggagcggcgggaggaggcccagcgggcacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcctgttcatctctgcaagatcatgttgttctttcggagtaacccctacttccagaataaagtgattaccaaggaatatctggtgaacatcacagaatacagggcttctcattccactccaattgagtggtatccggattatgaagtggaggcgtatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattct

SEQ ID NO: 62204 - DNA, 1889 bp, Homo sapiens
atgcgccctgagggctcgctgacctaccgggtgccagagaggctgcggcagggtttctgtggcgtgggtcgggcagcacaggccttggtgtgtgcgagtgccaaggagggcaccgccttcaggatggaggctgtacaggagggggcggccggggtggagagtgagcaggcggctttgggggaggaggcggtgctgctgttggatgacataatggcggaggtggaggtggtggcggaggaggagggcctcgtggagcggcgggaggaggcccagcgggcacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcctgttcatctctgcaagatcatgttgttctttcggagtaacccctacttccagaataaagtgattaccaaggaatatctggtgaacatcacaggtgacaggtggctcccaggatgggtagtggaaggaagatggtgggtggatcattgccaacgggatccagcccccttcccacaaaaactcctgtctctgtagaatacagggcttctcattccactccaattgagtggtatccggattatgaagtggaggcgtatcgccgcagacaccacaacagcagccttaacttcttcaactggttctctgaccacaacttcgcaggatctaacaagattgctgaggtgagtcctcactgggaaacatgaggaatgaccccgtgtgttcccagctgcttgggtcacctttctgagccctgatgaggcctttcccgattgagtcccctgacagatcctatgtaaggacctgtggcgcaatcccctgcaatactacaagaggatgaagccacctgaagagggaacagagacgtcagaaattccttgagaggaagacagagagtgacagaatccaggacgttcatggcattgggctgaaaaggcacgttagagactgcactgcaaagcgggtgatagctgtggagtcttaagcccagtgaagaatcgtccatttccagaatcaatgagaagtaaagctgaaaatcattcagttcagtctgtggcacttgattccacggctgtcaaccccaccggcagtcatcccaccaaccccatgagattgggctccctgaatgtgcgtcctggtcatccttgccccaaaccacaaaggactgtttagattgatggatttccttaagctgttgccccatcagacttgtgtgtgcttttagggcccagtgcatcttgttagctgactcccctcacagacaatactgggaatggggcagggattgcgcagaacagtttgtaacacgtggtaggaggaagtttaagggatcacaaatggggaagggatatccttttctcagcgggccccacaattgaaacatttcaaagtatggctcagagaaaatgcgttttaacatgagtttgtgtttctctaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattctcaagga

SEQ ID NO: 62205 - DNA, 579 bp, Homo sapiens
tccagaataaagtgattaccaaggaatatctggtgaacatcacaggtgacaggtggctcccaggatgggtagtggaaggaagatggtgggtggatcattgccaacgggatccagcccccttcccacaaaaactcctgtctctgtagaatacagggcttctcattccactccaattgagtggtatccggattatgaagtggaggcgtatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattct

SEQ ID NO: 62206 - DNA, 1308 bp, Homo sapiens; identical to SEQ ID NO: 62190

SEQ ID NO: 62207 - DNA, 1308 bp, Homo sapiens; identical to SEQ ID NO: 62190

SEQ ID NO: 62208 - DNA, 1308 bp, Homo sapiens
caaccagaatctttcccaacttgtctaagtcctctcaggccagccttggtgggaggtttctaggattcgctccctgcccttcccatcttagggtgtcgtctgagacagactcttattccctcaataaagagagagactcttattccctcagcggccagctcctcgcctcccctcggccgtagccacctcagtggtcaccgtcttcaccgtggtcgcctcagcccgctcgccaccccagttgaggcgctgctggtgtcatgtctgccacaggggaccgacacccgacccaaggggaccaggaggccccggtaagccaggagggagcacaggccgaggcggccggagctggtaaccaggagggcggcgactccggccccgacagcagcgacgtggtgcctgcggccgaggtggtcggagtcgcagggcccgtggaaggcctcggggaggaggagggtgagcaggcggcaggcctggccgcagtcccccggggcgggagcgccgaggaggactcagatatcgggcccgcgacggaggaagaggaggaggaagaggggaacgaggcggccaacttcgacttggcggtggtcgcccgtcgctacccggcgtcgggcattcacttcgtgctcctggacatggtccactcccttctccaccgcctctctcacaacgaccacatcctcatagagaaccgtcaactcagccgcctgatggtggggccacacgctgctgcgcgcaacctctggggcaacctccccccgctgctgctgccccagaggctgggtgcaggggccgcagcccgggcgggcgagggcctgggcctgatccaggaggccgcatcggtcccagagcctgcagtgccagctgacctggccgagatggccagggagcccgcggaggaggccgcagaggagaagctctcagaggaggccacagaggaaccagacgcagaggaaccggccacagaagaaccgaccgcacaggaggccacggccccagaggaagtcactaaatctcagcccgaaaagtgggatgaagaggcccaagatgctgcaggcgaggaagagaaagaacaagaaaaagagaaggatgcagaaaacaaggtgaagaactccaaagggacctagacgcagcagaggtgaagccaagaaaatccagatgcctgtgggaattgtaacacatatcattccaaagttcgttacatcaaaagtgatatccagtgacatctaactttcatggatgtatgtgacagtgttcaagttaaaaaataaaagtttgttttaaatgaataaactgaaacgtgggaagatt

SEQ ID NO: 62209 - DNA, 720 bp, Homo sapiens
aacagggttgcaggtgtaaaataacgggaaggcgggatgcgtggctaaattgctctgcgtgcacaaagagtaggagagcccagagttccagaatgcccctaattccgaacaccacagggtgagtctggagcaagtcacctgggagggcttacaggtgccataatgaaggcctggggcactgtggtagtgaccttggccacgctgatggttgtcactgtggatgccaagatctatgaacgctgcgagctggcggcaagactggagagagcagggctgaacggctacaagggctacggcgttggagactggctgtgcatggctcattatgagagtggctttgacaccgccttcgtggaccacaatcctgatggcagcagtgaatatggcattttccaactgaattctgcctggtggtgtgacaatggcattacacccaccaagaacctctgccacatggattgtcatgacctgctcaatcgccatattctggatgacatcaggtgtgccaagcagattgtgtcctcacagaatgggctttctgcctggacttcttggaggctacactgttctggccatgatttatctgaatggctcaaggggtgtgatatgcatgtgaaaattgatccaaaaattcatccatgactcagattcgaagagacagattttatcttcctttcatttctttctcttgtgcatttaataaaggatggtatctataaa

SEQ ID NO: 62210 - DNA, 2992 bp, Homo sapiens
atggaggaaacttttcttctggctaaagaagaaagacagcttggtgaagtgactgagcagacagaagggacagcagcctgcatcccacagaaggcaaaaaatgttgccagtgagagggagctctacatcccatctgtggatcttctgactgcccaggacctgctgtcctttgagctgttggatataaacattgttcaagagttggagagagtgccccacaacacccctgtggatgtgactccctgcatgtctcctctgccacatgacagtcctttaatagagaagccaggcttggggcagatagaggaagagaatgaaggggcaggatttaaagcacttcctgattctatggtgtcagtaaagaggaaggctgagaacattgcttctgtggaggaagcagaagaagacctgagtgggacccagtttgtgtgtgagacagtaatccgatcccttaccttggatgctgccccagaccacaaccctccttgcagacagaagtccttgcagatgacatttgccttgcctgaaggaccacttggaaatgagaaggaggagattatccatatcgctgaggaagaagctgtcatggaggaggaggaggatgaggaggatgaggaggaggaggatgagctcaaagatgaagttcaaagtcagtcctctgcttcctcagaggattacatcatcatcctgcctgagtgctttgataccagccgccccctgggggattctatgtacagctctgcgctctcacagccaggcctggagcgaggtgctgaaggcaagcctggggttgaggctgggcaggaaccagctgaggctggggaaagactccctggaggggagaaccagccacaggagcacagcataagtgacatcctcacgacctcacagactctggaaacagtgcccctaatcccagaggtagtggagcttccaccgtcactgcccaggagctctccttgtgtacatcatcatggttccccaggagtggatttaccagttaccataccagaagtttcttcagtccctgatcagatcagaggagagcccagaggctcatcaggacttgtaaacagcagacagaagagctatgaccactcaaggcaccatcatgggagcagcattgctggaggactggtgaagggggctttgtctgttgctgcctctgcatacaaggccctgtttgctgggccaccagtcactgcacagccaataatttctgaagatcagacagcagccctgatggcccatctctttgaaatgggattctgtgacaggcagctgaacctacggctgctgaagaaacacaattacaatatcctgcaggttgtgacagaacttcttcagttaaacaacaacgactggtacagccaacgctattgaggagtgaccttgtattaaataactgcctgctgctcagagatgatctttattctgtcattggggtatgggatagaagcccttgcttatttttaatctgatgaatctgtatagagcccatcgttgagttaccaagacaatacctgctacagtattttggggagcaaactaaagaccagaacttaaattttcactttagacattggatgaatagtatgaagacagtttttcagttgatttggataaaactattttagtgcattgacaagtgtaacttcaacttcatatagaaccatttttctttctgcttttattgaaactgagtatttttctttggctaatgtggattttttatggggatatctgttaattttcaggttttgaaagacattaacctcggaagttgtttttaagaattattctcataattcttattctcataatttctgtaatccacctcaagcttcatagttatttggcattgaaataacacccagagcatgatagaaatgttgttactcttcctctctcaaggagaaagtaattttcctgcaatacttaataattggcaccgttgctttctaaagactccatggtgcattcaagagtatccaacttcaagggaatctccgcatttcaatgaaaggaggaagagtgtgctgataaacctaccagcacctattgagcaatgtctattatagtaattttgcatacatttttatttaagggaaaaaatataggtattgtgaaatattttgctaatcttatagaaaaggaaaaaatcccgttatttaaagggaaaagtaaatttaacagttgccttttttcttaatgtcagggcagatcttattttacagtacagtgggggaaatagaaacatgtgaaaggcaaaaggcaggctcctaaattaatgtcagtgaagttcagggtgggcaaatgagtgtgtgtgaggtataggaaatgctgatgacttctttaatgcttgaagtccgttcacaggtatctagccctagaatgcctagaacaggaagaggcagctggtgttctgcaaaacttggacaggggcaaagttgctgaaaaagttttggtttaacccgaagataagtggaaaagagcttgtccatgaacccaggttctcactctgtttacagaagtgtgttgagtacagttggtgaaggaagaggtaacaaaaaatgctaaatattttatccatgaaaatgacttccagaaaaggaagaatatgaaccccagaccgaaggggaaaagatagttaatagtattatctaacctggttggtatttgtaatgaatggtgattttaattagtcattagccataatgatgtttatttacagtataactcctgaatgctacttaaataaaccaggattcaaactgcaagccagccaggccgttcattatttaaaacgttttaatcggggcttccgggtagaaggtggagcggcagggtgtaattgggttgatgggtgggacctgtcttgaccatcggagttttataatcgagggccaggagggcccgggttgctctcctggttatgtatgtacttgtacataaccacctaaagaatggtgaaataaatgttcttggaaat

SEQ ID NO: 62211 - DNA, 751 bp, Homo sapiens
tggcgtctgggtccgttggggcagaaccatggaggaaaagccttcgaaagtgtcgctcaagtcttccgaccgccaaggctcggacgaggagagcgtgcatagcgacactcgggacctgtggaccacgaccacgctgtcccaggcacagctgaacatgccgctgtccgaggtctgcgagggcttcgacgaggagggccgcaacattagcaagacccgcgggtggcacagcccggggcggggctcgttggacgaggggtacaaggccagccacaagccggaggaactggacgagcacgcgctggtggagctggagttgcaccgcggcagctccatggaaatcaatctgggggagaaggacactgcatcccagatcgaggccgaaaagtcttcctcaatgtcatcactcaatattgcgaagcacatgccccatcgagcctactgggcagagcagcagagcaggctgccactgcccctgatggaactcatggagaatgaagctctggaaatcctcaccaaagccctccggagctaccagttagggatcggcagggaccacttcctgactaaggagctgcagcgatacatcgaagggctcaagaagcgccggagcaagaggctgtacgtgaattaaaaacgccaccttgggctcgagcagcgacccgaaccagccccgtgccagcccggtccccagacccaagcctgaccccatccgagtggaatttgagtcctaaagaaataaaagagtcgatgc

SEQ ID NO: 62212 - DNA, 159 bp, Homo sapiens
atgtcttacgcagctcaatgcctgatacccaatcagttgtacttcagagatattgcaggacccaaaagggggaaacatgcctggacccacagactgcgtgagagaaagcagctggtgatttatgaagagatcagcgaccctgaggaagatgacgagtaa

SEQ ID NO: 62213 - DNA, 783 bp, Homo sapiens
atccctatgtcacctgaccaattcctcctgactgttagcgccctgcagcacgcccgtaattccggggaatttgcctatccctgtaggccccaaacagaaattactgatgtctggggaccttcaatttcatacccaaggaaggtcttgaatttcaaaggaaaatcaatccaacgtgcagttgatcggttgagattgagcaatcctcctatagatgtgaaacgaaccagtattccccttgaaatccagaaactgcagcccaacttgaagatctctttgcacagtcctagagcccagtccaccatacccgagcccatgattatccgctccaggttctctggcagcttaaagggtggagaccaagtgaccagttcaattgaaagggctgtgtgcagtacgggtcccctgaccagtatgcaggtcattaaaccaaaccgcatgctagctccacaagtgggcacagccaccctgtctcttaagaaagaacggcctcgcatctatacagcccttgatccttttagagtgaacgctgagttcgtgctgttgaccgtgaaggaggagaaggagcaccaggaagccaagatgaaggaatatcaggccagggagtccactggagtggttgatccaggaaaagccagcaaagctgcatggatcaggaagatcaaaggcctgcctattgataatttcacgaagcaagggaaaacagcggcccctgaacttggacaaaatgtatttatctaaaccagccttgggaaattacagtgttttacaataaacagaaagcca

SEQ ID NO: 62214 - DNA, 1310 bp, Homo sapiens
tctagggacagaaccttcccaaggcgggggggaggggagactctgattttcccgccgaaagcgtccccttggattggctactttaaattcagagtacgcacacgccgatttgcccttttgattcttccacaatcagggtgagactgctcccagtgccatgaacggagacgacgcctttgcaaggagacccagggatgatgctcaaatatcagagaagttacgaaaggccttcgatgatattgccaaatacttctctaagaaagagtgggaaaagatgaaatcctcggagaaaatcgtctatgtgtatatgaagctaaactatgaggtcatgactaaactaggtttcaaggtcaccctcccacctttcatgcgtagtaaacgggctgcagacttccacgggaatgattttggtaacgatcgaaaccacaggaatcaggttgaacgtcctcagatgactttcggcagcctccagagaatcttcccgaagatcatgcccaagaagccagcagaggaagaaaatggtttgaaggaagtgccagaggcatctggcccacaaaatgatgggaaacagctgtgccccccgggaaatccaagtaccttggagaagattaacaagacatctggacccaaaagggggaaacatgcctggacccacagactgcgtgagagaaagcagctggtggtttatgaagagatcagcgaccctgaggaagatgacgagtaactcccctcggggatatgacacatgcccatgatgagaagcagaacgtggtgacctttcacgaacatgggcatggctgcggacccctcgtcatcaggtgcatagcaagtgaaagcaagtgttcacaacagtgaaaagttgagcgtcatttttcttagtgtgccaagagttcgatgttggcgtttccgctgtattttcttgcagtgtgccattctgttagacattagcgttttcgttgatgagcaagacatgcttaatgcatatttcggcttgtgtatccatgcacctacctcagaaaacaagtattgtcaggtattctctccatagaacagcactaccctcctctctccccagatgtgactactgaggggaggtctgagtgtttaatttccgattttttcctctgcatttacacacacaccacacacgcacacacacacaccaagtaccagtataagcatctcccatctgcttttctccattgccatgcgacctggtcaagcccccctcactctgtttcctgttcagcatgtactcccctcatccgattccgttgtatcagtcactgacagttaataaacctttgcaa

SEQ ID NO: 62215 - DNA, 1174 bp, Homo sapiens
tctagggacagaaccttcccaaggcgggggggaggggagactctgattttcccgccgaaagcgtccccttggattggctactttaaattcagagtacgcacacgccgatttgcccttttgattcttccacaatcagggtgagactgctcccagtgccatgaacggagacgacgcctttgcaaggagacccagggatgatgctcaaatatcagagaagttacgaaaggccttcgatgatattgccaaatacttctctaagaaagagtgggaaaagatgaaatcctcggagaaaatcgtctatgtgtatatgaagctaaactatgaggtcatgactaaactaggtttcaaggtcaccctcccacctttcatgcgtagtaaacgggctgcagacttccacgggaatgattttggtaacgatcgaaaccacaggaatcaggttgaacgtcctcagatgactttcggcagcctccagagaatcttcccgaaggacccaaaagggggaaacatgcctggacccacagactgcgtgagagaaagcagctggtggtttatgaagagatcagcgaccctgaggaagatgacgagtaactcccctcggggatatgacacatgcccatgatgagaagcagaacgtggtgacctttcacgaacatgggcatggctgcggacccctcgtcatcaggtgcatagcaagtgaaagcaagtgttcacaacagtgaaaagttgagcgtcatttttcttagtgtgccaagagttcgatgttggcgtttccgctgtattttcttgcagtgtgccattctgttagacattagcgttttcgttgatgagcaagacatgcttaatgcatatttcggcttgtgtatccatgcacctacctcagaaaacaagtattgtcaggtattctctccatagaacagcactaccctcctctctccccagatgtgactactgaggggaggtctgagtgtttaatttccgattttttcctctgcatttacacacacaccacacacgcacacacacacaccaagtaccagtataagcatctcccatctgcttttctccattgccatgcgacctggtcaagcccccctcactctgtttcctgttcagcatgtactcccctcatccgattccgttgtatcagtcactgacagttaataaacctttgcaa

SEQ ID NO: 62216 - DNA, 984 bp, Homo sapiens
caatgagtggactcacaacctctgctgcagaatgccctcatgcgacagaagtctctctagagtttggaaatctttaccaacaaagaaaaattctgatgtattctctttcagttgaacgtcctcagatgactttcggcagcctccagagaatcttcccgaagatcatgcccaagaagccagcagaggaagaaaatggtttgaaggaagtgccagaggcatctggcccacaaaatgatgggaaacagctgtgccccccgggaaatccaagtaccttggagaagattaacaagacatctggacccaaaagggggaaacatgcctggacccacagactgcgtgagagaaagcagctggtggtttatgaagagatcagcgaccctgaggaagatgacgagtaactcccctcggggatatgacacatgcccatgatgagaagcagaacgtggtgacctttcacgaacatgggcatggctgcggacccctcgtcatcaggtgcatagcaagtgaaagcaagtgttcacaacagtgaaaagttgagcgtcatttttcttagtgtgccaagagttcgatgttggcgtttccgctgtattttcttgcagtgtgccattctgttagacattagcgttttcgttgatgagcaagacatgcttaatgcatatttcggcttgtgtatccatgcacctacctcagaaaacaagtattgtcaggtattctctccatagaacagcactaccctcctctctccccagatgtgactactgaggggaggtctgagtgtttaatttccgattttttcctctgcatttacacacacaccacacacgcacacacacacaccaagtaccagtataagcatctcccatctgcttttctccattgccatgcgacctggtcaagcccccctcactctgtttcctgttcagcatgtactcccctcatccgattccgttgtatcagtcactgacagttaataaacctttgcaa

SEQ ID NO: 62217 - DNA, 1875 bp, Homo sapiens
gactacaactcccagtatgcaccgcgatgcgcgcctcaccctgcatctcccagcccgcagccagctggcatcctagaccctctgccctgcgaccaacagccgggagcggaccagacaccagaactcccggaacggttgaagacggttccgctccctgtcccgcctttcgcagcccagcagtttcgccctgcggagaggagccttgctgtttccaaatctctcctgctgaagagacattggagctagggcggctagtttcacctggtaattgtgacaccctgtctcctcgagctgcaggcttttatgcttgtcatgttcgaagtttgataccttgcagatcaacaaagggccggtggcctctcactgcctccgcggcagggttgtcaagacatgcgcagtgcggcccgtccctagggctgggttaagggccgcggatgtggcagttctcaggcctcttgggatcgcctcaagaagccccctcacgagtgtctcgatttcctgtcagccaacaaagggccgttcgcctttcatggcctccacagcagcgttgccgtggctgtcacaaatcctctgcaccccaggagcgccgcttggacccccgggctcgctgcgtggtccatatctaggtcgggcctctcacggagactttcccaccagtgtaataaagaggagaaaacgtcacagcggaagggcctgaccctgctgcatccactaaggaaacagctacggggatgggaccctgggagctgctgtggagcctcatccaccgcttctctgaccccacccaggctgcttcccaggcctcagggtcttagtgtggacctccgggccgtgattaatgcagtttttcaggttaagtactgcacgactactcgcttctgaaactgatagacactgcctcagctccgtgcagggcagacgcacaagagcagaatctccgtgggacatctctctggagcatcaatattactgcagtatttggaagaaacaaatttaaataagttctaaggtgaagaatggaacatttaagacaagtctggaaagtcatctgcctttaataactgtcgtttgtccttaacgtcagactttctccaagaccaaaactctaagaacttatttccattcttacaaatagtaaaaatgataaatcatatcaagtcaattgaaagtcctgcctgctgctttcctaaattgcaatatggccttggtatggttttatttgtacttttgtgggggattcgtggatctttagattaaaaaaaaaaaaataggtttttgaacaatttttgcaagtttgcagctgttagttattgatttatttttccaacccatctaattcttctgtctctctcctctcctcaggctcaataattccatgggtctctaaggctgtgtttattttctttaaattttgttgatttacttttatactccatttgattttttctatctctcaccttttctcagactcagtcatcccacaggtctgtaaggctctgttcattttctttaaacttcttttttttttcctctcctcagattggataaattatattgctatgtctctgtttctgaactatagaaaagctcaaaattattatttttatttctcattttttatatggctattttttctctgctgatgtttcacatctattcatttatgagaatattttcctttgccctcatgagcgtgtttataatagctgccttcaaattcttgtctgccgtttacatcttggacatcttggagatggctactgcctgctttttatcttgtgtatttattacattttcacgtgtcttcacgcatcccttgaattggaaattgtgccctggagactgtatacaagactggattaaaaagactggatt

SEQ ID NO: 62218 - DNA, 1794 bp, Homo sapiens
ctacaactcccagtatgcaccgcgatgcgcgcctcaccctgcatctcccagcccgcagccagctggcatcctagaccctctgccctgcgaccaacagccgggagcggaccagacaccagaactcccggaacggttgaagacggttccgctccctgtcccgcctttcgcagcccagcagtttcgccctgcggagaggagccttgctgtttccaaatctctcctgctgaagagacattggagctagggcggctagtttcacctggctgtcacaaatcctctgcaccccaggagcgccgcttggacccccgggctcgctgcgtggtccatatctaggtcgggcctctcacggagactttcccaccagtgtaataaagaggagaaaacgtcacagcggaagggcctgaccctgctgcatccactaaggaaacagctacggggatgggaccctgggagctgctgtggagcctcatccaccgcttctctgaccccacccaggctgcttcccaggcctcagggtcttagtgtggacctccgggccgtgattaatgcaggtcagcaggaccagagcgccccttggtccctcccaacacatgagggtagtttgtgtggtgaggtcagggatagtgtctgcgcttctaccctgaatagggctcccttggaaaatactttaatatctctttttaaatacccccttggaccacttttaatagttttctgatagaactaaacagtgatcattctcttaattcatgtttccattaagtttttcaggttaagtactgcacgactactcgcttctgaaactgatagacactgcctcagctccgtgcagggcagacgcacaagagcagaatctccgtgggacatctctctggagcatcaatattactgcagtatttggaagaaacaaatttaaataagttctaaggtgaagaatggaacatttaagacaagtctggaaagtcatctgcctttaataactgtcgtttgtccttaacgtcagactttctccaagaccaaaactctaagaacttatttccattcttacaaatagtaaaaatgataaatcatatcaagtcaattgaaagtcctgcctgctgctttcctaaattgcaatatggccttggtatggttttatttgtacttttgtgggggattcgtggatctttagattaaaaaaaaaaaaataggtttttgaacaatttttgcaagtttgcagctgttagttattgatttatttttccaacccatctaattcttctgtctctctcctctcctcaggctcaataattccatgggtctctaaggctgtgtttattttctttaaattttgttgatttacttttatactccatttgattttttctatctctcaccttttctcagactcagtcatcccacaggtctgtaaggctctgttcattttctttaaacttcttttttttttcctctcctcagattggataaattatattgctatgtctctgtttctgaactatagaaaagctcaaaattattatttttatttctcattttttatatggctattttttctctgctgatgtttcacatctattcatttatgagaatattttcctttgccctcatgagcgtgtttataatagctgccttcaaattcttgtctgccgtttacatcttggacatcttggagatggctactgcctgctttttatcttgtgtatttattacattttcacgtgtcttcacgcatcccttgaattggaaattgtgccctggagactgtatacaagactggattaaaaagactggatt

SEQ ID NO: 62219 - DNA, 1870 bp, Homo sapiens
gactacaactcccagtatgcaccgcgatgcgcgcctcaccctgcatctcccagcccgcagccagctggcatcctagaccctctgccctgcgaccaacagccgggagcggaccagacaccagaactcccggaacggttgaagacggttccgctccctgtcccgcctttcgcagcccagcagtttcgccctgcggagaggagccttgctgtttccaaatctctcctgctgaagagacattggagctagggcggctagtttcacctggtaattgtgacaccctgtctcctcgagctgcaggcttttatgcttgtcatgttcgaagtttgataccttgcagatcaacaaagggccggtggcctctcactgcctccgcggcagggttgtcaagacatgcgcagtgcggcccgtccctagggctgggttaagggccgcggatgtggcagttctcaggcctcttgggatcgcctcaagaagccccctcacgagtgtctcgatttcctgtcagccaacaaagggccgttcgcctttcatggcctccacagcagcgttgccgtggctgtcacaaatcctctgcaccccaggagcgccgcttggacccccgggctcgctgcgtggtccatatctaggtcgggcctctcacggagactttcccaccagtgtaataaagaggagaaaacgtcacagcggaagggcctgaccctgctgcatccactaaggaaacagctacggggatgggaccctgggagctgctgtggagcctcatccaccgcttctctgaccccacccaggctgcttcccaggcctcagggtcttagtgtggacctccgggccgtgattaatgcagtttttcaggttaagtactgcacgactactcgcttctgaaactgatagacactgcctcagctccgtgcagggcagacgcacaagagcagaatctccgtgggacatctctctggagcatcaatattactgcagtatttggaagaaacaaatttaaataagttctaaggtgaagaatggaacatttaagacaagtctggaaagtcatctgcctttaataactgtcgtttgtccttaacgtcagactttctccaagaccaaaactctaagaacttatttccattcttacaaatagtaaaaatgataaatcatatcaagtcaattgaaagtcctgcctgctgctttcctaaattgcaatatggccttggtatggttttatttgtacttttgtgggggattcgtggatctttagattaaaaaaaaaaaaataggtttttgaacaatttttgcaagtttgcagctgttagttattgatttatttttccaacccatctaattcttctgtctctctcctcaggctcaataattccatgggtctctaaggctgtgtttattttctttaaattttgttgatttacttttatactccatttgattttttctatctctcaccttttctcagactcagtcatcccacaggtctgtaaggctctgttcattttctttaaacttcttttttttttcctctcctcagattggataaattatattgctatgtctctgtttctgaactatagaaaagctcaaaattattatttttatttctcattttttatatggctattttttctctgctgatgtttcacatctattcatttatgagaatattttcctttgccctcatgagcgtgtttataatagctgccttcaaattcttgtctgccgtttacatcttggacatcttggagatggctactgcctgctttttatcttgtgtatttattacattttcacgtgtcttcacgcatcccttgaattggaaattgtgccctggagactgtatacaagactggattaaaaagactggatt

SEQ ID NO: 62220 - DNA, 1789 bp, Homo sapiens
ctacaactcccagtatgcaccgcgatgcgcgcctcaccctgcatctcccagcccgcagccagctggcatcctagaccctctgccctgcgaccaacagccgggagcggaccagacaccagaactcccggaacggttgaagacggttccgctccctgtcccgcctttcgcagcccagcagtttcgccctgcggagaggagccttgctgtttccaaatctctcctgctgaagagacattggagctagggcggctagtttcacctggctgtcacaaatcctctgcaccccaggagcgccgcttggacccccgggctcgctgcgtggtccatatctaggtcgggcctctcacggagactttcccaccagtgtaataaagaggagaaaacgtcacagcggaagggcctgaccctgctgcatccactaaggaaacagctacggggatgggaccctgggagctgctgtggagcctcatccaccgcttctctgaccccacccaggctgcttcccaggcctcagggtcttagtgtggacctccgggccgtgattaatgcaggtcagcaggaccagagcgccccttggtccctcccaacacatgagggtagtttgtgtggtgaggtcagggatagtgtctgcgcttctaccctgaatagggctcccttggaaaatactttaatatctctttttaaatacccccttggaccacttttaatagttttctgatagaactaaacagtgatcattctcttaattcatgtttccattaagtttttcaggttaagtactgcacgactactcgcttctgaaactgatagacactgcctcagctccgtgcagggcagacgcacaagagcagaatctccgtgggacatctctctggagcatcaatattactgcagtatttggaagaaacaaatttaaataagttctaaggtgaagaatggaacatttaagacaagtctggaaagtcatctgcctttaataactgtcgtttgtccttaacgtcagactttctccaagaccaaaactctaagaacttatttccattcttacaaatagtaaaaatgataaatcatatcaagtcaattgaaagtcctgcctgctgctttcctaaattgcaatatggccttggtatggttttatttgtacttttgtgggggattcgtggatctttagattaaaaaaaaaaaaataggtttttgaacaatttttgcaagtttgcagctgttagttattgatttatttttccaacccatctaattcttctgtctctctcctcaggctcaataattccatgggtctctaaggctgtgtttattttctttaaattttgttgatttacttttatactccatttgattttttctatctctcaccttttctcagactcagtcatcccacaggtctgtaaggctctgttcattttctttaaacttcttttttttttcctctcctcagattggataaattatattgctatgtctctgtttctgaactatagaaaagctcaaaattattatttttatttctcattttttatatggctattttttctctgctgatgtttcacatctattcatttatgagaatattttcctttgccctcatgagcgtgtttataatagctgccttcaaattcttgtctgccgtttacatcttggacatcttggagatggctactgcctgctttttatcttgtgtatttattacattttcacgtgtcttcacgcatcccttgaattggaaattgtgccctggagactgtatacaagactggattaaaaagactggatt

SEQ ID NO: 62221 - DNA, 1875 bp, Homo sapiens; identical to SEQ ID NO: 62217

SEQ ID NO: 62222 - DNA, 1794 bp, Homo sapiens; identical to SEQ ID NO: 62218

SEQ ID NO: 62223 - DNA, 1116 bp, Homo sapiens
cacaggcagttactgctgcagacccagttcgtggaccagctgcagcagcaggaagcttggggcaaagcggtggctgagatggccggacaaaagttgcaggagacccaggggagggagttgctgaggacggggccccgagggggatgacctggcaacctccgtgccttctcactctgtttcccgtccccttaggagcacctagaagctgccagccaccagaaccaacagctagagacccagctaagcctcgtggctctccctggagaaggagatggaggacaacatctggacagtgaggaggaggaggcgcctcggcccacgccaaacatcccagaggacctggagagccgggaggccacgagcagctttatggacctcccgaaggagaaggcggacgggacggagcaggtggagagacgagagcttggattcgtccagccttctggagtgacagacggcatgagagagtccttcaccgtatatgaaagccagggggcagtgccaaacacgcggcaccaggagatggaggatgtcatcaggctggcccagaaggaggaggagatgaaggtgaagctgctggagctgcaagagttggtgttgccccttgtgggcaaccatgaggggcatggcaaattcctcatcgctgcccagaaccctgctgatgagcccactccaggggccccagccccccaggaacttggggctgccggtgagcaggatgttttttatgaagtgagcctggacaacaacgtggagcctgcaccaggagcggccagggagggttctccccatgacaaccccactgtacagcagatcgtgcagctgtctcctgtcatgcaggacacctaggagcacccaggcttgcccagcaaaccctgcgtgccattcttctaccaggcagccgagaacagggagataaacatcatcatcttctaagagctggtcaagaaatttaaaacaacaacaacaacaaaaagttacggggttcatctcctacacaattcatttactccatttgaatgctagagccactcacatttatttgtgtttctaatttaccgtttaaatttatttgtaaaaagttaagggagagttggtctttccctgatgttcttt

SEQ ID NO: 62224 - DNA, 1113 bp, Homo sapiens
cacaggcagttactgctgcagacccagttcgtggaccagctgcagcagcaggaagcttggggcaaagcggtggctgagatggccggccaaaagttgcaggagacccaggggagggagttgctgaggacggggccccgagggggatgacctggcaacctccgtgccttctcactctgtttcccgtccccttaggagcacctagaagctgccagccagcggaaccaacagctagagacccagctaagcctcgtggctctccctggagaaggagatggaggacaacatctggacagtgaggaggaggaggcgcctcggcccacgccaaacatcccagaggacctggagagccgggaggccacgagcagctttatggacctcccgaaggagaaggcggacgggacggagcaggtggagagacgagagcttggattcgtccagccttctggagtgacagacggcatgagagagtccttcaccgtatatgaaagccagggggcagtgccaaacacgcggcaccaggagatggaggatgtcatcaggctggcccagaaggaggaggagatgaaggtgaagctgctggagctgcaagagttggtgttgccccttgtgggcaaccatgaggggcatggcaaattcctcatcgctgcccagaaccctgctgatgagcccactccaggggccccagccccccaggaacttggggctgccggtgagcaggatgatttttatgaagtgagcctggacaacaacgtggagcctgcaccaggagcggccagggagggttctccccatgacaaccccccggtacagcagatcgtgcagctgtctcctgtcatgcaggacacctaggagcacccaggcttgcccagcaaaccctgcgtgccattcttctaccaggcagccgagaacagggagataaacatcatcatcttctaagagctggtcaagaaatttaaaacaacaacaacaaaaagttacggggttcatctcctacacaattcatttactccatttgaatgctagagccactcacatttatttgtgtttctaatttaccgtttaaatttatttgtaaaaagttaagggagagttggtctttccctgatgttcttt

SEQ ID NO: 62225 - DNA, 1116 bp, Homo sapiens
cacaggcagttactgctgcagacccagttcgtggaccagctgcagcagcaggaagcttggggcaaagcggtggctgagatggccggccaaaagttgcaggagacccaggggagggagttgctgaggacggggccccgagggggatgacctggcaacctccgtgccttctcactctgtttcccgtccccttaggagcacctagaagctgccagccagcggaaccaacagctagagacccagctaagcctcgtggctctccctggagaaggagatggaggacaacatctggacagtgaggaggaggaggcgcctcggcccacgccaaacatcccagaggacctggagagccgggaggccacgagcagctttatggacctcccgaaggagaaggcggacgggacggagcaggtggagagacgagagcttggattcgtccagccttctggagtgacagacggcatgagagagtccttcaccgtatatgaaagccagggggcagtgccaaacacgcggcaccaggagatggaggatgtcatcaggctggcccagaaggaggaggagatgaaggtgaagctgctggagctgcaagagttggtgttgccccttgtgggcaaccatgaggggcatggcaaattcctcatcgctgcccagaaccctgctgatgagcccactccaggggccccagccccccaggaacttggggctgccggtgagcaggatgttttttatgaagtgagcctggacaacaacgtggagcctgcaccaggagtggccagggagggttctccccataacaaccccactgtacagcagatcgtgcagctgtctcctgtcatgcaggacacctaggagcacccaggcttgcccagcaaaccctgcgtgccattcttctaccaggcagccgagaacagggagataaacatcatcatcttctaagagctggtcaagaaatttaaaacaacaacaacaacaaaaagttacggggttcatctcctacacaattcatttactccatttgaatgctagagccactcacttttatttgtgtttctaatttaccgtttaaatttatttgtaaaaagttaagggagagttggtctttccctgatgttcttt

SEQ ID NO: 62226 - DNA, 5007 bp, Homo sapiens
ctgagaaacaaaacaagcaaattaattttccacttttgcacctgcaaaaaaatgtctcaagaaccagaactgagtaagaattgtgataaagagtgtttatctgtatattcagggcttcctttaaaattaattacaagaaagttcaactgaaaattggtgaaagttttgaaaaatccaaaattactgtttgtcctgaggaagagctcttacatagttactctaaagagggacaaaattaaaggaagtgccctctaacccaatgaatcatgtccctgactgcaaggaagcagatgcatcttggagtgtcgaactctgtagtatcccaggcattgcctgaacaggaggagaacatcacaaacctgtcttttcattgtatttatactctgggtccctcaaacacacctgccagtcatcttctaagctttattcaaatgaaaataaatcagactgtaaaacttgtaactatccagacatgtagcctgtttctcagagatgaagagaattgttgtaatgatacagaaatagaaaaattagggaacccagtagttatggttgaaatgaaagaggaccaagagtttgatatgcaaatgacaaaaaaatataaaccaaaataccgttaattggaaattagacattagacattggcctcagtctagagatccaaaaagtctgtttgatttgtggtttgtttactctaaagaaatgaagcatgtgatacagatagaaagccacagtatttctgctgttacagacacttacaaaaacaaaaatccagtaagcacttgttccacaagccatatggaacttagaagctcttctaaagcttagaagatgactggcaagtatgtttcagggagccacataagacagttccactgctaatagctataaaagcatgaaacctgcatgagaaaatgtgagttattctccaccccatagtgacagaacatcaaaagcatatctagaagaagacttacagcaagatatgcaaaggcttaagaatgaggtgggcatgttacaagtagagttcctggctttgaagaaagaaagcttaactataaaaagaaagaggttcacttgctgcttctctttttataaattatctgattcattctggttttctactcaagaaaatctcatgtgtctagttacagtgtggttatctaaatgcataattatgtgtctaagtagatcagtgctgctatctaaatgacagttctggaaaacactctcataatctttgttcattagtcaacctgagtctcactatcagtcttccaagtggcacatgggctgggaaaataatttagccatatgccatgtgaccttctgaatcagctaaacataaagaaaattgctaaagaaataagctctagattcttcttactgtattcatttaaagatgacttacatttatttaaatgataaaatggtaacacgatgggagggaaacaatgactgagaagagacatgaaaatgtatctagcctggagacttgtaacaaatattatcagccaaaggcgtctgtttaatgtgctttcatgcatgcaagtttatttgtctgactcaagctgtttaaacttataattccataatggccattttaaatatttttggaaacaaatacatatacttttgcatatttaaaaaaaatcaccactctccaatgtttctgttgaatcacacttttacattatgttgtttaataaaatatggtaagttttgacatgtatgattttatcatgtaagtagcataacttctcagccaaatatttatcatttgactctatagtggaaagctgagttctgtacattgtgttctaaagatagacaaaaatctagagattttcttaaaagcagatgaggcctcctgccatcctctgaggcattaaattgctttgccaaagtcacgcttttaatttatttgactaatttgatatatttatctggtaatttatgtaatgcagcaatatgtaattgtatcttcccttttggtgccatgaagtgctaggtaatgccaccttaggagctttgggtgaattatttaatatttattggttttacttctattatcaagtagataatgggggctagagtagacaactattctgtatatcttccagctataaacttttgtggtgattgaatgtaaacttggggaacatctcattttctaggattctgcactagcaactcagcagtgtcactctgctccttgagttgtggtaaactttggttcctctatttcagtgagcaccttcacttttttgatatcccaggatccaagtgaaaaaataaggataaaagacagtggggaaaataacagcttagtgcagaacagggaaagcttcttttctgtttctgaagccccacaaggtcacctcctctcaatctggctatttcatggagaatccaggtgacaaagacagaagacacattttatgtctgtgtctttttgtttctctgtttttgtgttgatatatttacaccacagaagtaactgtgatctggtggagaactagaagtagagtcagaagccctgggaacatcctgcagcttgcttatatttttaacctctctttttaagaattgtgataagaaattcatcaatgtatgtacgtagaagtgcttagtacaatgtctagatttatgatttagtaaatgaaattcttataactgactaaaaatgttgagtcaaatcacaatagaatattatcagggaaacagaacttctaaaactttgagaaattttatcggtccaaatacacgtggaggtaaagctcttactacagggtggtatctgggttagatatcagagtataaatgcaatttcctttttccaatattttaatttagtcaaatttgttaatattttactttatgctttgagtttgttgtaattcagagaaaggcttttccaattctgatattcttaacagttctctagtgtgtatgtgtgtgtttttagttttatggattcattgacttcaaataaagttttgaactttttgaaatttatgctctttaaggttcaaggttttgcttcaactttttctccagttggatatccacttacagcaacttttaattgcatgaatgtacaggttgttctttcacttcagagataaacatgatatgttattttattgagtgctagctgaaaatttcttttgttttatttaagattttcaaagttatagaaaaaagaaggatgtgatatatacaaattgcatattgaagggagatattgccacactcaaacaggaataatacacaataaaaaatgacagtgtcaaaaaggaaaaggaatatattcaggaaattaagagtattagagaaataaatgctaactttgaaaaaagtgcaagactcaatgaggaaatgacaacaaaaacgatgtcccagtattgtcaacagcttaatggcctcaaagctgagaatacaaggctgaattcaaaattggagaaggaagaacaccacacagatggactggaagctgaagttgaattcttccattctaggctggctgctgctataaatgagcacaatgaaagtttagaaacgaaagacctagaacttgttttacagagagcacataatttttccgtacataaaaaaataagttctactgtttctcaactaaaagataaaaatgagttgcttactgaacaattttctaaagctcagatgaagttcaataccttaaaaggtaagctccatgagataagagatgctctcagggaaaagacattggctttagaaagtgtacagatggaccaaaggcaagcacagcatcgaataaaggaaatggagcagattcatccaaatgaggaaactaaaggagtcgatccaccggaaagcacaactgtgtagaggagagactatgtcaactagaatgtgacagtctcttgcttcaacgacaactagagggtgctcataaggaaggcaatgataaagagatagtaattaatatccaaggaggctgtcttgagagtggaaagatcttctagaagagaaaaataagaaactaatgaatgaatataattctataaaagaaaaactgtttcagtatgtaaaagaagaaggagaagtaagtatgaagaaagataaatatatttaaccttccagaaagaaaatttaaacatttcattgtggctatatgttgaatctagttcaatataataataaatagatgaaaatgtatttaccatactgtataattccattaacatgaaacatccagaaaagacatgtatagggacagaaagaagatgaatgtttctgtagggctggggctggaaatgggtcgtgactgctgatgggcatgagggatcatcctggagtgatgaaaatgttctaaagctggattgtaaagatgactgcacgactggtaaatttactaaaaatctttgaactgtatgttaaaacagataaattctgtagtatgtaaatcatattttagcaaagctgttttaataaaaaaacaaaaaaaatatgtttactgtatcagcttggaaacataccttgtttccaggaaataaaaggtagagctgacagatgctttcctttgagtaaacacattatgtcacctatgaaattttagtagctacagagtaatgttcatacagtatgtagtcttatactgctgaaataataaatttaatgtctttatgttgtcacattttaagaccataatgaagcagataaattgatatcttgtacctgaaataagtattttgaaattaagattcaattaagtgagccactttgacacttaattctagatttcccagatgaactgaagtgtgttgctctgtcttgtggtgcttttccttcagtggctcttttatgtattttagttggcataactttattttgattcatatcaatgtgacttaagtctgaaaatatgtcagtctcacattatgtatttttctgaccacttaatattttaaagacatctacttgttataaaatcacaatttggaataaatgtggtaaatttta

SEQ ID NO: 62227 - DNA, 1771 bp, Homo sapiens; identical to SEQ ID NO: 62164

SEQ ID NO: 62228 - DNA, 874 bp, Homo sapiens
gggctcctttctccgtcgccgctccaggacgcggcctcgggggagccctaccgggacggagccgcggggcctgcgacttcccccggagctggcctgagggattctcctgtccatggctgccaccaaaactgcgagttatgatgaacatttcaggccagaaaagttaagagaatggccggagcccgagtccgtttctttaatggaggtattagctagagaagacattgatgaagcagtatgtgcaatattatttaaagaaaattccattgtgaagagattggatatgtattttcagcatgtggatacttttaaggaaagaagaaaagagatgttacataaaaaatgggttgaaaatgttgcagagcctcttcagcagagaattatggaaaaagtaatttcatataaagagcttaaaatgaaacaagagaatgttgaatattatttacagcacagacataaaatggttacagtcccaccatttgttgatcctctgtttcaaagacagcaagaggtggatgaagagaggagaactggtcttcagtgtgagacaggaaaacgacattccataaaagaacttgaagaaatagagaaggccaggctgcatgccagctcgccctacttcactttcacttcacactgtgtgattccaaaagagtggcataaagcctctgcaagagccaggagtaaaacttacaaatacaggtacagatgagcagaacaaacaaatatttgtttaacttgcaacttactttatttcctactgaagctcttgtaactagtcacacttttgtcttttagtagtttatagttttattattattatcatcacctttgtattatgaaatatatgtagaggacagaataaaacataaac

SEQ ID NO: 62229 - DNA, 901 bp, Homo sapiens; identical to SEQ ID NO: 62166

SEQ ID NO: 62230 - DNA, 1113 bp, Homo sapiens
gggctcctttctccgtcgccgctccaggacgcggcctcgggggagccctaccgggacggagccgcggggcctgcgacttcccccggagctggcctgagggattctcctgtccatggctgccaccaaaactgcgagttatgatgaacatttcaggccagaaaagttaagagaatggccggagcccgagtccgtttctttaatggaggtattagctagagaagacattgatgaagcagtatgtgcaatattatttaaagaaaattccattgtgaagagattggatatgtattttcagcatgtggatacttttaaggaaagaagaaaagagatgttacataaaaaatgggttgaaaatgttgcagagcctcttcagcagagaattatggaaaaagtaatttcatataaagagcttaaaatgaaacaagagaatgttgaatattatttacagcacagacataaaatggttacagtcccaccatttgttgatcctctgtttcaaagacagcaagaggtggatgaagagaggagaactggtcttcagtgtgagacaggaaaacgacattccataaaagaacttgaagaaatagagaaggccaggctgcatgccagctcgccctacttcactttcacttcacactgtgtgattccaaaagagtggcataaagcctctgcaagagccaggagtaaaacttacaaatacagtcctgaaaagctcatctatgcagacaagaaacagaaaagaaaagagaaaaagacggccgacctaagtcaggctgcgtttgaaaggcagttcctttcctcaaagctcagccagaagaacaaagtgggtgaaagaaagggtctggttttaggaaccagacagcagagaccccgttcctgggctgctggggacagccaacagcacaggggtccccagcctgtgggaaaaagagtgatgacagctgaggtgctggggcagcacctggcctccctgcagaaggtggccaggcagggccacccttggtactgaagcttcgtggacttgacttggcagtgtctgtacagcagttaaaatactctaaacatattttcttcctccagaagtggaaataaattgcaagaaatacccaaatc

SEQ ID NO: 62231 - DNA, 624 bp, Homo sapiens
atgatgtagaaatagactctgatggtcacacggatgcttttgtggcttattttgctgatggcaataagcaacaagatcgtgaacctgtattttcagaagaactggggcttgcaatagagaaattgaaggatggattcaccctacagggactttgggaagtaatgagttgattgaccttgagttgagatggatttctattaaagatatctctagtttaaagatactagtcacctgccataagtcatggaatagtttttatatttacagcttttatatttaaaacttgtaagagtttttttaatgattgaggaaaaagtcatttagaaaacttcagttttcggccagcgcgtcgagggaggggccagcgacacatggcctagtaaccgtccggccgcggcgctggcttaagccatggctgagggtagctggattcctcaggcccgggcgctcctacagcagtgcctgcacgcccggctgcaaattcgcccagccgatggggacgtcgcggcccagtgggtggaggtccaaagaggactggtgatctacgtgtgctttttcaagggagctgataaagaacttcttcccaaaatggccgaagctggactctgtttccctagtgattaa

SEQ ID NO: 62232 - DNA, 618 bp, Homo sapiens
atggagcggctctcagtggattacggcaagaagtccaagctagagtttgccatttacccagccccccaggtctccacagccgtggtggagccctacaactccatcctgaccacccacacgaccctggaacattctgactgtgccttcatggtcgacaatgaagccatctatgacatatgtcggcgcaacctggacattgaacgtcccacgtacaccaacctcaatcgcctgattgggcagatcgtgtcctccatcacagcctccctgcgatttgatggggccctgaatgtggacttgacggaattccagaccaacctagtgccgtacccccgcatccacttccccctggccacctatgccccagtcatctcagctgagaaggcctaccacgagcagctgtctgtggccgagatcaccaatgcctgcttcgagccagccaatcaaatggtcaagtgtgaccctcgccacggcaagtacatggcctgctgcatgttgtacaggggggacgtggtccccaaagacgtcaacgcggccatcgccaccatcaagaccaagcgcaccatccagtttgtggattggtgcccgactggatttaagcagcattcatatgacccttga

SEQ ID NO: 62233 - DNA, 2716 bp, Homo sapiens
aggctgaggggcggttgttgttggcagctgtggctaaggaggggagaacctctgctccccgcccgtcttctcttctgcgtttcccgggctagggggcgtggggagtggttttaggcggcgaagccgctcggcagcaccttccttctttgccaggcagacgcccgttgtagccgttggggaaccgttgagaatccgccatggagccagagagggaagggaccgagagacaccccaggaaggtcagggaaggcaggcaggccccaaataagctggtcggggcagctgaggcgatgaaagccggttgggatctcgaggagagtcagcccgaggccaagaaagcccgcttatctaccattttatttactgacaactgtgaagtaacccatgaccagctgtgtgaattgctgaagtatgcagttctgggcaaatccaatgttccaaaacccagctggtgccagctttttcatcaaaaccacctaaacaacgtagtggtttttgttctgcagggaatgagtcagctacacttttacaggttctatttggagtttggatgtcttcgaaaagcattcagacataaattccgcttgcctccaccatcatctgattttctagctgatgttgttgggctacaaactgaacaaagagctggagatctgcccaagacaatggaagggcctttaccttctaatgcaaaagccgccatcaaccttcaggatgatcccatcattcaaaagtatggctctaagaaagtgggcttgaccagatgccttctgacaaaggaggaaatgagaacgtttcactttccattacaaggttttcctgattgtgaaaactttttacttaccaaatgtaatggttctatagcagacaatagtcctctctttggacttgactgtgaaatgtgcctcacatccaaggggagagagctaacacgcatctcactggttgctgaaggaggctgctgtgttatggatgaactggtcaaacctgaaaacaagattctggactacctcaccagcttttcgggaatcacgaagaagattcttaacccagtgacgaccaaactcaaagatgtacagaggcagttaaaagcactgcttcctcctgatgctgtgttagtgggccactccttagatttggatctcagagcactgaaaatgatacatccatatgttattgatacatcgttgctttatgtcagagagcagggcagaagatttaagctcaagttcttagccaaagttattttggggaaggatatacagtgtccagacagacttggtcatgatgccacagaagatgctagaacaatccttgaattggctcggtatttccttaagcatggcccaaaaaagattgcagaactaaatctagaagcactagctaatcaccaagaaatacaagcagcaggccaagagcctaaaaacacagcagaagtacttcagcacccaaacacaagtgttttagaatgcttggattcagtgggtcagaagcttctttttttgacccgggagacagatgctggtgaacttccatcttccagaaattgtcaaactattaagtgtctttcaaataaagaggttcttgagcaggccagagtggaaatccccctgtttcccttcagcattgttcagttctcttttaaggccttttcacctgtcctcactgaggagatgaacaaaaggatgaggatcaagtggacagagatatcaactgtctatgctgggccatttagcaaaaattgcaatctcagggctctgaagaggctgtttaaaagctttggcccagtccagtcaatgacttttgttcttgaaacccgtcagcctcatctctgtatacagtatgaagtcctagaagctgcccagctggccatagagtccttggatggtattctggtagatggtatctgcatcaaggtgcagaggcctgtgacagagctcacgcttgattgtgacaccctcgtgaatgagctggaaggagattctgaaaaccaaggctctatatatctgtctggagtgagtgaaaccttcaaagaacagctattgcaggagccccgcctctttcttggcctggaagctgtgatcttgcctaaagatcttaaaagtggaaagcagaaaaaatactgtttcctgaaattcaaaagttttggcagtgcccagcaggccctcaacattctcacaggcaaggactggaagctgaaaggcaggcatgccctaacccccaggcacctccatgcctggctcagaggcttaccacctgaatcaacaaggctcccagggcttcgtgttgtacctcccccctttgaacaggaggccttgcagactctgaaactggaccacccgaagatagcagcctggcgctggagccggaagattggaaagctctacaacagcttgtgcccgggcactctctgcctcatcctgctgccaggaaccaagagcactcatggttcactctctggtctaggactgatgggaataaaagaggaagaagaaagcgctggcccaggcctgtgttcgtgagtcggcctgccatgtttccatgtgccatttcttaccccttgtaggcaatggcaaagaatgtggtcaggctgtagcctccccaaccagcagacagttttatggaaacttggtatagcagctaaaagagtttagtttgtttatatggcatgtataagttttcaataaatgcctaaagttcaagcataaaaaaaaaa

SEQ ID NO: 62234 - DNA, 2473 bp, Homo sapiens
gagcggagtaaaatctccacaagctgggaacaaacctcgtcccaactcccacccaccggcgtttctccagctcgatctggaggctgcttcgccagtgtgggacgcagctgacgcccgcttattagctctcgctgcgtcgccccggctcagaagctccgtggcggcggcgaccgtgacgagaagcccacggccagctcagttctcttctactttgggagagagagaaagtcagatgccccttttaaactccctcttcaaaactcatctcctgggtgactgagttaatagagtggatacaaccttgctgaagatgaagaatatacaatattgaggatatttttttcttttttttttcaagtcttgatttgtggcttacctcaagttaccatttttcagtcaagtctgtttgtttgcttcttcagaaatgttttttacaatctcaagaaaaaatatgtcccagaaattgagtttactgttgcttgtatttggactcatttggggattgatgttactgcactatacttttcaacaaccaagacatcaaagcagtgtcaagttacgtgagcaaatactagacttaagcaaaagatatgttaaagctctagcagaggaaaataagaacacagtggatgtcgagaacggtgcttctatggcaggatatgcggatctgaaaagaacaattgctgtccttctggatgacattttgcaacgattggtgaagctggagaacaaagttgactatattgttgtgaatggctcagcagccaacaccaccaatggtactagtgggaatttggtgccagtaaccacaaataaaagaacgaatgtctcgggcagtatcagatagcagttgaaaatcaccttgtgctgctccatccactgtggattatatcctatggcagaaaagctttataattgctggcttaggacagagcaatactttacaataaaagctctacacattttcaaggagtatgctggattcatggaactctaattctgtacataaaaattttaaagttatttgtttgctttcaggcaagtctgttcaatgctgtactatgtccttaaagagaatttggtaacttggttgatgtggtaagcagataggtgagttttgtataaatcttttgtgtttgagatcaagctgaaatgaaaacactgaaaaacatggattcatttctataacacatttatttaagtatataacacgttttttggacaagtgaagaatgtttaatcattctgtcatttgttctcaatagatgtaactgttagactacggctatttgaaaaaatgtgcttattgtactatattttgttattccaattatgagcagagaaaggaaatataatgttgaaaataatgttttgaaatcatgacccaaagaatgtattgatttgcactatccttcagaataactgaaggttaattattgtatatttttaaaaattacacttataagagtataatcttgaaatgggtagcagccactgtccattacctatcgtaaacattggggcaatttaataacagcattaaaatagttgtaaactctaatcttatacttattgaagaataaaagatatttttatgatgagagtaacaataaagtattcatgatttttcacatacatgaatgttcatttaaaagtttaatcctttgagtgtctatgctatcaggaaagcacattatttccatatttgggttaattttgcttttattatattggtctaggaggaagggactttggagaatggaactcttgaggactttagccaggtgtatataataaaggtacttttgtgctgcattaaattgcttggaaagtgttaacattatattatataagagtatcctttatgaaattttgaatttgtataacagatgcattagatattcattttatataatggccacttaaaataagaacatttaaaatataaactatgaagattgactatcttttcaggaaaaaagctgtatatagcacagggaaccctaatcttgggtaattctagtataaaacaaattatacttttatttaaatttcccttgtagcaaatctaattgccacatggtgccctatatttcatagtatttattctctatagtaactgcttaagtgcagctagcttctagatttagactatatagaatttagatattgtattgttcgtcattataatatgctaccacatgtagcaataattacaatattttattaaaataaatatgtgaaatattgtttcatgaaagacagatttccaaatctctcttctcttctctgtactgtctacctttatgtgaagaaattaattatatgccattgccaggtagaagtttggaataattgtttagtctctcctattagatgtggacaattttgtttttgtttttgttttcagggrtgaaataaaatatattatttctcccttaaaaaaaaaaaaaaaaaaaaaaaaaaaaaaaaa

SEQ ID NO: 62235 - DNA, 5363 bp, Homo sapiens
cagccggcggcgggctgggtgtttgcaatacaaaggcggccacgcgcggcgccgctcggtgcagaccatgaattacgtggggcagttagccggccaggtgtttgtcaccgtgaaggagctctacaaggggctgaatcccgccacactctcagggtgcattgacatcattgtcatccgccagcccaatggaaacctccaatgctcccctttccacgtccgctttgggaagatgggggtcctgcgctcccgagagaaagtggttgacatagaaatcaatggggaatctgtggatttgcatatgaaattgggagataatggagaagcattttttgttcaagaaacagataatgatcaggaagttatccctatgcacctggccacctcccccatcctgtcagaaggagcttcgagaatggaatgccagctgaaaaggggctctgtggacaggatgagaggcctggaccccagcacgccagcccaagtgatcgctcccagcgagacgccgtcaagcagctctgtagtaaagaagagaagaaaaaggaggagaaagtcacagctggacagcctgaagagagatgacaacatgaacacatctgaggatgaggacatgttccccatcgagatgagctcggatgaggccatggagctgctggagagcagcagaactcttcctaatgatatacctccattccaagatgatattcctgaggaaaacctctccctggctgtgatttaccctcagtcagcctcataccctaattcggatagagagtggtcacccactcccagtccttccggttcccgaccttcaacacctaaaagtgattcagaattggtcagcaagtccacggaaaggacagggcagaagaacccagaaatgctttggctgtggggagagctgccgcaggctgctaagtcttcttctccacacaagatgaaagagtccagcccattgagcagtagaaaaatttgtgataaaagtcactttcaggccattcacagcgaatcttcagacacttttagtgaccaatcgccaactctggtcggtggggcacttttggaccagaacaagcctcagacagaaatgcagtttgtgaatgaagaagacctggagaccttaggagcagcagcgccactcttgcccatgatcgaggagctcaaacccccctctgccagtgtagtccagacagcaaacaagacggattctccttccaggaaaagagataaacgaagccgacatcttggtgctgacggcgtctacttggatgacctcacagacatggatcctgaagtggcggccctgtattttcccaaaaacggagatccttccggactcgcaaaacatgcaagcgacaacggagcccggtcagccaaccagtccccgcagtcggtgggcagctcgggcgtggacagtggcgtggagagcacctcggacgggctgagggacctcccttccatcgccatctccctctgcgggggcctcagcgaccaccgggagatcacgaaagatgcattcctggagcaagctgtgtcatatcaacagtttgtggacaaccccgctattatcgatgaccccaatctcgtggtaaagattgggagtaaatattataactggacaacagcagcacccctcctcctggcaatgcaggccttccagaaacctttgccaaaggccactgtggaatctatcatgagggataaaatgcccaaaaagggaggaagatggtggttttcatggaggggaagaaacaccacaatcaaggaggaaagtaagccagagcagtgcttggctggcaaggcccatagcaccggagagcaaccgccgcagctcagcttggccaccagggtaaagcatgaatcatcctccagtgatgaggagcgcgcagctgccaagccatcaaacgcaggccacctccctcttctgcctaatgtcagctacaagaagactctccggctgacttccgagcagcttaaaagcttgaagttgaagaatggccccaacgacgtggttttcagtgtcaccacgcagtaccaaggcacgtgccgctgtgagggcaccatctatctgtggaactgggatgataaagtcatcatttctgatattgatgggacaattaccagatcagatactcttggccacattttgcccacccttgggaaggattggacccatcagggcatcgctaagctgtaccataaagtgagccagaatggatataaatttctctactgttctgcccgtgccatcgggatggcggacatgacgcggggctacctgcactgggtcaacgagaggggcacggtgctgccccaggggcccctgctgctgagtcccagcagcctcttctctgccctgcacagagaagtgattgaaaagaagccagaaaagtttaaagtccagtgtttgacagacatcaaaaacctgtttttccccaacacagaacccttttatgctgcttttggaaaccgaccagctgatgtgtattcatacaagcaagtaggagtgtctttgaatagaatatttaccgtcaaccctaaaggagagctggtacaggaacatgcaaagaccaacatctcttcgtatgtgagactctgtgaagtagtcgaccacgttttcccgttgctgaaaagaagccattcttcagactttccctgttcggataccttcagtaacttcaccttttggagagagccactgccaccttttgaaaaccaggacattcattctgcctcagcgtaaaatgtcccaagcagcctcttgccagcagtgcagagcctggttgtcacccattaaaggataggtctccccggagtgcacagctccacctgggagcctggcgcgtcatcattggcctgacagcagagagaattgagaagcatttctcccctgccccaccccggggctgacatttctaagcaagataggaagggagcactttctaggctaggagttgggtgcatttgtaccgtgaaaagcattcctcagttgtggcttaatgccagttacgacgctgcctttccggcctgctccagcaagtagctactggttcacgtgcagtttggggctgtgaaacctaggcagaaggcggctgtctgagggctgtccccgcctaggacagggtcaatcgaggaatgccagatgtgcacggtttttggcaaagtagggggcacatttccattatagcaatgttagtgccaccaccttctgaacacagtggggagggctgtgaaggctcatgtgacctggatctgaggtctctgatagaaatctggacgccaccgggtccaggcctggcctcagacttggccttgtggatgggccccttacagtatttgctgactagtctcatttttaggtgataaatttttctttaattcctttggttaaagatagtctatttcattggcatatctccccccagtttttgtggctcaaggctggaatatttatgccttaatatatctatggcagacatttaagaatgcgctttatctagctcatggtaactttgcaacgccttagattaaaatgacagtaaatattactaaggcagtattttgaatgagtttgacactgccggcttccttccatccagcgaggtggtgctgacagtgtggacttgagcacacttatgccaaatgataatgatactgacttctgttgggagctctccaaagaaactggttggttttaagaaaatagtttcaagaagttcaactatattcttttagatattatgtattgttttactctgattaggttactgtgataggcatttattcatattctttctataccactgtcattaatatattaaaaagatgtatgtgttagactatcgaaagggccttattctctctttctcatagactgaccttcttttggaatttctgagtcatttattttccttagctttttccactcaaattaagggcaagcgaaaaagtaataatttggcattctttaagcctacagaatgtgattctttcacttgtttattacactggctcgtggacagaacaatttgaaaagtgaaagaattattttggtaaaagattttgctttacttttcgaagcattatttttttaaagagtgttttactccaacgattgaaacattttcctatttaaatttcattgttagaatcacaggaggcaaaaaatggaacggttgaatgaaattttactctttctgtgaaagaaaatccacagagttgttgcctccgttgtagttggtgggccccgttagcattggatgcctttgccaaatggttcatgtggacacacaaaggcaaacagatctgccatcgatcgcagatttctgtagaaacacggatgtgcatgtgcagattcccttttgcaggtattaaaaataattaaaaatagtcctgcctgaggttgcagtgagccgagcttgcactactgcactccagcctgggtgacagagtaagactccatgtcaaaaaaaaaaaaaaaaaaaaaaaagtcctgccttaactaactcctctgcgcttgttcactagtaacctaaagaggctatattcattctttatgcaatgagggtatttttgagtgaattttaactgctctgaactaagtataagctcatgggcctgcaaaggttcagacggtttctcctttgcacccaggaggaactttggctgcgagaatggggggatgtatccctcatgcagttggcatccaggcagccctctgcagcagcacaccctgcaggcggagttttcagaggatgcaattttggatcccgaattttgatgtaccttaaacttccacatcactgcaccctgaaacagagcatgctttccagaaagtcacactctcagatctgtgtcaagttcaatgtgagccctggcaaggctggcatattaacacctgccttctggcttctgaaagtgagatttgtatatgggctgcactcacgcatatacgagttggtttatctttgtgtacatgactataacccagtgatgctgaggtcatgtgctggaatgctgtatttggaccacacatttcaaagttgccctatggaaatgaatcctacttagtgacaagtcatcaaatgtttgtcacatgtgatgaagacaaatatgtatacctggcatagagaaaaatatatacctggtacattggagaaaaataattacactttcaaagagaattccctttgcaattttatgtttggatcaccactgtaagcacactttatttgcatttgatctgtatttgtatatgctgatgcaatgataaaaatcactgtaatacttcattgtgttgtactggatgcaaagctagaaaatattgcaataaatgagaccgatgaaagacttctctgaaaaaaaaa

SEQ ID NO: 62236 - DNA, 1653 bp, Homo sapiens
ctgggactagcaggtttttcatgatttttcctcacactgatcactatccaatcagaacaataaacttctaacactcccttactaaaagaacatggttaagggtgagaaaggccccaagggcaagaagatcaccctcaaggtggccaggaattgcatcaaaatcacttttgatgggaaaaagcgccttgacttgagcaagatgggaattaccaccttccccaagtgtattctgcgccttagtgacatggacgagctggaccttagccggaatcttatcaggaagatccctgactccatctccaagttccagaacctccggtggctggacctgcacagcaactacatagacaagctgcctgagtccattggccagatgaccagcctgctctacctcaacgtcagcaacaaccggctgaccagcaacgggctgcccgtggagctgaagcaactcaagaacatccgcgctgtgaacctaggcttgaaccacctggacagcgtgtccaccacactgggggccctgaaggagctccacgaggtagggctccatgacaacctactgaacaacatccccgtgagcatctccaagctccccaagctgaaaaagctcaacataaagcggaacccctttccaaagccaggtgagtcggaaatattcatagactccatcaggaggctggagaacttgtatgttgtggaggagaaggatctgtgtgcggcttgcctgagaaaatgccaaaacgcccgggacaacctgaatagaatcaagaacatggccacgacgacaccgagaaagaccatctttcccaatctgatctcacccaattccatggccaaggactcctgggaagactggagaatacgcttgacatcttcctagagtagctgtggcaaaatcttgaagactactcagctaacagaataaacgactctgaagaggagaagcccccagttaggagaagacagagtggcaagtgagatgttctggaaaccaggctcgccggagctggccaagccaccgacttgcttctcaaattcacttcacctcccttagctttagcccacctgtgtgtgaaaatgactttgggaaatatttgatgtggtttttaaaatgtatatagaaaaaaatttaagaaaattacagattatatattatagacaactaaatatttaagactttaagacttaaaaggcttactgcctctacatttcactcagactagtacatctcaatgccagtagtctgtgataaatttatgtaggtataatgagatactgatatggtttgggcatttgtctcctccaaacctcatgttgagatttgatccccagtgttggaggtggggcctaatggaaggtcatgggggtgggtccctcatgaatggcctggtgccatccttttggtaatgagtgagttctcactgtattagatcctgttgaaaattgattgttaaaaagaccttggcacctccctctcctctctctctcttcctctcactatgtgatgcctgctccccttcaccttccaccatgagtggaagcacctataccccaaagccctcaccagaaggaggtgccggcacctgtacagcttgtaagaaccatgactcaaataaacttcttttctttataaaaaaaaaaaaaaaaaaaaaaaaa

SEQ ID NO: 62237 - DNA, 2100 bp, Homo sapiens
ggccagagaggagccaggagccatgagggtggcattaggcatgctctggctcttggcccttgcgtggcccccccaggcccggggcttctgcccctctcaatgcagctgcagcctccatatcatgggtgatggcagcaaggccaggacagtagtgtgcaacgaccctgacatgaccctgcccccggcgtccatccccccggacacctccagactgcgcctggagcggacggccatacgcagggttcctggcgaggccttcaggcccctgggccgcctggagcagctgtggctgccttacaacgccctcagcgagctcaacgccctcatgctgcggggtctgcgacgcctgcgggagctgcggctgcccgggaaccgcctggccgccttcccctgggcggcgctcagggacgcccccaagctgcggctgctggacctgcaggccaaccgcctctcggctgtgcccgctgaggccgcgcgcttcctggagaacctcaccttcctcgacctctccagcaaccagctgatgaggctcccgcaggagctcatcgtctcctgggctcacctggagaccggtatctttcctcccggccaccaccccaggcgggtcctagggctacaggacaacccctgggcatgtgactgccgactctatgacctggttcatcttttggatggctgggccccaaacttggccttcattgagactgaactgagatgtgccagcccacgtagcctggccggagtggccttcagccagcttgaactgaggaagtgccagggcccagagctccatccaggagtggccagcatcaggtcccttttgggtggcacagcattgctacgctgtggagctactggagtccctgggcccgagatgagctggaggagggccaatggcaggccccttaacggtacagtgcaccaggaagtctccagtgacggcacgagctggactctgctgggcctgcctgcagtgtcccaccttgactccggagactacatctgccaagccaagaacttcctgggagcctctgaaactgttatctccttgattgtcactgagccgccgacttccacagaacacagtgggagcccaggggcactatgggcaaggacaggtggcggaggggaagctgctgcttacaacaacaagctggtggccaggcatgtcccccagattcccaaacccgctgtcctggccactggaccctctgtgcccagcacaaaggaggagctgacccttgagcacttccagatggatgccctgggagagctctctgatgggcgggcaggaccctcagaggcacgaatggtgaggtctgtgaaggtggtgggggacacttaccacagcgtgtccttggtgtggaaggcaccccaggctaagaacacaactgccttcagtgtcctctacgcggtctttgggcagcacagcatgcggcgggtgattgtgcagcctgggaagaccagagtgaccatcactgggctgttgcccaagaccaagtatgtggcgtgtgtctgtgtgcagggcctggtgccccggaaggagcagtgtgttattttctccaccaatgaagtggtggatgctgagaacactcagcagcttatcaatgtggtggtgatcagtgtggccatcgtcattgccctgcctctcacgctgcttgtctgctgcagtgctcttcagaagcgctgccgaaagtgcttcaacaaggactccactgaggccacagttacctacgtcaacctagagagactgggctacagcgaggacggcttggaggagctgtcccggcacagtgtcagcgaggctgacaggcttctctcagctcgttccagtgtggactttcaggcctttggagtcaaagggggcaggagaatcaatgagtacttctgctgagggatatgcctccgcaactcacacacctgcctgcccacgctccttctttagctctgacacctgagtacacgatcacccactcttacctgctcgggtacctgcttactcagatacttacacacaacaacagcagcagcaagctgctactgcaacaaccgctaacacttgttaagcacttactacagactagaaagtgttctaagtgc

SEQ ID NO: 62238 - DNA, 6382 bp, Homo sapiens
ggctgctgctctcagcggcggggctcgccagcgcttcagtgggcggggacgcggcaggtgactccagaccaaggaggatgagctgctgtccctggaagagaacggatggagggaagcagctcctacgaagttccctctgtggctgctgctgatctggaggagggtgctggtcagactaggagcttgcctgccaccccctccaaagatgttcacaagggtgttggaggcatcatcttttcctcctcaccgattttagacttgagtgaaagtggtctgtgccgtttggaggaggtctttagaatccccagccttcaacaattgcatctgcaaaggaatgccctgtgtgtgattcctcaagatttctttcagttgcttccgaacctgacttggctggacctccggtacaatagaattaaagcgcttccttctgggattggagctcaccagcatttgaaaactttgcttttagaaagaaatcctatcaaaatgttacctgtggagctggggagcgtaaccacgctgaaagcactgaacctaagacactgccctctggaattccctcctcagctcgttgtgcagaagggattggtggctatccagcgcttcctgcggatgtgggcagtagaacactctctccccagaaatccaacttctcaagaggctccaccggttagagagatgaccctccgtgacctcccgagcccaggactggagttgtctggagaccacgcgtctaaccaaggagctgtgaacgctcaggacccagagggggctgtgatgaaagagaaggccagctttctcccacctgtggaaaagccagacctgagtgaactcaggaagtctgcggactcctcagagaactggcccagcgaggaggagatcaggcgcttttggaagctgaggcaggagattgttgagcacgtgaaggcagacgttctgggagatcagctcttgacgagggaattacctccaaatctcaaggcggccttgaacattgagaaagaactaccaaagccaagacacgttttcagaaggaagacagcctcctccaggagcatcttacccgacctcttgtcaccgtaccaaatggcgatccgagcaaaaagactggaagagagccgagcggcggcgctccgagagctccaggagaagcaggctctgatggagcagcagagacgagagaaaagggcactgcaggagtggagagagcgagcccagaggatgaggaagaggaaggaagagctcagcaaactcctgcctccgcggaggagcatggtggcatcaaagattccctctgccacagatctgatagataacaggaaagtaccactgaatccgcctggaaaaatgaaaccaagcaaagagaaatcgccacaagcaagtaaagaaatgagtgccctgcaggagagaaatttagaagagaagataaaacagcacgtcctccaaatgcgtgagcaaagaagattccatggccaggccccactggaggagatgaggaaggctgccgaggatctggaaattgccacagagctacaggatgaagtattgaagctaaaattgggattaaccttgaacaaagatcgtcgacgggcggccctcactggaaacctttcgcttggcctgccggcagcacagcctcaaaatacattttttaacacaaaatatggagaatcaggaaatgttcgcagataccagtgacaccaggtggctggactgatggagacgtcttcagacaggagccgctcagtcttctttcccgggcgtcgcctcctgtgtggtgccggaagagcgccaggttcagtgttaccctgagggctgatttcgcgcagcctgttgttttccttagacaggtccacgtccctctcctgaggctgtggaagatttcagccgtattaaaagaaaggacactgtgagcacgtggtctcgccttcccttcttcctgcaggttcccgccaagccatgtgacagagtgctcacactcaggcacttgcctctctcctgtcctggagcccttgttacaaaagtactcacagctttccttcacttagttatttgagtgtgggagaggagaccaggtcacccgattcccgccaagccggaagtccctgcagcaccacctttggctaggagggaggggtgacagccaaaaagggcttcgggggagtggttaccctgctccctgcccagtgacaagccctcctttcccctgggggccctcctttcccctgctccctgcccagctacggggccctcctttcagccttgaccccttcctggttgctaccactcaggctgccactcagtggactccaccccagggacacggcagggtctgcagacctccccatgctagatcagccgtatttcatgctctgtctgcccaggctgtgtagattctgtgtgacttagtctcttgtgctgagtgtttgcttggatcttgaaaacatctttggtttgatttctttaacagaggtgagactattcagactttgtttatttttgtgttaattttggtaaatatggtttcagtgagtttcctcatttcatccaagttgtgcaatgtatcagcataaagttcctcttattttcagtatctttaggatccgtaataatgtcccctcttttattcttgacctggtgttcttcatcattcttgctatggatttatcaattttgttcctcttttccaaaagccccaggttttggcttcactggatttgctgtttgtcttctgtctcatgggtctctgcgccctgcacttcgtactttccgagagtttaactggtgcttagagagaaatgcatcacttccaaacccatgtattagagaagaagggcgtgaaatttatcacctaagctttccattcaggaagctagaaaaggtgtcagtgacctgttgcggcccagcggctggagcagcagacgtttgccatttctcacgcctgagggcaggcgttggagcagctcagccggcgttgctggtcagggtctcccgtgaggctggagtcagccgtgggttgagctgctctcctctgaaggtttaactgggcttggggctcagcttccaaggtgctcacctggttgttgatcagagagcgtgtccgttgtgatcccagtcctttgaaactgtgaagcctcgccccgcggcctgccgcaggatatgttttggtaaatgtagactgtgcacttgagaagaatgtattttgagttgttgggtacattgttttgtgtgtgtcaggtgacattgactaatcctgttgctcagagctcctgtacccttactgactgacttaagcctggtttctcagttactgagagaggcctgtgaacagttctagctatgatcatgaacatgtgttttcttcttagttatgtgagtttttgctatacgtgttttggggctattttgtcagatgcctacaaatttaggattgttttatcttcctgtcgaactgaccttgtcattattatgaactatttctcttcgcctctccttttcacttcttgccttctgtggattttgtctgatactaatccaggcacactgctgctgttttggtcagcgttttcataatgcatcttcttccctccttctactgtactggatttaaagcgcaccttatagagacatcatatactcgggactccttttctttctctagctgccagttctgtgtttcagttacagtgtttggccctcacatttaaggtgcgtgtgcgtacggcggattccgtgcccatctcatgtttttattccctttattcttcttttgctgctttctgatagtgatcaatttttttatttatatctcttgtattagagttttagtaatatcttttaatattattctcttgggtgttgccttagagatttcatacatgcccttgagttcattagcatttcctgaatgagccaatgaccctgagaaggtccctcccatctgccagttccctgcccttgatgctgttgctctcgtccgcctcccttccacaggtaagcacgcaagacacaggtaccgtgtgccccaacggtgtcttgactcgctgttcctagacatcagtgtttgcttcactttacccatcccgatgctcttccttcctgcagcttcatgctccaatgagggctgattttcatttagctaaataacttttttttaagtatttctttgtatcatggttatgctttgactggccgtaagttctctcagcttttgtttgtctgaaaataaatttagttcgcctttattctgcacaggacagaattctaggtggatgatttttgccattcccagaactttaaagatgggctccactgtcttctggctcccatgtgttttgttaaaaattcagtgttcaggccgggtgctgtggctcacgcctgtaatcccagcactttgggaggccgaggcgagtggatcacgaggtcaggagatcgagaccatcctggctaacacggtgaaaccccgtctctactaaaaaatacaaaaaattagccgggcgtggtggcaggcacctgtagtcgcagctactcaggaggctgaggcgggagaatggcgtgaacccaggagacggagcttgcagtgagccgagatcgcgccactgcactccagcctgggcgacagagcgagactccgtctcaaaaaaaaaaaaaaaaagattcaatgttcattgttatttgttgctcctttgaaggtaatgtgtcttttttctttgtcttaaaattgtttctccttatctttggttttcagcagtctgtgctgtgcctggatgtgattttctttttacgtatttttcttggaatatacagaactcaaatctgggagttagcatctttcatcagttttggaaaattcttagccattttttttttttttactattttttcccctgttctccctcttctccctgagacttcagttttgtgtgtgtgtgcacatgtatgtatgcattcgtgcgtacgagtgtgtgcatgtgtgcgcccgtgtgtatgtgcatatgtgagtgtgtgtggctgtaacctgcacgtctcttctgtcatgtgttctatttttcattcctctctgtacatcaggctagatgcctcctgtctacgtggttttagatttacgaatcctgtcttctgttgtgtcccacagaaaaacccatgaggttttttaacattaaaaacagcagctttatgatagagaaaaaaacacaaacatagacgattgtaccattgcactcagaagaaacatcccaggccctgagcagcgtgtctttcctcggccgagtcaggcttcctggtgagcctcagggagtgcatggtctcagatgccatccttctcttctccagcatttccactcacctccgtgttcttggggagtgcgtggtgtcagatcccatcctgctcctctccagagtttccggtcacctccgtgttctcagggagtgcgtggtcttggatgccatcctgctcatctccagcatttcctctcacctccgtgttctcggggagtgcgtggtgtcagatcccatcctgctcatctccagcatttcctctcacctctgtgttctcggggagtgcgtggtgtcagatcccatcctgctcctctccagcatttcctctcacctccgtgttctcggggagtgcgtggtgtcagatcccatcctgctcctctccagagtttcctctcacctccgtgttctcggggagtgcgtggtctcagatcccatcctgctcctctccagagtttcctctcacctccgtgttctcagggagtgcgtggtcttggatgccatcctgctcatctccagcatttcctctcacctccgtgttctcggggagtgcgtggtgtcagatcccatcctgctcctctccagcatttcctctcacctccgagctctcggggagtgcgtggtctcagatcccatcctgctcctctccagagtttcctctcacctccgtgttctcgttctcatctctgccggaattccacatctgctcgtgcatgccatccaccttttccactagatccttttacatcatcattataatgatttttttttaataagtgttttctttcagttttaaatttcagatgttgtgtttttcaggtctaaggtgtctggtaattttttgtggatgccgattctctgttgaaattctccatcttttcatttcctttatatctcttttcttcttttttctataatatattacatttttctaataagtttttagtgagtgtccagcattgtataagttgacccttgaacaagagtttgaattataagggtccacttataagtggatttttaaaaaaatatatattgcaaaaatttttggaaatttgcaacaatttgaaaaactttgcagatgagccacatagcctagaaatatctg

SEQ ID NO: 62239 - DNA, 1371 bp, Homo sapiens
ggacttgcaaacgcagggaaagggtgagacctttcaaagctgccaagtgggcaagcttccagcagcagtctgggagcgagcgacagagccaccaagctgggcggcagggcattgagcctcgcgtttcaatttctgttcagttctcctgtaatggaaaattgctttgcacaaagctgaagtgttacagttctttccagcgcccctcccccgcccctccccccgaccggcagccttcggatcagaggacagagcccgcaggaaggtgaaaggagggtggttgtggcttcttactatgtcccttgcttcaggccctggccctgggtggttactcttttcctttggaatggggctggtatcagggtcaaagtgtccaaataattgtctgtgtcaagcccaagaagtaatctgcacagggaagcagttaaccgaatacccccttgacatacccctgaacacccggaggctgttcctgaacgagaacagaatcactagtttgccagcaatgcatctaggactcctcagtgaccttgtttatttggactgtcagaacaaccggattcgagaggtgatggattataccttcatcggggtcttcaaactcatctaccttgacctcagctccaacaacctaacctcgatctccccattcactttctcggtgctcagcaacctggtgcagctgaacattgccaacaaccctcacctgttatcgcttcacaagttcacctttgccaacaccacctctttgaggtacctggacctcagaaataccggcttgcagaccctggacagtgctgccttataccacctcactactctggagaccctgtttctgagtggaaacccctggaagtgcaactgctctttcctggacttcgccatcttcttaatagtgttccatatggacccctcagatgatctaaatgccacatgtgtggagcccacagagctgacagggtggcccatcacccgggtggggaacccactccgatacatgtgcatcacgcacctagaccacaaagactacatcttcctgctgctcatcggcttctgcatcttcgccgcgggaactgtggctgcctggctcacaggtgtgtgtgctgtgctctaccagaacacccgccacaagtcgagtgaagaagatgaggacgaggccgggactagggtggaagtcagcaggcggatttttcaaacccagacgagctcggtccaggagtcccctcagcttatttagttgccagagaccactatcttatgtgcctcccccaggctccctgctttctctcttgccctccccatcccaccaccttggagctgtcatagagattgaaaccttctagtaaaataaataaaatctctgctggccatttc

SEQ ID NO: 62240 - DNA, 777 bp, Homo sapiens
atggcttcaggggatgcaggacgctcccctgagctgcctgtcaccgactaagtggagcagtgtttcttccgcagactcaactgagaagtcagcctctgcggcaggcaccaggaatctgccttttcagttctgtctccggcaggctttgaggatgaaggctgcgggcattctgaccctcattggctgcctggtcacaggcgccgagtccaaaatctacactcgttgcaaactggcaaaaatattctcgagggctggcctggacaattactggggcttcagccttggaaactggatctgcatggcgtattatgagagcggctacaacaccacagcccagacggtcctggatgacggcagcatcgactacggcatcttccagatcaacagcttcgcgtggtgcagacgcggaaagctgaaggagaacaaccactgccacgtcgcctgctcagccttggtcactgatgacctcacagatgcgattatctgtgccaagaaaattgttaaagagacacaaggaatgaactattggcaaggctggaagaaacactgtgaggggagagacctgtccgactggaaaaaagactgtgaggtttcctaaactggaactggacccaggatgctttgcagcaacgccctagggtttgcagtgaatgtccaaatgcctgtgtcatcttgtcccgtttcctcccaatattccttctcaaacttggagagggaaaattaagctatacttttaagaaaataaatatttccatttaaatgtcttcaccctgaaaa

SEQ ID NO: 62241 - DNA, 886 bp, Homo sapiens
agtggatgattaatgaagtagcatctgaaaaacccaaggaaccaaatgtaggtggagcaacttccctgcaacacacgtcgaagctgctgcagtggctgttcttcccctccccttggaaaggcaccaaaagccagcctttggaagggctggtggactgtgcccttctttcccttcagagaaccagtgtccctgtgactccacccactcatctggccaccgttgccctgacctgccaggagcctggagaagatgaaggcatccgtggttctctccctccttggctacctggtggttccaagtggtgcttacatcttggggcgttgcacagtggctaagaaactccacgatggaggcctggattattttgagggctatagccttgagaactgggtgtgcctggcctacttcgagagcaagttcaaccccatggccatctacgagaacacacgtgagggctacactggctttggcctctttcagatgcgtggcagtgactggtgtggcgaccatggcaggaaccgctgccatatgtcatgttccgctttactgaatcctaatttagagaagacaattaaatgtgccaagaccattgtaaaaggaaaagaagggatgggagcatggcccacctggtcccggtactgccagtactccgataccctggcacggtggctggatggttgcaagctgtagccgcctgcatggcccctgcagcactcaccagttgcatcttgtgaatgaaggtgcttttctgcttgctgcttcagtcaatccttttgatgatctcaccactttaagagttccagatggaaaaagacaaaagtttgcttcatccggggatgcaggatgcagaataaaccaaactagttactcaaaaaaaaaaaaaaaa

SEQ ID NO: 62242 - DNA, 1666 bp, Homo sapiens
gattctcgccctgagcaacggcctgacgtcggtggagggaagcaggcgcaggctccgtgaggaggcaaggttctgaggagacaggccccggagcagcactagctcctgcccacactcctacctgctgccctgaccagagtcatcatgccacttgagcagaggagtcagcactgcaagcctgaggaaggccttgaggcccaaggagaggccctgggcttggtgggtgcgcaggctcctgctactgaggagcaggagactgcctcctcctcctctactctagtggaagtcaccctgcgggaggtgcctgctgccgagtcaccaagtcctccccacagtcctcagggagcctccaccctccccactaccatcaactatactctctggagtcaatccgatgagggctccagcaacgaagaacaggaagggccaagcacctttcctgacctggagacgagcttccaagtagcactcagtaggaagatggctgagttggttcattttctgctcctcaagtatcgagccagggagccattcacaaaggcagaaatgctggggagtgtcatcagaaatttccaggacttctttcctgtgatcttcagcaaagcctccgagtacttgcagctggtctttggcatcgaggtggtggaagtggtccgcatcggccacttgtacatccttgtcacctgcctgggcctctcctacgatggcctgctgggcgacaatcagatcgtgcccaagacaggcctcctgataatcgtcctggccataatcgcaaaagagggcgactgtgcccctgaggagaaaatctgggaggagctgagtgtgttggaggcatctgatgggagggaggacagtgtctttgcgcatcccaggaagctgctcacccaagatttggtgcaggaaaactacctggagtaccggcaggtccccggcagtgatcctgcatgctacgagttcctgtggggtccaagggccctcgttgaaaccagctatgtgaaagtcctgcaccatttgctaaagatcagtggaggacctcacatttcctacccacccctgcatgaatgggcttttagagagggggaagagtgagtctgagcacgagttgcagccagggccagtgggagggggtctgggccagtgcaccttccaaggccccatccattagtttccactgcctcgtgtgacatgaggcccattcttcactctttgaagagagcagtcagtattgttagtagtgagtttctgttctattggatgactttgagatttatctttgtttcctgttggaattgttcaaatgttccttttaacggatggttgaatgaacttcagcatccaagtttatgaatgacagtagtcacacatagtgctgtttatatagtttaggagtaagagtgttgttttttattcagattgggaaatccattccattttgtgaattgtgacaaataacagcagtggaaaaagtatgtgcttagaattgtgaaagaattagcagtaaaatacatgagataaagacctcaagaagttaaaagatacttaattcttgccttatacctcactctattctgtaaatttgaaaaaaaagcatggatacctggatatccttggcttctttgagaatttaagagaaattaaatctgaataaataaaaaaaaaaaaaaaa

SEQ ID NO: 62243 - DNA, 1753 bp, Homo sapiens
gagattctcgccctgagcaacgagcgacggcctgacgtcggcggagggaagccggcccaggctcggtgaggaggcaaggttctgaggggacaggctgacctggaggaccagaggcccccggaggagcactgaaggagaagatctgccagtgggtctccattgcccagctcctgcccacactcccgcctgttgccctgaccagagtcatcatgcctcttgagcagaggagtcagcactgcaagcctgaagaaggccttgaggcccgaggagaggccctgggcctggtgggtgcgcaggctcctgctactgaggagcaggaggctgcctcctcctcttctactctagttgaagtcaccctgggggaggtgcctgctgccgagtcaccagatcctccccagagtcctcagggagcctccagcctccccactaccatgaactaccctctctggagccaatcctatgaggactccagcaaccaagaagaggaggggccaagcaccttccctgacctggagtccgagttccaagcagcactcagtaggaaggtggccgagttggttcattttctgctcctcaagtatcgagccagggagccggtcacaaaggcagaaatgctggggagtgtcgtcggaaattggcagtatttctttcctgtgatcttcagcaaagcttccagttccttgcagctggtctttggcatcgagctgatggaagtggaccccatcggccacttgtacatctttgccacctgcctgggcctctcctacgatggcctgctgggtgacaatcagatcatgcccaaggcaggcctcctgataatcgtcctggccataatcgcaagagagggcgactgtgcccctgaggagaaaatctgggaggagctgagtgtgttagaggtgtttgaggggagggaagacagtatcttgggggatcccaagaagctgctcacccaacatttcgtgcaggaaaactacctggagtaccggcaggtccccggcagtgatcctgcatgttatgaattcctgtggggtccaagggccctcgttgaaaccagctatgtgaaagtcctgcaccatatggtaaagatcagtggaggacctcacatttcctacccacccctgcatgagtgggttttgagagagggggaagagtgagtctgagcacgagttgcagccagggccagtgggagggggtctgggccagtgcaccttccggggccgcatcccttagtttccactgcctcctgtgacgtgaggcccattcttcactctttgaagcgagcagtcagcattcttagtagtgggtttctgttctgttggatgactttgagattattctttgtttcctgttggagttgttcaaatgttccttttaacggatggttgaatgagcgtcagcatccaggtttatgaatgacagtagtcacacatagtgctgtttatatagtttaggagtaagagtcttgttttttactcaaattgggaaatccattccattttgtgaattgtgacataataatagcagtggtaaaagtatttgcttaaaattgtgagcgaattagcaataacatacatgagataactcaagaaatcaaaagatagttgattcttgccttgtacctcaatctattctgtaaaattaaacaaatatgcaaaccaggatttccttgacttctttgagaatgcaagcgaaattaaatctgaataaataattcttcctcttcaaaaaaaaaaaaaaaaaaaaaaaaaaaaaa

SEQ ID NO: 62244 - DNA, 1724 bp, Homo sapiens
agagacaagcgagcttctgcgtctgactcgcagcttgagactggcggagggaagcccgcccaggctctataaggagacaaggttctgagcagacaggccaaccggaggacaggattccctggaggccacagaggagcaccaaggagaagatctgcctgtgggtccccattgcccagcttttgcctgcactcttgcctgctgccctgaccagagtcatcatgtcttctgagcagaagagtcagcactgcaagcctgaggaaggcgttgaggcccaagaagaggccctgggcctggtgggtgcacaggctcctactactgaggagcaggaggctgctgtctcctcctcctctcctctggtccctggcaccctggaggaagtgcctgctgctgagtcagcaggtcctccccagagtcctcagggagcctctgccttacccactaccatcagcttcacttgctggaggcaacccaatgagggttccagcagccaagaagaggaggggccaagcacctcgcctgacgcagagtccttgttccgagaagcactcagtaacaaggtggatgagttggctcattttctgctccgcaagtatcgagccaaggagctggtcacaaaggcagaaatgctggagagagtcatcaaaaattacaagcgctgctttcctgtgatcttcggcaaagcctccgagtccctgaagatgatctttggcattgacgtgaaggaagtggaccccgccagcaacacctacacccttgtcacctgcctgggcctttcctatgatggcctgctgggtaataatcagatctttcccaagacaggccttctgataatcgtcctgggcacaattgcaatggagggcgacagcgcctctgaggaggaaatctgggaggagctgggtgtgatgggggtgtatgatgggagggagcacactgtctatggggagcccaggaaactgctcacccaagattgggtgcaggaaaactacctggagtaccggcaggtacccggcagtaatcctgcgcgctatgagttcctgtggggtccaagggctctggctgaaaccagctatgtgaaagtcctggagcatgtggtcagggtcaatgcaagagttcgcattgcctacccatccctgcgtgaagcagctttgttagaggaggaagagggagtctgagcatgagttgcagccagggctgtggggaaggggcagggctgggccagtgcatctaacagccctgtgcagcagcttcccttgcctcgtgtaacatgaggcccattcttcactctgtttgaagaaaatagtcagtgttcttagtagtgggtttctattttgttggatgacttggagatttatctctgtttccttttacaattgttgaaatgttccttttaatggatggttgaattaacttcagcatccaagtttatgaatcgtagttaacgtatattgctgttaatatagtttaggagtaagagtcttgttttttattcagattgggaaatccgttctattttgtgaatttgggacataataacagcagtggagtaagtatttagaagtgtgaattcaccgtgaaataggtgagataaattaaaagatacttaattcccgccttatgcctcagtctattctgtaaaatttaaaaaatatatatgcatacctggatttccttggcttcgtgaatgtaagagaaattaaatctgaataaataattctttctgttaa

SEQ ID NO: 62245 - DNA, 1721 bp, Homo sapiens
ttagagagaagcgagctgctctgaccagccgcttgggattggcggagggaagcgggccaggccctgtgaggagtcaaggttctgagcagacaggccaaccggaggacaggattccctggaggccacagaggagcaccaaggagaagatctgcctgtgggtccccattgcccagcttttgcctgcactcttgcctgctgccctgaccagagtcatcatgtcttctgagcagaagagtcagcactgcaagcctgaggaaggcgttgaggcccaagaagaggccctgggcctggtgggtgcacaggctcctactactgaggagcaggaggctgctgtctcctcctcctctcctctggtccctggcaccctggaggaagtgcctgctgctgagtcagcaggtcctccccagagtcctcagggagcctctgccttacccactaccatcagcttcacttgctggaggcaacccaatgagggttccagcagccaagaagaggaggggccaagcacctcgcctgacgcagagtccttgttccgagaagcactcagtaacaaggtggatgagttggctcattttctgctccgcaagtatcgagccaaggagctggtcacaaaggcagaaatgctggagagagtcatcaaaaattacaagcgctgctttcctgtgatcttcggcaaagcctccgagtccctgaagatgatctttggcattgacgtgaaggaagtggaccccgccagcaacacctacacccttgtcacctgcctgggcctttcctatgatggcctgctgggtaataatcagatctttcccaagacaggccttctgataatcgtcctgggcacaattgcaatggagggcgacagcgcctctgaggaggaaatctgggaggagctgggtgtgatgggggtgtatgatgggagggagcacactgtctatggggagcccaggaaactgctcacccaagattgggtgcaggaaaactacctggagtaccggcaggtacccggcagtaatcctgcgcgctatgagttcctgtggggtccaagggctctggctgaaaccagctatgtgaaagtcctggagcatgtggtcagggtcaatgcaagagttcgcattgcctacccatccctgcgtgaagcagctttgttagaggaggaagagggagtctgagcatgagttgcagccagggctgtggggaaggggcagggctgggccagtgcatctaacagccctgtgcagcagcttcccttgcctcgtgtaacatgaggcccattcttcactctgtttgaagaaaatagtcagtgttcttagtagtgggtttctattttgttggatgacttggagatttatctctgtttccttttacaattgttgaaatgttccttttaatggatggttgaattaacttcagcatccaagtttatgaatcgtagttaacgtatattgctgttaatatagtttaggagtaagagtcttgttttttattcagattgggaaatccgttctattttgtgaatttgggacataataacagcagtggagtaagtatttagaagtgtgaattcaccgtgaaataggtgagataaattaaaagatacttaattcccgccttatgcctcagtctattctgtaaaatttaaaaaatatatatgcatacctggatttccttggcttcgtgaatgtaagagaaattaaatctgaataaataattctttctgttaa

SEQ ID NO: 62246 - DNA, 1712 bp, Homo sapiens
cgagctgctgtctgaccagcagcttgggattggtggaaggaagcaggccaggccctgtgaggagtcaaggttctgagcagacaggccaaccggaggacaggattccctggaggccacagaggagcaccaaggagaagatctgcctgtgggtccccattgcccagcttttgcctgcactcttgcctgctgccctgaccagagtcatcatgtcttctgagcagaagagtcagcactgcaagcctgaggaaggcgttgaggcccaagaagaggccctgggcctggtgggtgcacaggctcctactactgaggagcaggaggctgctgtctcctcctcctctcctctggtccctggcaccctggaggaagtgcctgctgctgagtcagcaggtcctccccagagtcctcagggagcctctgccttacccactaccatcagcttcacttgctggaggcaacccaatgagggttccagcagccaagaagaggaggggccaagcacctcgcctgacgcagagtccttgttccgagaagcactcagtaacaaggtggatgagttggctcattttctgctccgcaagtatcgagccaaggagctggtcacaaaggcagaaatgctggagagagtcatcaaaaattacaagcgctgctttcctgtgatcttcggcaaagcctccgagtccctgaagatgatctttggcattgacgtgaaggaagtggaccccgccagcaacacctacacccttgtcacctgcctgggcctttcctatgatggcctgctgggtaataatcagatctttcccaagacaggccttctgataatcgtcctgggcacaattgcaatggagggcgacagcgcctctgaggaggaaatctgggaggagctgggtgtgatgggggtgtatgatgggagggagcacactgtctatggggagcccaggaaactgctcacccaagattgggtgcaggaaaactacctggagtaccggcaggtacccggcagtaatcctgcgcgctatgagttcctgtggggtccaagggctctggctgaaaccagctatgtgaaagtcctggagcatgtggtcagggtcaatgcaagagttcgcattgcctacccatccctgcgtgaagcagctttgttagaggaggaagagggagtctgagcatgagttgcagccagggctgtggggaaggggcagggctgggccagtgcatctaacagccctgtgcagcagcttcccttgcctcgtgtaacatgaggcccattcttcactctgtttgaagaaaatagtcagtgttcttagtagtgggtttctattttgttggatgacttggagatttatctctgtttccttttacaattgttgaaatgttccttttaatggatggttgaattaacttcagcatccaagtttatgaatcgtagttaacgtatattgctgttaatatagtttaggagtaagagtcttgttttttattcagattgggaaatccgttctattttgtgaatttgggacataataacagcagtggagtaagtatttagaagtgtgaattcaccgtgaaataggtgagataaattaaaagatacttaattcccgccttatgcctcagtctattctgtaaaatttaaaaaatatatatgcatacctggatttccttggcttcgtgaatgtaagagaaattaaatctgaataaataattctttctgttaa

SEQ ID NO: 62247 - DNA, 1727 bp, Homo sapiens
ggttagagagaagcgagctgctctgtctgaccagcagcttgggattggcggagggaagcgggccaggccctgtgaggagtcaaggttctgagcagacaggccaaccggaggacaggattccctggaggccacagaggagcaccaaggagaagatctgcctgtgggtccccattgcccagcttttgcctgcactcttgcctgctgccctgaccagagtcatcatgtcttctgagcagaagagtcagcactgcaagcctgaggaaggcgttgaggcccaagaagaggccctgggcctggtgggtgcacaggctcctactactgaggagcaggaggctgctgtctcctcctcctctcctctggtccctggcaccctggaggaagtgcctgctgctgagtcagcaggtcctccccagagtcctcagggagcctctgccttacccactaccatcagcttcacttgctggaggcaacccaatgagggttccagcagccaagaagaggaggggccaagcacctcgcctgacgcagagtccttgttccgagaagcactcagtaacaaggtggatgagttggctcattttctgctccgcaagtatcgagccaaggagctggtcacaaaggcagaaatgctggagagagtcatcaaaaattacaagcgctgctttcctgtgatcttcggcaaagcctccgagtccctgaagatgatctttggcattgacgtgaaggaagtggaccccgccagcaacacctacacccttgtcacctgcctgggcctttcctatgatggcctgctgggtaataatcagatctttcccaagacaggccttctgataatcgtcctgggcacaattgcaatggagggcgacagcgcctctgaggaggaaatctgggaggagctgggtgtgatgggggtgtatgatgggagggagcacactgtctatggggagcccaggaaactgctcacccaagattgggtgcaggaaaactacctggagtaccggcaggtacccggcagtaatcctgcgcgctatgagttcctgtggggtccaagggctctggctgaaaccagctatgtgaaagtcctggagcatgtggtcagggtcaatgcaagagttcgcattgcctacccatccctgcgtgaagcagctttgttagaggaggaagagggagtctgagcatgagttgcagccagggctgtggggaaggggcagggctgggccagtgcatctaacagccctgtgcagcagcttcccttgcctcgtgtaacatgaggcccattcttcactctgtttgaagaaaatagtcagtgttcttagtagtgggtttctattttgttggatgacttggagatttatctctgtttccttttacaattgttgaaatgttccttttaatggatggttgaattaacttcagcatccaagtttatgaatcgtagttaacgtatattgctgttaatatagtttaggagtaagagtcttgttttttattcagattgggaaatccgttctattttgtgaatttgggacataataacagcagtggagtaagtatttagaagtgtgaattcaccgtgaaataggtgagataaattaaaagatacttaattcccgccttatgcctcagtctattctgtaaaatttaaaaaatatatatgcatacctggatttccttggcttcgtgaatgtaagagaaattaaatctgaataaataattctttctgttaa

SEQ ID NO: 62248 - DNA, 1824 bp, Homo sapiens
ctgggggtcagagagaagggagaggcctccttctgaggggcggcttgataccggtggaggagctccaggaagcaggcaggccttggtctgagacagtgtcctcaggtcgcagagcagaggagacccaggcagtgtcagcagtgaaggttctcgggacaggctaaccaggaggacaggagccccaagaggccccagagcagcactgacgaagacctgcctgtgggtctccatcgcccagctcctgcccacgctcctgactgctgccctgaccagagtcatcatgtctctcgagcagaggagtccgcactgcaagcctgatgaagaccttgaagcccaaggagaggacttgggcctgatgggtgcacaggaacccacaggcgaggaggaggagactacctcctcctctgacagcaaggaggaggaggtgtctgctgctgggtcatcaagtcctccccagagtcctcagggaggcgcttcctcctccatttccgtctactacactttatggagccaattcgatgagggctccagcagtcaagaagaggaagagccaagctcctcggtcgacccagctcagctggagttcatgttccaagaagcactgaaattgaaggtggctgagttggttcatttcctgctccacaaatatcgagtcaaggagccggtcacaaaggcagaaatgctggagagcgtcatcaaaaattacaagcgctactttcctgtgatcttcggcaaagcctccgagttcatgcaggtgatctttggcactgatgtgaaggaggtggaccccgccggccactcctacatccttgtcactgctcttggcctctcgtgcgatagcatgctgggtgatggtcatagcatgcccaaggccgccctcctgatcattgtcctgggtgtgatcctaaccaaagacaactgcgcccctgaagaggttatctgggaagcgttgagtgtgatgggggtgtatgttgggaaggagcacatgttctacggggagcccaggaagctgctcacccaagattgggtgcaggaaaactacctggagtaccggcaggtgcccggcagtgatcctgcgcactacgagttcctgtggggttccaaggcccacgctgaaaccagctatgagaaggtcataaattatttggtcatgctcaatgcaagagagcccatctgctacccatccctttatgaagaggttttgggagaggagcaagagggagtctgagcaccagccgcagccggggccaaagtttgtggggtcagggccccatccagcagctgccctgccccatgtgacatgaggcccattcttcgctctgtgtttgaagagagcaatcagtgttctcagtggcagtgggtggaagtgagcacactgtatgtcatctctgggttccttgtctattgggtgatttggagatttatccttgctcccttttggaattgttcaaatgttcttttaatggtcagtttaatgaacttcaccatcgaagttaatgaatgacagtagtcacacatattgctgtttatgttatttaggagtaagattcttgcttttgagtcacatggggaaatccctgttattttgtgaattgggacaagataacatagcagaggaattaataatttttttgaaacttgaacttagcagcaaaatagagctcataaagaaatagtgaaatgaaaatgtagttaattcttgccttatacctctttctctctcctgtaaaattaaaacatatacatgtatacctggatttgcttggcttctttgagcatgtaagagaaataaaaattgaaagaataaaaaaaaaaaaaaaaaaa

SEQ ID NO: 62249 - DNA, 1626 bp, Homo sapiens
acttccgctttggaggcgaggacccgagcgagtgtagggggtgcggcgtctggtcagccaggggtgaattctcaggactggtcggcagtcaagccatcatgcctcgtggtcagaagagtaagctccgtgcccgtgagaaacgccgcaaggcccgagatgagacccggggtctcaatgttcctcaggtcactgaagcagaggaagaagaggccccctgctgttcctcttctgtttctgggggtgctgcttcaagctctcctgctgctggcattccccagaagcctcagagagccccaaccactgccgctgctgcggctgcgggtgtttcatccacaaaatctaaaaaaggtgccaagagccaccaaggtgagaaaaatgcaagttcctcccaggcctcaacatctactaagagcccaagcgaagatcctctaaccaggaagtcagggtcgttggtgcagttcctgttgtacaagtataaaataaaaaagtccgttacaaagggagaaatgctgaaaattgttggcaaaaggttcagggagcacttccctgagatcctcaagaaagcctctgagggcctcagtgttgtctttggccttgagctgaataaagtcaaccccaacggccacacttacaccttcatcgacaaggtagacctcactgatgaggaatccctgctcagttcctgggactttcccaggagaaagcttctgatgcctctcctgggtgtgatcttcttaaatggcaactcagctactgaggaagagatctgggaattcctgaatatgttgggagtctatgatggagaggagcactcagtctttggggaaccctggaagctcatcaccaaagatctggtgcaggaaaaatatctggagtacaagcaggtgcccagcagtgatcccccacgctttcaattcctgtggggtccgagagcctatgctgaaaccagcaagatgaaagtcctggagtttttggccaaggtaaatggtaccaccccctgtgccttcccaacccattacgaagaagctttgaaagatgaagagaaagccggagtctgagccagagttgtagccaggccttgcactactgccatagccaatcaatctcccaaagccaagtttacctgctgttctcacccccaatgaggtcttaggcagattctttactttgtaattcaaaaggcctgttaacctttgttcttgttatgcatgaataacttgttgactttttttttttctctttttcaactagtgtttcaacaggtttatttagattcagaatgtaaatttacaaatgatatagatcaccctgttattgctgtttttcagggacagtagaaagtgttttgttttttgagtgaaacaacttattaataaaaatccttaaatcacttttgtaatccaggacaagaaaatgtggcattagagtagaaatatctttggaaatgtgaaagaccccatagtgaaatatttgggatcagaagccagaggggtaaaagtggtcaattcttggtttacttcatttaatctttcttttcataaagatacatacctggatttgtttatgttattcaagaatgtgtgagaaattaaaccatagttagttaaaaaaaaaaaaaaaaaaaaa

SEQ ID NO: 62250 - DNA, 2303 bp, Homo sapiens
ataacggggcaatctacccaaacctcttctcagcctagaatgccccaggcagtgcagtcagactgagcatcctctcttttacccttcagagttctcagtgaagtgagagttttgacctaaggtgacctcagttaactagagggaggatccagggtctggcagatatcagggaggaccttgaatgaagaacaggaggagccagaacagtgatgtcccatagaaacccgactccgctgtctgccctcacaggacccaaacatccctggcctaatgtggctcatcaaaacttcagcctagatctcggaggaccttgatctgagcaggattcatggcatggaatgtggagtcccaggactggccagcagcgaagtgaggttcttgagcagggctctggctcacgcttgtaatcccaacattttgggaggacgaagccagcctcatcgcttaagcacaggagttcgaggactgggaggtggaggttgtggcagggctgtggctcacgcttgtaatcccaacattttgggcggaggaagccagcctcatcgcttaagcacaggagttcgcggactgggaggcagggctctggctcacgcttgtaatcccaacattttgggaggacgaagccagcctcatcgcttaagcacaggagttcgaggactgggaggtggaggttgtggtgcctgtatcacctgcccttctgctgacactcctgcctgctgttcctgactacagccatcatgcctcggggtcagaagagtacgctccatgcacgtgagaaacgccagcagacccggggtcagacccaggatcaccagggtgctcagatcactgcaactaacaagaaaaaagtatccttttcatcccctcttattttgggggctactatccagaaaaagtctgctggtaggtcacgtagtgctctcaagaagcctcagagagcactatccaccactacatctgtagatgtttcttacaaaaagtcatacaagggagccaacagcaaaattgagaaaaagcaaagcttctctcagggtctatcctccactgtgcagtctcgcacagaccctctaatcatgaagacaaatatgttggtgcagttcctgatggaaatgtacaagatgaaaaagcccattatgaaagcagatatgctaaaaattgtccaaaaaagccataagaattgcttccctgagatccttaaaaaagcttctttcaacatggaggtggtatttggtgttgatttaaagaaagttgattctaccaaggactcctatgtccttgtcagcaaaatggatctccccaacaatgggacagtgactcgtgggaggggatttcccaagacaggtctcctgctgaatctcctgggcgtgatcttcatgaagggcaactgtgccactgaggagaagatctgggaattcctgaataagatgagaatatatgatgggaagaaacacttcatatttggggagcccagaaagctcatcacccaagatttggtgaagcttaaatacctggagtaccgacaagtgcccaacagtaatcctgcacgctatgaattcctgtggggtccaagagcccatgctgaaaccagcaagatgaaggtcctggagttttgggccaaggtcaataaaactgtccccagtgcgttccagttctggtatgaagaggctttgagagatgaggaagaaagagtccaagctgcagctatgctcaatgatggcagtagtgccatgggcagaaagtgttccaaggccaaggctagcagctcttcccacgcctagtgaagttgaagcaaattttgcattttgtggttaaagagggcagtcactgttccaaggagtgaaggactgggtgttactggagggaacacactgtataataccttttgtttctgttctaaatggataatttgaagttttatctgtattttggggcatatttttcaaatgttccttttatttaacattgtaatctaagtttaggattgatactggtcacatttgttgtttaagagtaaaaattttgctgttttgtaaaacagattgagaaaaattcgatcttatttagtgatctgttgcaagataacttggaattagaataagcatttccttgaaaatgtttaaaaaaaaaaagtcagcagtaaaatgtatggcattaagaaatagagaaagagtgtaagatggtcaatatttggtttcctaaatgcttttactctgtgttttaagaaaatgaaagataaataaccatatatgtctggcttacttaagaatgtagaattaaatcataataaattagacctcatgctg

SEQ ID NO: 62251 - DNA, 2142 bp, Homo sapiens
aggatttcatttgctcttctccaggaaccacatcacctgcccttctgcctacactcctgcctgctgtgcctaaccacagccatcatgcctcggggtcagaagagtaagctccgtgcccgtgagaaacgccagcggacccgtggtcagacccaggatctcaaggttggtcagcctactgcagcagagaaagaagagtctccttcctcttcctcatctgttttgagggatactgcctccagctcccttgcttttggcattccccaggagcctcagagagagccacccaccacctctgctgctgcagctatgtcatgcactggatctgataaaggcgacgagagccaagatgaggaaaatgcaagttcctcccaggcctcaacatccactgagagatcactcaaagattctctaaccaggaagacgaagatgttagtgcagttcctgctgtacaagtataaaatgaaagagcccactacaaaggcagaaatgctgaagatcatcagcaaaaagtacaaggagcacttccctgagatcttcaggaaagtctctcagcgcacggagctggtctttggccttgccttgaaggaggtcaaccccaccactcactcctacatcctcgtcagcatgctaggccccaacgatggaaaccagagcagtgcctggacccttccaaggaatgggcttctgatgcctctactgagtgtgatcttcttaaatggcaactgtgcccgtgaagaggaaatctgggaattcctgaatatgctggggatctatgatggaaagaggcaccttatctttggggaaccccgaaagctcatcacccaagatctggtgcaggaaaaatatctggaataccagcaggtgcccaacagtgatcccccacgctatcaattcctgtggggtccaagagctcatgcagaaaccagcaagatgaaagtcctggagtttttggccaaggtgaatgacaccacccccaataacttcccactcctttatgaagaggctttgagagatgaagaagagagagctggagcccggcccagagttgcagccaggcgtggcactacagccatgactagtgcgtattccagggccacatccagtagctcttcccaacccatgtgagatctaaggcaaattgttcactttgtggttgaaagacctgctgctttctctgttcctgtgatgcatgaataactcattgatttatctctttgttgtattttccatgatgtttcttaaaatagaaagtttatttagattcagaatataaatttagaaatggcatgcatcacacatttattgctgtttatcaggttggtttagtgataataattttgtttttgaaatacaaatagaaaatcctgaaataatttttgtgatacagagcaaaataacacggcatgggagtaaggttatccttagaaatttaaaataactccacagtaaaataggtagaatctgaagatagaaagggaagaaaagtaaaagttgctttattcgtggtttgtcttactcagttcagtctttttttgctcataaatttaaaagttacatacctggtttgcttagattattcaagaatgtggaggcctgggccaaggtcaatgacagtgtctccattgtcttccctccattaagagaagactttaagagatgagggagagagagccagagacagtgttgcaactgggcctggcatgtttcagtgtggtgtccagcagtgtctcccactccttgtgaagtctgaggtatattctttacttttgattaagaaaacacttaaccttctaattaatggagagccaaaggggagttggtgggaacaccatgtataacatatttgtatgtaaaatgatttatcttttctttttcctgtttttcagtgttctttttttaaattgtagatttatttagtttcagaatctaagtttatgaatggcatgaatcactcatttattaaaatatatcaggttggagagtgagaatttttgcattatgtaaaacaatttaaaaatcttttaagtctttttctgtgatctagaacaagataatatggcattggaatatggaatttgtgaaaaggaaattaccttgcaataaagttggtgggaccaggaagtagagaaaaaaaaagtaaaa

SEQ ID NO: 62252 - DNA, 1949 bp, Homo sapiens
aataaaggggtctgagccggtcgcctgagcctgaaaagtgctgtcacgtcagcggaaggaggcgtcccagatcttctcagctgtcttggtgccagccttcctagtcttcctacccacactcctacctgctgtcacaggccacagccatcatgcctcggggtcacaagagtaagctccgtacctgtgagaaacgccaagagaccaatggtcagccacagggtctcacgggtccccaggccactgcagagaagcaggaagagtcccactcttcctcatcctcttctcgcgcttgtctgggtgattgtcgtaggtcttctgatgcctccattcctcaggagtctcagggagtgtcacccactgggtctcctgatgcagttgtttcatattcaaaatccgatgtggctgccaacggccaagatgagaaaagtccaagcacctcccgtgatgcctccgttcctcaggagtctcagggagcttcacccactggctctcctgatgcaggtgtttcaggctcaaaatatgatgtggctgccaacggccaagatgagaaaagtccaagcacttcccatgatgtctccgttcctcaggagtctcagggagcttcacccactggctcgcctgatgcaggtgtttcaggctcaaaatatgatgtggctgccgagggtgaagatgaggaaagtgtaagcgcctcacagaaagccatcatttttaagcgcttaagcaaagatgctgtaaagaagaaggcgtgcacgttggcgcaattcctgcagaagaagtttgagaagaaagagtccattttgaaggcagacatgctgaagtgtgtccgcagagagtacaagccctacttccctcagatcctcaacagaacctcccaacatttggtggtggcctttggcgttgaattgaaagaaatggattccagcggcgagtcctacacccttgtcagcaagctaggcctccccagtgaaggaattctgagtggtgataatgcgctgccgaagtcgggtctcctgatgtcgctcctggttgtgatcttcatgaacggcaactgtgccactgaagaggaggtctgggagttcctgggtctgttggggatatatgatgggatcctgcattcaatctatggggatgctcggaagatcattactgaagatttggtgcaagataagtacgtggtttaccggcaggtgtgcaacagtgatcctccatgctatgagttcctgtggggtccacgagcctatgctgaaaccaccaagatgagagtcctgcgtgttttggccgacagcagtaacaccagtcccggtttatacccacatctgtatgaagacgctttgatagatgaggtagagagagcattgagactgagagcttaaggcagggctggcactatttccttggccagggtaccttatggggccatatcctacagatcctcccatttctagggaggtctgaagtagaattttcactttatgttagaagagagtagtgagctttctaagtagtgcagtatagtagaggctggagggaacaagatatgtatctttcttttgttacacatgagtaacttgcagatttatgttttatctctgtcagttatcaacattgttcctgttaagtgaaggtttattttgcttcagattatacaattatcaataacatagctctcacattcatggctgtttaaccaatctgaaagttacggtttgggaattaataaaacaaagtcatacaacacattttctttgtaattgagaactagataacatggtaacagagaattgattttcatatgaatcttaactccacagtaaaatagttgacatcataatatgaagagaaagaaaaggaaaaacagaaatgtaaaagttgtttaattcttggtttgcctaattcgttttcctatttcttttcatacaaataaaggatacctggatttatttaggtta

SEQ ID NO: 62253 - DNA, 2666 bp, Homo sapiens
aagattatagagacttgctttagaaccacaagaagaaagaggaggccggcttttcagctagcatcatggcgtggccgtgcatcacgagggcctgctgcatcgcccgcttctggaaccagttggacaaagcggacatcgctgtgccgctggttttcaccaagtactcggaggccaccgagcacccgggcgccccgccgcagccaccgccgccgcagcagcaggcgcagccggcgctcgcgcccccctcggcgcgcgcggttgccatagagacgcagccagcccagggcgagttggatgcagttgcccgggcaacggggccagcgcctgggcctaccggcgagcgcgagccggcggcgggccccggccggagcgggccgggcccgggcctgggctccggctccacctccggccccgcggactcggtgatgcggcaggattaccgagcctggaaggtgcagcggcccgagcccagctgccggccgcgcagcgaataccagccctccgacgctcccttcgagcgcgagacccagtaccagaaggacttccgcgcctggccgctgccgcgccgcggggaccacccgtggatccccaagcccgtgcagatctctgcggcctcccaggcgtcggcgcccattctcggggcgcccaagcgccggccgcagagccaggagcgctggccagtgcaggccgccgctgaggcccgggagcaggaggcggcccccggcggagcgggtggcctggcggccggaaaggcgtccggggcggacgagcgcgacacgcgcaggaaggccgggcctgcctggattgtgcgccgcgccgagggcctggggcacgagcagacgccgctgcccgcggcccaggcccaggtccaggccaccggccccgaggctggcagggggcgcgccgcggcggacgccctcaaccggcaaatccgcgaggaggtggcgagtgcagtgagcagctcctacaggaatgaattcagggcatggacggacatcaagcctgtgaaaccaataaaggccaagccccagtacaagcccccagatgataagatggttcatgagaccagctacagtgctcagttcaaaggagaggccagcaagccaacaacagctgacaataaggtcattgatcgcagaagaatacgcagcctctacagcgaacccttcaaggaacccccaaaggtggaaaaacctagtgttcagagttccaaaccaaaaaagacctcagcgagccataagcccacgaggaaggccaaagacaagcaggcggtgtcaggccaggctgccaagaaaaagagcgcggagggcccgagtaccaccaagccagacgacaaggagcaaagcaaagagatgaacaataaactggctgaggcgaaagagagcctggctcaacccgtcagtgattcaagtaagactcaaggtcctgtagccacagagccagacaaggatcaaggttctgtggtcccaggccttctgaaaggtcaaggtcctatggtgcaagagcctctgaagaagcaaggttctgtggtcccagggcctccaaaggatctaggtcccatgatcccattaccagtcaaggatcaagatcacacggtccctgagcctttaaagaatgaaagccctgttatctcagcaccagtcaaggaccaaggtccctcggtcccagttcctccaaagaatcaaagtcctatggttccagcaaaagttaaggatcaaggctctgtggtaccagagtctctaaaggatcaaggtcctaggattcctgagcctgtgaagaatcaagctcctatggtcccagcacctgtcaaggatgaaggtcccatggtctcagcatctgtcaaggatcaaggtcccatggtctcagcacctgtcaaggatcaaggtcccatagtcccagcacctgtcaagggtgaaggtcccatagtcccagcacctgtcaaggatgaaggtcccatggtctcagcacctatcaaggatcaagatcccatggtcccagagcatccgaaggatgaaagtgccatggccacagcacccataaagaatcaaggttccatggtctctgagcctgtaaagaatcaaggtttagtggtctcagggccagtcaaggatcaagatgttgtagtcccagagcatgcaaaggttcacgattctgcagttgtggcacctgtaaagaatcaaggtcctgtggtccccgagtccgtgaagaatcaagaccccattctcccagtactagttaaggatcaaggccccacagtcctacagcctccaaagaatcaaggtcgtatagtccctgaacctctgaagaatcaagttcctatagtcccagtgcctctgaaggatcaagatcctctggtgccagtaccagcaaaggaccaaggtcctgcagtccctgaacctctgaagactcaaggtcccagggaccctcagctacctactgtctcacctctaccccgagtcatgatcccaactgccccccatacggaatacattgagagctccccttgacactcaccccttgacacaccaatgaaggagctgacagtgagagtgctcccctcccaggggcagtgaagacacatatttaatctgcatgaaacatgtacagtagtcttgctggaatctaataaaaatggtccctctggctcaaaaaaaaaaaaaaaaaaa

SEQ ID NO: 62254 - DNA, 4338 bp, Homo sapiens
aagattatagagacttgctttagaaccacaagaagaaagaggaggccggcttttcagctagcatcatggcgtggccgtgcatcacgagggcctgctgcatcgcccgcttctggaaccagttggacaaagcggacatcgctgtgccgctggttttcaccaagtactcggaggccaccgagcacccgggcgccccgccgcagccaccgccgccgcagcagcaggcgcagccggcgctcgcgcccccctcggcgcgcgcggttgccatagagacgcagccagcccagggcgagttggatgcagttgcccgggcaacggggccagcgcctgggcctaccggcgagcgcgagccggcggcgggccccggccggagcgggccgggcccgggcctgggctccggctccacctccggccccgcggactcggtgatgcggcaggattaccgagcctggaaggtgcagcggcccgagcccagctgccggccgcgcagcgaataccagccctccgacgctcccttcgagcgcgagacccagtaccagaaggacttccgcgcctggccgctgccgcgccgcggggaccacccgtggatccccaagcccgtgcagatctctgcggcctcccaggcgtcggcgcccattctcggggcgcccaagcgccggccgcagagccaggagcgctggccagtgcaggccgccgctgaggcccgggagcaggaggcggcccccggcggagcgggtggcctggcggccggaaaggcgtccggggcggacgagcgcgacacgcgcaggaaggccgggcctgcctggattgtgcgccgcgccgagggcctggggcacgagcagacgccgctgcccgcggcccaggcccaggtccaggccaccggccccgaggctggcagggggcgcgccgcggcggacgccctcaaccggcaaatccgcgaggaggtggcgagtgcagtgagcagctcctacaggaatgaattcagggcatggacggacatcaagcctgtgaaaccaataaaggccaagccccagtacaagcccccagatgataagatggttcatgagaccagctacagtgctcagttcaaaggagaggccagcaagccaacaacagctgacaataaggtcattgatcgcagaagaatacgcagcctctacagcgaacccttcaaggaacccccaaaggtggaaaaacctagtgttcagagttccaaaccaaaaaagacctcagcgagccataagcccacgaggaaggccaaagacaagcaggcggtgtcaggccaggctgccaagaaaaagagcgcggagggcccgagtaccaccaagccagacgacaaggagcaaagcaaagagatgaacaataaactggctgaggcgaaagagtaaatttccctgcactttccttttactcttctctctctctccctccccccaactttttttttttaaaccaacaaaccaaaaaaggccacaaaattaattagaggcttctcatctgccttggtcctgagtgttccaggagctctttggtttggcttcttttgatggaagaatcctgcttcacagactgagtggcaggcctcctcctgagggcagcccctggagcaccaggaagcgttgccgctggctgtgccctcccctggcactctgactgcatgctgatgagcaaggcaggcaggtctgagaggcgaaacgaatctcccggcagtgcttggaagtgtctgtggggtctcctcctcccagatccccaagatctgtgtcactggtcgattttgaactttaggtacatgtgttcttttcaaaaattcagagaatcgtcatgtgccacagaagctcagcctgggcttcagcaattgacaaaatttgaagaaatattaaacaaaaataacaaaaaaagaaacaaccttggccttaatgtcaataaaagggagttgtgtctgttaagtggtcttttcatagaatcgtccattagaaatgtgtgcctgtgtttagcttcctatcagtgggctttaaattgtataccgagtcatagatacgccactgataactaaaactagatcagggctggtgaagaaggttaggtgttttaggtacattccagctgtcataggaagatcacagaaatgaggaggctgttttcctctgattctcctcggccgaccacctgtccaatgctgctggtttcgcagagcgaccggttggagatgtctgaggaagaaagttcaaggtgtagggatagtgtgtttggaatttgactttccatttctgagacccaagggggcgtagatgtagtggcaagtgtggcgatgtttactctcccttcctgaaccgctctggtctgctcctcagagagggcagcggtgccaggcctcaggtcagggagaatgtctgtgacttagctgcagactaggagactgccctgctaactaattagcaagcagctttgacctcattaatatataaaagcagctctcagtatattccgtgtcgtgtgtgtgtgtggccaaagcccccaagggtggcaagtgccaccttcgctgtgctagagttgtgttgtaggaattagtcagggagttgttgtgaaaaaaaaaaccccagtgcttgtgagggaactcaaaatagttaccagaaaaataatatttgccaatatgacgtgtatattgctcagcacactctgtatctcctgtccttaaaatcctcttgtccccggcattctgacacactgggctgccgtccggtgtcaagccccggcgcaggcttgctcttcttttacaatgaaaggggtgaagagtgagggtctcacagttccttacctcaaagtccctttaggtccttctggtttggaggaagtggagcctccacgaactctctcttactccgaccattcaggcagcaaagtctctgcttacatcattttggttgtcaccttggggctgagtgagaagtcttttgtaaattaattcggcgtgtgctacatgagccataattattaacagaacaggaatatcagaaacgaagttgttgatcaggcccactgcgaccttcctttctatctcagggtttaaaactgtgaggaaggagaagtatgaaggaaggtagaaaatgctggtgggtctccgtgtttatgagtcacagattttgaaagctatcaggaaatgactagagtggatcctggcactgattccaactctttgccagctaatcttaacatttagcagaaagctctagcaacatgatcttaattgtatccagaggatttgccaatgtatgttcagtctctcaagatttggcattagtcagacatgttgatgctagccacaatttggatttctccatagaataatcatttatttttgcagatcaaataaatcagagtttacaatgcacaggggatcatttatttagcattcccttgctagaagcccgtgtgccaggcactgtgctaggcgtggtgggcagtataaagaaatctgtctccacagccacacaaccagagggtgcacatgacttgatccctatgaccaagtcaagttggtgttgcccaaatcgcagtttgacataagggtcccacaggcttccccaccccccgcccccactcactgccccagggaccaacttcctaccctcacccaaggctttagaggacctgtagcatgtctttttcaacctgtcagtatccccttctgcttaacacacccactgagaaaaccctgtttgtagttcactttgactcttgaatgtgtcactttactggcaagagacttcctttgatttctactgtttacaaataaaactcagccagtctcattctatatcccaaacgtactgaatgaaactgattttggttccacaagcagtgtttgggtgttgccttcctgaaggtgaccaagcttccaaagctcgtcccactggcctctgtacatttccctgtggttctccgtccttccctggcgagggagctgggactgaagctttcccgctgtttccctgcctgcaaaagcagccccaagagctgcgcattggcttccctcagcaatctgtcctgtctgtgctcccattcggtccacatagctttctttgcctctctgaggcagacaggaagtgtctaattacgattttgtggcctgggttttgttgcataccacagattgtctatgtaacatgtagcgcacacctctcttggtgctatttcattcctgctgtaagagaatgacaaaaatattcatgtatagccaattgattgtgacgtgcttgtggtctgtgcttgctcagaaaaacaaacaaacaaacagtttttccaattataaataaatgctaaagacgaacaccaaaaaaaaaa

SEQ ID NO: 62255 - DNA, 1357 bp, Homo sapiens
gggggcgtggccccgagaaggcggagacaagatggccgcccatagcgcttggaggacctaagaggcggtggccggggccacgccccgggcaggagggccgctctgtgcgcgcccgctctatgatgcttgcgcgcgtcccccgcgcgccgcgctgcgggcggggcgggtctccgggattccaagggctcggttacggaagaagcgcagcgccggctggggagggggctggatgcgcgcgcacccggggggaggccgctgctgcccggagcaggaggagggggagagtgcggcgggcggcagcggcgctggcggcgactccgccatagagcaggggggccagggcagcgcgctcgccccgtccccggtgagcggcgtgcgcagggaaggcgctcggggcggcggccgtggccgggggcggtggaagcaggcgggccggggcggcggcgtctgtggccgtggccggggccggggccgtggccggggacggggacggggccggggccggggccgcggccgtcccccgagtggcggcagcggccttggcggcgacggcggcggctgcggcggcggcggcagcggtggcggcggcgccccccggcgggagccggtccctttcccgtcggggagcgcggggccggggcccaggggaccccgggccacggagagcgggaagaggatggattgcccggccctcccccccggatggaagaaggaggaagtgatccgaaaatctgggctaagtgctggcaagagcgatgtctactacttcagtccaagtggtaagaagttcagaagcaagcctcagttggcaaggtacctgggaaatactgttgatctcagcagttttgacttcagaactggaaagatgatgcctagtaaattacagaagaacaaacagagactgcgaaacgatcctctcaatcaaaataagctgcgctggaacactcatcgtcctgcaccatggcatgcgctttcaagactctgcttgctcatacgctgtttgctctgcttggaatgtgcttacccccttccccttcatctggtgaactcctactcatccaagacccagcttcattgtctccatctctgggaagcctgccctgcatactccaggcagaaccaatcctttcctccataatgcttccctggtgctttgccattgtatttgtgacttgtttgtctgcttcagctagactgtgagctccatgagggcagggaccatgtctttttttgcttttgcacacggtaggtacttaatattgctttatgtttatttgatttaccatccacctcattctagaagtgtatagtggtaataaatgtttattaaataaataaattataccgtacattattt

SEQ ID NO: 62256 - DNA, 664 bp, Homo sapiens
agtgtaagaggaaaagaagtgtgatggccaagagttcacagaggaagcaacgtgactgtgtaaaccaatgcaaatcaaagcctggcttgagcacctcaatccctttgagaatgtccagttacacattcaagaggccagtaacgagaattacaccccatcctggcaatgaggtcagataccatcaatgggaggagagcttggagaagcctcagcaggtctgctggcagaggagactgcagggactccaggcttacagcagtgcaggagaactttcaagcactttggatcttgccaataccttgcaaaaacttgtccctagttacacaggtggatctctgctggaggatcttgccagtggtctggagcactcctgccccatgccccaccttgcctgctcttcagatgcggtggagataattcctgcagagggagtgggtatctcgcagctcctctgcaaacaatttctggtcactgaggaagatatcaggaaacaggaagggaaagtgaagacagtcagagagagactcgcaatagcactgattgcggatggactcgctaatgaggcagagaaagtgagagaccaagaaggctgtcctgaaaaacgctaagaaaaaaagggaagatagtgcagatgaaataaagtgtaatcctttattaacatctc

SEQ ID NO: 62257 - DNA, 2701 bp, Homo sapiens
aattcatttttaatcctttaatagtccacagtaatattgtcctaaagagggtacattggattttaattttgctttcaatatgacggctgtcaatgttgccctgattcgtgataccaagtggctgactttagaagtctgtagagaatttcagagaggaacttgctctcgagctgatgcagattgcaagtttgcccatccaccaagagtttgccatgtggaaaatggtcgtgtggtggcctgttttgattctctaaagggtcggtgtacccgagagaactgcaagtaccttcaccctcctccacacttaaaaacgcagctggagattaatgggcggaacaatctgattcaacagaagactgccgcagccatgttcgcccagcagatgcagcttatgctccaaaacgctcaaatgtcatcacttggttcttttcctatgactccatcaattccagctaatcctcccatggctttcaatccttacataccacatcctgggatgggcctcgttcctgcagaacttgtaccaaatacacctgttctgattcctggaaacccacctcttgcaatgccaggagctgttggcccaaaactgatgcgttcagataaactggaggtttgccgagaatttcagcgtggaaattgtacccgtggggagaatgattgccgctatgctcaccctactgatgcttccatgattgaagcgagtgataatactgtgacaatctgcatggattacatcaaaggtcgatgctcgcgggagaaatgcaagtactttcatcctcctgcacacttgcaagccagactcaaggcagctcatcatcagatgaaccattcagctgcctctgccatggccctgcagcctggtacactgcaactgataccaaagagatcagcactggaaaagcccaatggtgccaccccggtctttaatcccactgttttccactgccaacaggctctgactaacctgcagctcccacagccggcatttatccctgcagggccaatactgtgcatggcacccgcttcaaatattgtgcccatgatgcacggtgctacacctaccactgtgtctgcagcaacaacacctgccaccagcgttccgttcgctgcaccaactacaggcaatcagctgaaattctgaacagcagagttatggagtatcagaatctttccatggaaacctccatatggcctttctatatatattctcgtatgtcttattctaccaacacaacaataagcgtgttgcagtcaatgtattaagcaaagcaaacctgccagccagcaaattcaaataaaaaataaagcattaaaaatcaatggagatgttaaaacaacacaaatagaaaactagtaactaccatccatcctatttgaattatcaagcagaacatgaccataaaatttggtaacttgttacattactctttgtgattttctaataaccatgctaagtgtatttccacagtgagcttttggcttactatatacattcttggtggataaattgttcatctgtttttgaagtgttaccttactattttgtttacaagatagtctattgggttgattcaggatgtaacaaatatattcagtaccatttcttgtgttgtattgtgttgtgctgtgttaggtttttacatactgtagtgttttgctgtatatgtgtggtgtttgatttcaactaaagtgttattagtggggaacagaagtatatgtgcttaagaacatgacaggttcatgcaaatatgctctctttctttagaatatttctgtaggtttcttgggactgacatttaaaacgcctcacttttgaatgtgcacaaaacctgctcattaacatgcatgtgtataatttgtacctgcagatctgatgttgcataatacaatcaaattactagattttttaaagagagaaataattacctgcacaaagcagagaacttcataaaacattaacccctaattcactcttcttaaatagcttggcaaataagactttacctttaaatgaatttctcagcatttatactaaaaattatgtaacgtgctcattagattttttgtgtgtgtggcttgagaatcccatctcctaaattgagtgtctaaaactgagccatttgtcatcttcagctgagaaactggtacttgggagcttaaaaatatgctaattacaagttataaatcaaacggagagatgggggcatggagatagtttttacgtactggaggaaagtgtgtaaaaccatggcaatgtcaccttttacacaaatgccattttccaaatgcaaatggctcatgctctttagactactctttgaataacaagtaagatgcaatctagcaaaagtcagtcagggtgaaagagaattggttgcaaatgaggacttccctccccaaatggacagtcttctctgttgatcacagagggagcctgagtacaggcttggagaaatggctaggacagggaacagggaagcacttacaattattccttgatttattcaaaagaactgggaaagatggttgtagttgtctttagcttcggttcaactgagtttcgttttgttaaacagttcagtgaaggagaaagcacctgtgatatatggcaagtgtccccctgcccaaactttaacatcagaccctctcacatcataaaaaaaaaaaaaaaaaaaaaaaaaaaaaaaaaaaaaaaaaa

SEQ ID NO: 62258 - DNA, 1041 bp, Homo sapiens
tcatcctgccaaactccaggctcagatgatgtcacaggttaaaaaatgcccttcatgagaaagatcttaagcaacatgatagattcagaagctcatgaaaagaggccaccaatacttacatcttcaaaacaagatatatcacctcatattacaaatgttggtgaaatgaagcattacttgtgtggctgctgtgcagccttcaacaacgtcgcaatcacatatcccattcagaaggtcctctttcggcaacagctgtatggcatcaaaacccgggatgcagtacttcagttgagaagggatggatttcgaaatttgtatcgtggaatccttcccccattgatgcagaagacaactacgcttgcacttatgtttggtctgtatgaggatttatcctgccttctccggaagcatgtccgtgctccagagtttgcaacccatggcgtggcggcagtgcttgcagggacagcagaagcaattttcactccactggaaagagttcagacattgcttcaaaaccacaagcatcatgacaaatttaccaacacttatcaggctttcaaggcactgaaatgtcatggaattggagagtattatcgaggcttggtgcccattcttttccggaatggactcagcaatgtcttgtttttcggccttcgaggtcccattaaggagcatctgcctaccgcaacgactcacagtgctcatttggtcaatgattttatcggtggaggtctattgggtgccatgttgggattcttgtgttttccaattaatgttgtaaaaactcgcatacagtctcagattggtggggaatttcagtctttccccaaggttttccaaaaaatctggctggaacgggacagaaaactgataaatcttttcagaggtgcccatctgaattaccatcggtccctcatctcttggggcataatcaatgcaacttatgagttcttgttaaaatttatatgaaaaaaaaccatcagttaagtgccatttatcaactgaatagaccttctaagaagaatgcagtttggcctcttt

SEQ ID NO: 62259 - DNA, 1345 bp, Homo sapiens
tatggacccaggacaggtttgtcccatgacctgctgtgaacagtgtgttgtctgatagaagattcggttggcaaaccatctctctattgccttacagagcaagcaaagaagatggatcgattgaagagccatctgactgtgtgctttctaccttctgtgccctttttaatcctagtatccactctagccaccgctaagagtgtgactaacagcactttaaatggcactaacgtggtcttgggctctgtgcccgtaatcattgccagaactgaccatatcatagtcaaggaagggaacagtgccttgattaactgtagtgtttatggcatccctgacccacagttcaagtggtataattccattggcaagctgctgaaagaagaagaggatgagaaggagagaggaggaggaaaatggcaaatgcacgacagcggcctcctgaacatcaccaaggtatccttctcagaccgaggtaaatacacgtgtgtggcttctaacatctacggcaccgtgaacaacacggtgaccttgcgcgtcatcttcacttctggagacatgggtgtctactacatggtcgtgtgcctggtggccttcaccatcgtcatggtcctcaatatcacccgcctgtgcatgatgagcagccatctaaagaagactgagaaggccatcaatgagttctttaggaccgaaggtgcagagaagctgcagaaggcatttgagatcgccaagcgcatccccatcatcacctccgccaaaactctagagcttgccaaagtcacccagttcaaaaccatggagttcgcccgctacatcgaagagcttgccaggagcgtgcctctgccgcctctcattatgaactgcaggactatcatggaggagattatggaggtggttgggctggaggagcaggggcagaattttgtgaggcatactccagagggccaggaggccgcagacagggatgaggtctacacaatccccaactctctgaagcggagcgactcccctgccgctgactcggacgcctcatcgctgcacgagcaacctcagcaaattgccatcaaggtgtcagttcacccgcagtccaaaaaagagcatgcagatgaccaagagggtggacagtttgaagtcaaagatgtagaggagacagaactgtcggcggaacattcccccgaaactgcagaaccttctaccaatgtcacgtccaccgagctaacatctgaagagccaacacctgttgaggtaccagataaggtactgccgccagcttacctggaagccacagagccagcagtgacacatgacaaaaacacctgcattatttacgaaagccatgtctaatacc

SEQ ID NO: 62260 - DNA, 1221 bp, Homo sapiens
gggaggatggagagtggtttggggttttgggtcgggctctagtgtgatcaactgcagaagcattacaccgtggcctggtttctttactcagcccctgggttagatcccagccccccgcataggtccttttgctggaaaaggaagatggagtggtgggacgaatctgaggagtcgttggaggaggagccacggaaggtgctcgcccctgagcctgaggagatctgggtggcggagatgctgtgtggcctcaagatgaagctgaagcgacggcgagtgtcgctcgtgctccctgagcaccacgaggccttcaacaggctgcttgaggatcctgtcattaaaagattcttggcctgggacaaagatctgagggtgtcggacaagtatctcctggctatggtcatagcgtatttcagccgggccggcttcccctcctggcaataccaacgcattcatttcttcctggctctctacctggccaatgacatggaggaggacgacgaggactccaaacaaaacatcttccacttcctgtataggaagaaccgctctcgcatacccttgctccgtaagcgttggttccagttaggccattccatgaacccgagggccaggaagaaccgctctcgcatacccttgctccgtaagcgtcggttccagttataccgttccacgaacccgagggccaggaagaaccgctctcgcatacccttgctccgtaagcgtcggttccagttataccgttccatgaactcgagggccaggaagaaccgctctcagatagtcctgttccagaaacgacggttccacttcttctgttccatgagctgcagggcttgggtttccccagaggagttggaggagatccaggcttatgacccagagcactgggtgtgggcgcgagatcgcgctcacctttcctagagctccagggaccggggaggcctgaggtcatcggcctgagagaagaacaccggacccaggggagatgtggattttcagcaggaactttattccaatgctaatggcagacaccaggcaggaggagaggaaccatttgtgcagatcatctagaagaacctggaccattcttgatggagctgaatacagtgatcacgttgtcctcctaggagcaggggtggggggaggggggtggggtccttctaggagtccttggagaaaagtaagaaaccaggagcgtttccagttccaccctttcctggg

SEQ ID NO: 62261 - DNA, 1273 bp, Homo sapiens
acgatggctactggggagctcggggacttgggtggctactacttcaggttcttgcctcagaaaaccttccagtctctgagctctaaggagatcaccagccggctccgccagtggtgaggaaccgaggcgcagggagagaagaggcccttggtcttcgcggctgtggaggcgcaggccgggcgtcgaggggcccgcgcgggtcggcgccattctgagtgaaccctgaggcttcctgagtgaaccccgaaccacccgggaagggcggatgctgtgggtgggatcggttatcggtgcgctctgagagggtgccagcccccagatgatttctttttcctcctctgccccaggtccatgctgggcagaatcaaggcgcaggcgttcggctttgaccagacctttcagtcctatcggaaggatgatttcgttatggcttttttcaaagacccaaatgttattcccaatttgaagttactttcagattcttctggacaatggatcatattaggaactgaagtgaaaaaaattgaagctataaatgttccttgcacacagctttcaatgtcattttttcatcggttatatgatgaagatattgtacgagacagtggacatattgttaaatgtttagattctttttgtgatccatttctcatttctgatgagttacgaagagttttgctagtggaagactcagaaaaatatgaaatattcagccaaccagatagagaagagttcctgttttgtcttttcaaacatctttgccttggtggagccctttgtcaatatgaggatgtgattagcccatatctggaaacaacaaagcttatctataaggatctggtgagtgttcgaaagaatcctcaaaccaagaaaatacagattacctcttctgtctttaaagtttcagcttatgattctgctggtatgtgctatccttcagcaaagaatcatgaacagacattttcttactttattgtggatcctatcaggcgtcaccttcatgttttataccactgttatggtgtgggagacatgtcttaatgttctttcagattatgtacctctactattttgtatttatcatttttctatcttaatactaacttatagataaacatatactttgcaaattaattcaagaaaaatgtaaggagcctacttagagcagaagaaagcaaacaccaagatgcctttttaaaaatttgtgtggaatactaaccggggatcaaatttcatccataataaaatctataccaaaaaaaaaaaaaaaaaa

SEQ ID NO: 62262 - DNA, 2103 bp, Homo sapiens
ctcagactacaggtgtgagccaccatgcccggccttctcctttaagtattgttggcctcactttcccaactaaaatgggagctcactaagaacaaaggctgttccttcatcttatacttagtaccttgaaagggcctaccacacagtaggtggtcacgtgttagtctgttaggtcttttggattttctaggtagacaatcacatcgattgcaaataatagtctttctcttttcagtctttgtatttcttttttcttgttttattgcattgactgagctcatcagtgaaatgttgaatagtagcaatgatggagggcaccccaatcttattatgctcaatactcattaatttatgcaataggaatgtaaagtacctactgcaggtcaaatcctgtgcctggggataacagtgtaacacatttgagatcttttcctgtccactgaaatgcctgagcagtagcagtatttcagtaaacacgacaatgctgagaatatcaccaaattctccagacttgctgaagtgttcctttgggatcctggttcccaaaaagtatggacataggtccctgctggtggccccaggttccaggccatcagtaaggttgggggctgcagactggaccactgcaccgtggagcagaggtgaagaaaccaagacgcagagaggccaagccccttgccttgggtcacacagccaaaggaggcagagccagaactcacaaccagatccagaggcaacagggacatggccacctgggacgaaaaggcagtcacccgcagggccaaggtggctcccgctgagaggatgagcaagttcttaaggcacttcacggtcgtgggagacgactaccatgcctggaacatcaactacaagaaatgggagaatgaagaggaggaggaggaggaggagcagccaccacccacaccagtctcaggcgaggtcatcatcatctgcttggtggttctggatgccctcctggtgcttgctgagctcatcctggacctgaagatcatccagcccgacaagaataactatgctgccatggtattccactacatgagcatcaccatcttggtcttttttatgatggagatcatctttaaattatttgtcttccgcctggagttctttcaccacaagtttgagatcctggatgccgtcgtggtggtggtctcattcatcctcgacattgtcctcctgttccaggagcaccagtttgaggctctgggcctgctgattctgctccggctgtggcgggtggcccggatcatcaatgggattatcatctcagttaagacacgttcagaacggcaactcttaaggttaaaacagatgaatgtacaattggccgccaagattcaacaccttgagttcagctgctctgagaaggaacaagaaattgaaagacttaacaaactattgcgacagcatggacttcttggtgaagtgaactagacccggaccagctcccctcaaaaagaagacactgtctcatgggcctgtgctgtcacgagaggaacagctgcccctcctgggccgcttggtgagaggtttggtttgatacctctgcctccctcctgccagcatggattctgggtggacacagccttgtggaaggtccagtaccaccaagagctgcccatccactcccaccccacactgtatcaaatgtatcacattttctcatgttgaacactttagccttaattgaaaatgagcaacaaagctggacaattgctagttgtatataaaatttaatctcaccgaatgtacagttttcaaatttcacgtgtatattaaggaactgatgcatctgagcattctgaaagaaagaaaaagaagctactttagctgccaccccattctagaaaagtctcttattttcaagctgttctaaatagcttcgtctcagtttccccaaaaggggtacccaggcccctcctctgtgtgccccagctgcatcagccagcttctaggtggctccattgttttctgccacctgacaacatttttcctcaattactgtacaactactgtataaaataaaacaactactgtataaaataaactctctcttttccctggaaaaaaaaaaaaaaaaaa

SEQ ID NO: 62263 - DNA, 1828 bp, Homo sapiens
cttgcaggggtccccgaagccaagcagggtcccaaggccgattcagactccgacctagagacggaaggtgctcggggcaggggccaggcccgtctcctccccttgggggcttctcccgcaggggttgtgggaggtgggctggcgccgccgaggaggcaggagacctctgtccagcagggcacgtagccctctgcggggcgtctccagccccctgccctctcctcggcgctcctggcggcatcaggaactttaccatgagaaggcgcttctagaaggaggttaaaatggaaaatcccgccagacagtgcaccaaaggctgtcccgccctgaaatgcaatcagagctgggttttcccaatccacagatgtggacctgttggagaaccagctgggagtggcaggagcccaggccctctgtgccgccctcacagtgaaccaggccatgcggaagatgcagctgtcagggaatggcctggaggagcaggcggcccagcaccttgatgaactcctgctggcccacacagacctgaagtccctggacctgagctacaaccagctgaatgaccaagcagatctgtgcatgggactgcagggcttcctcatcttccacagctttgggggcggcactggctctgggttcgtgtctctgctcatgaagcggctctcggtggactacgggaagaagtccaagctggagtttgccatttgcccagccccccaggtctccatggccatgacggagccctacaactccatcctgaccacctacacgaccctggaacattctgactgtgccttcatagtcaacagcaaagccacctatgacatgtcagcacaacctggacatcgagtgtcccacgtacaccaacctcagtcgtctgggcagatcgtgtcctccatcacggcctccctgtgatttgatggggccctgaatgtgtacttgacagaattccaaaccaacttggtgccgtacccccacatccacctccccctggccacctacgccctggtcatctcagccaagaaggcctaccatgagcagctgtccgtggccaagatcgccagtgcccgcttcgagccagccaatcagatggtcaagtgtgaccctcaccatggcaagtacatggcctgctgcatgttgtacagaggggatgtggtcctgaaagatgtcagtgcggctgtcgccaccatcaagagcaagcacaccaaccagtttgtggactggtgtccgattggatttaaggtaggactgggtgatgtggagtccttgtgccatcaggaagcaggagacctgcagaataatgctgcccctgaaggcccgcatcctttatggagacaaccccttttcacgtcagctaggttgcaaggataataattttagtaatttatttcctaccgccttatactttaccaaatactttatgttccctcataccttaaccactaccctttaaagttcatggggcaatattaccagtatcttacactttagaaaacagaggctgaggctgggcacggtggctcatgcctgtaatcccagcactttgggaggccaaggcaggcagatcacgaggtcaggagattgagacggtcctggctaacacggtgaaaccccggctctactaaaaaatacaaaaaattagccgggtgtggtggcagacacctgtggtcccagctattcgggaggctgaggcaggaggatggcgtgaacccgggaggcagagcttgcagtgagtcgagattgcaccactgcactccagcctgggcaacagagcgagactacatctcaaaaaaaaaaaaaagaaagaaaaagaaaaaaaaaaaaaaaa

SEQ ID NO: 62264 - DNA, 4844 bp, Homo sapiens
gagaacagctggaatccttcgcccccggcgcgcagccttcgcccgccggaatcgctgccttatccaccagcgggatgcttacctcgcccgccctctcgggtcaggcgggcccgggaggatgggagggtggctgctgagcgggagccgccacgtcttccacccgacatattgcctagagcttgctgtgacttagatctcgattcagagatggagaaatcaggcccatcttctaccatctctgagcagcagctgcagaggcaagagggatggattaacaccaaaacagacttggctgagcagagtctcatttcatctgagaaatggcttcaactgcatgggcttaagagcaacaaattgaccttgaaacagattttgtcacagatcggattcccacattgtgaagattatgtggcgtctctggggaggcctgtggcttctcggtatgctgatggtctgtttccacagctctacagagcagaagatggcagagtatacaatctgacagctaaatcagaactgatttatcagtttgtggaacatttaacacaagctgtggagagctacaagcagcgaatggactggctcaccagcaagagccggcagatttttggtgtcatcttggaacagtgcgtcaccatagtgctggattttggcggcattctggagggggagcttgatctgtgccgagaggctctaacaatggttctccaggagcaggtggctcacataaccgagttcaatatcatacgggtttctcaagagcctgtgaagtggcaggaaaatgctactcctgtgaccgaacagtccatagctactgccatcagttgggttgagaaactgacggttgagctgactgtgagcgaggctggccgcctggatgctctgctggaagccgggagagacaagactattgaatccatttactactttgtggtgggggatgttcctgaagaatccaaggagcttctcctccagagggccttggagatcccgtgtccagtctacacagtgtccttcaacgccagaggagaaggcactatagcttttctaaaggatctgagtgccaagacccacagcagattccacgcatttgccgagagaacagagtgtgtagaatttcctgcattctccacaaaggatggtgacaatgtgatgacttggaattcaaggaaactgaaaggaaaactccctccaggagctggagtcagagaggacgtgtttctcgtttggcaagagatggaggaagcccgcagcacgctggcccagatccagaggctggtggccgagcctcccaagcccgacgtggccactgtggactgcgagtcagaaacaacctctgttgagattgcatcgaatccagaagacacctgggactctaagacatggctgcagaaatatggcttgaaggcccagaagctatccttgtatgatgtgcttgccgactgctctttctgccacgctgatggggttgtggatataaaagccaaaccggagaatgagtccgtgcagaccagtgcggagacgaacaagaagacagtccatgcaaaatattgcagcaggtttgtccatgctccctggaaggatgggagcttggtccacgtcaacattaccaaagagaagtgcaagtggtacagtgagagaatccacacagccctggcccggatccgaaggaggattaaatggctacaggatgggagtcaaagcctctttggaagattgcataatgattgcatctacattctcattgacacgtctcactcaatgaagagcaaactggacttggtgaaggacaagatcattcagttcatacaggaacagctgaaatataaaagtaagtttaactttgtgaagtttgatggtcaagcagttgcttggcgggaacaacttgctgaagtcaatgaagataatttggaacaggctcagtcctggattagagacataaagattggaagctccacaaacaccctgagtgccctgaaaactgcttttgctgataaagaaacacaggcaatctaccttctgaccgatgggagacctgatcagccacctgaaacagttatagaccaggtcaaacgttttcaggaaattcctatttataccatctccttcaattacaatgatgagattgcaaacaggtttttgaaagaggttgctgctttgactggaggagagttccatttttataattttggttgcaaggatcccacccccccagaggctgttcagaatgaagatgtgactcttttagttaaggaaatggaacagggtcacagtgatctggagaagatgcaagacctttattctgagtccttgatcatggactggtggtacaatgcagaaaaggatggagacagcaagcatcaaaaggaaatctgttctatgatttcaaccccagaaaggtgtgcaaagcctcaatctgatgtcgattcaacacaaacttcatctctgaatatgttgaagggaccatggggcctttcagatcaaaaggttcagaaaaagaaagtccttcacgcagaatcaaccaaaaccagcctgctcagaagccagatgtcctccctcaggagctcagcttgcagtgaaaggaaggatggcctctccaatgccagcagccggaggactgctctaagtgacaaagaaatgagcatcttgctggctgaggagtggctggatgacaaatcgtcagaaaaggtgacgcgagaaggaagccaggtttatgaccacgattcttcagatgtgtcttcagaaaactggctgaagacctatggcttggtcgccaagaaactcaccctcatggatgccttgtcagtggcagcagtcccgcacagctccacctatgttcccgtcctggacaagcatgtcatgtctaaggttcttgatgaggtgttccctctggcacatgtgtgcaacgacacaaataagatgacattaattaacccccaaggagccaaactcaatatctacaagcgaaaagtggaacaggcaattcaatcctatgaaaagcgcttgaataaaattgtttggcgagcattatctcaagaggaaaaagaaaagttagatgcaaacaaaccaatacagtacttggaaaacaaaacagttttaaaccaggctttagaacggttgaattggcccatttcactgaaagagctgtcgatgctggaaagtgaaatcctagctgggaaaatgtacatccagcaggccatggaactccaggaggctgccaagaagaattatgcaaacaaggccccgggagagcaacagaaattgcaaggaaatccaacaaagaaaaccaaatcaaaaagaccagatcccctcaaaggacagaaggttattgcaagatgtgatgaaaatggcttttattttccaggtagttttttttttttaatttcgtgaggcttttgttaaataatttgatactagggacaagaagtttcaacctgtgcttttgctagaacactgacatttcatgagctggcctgagctagtccacttttcacagagaagaagtggaatatctctggccagctcatgaaatgagcgtatttgggccccccaaaaaagtagccagaaaaatgcacttattttaatttctcattttttagtagacaaatttttattacccatttactgcgttgcatgtatgtaatattttgaaagtactggtctaatggtatgagcaaaaaggtgaacattcttgctttttggagattacatcttaaaggagacagacaagcaatgaaataaacagataaaatatgtggtgtgtcagatacagtgccatagagaaaaatcaagccacaaatggggttgagaatgttggggtgagggttttgattctatatttggtggttaatgaagagctcctggggaaggtgacatatgaataaggacttaaaggaggtggggcaagccatgagattggggaagggagttctaagcagaaacaacagcggtgcccaggcctcagggtggagtgcacacgtgtgttggaggaagggccatgagactgggatagctgggcctcagaggtttgccccagacttcctgggggatgtgatccctgaaggaatcagccagctgcaattcagcaaggggtggaggtatgaagggagtttcatggatggtgacaataatacgtgtgaagacttagaaatgaagaaagacatctatgtctggagaaataaaattgattctggctggaacataaaatgagaaggaagggtggaaataataaagctcttcagagaggtgagcatggggctatgcataaagggtcatattaaggatttgcactttaccctgagggcaatgagagccacatttaaagcagtgagaaacacaatcacatttgaagttttcaaaagctctctcccactgctgtgtgaagattggataccaaggggttaggatgtctctggtccctggcttcgggtggtagatagatagtggtacctacaggagatggtggtgtggatggaaagacaatgagatgtgtctgcaacatgatgaattgcaggtgcctgcaagatgcccagatgaagatatcagagaagcaattggagatgtgggtctagagtctggagacagagatttgggagacataactacagaagtcatcactgaaatcatgggaagggtctgtagggaaaagggaactgggagaaaaccctgaggaagctctgtcaggcaaaaagattacattgcagggcgggtgtggtgggtcacacctgtaatcccagcactttgagaggccgaggctggtggatcacttaaggtcaggagttcaagaccagcctggccaacatggtgaaacctcatctctactaaaaaaaaaaaaaaaaaaaaaa

SEQ ID NO: 62265 - DNA, 980 bp, Homo sapiens
agcgtctggtccgcgcagtcagggcatcctccgcatcctccacatccttccatggctctgaagaataaattcagttgtttatggatcttgggtctgtgtttggtagccactacatcttccaaaatcccatccatcactgacccacactttatagacaactgcatagaagcccacaacgaatggcgtggcaaagtcaaccctcccgcggccgacatgaaatacatgatttgggataaaggtttagcaaagatggctaaagcatgggcaaaccagtgcaaatttgaacataatgactgtttggataaatcatataaatgctatgcagcttttgaatatgttggagaaaatatctggttaggtggaataaagtcattcacaccaagacatgccattacggcttggtataatgaaacccaattttatgattttgatagtctatcatgctccagagtctgtggccattatacacagttagtttgggccaattcattttatgtcggttgtgcagttgcaatgtgtcctaaccttgggggagcttcaactgcaatatttgtatgcaactacggacctgcaggaaattttgcaaatatgcctccttacgtaagaggagaatcttgctctctctgctcaaaagaagagaaatgtgtaaagaacctctgcaaaaatccatttctgaagccaacggggagagcacctcagcagacagcctttaatccattcagcttaggttttcttcttctgagaatcttttaatgtcatttatatacaaaagaaattctcaaatgttaaaataaaggaatagtttattgcttaatataacttatcatcactttgcttctttactgaatcttctacactcttgcctgatacctaaatttaatgtttgtttttaactcaaaaaatgtactgtagtatggaaaatggatggcagtagaataaagtcttaagattattttttaattacaaaaaaaaaaaaaaaa

SEQ ID NO: 62266 - DNA, 2100 bp, Homo sapiens
tctgcctgctgtcgggggcgggctggccaggccgaggccggagcaggcaggcatcccccggagttgtctcttttcatgccagcgtcaacaggaggctgtctggacacactgattactcactcaccagcctccctcttttgtccaccagcccagcctgactcctggagattgtgaatagctccatccagcctgagaaacaagccgggtggctgagccaggctgtgcacggagtgcctgacgggcccaacagacccatgctgcatccagagacctcccctggccgggggcatctcctggctgtgctcctggccctccttggcaccgcctgggcagaggtgtggccaccccagctgcaggagcaggctccgatggccggagccctgaacaggaaggagagtttcttgctcctctccctgcacaaccgcctgcgcagctgggtccagccccctgcggctgacatgcggaggctggactggagtgacagcctggcccaactggctcaagccagggcagccctctgtggaatcccaaccccgagcctggcgtccggcctgtggcgcaccctgcaagtgggctggaacatgcagctgctgcccgcgggcttggcgtcctttgttgaagtggtcagcctatggtttgcagaggggcagcggtacagccacgcggcaggagagtgtgctcgcaacgccacctgcacccactacacgcagctcgtgtgggccacctcaagccagctgggctgtgggcggcacctgtgctctgcaggccaggcagcgatagaagcctttgtctgtgcctactcccccagaggcaactgggaggtcaacgggaagacaatcgtcccctataagaagggtgcctggtgttcgctctgcacagccagtgtctcaggctgcttcaaagcctgggaccatgcaggggggctctgtgaggtccccaggaatccttgtcgcatgagctgccagaaccatggacgtctcaacatcagcacctgccactgccactgtccccctggctacacgggcagatactgccaagtgaggtgcagcctgcagtgtgtgcacggccggttccgggaggaggagtgctcgtgcgtctgtgacatcggctacgggggagcccagtgtgccaccaaggtgcattttcccttccacacctgtgacctgaggatcgacggagactgcttcatggtgtcttcagaggcagacacctattacagagccaggatgaaatgtcagaggaaaggcggggtgctggcccagatcaagagccagaaagtgcaggacatcctcgccttctatctgggccgcctggagaccaccaacgaggtgattgacagtgacttcgagaccaggaacttctggatcgggctcacctacaagaccgccaaggactccttccgctgggccacaggggagcaccaggccttcaccagttttgcctttgggcagcctgacaaccacgggtttggcaactgcgtggagctgcaggcttcagctgccttcaactggaacaaccagcgctgcaaaacccgaaaccgttacatctgccagtttgcccaggagcacatctcccggtggggcccagggtcctgaggcctgaccacatggctccctcgcctgccctgggagcaccggctctgcttacctgtccgcccacctgtctggaacaagggccaggttaagaccacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcaaaggagaggacaccgccagtggtccaaaaaggctgctctcttccacctggcccagaccctgtggggcagcggagcttccctgtggcatgaaccccacagggtattaaattatgaatcagctgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 62267 - DNA, 958 bp, Homo sapiens
ctgccctcctgcttccgttgctagggacgcttcggccgaggataccgcaatggatcaggaagaggggctgaaggccttggacaatattgtcactcaattcaacgcctatgaagatttcctggactcgcagatcactactgtggacttgtactacctggaggatgaaaccctggcccgccagttggtggagctaggctaccgagggactggagagagagtgaaaagggaagattttgaagcaaggaaagcggctatagagattgcaagactggctgaaagagctcagcaaaagacgctaacaagtgctggtaaagacctacaagataattttctgacggccctggcaatgagagaagaagacaatcgcagtggaaaactgagttccgtgatctttattcgtgacagaaattctcatgggcaagagatatcaggatacatcgactatgcccacaggctaaagacggaagattttgaagtctactttactggaaaaaaaagacttcttccaaggcctacagatataagcttttacaactgggacgctgatattgctgttagtaattcaagtcccaactatcaagtgattgccgataatccagaaggcttacttttcagatacaaaagagacagaaaaattcttaatgtggacccaaaggcgcagccaggtgacaactctactagaatcactatcctgacagaactctacatacaagctgtcatttttgaccacatttccagaaggaagacttaagtaccaacatgttaatttcctaataatttgctaaatttaaataaattccgtagacagagcaaattagaataataaatgagccctgtagctggaaggcaaattagaacaataaagttaataaagaagttagaaagaaaaaaaaaaaaaaaaaaaaaaaaaaaaaaaaaaaaaaaaaaaaaaaaaaaaaaaaaaaaaaaaaaaaaaaaa

SEQ ID NO: 62268 - DNA, 2514 bp, Homo sapiens
agcgggtggcggttgaggggcagtggtggcggcggaagcccaagtcgatgctgatgttgatgctggtggcggctgtgaccatgtggctccgaccgctggtcacagctcagctctgtcgttctcgcacagtgaggacaggaaaagtgtttaatctgatacaggacgttcaaggggaccgcctgtattttcatcctacaacaacacgcttgattaaacatccttgcgagaaaaatatagcactatatctagggaaacaagtttttttcacaatggataactttgagactagtctccttccatttaccatccctacatcaatgcaggtcggcgtaccagaagtgacatcagcacattttgctggttcgttattgctgttagtagtggatcaaaaagtctatatttatgattatgaaaataattcttggagcatgtctttaggtataaaacaccctgttacacatgtctctggtgataattgttgttatactggaagtttgttttgtgtgcatgtcagtaatttggtttttgcatatttccgtggagatcagatatcccagacttatatatattattcaaatactgggggattcagtttttggaagtatcactatgacagacaggcagaaatcattgggtctttaggcggaatcttccactttttttctttgtcacaggttgcgatgcttgtagtgaatcaagggaagggcatgttcaagtactcagatcaccccctcaaccggagtttcgggctgtcttttgactataatgggactctagacatcctcatcgcccccggccagagaggcatcctgctcctatggtttgagaacagcctgttgttttcccataatgcaggtcagctcgtcgacaccgtccgggtgaaaaaaggagaccagaccttgttttcttccatttttgaagccaagatcaccatccacaacattgctgtcactgaaaatgaactggcagttataactcgggaggataatttgtattatggcaatctgggcatcgtgccaagttccataatcaaatttgcagaccaatacatctggtcagaagacgtggccctgatgttcaggagcccagggactctggaaatactgaccccactgcgtgacacagcctttccagcttttgatttccagaagtgcctcgtgaatatccaggcgcttctcatggaccctgaactccacgttggaaagtgcaagatagagtttctgacaggagaatttatatacaggatgtataccattgacatgcacagccagctggaattgactgcttcgttgataccccagccaggcacatccctgattcctctggtgatggtgagcaacccccactccctggggttccaggccaccttctacgagaacggttacacatcagatgggaacaccaagtacaaactggatattttcctaaaacagcagcagcactggggcaggaccgactccaacttcacttccagtttaaagaaagccaccatgtctaccttaactgtggacatagcaaacaaggaaatttcatgtgtggatatcaagccactgtcggcactgatttcagttggctgcgacctggataaaaagatcgtcatccagaacaaagtttccgcctgttccatgggcatcctggaccccttgaccctgcaagacaattacagcttcatcatcgagaaggaattctacgaccccggcttccaggggcagcagtcctccgaggacctgcacgtgttttactcctaccagcagctgggctgtcctctcctcgtctactatgacaccctatggaagcccgtggtggagctgtggcgaaaagacagtttccaggaggtcatcgacgccgagtatgtgttactggaggtgaacgggcagttctcatactcctattccctgacggcccagtcggccatgtgtacctcccagccgcagaactggaccaccatgataaaggaattcggggggcccttcttctggaacagagagaactatgtgagctgccacgaccccaacaacaatgcccctttgaggtggccagacgtccagtatcagatcttgggcggccggacagcaaaccagatcattttcggccacaatggcttttatgtcttctacatttcgatcgtggatccgtactacagctactgtcaactggagaccatctttagcatctacgtgtatggagcattccccgtgcagctggtctctgctggagtcgtcatcctactgatcatctccagcatcctggggtccgtttggctggcctacaagacccccaagctgctacgcacagcacgcggccgcaggatcaagaagtgtgcgacacagctgtgtaggagatgcaagacggtctgccagttcagggcctcagccacagccagggcaggcacagagcccccgggacgccaccgcactcctcacggaggcaggtctgaccactgaggccggtccacagggtcccaaccccttgtcttcaaataaagtataatgtaacataaaaaaaaaaaaaaaa

SEQ ID NO: 62269 - DNA, 767 bp, Homo sapiens
aagggcccaccgggctcccggggctgccaggccccaaattgaggaagttgactgccagatcacactctgttggcccacgcagatagattccattcatcctttctaatgtctacaccatattttggataacatgccatcatctcacattgtgttgaaagaagaaaccagaatgttggggttgatgtatgccatatggatgaatttaaacagtttcggccttgcaataattggtatacttctaattgcatgtgaaattatactctttttaacgaaagatgaaactattcagtggccacatgtacccagtaacagagggagcaaagcaaatcttatcctcaaagaactgcagctgcttgttagatctacctggtggttccatagagaaactgctcagagaacctgcctttacctcgcctaaaacagaactatcccggagctcagttcatcaactcaggatccagtagtgtaatacagaagcctgttacgagatataaggcacttcgccctcggaaatctcactgtcggaatccttggaaatcacaccacgcacaacttctatttcttcataatttgcaaagaaccagtgtgactccagtcaagaacaaaagattaattgtgaattagcgaagaactctaattttttcaagcagccacatggaaaacgcattctaatgaaatcctttccattgctcttttttcttagttcttcaataaagcatgcgatttgatcacaaaaaaaaaaaaaaaaaaagaaaaaaaaaaaaaaa

SEQ ID NO: 62270 - DNA, 3403 bp, Homo sapiens
ggtgaactgccagaaggctaagggaaatggaatggctgctggaggacctgcttggggctaagggggatatggggcttctctggggccaactgacccatgccctagcctgcagacactgcggcagcagctgcttccagagtccaggaaatctggtgacactattcttattcgtggtttggcagattcagagatggtggcagcttgggaggttgcgacagcttcatccctggtgctctgggaatatggtgcaaggcaaggaactaccacttctgcaccgtgtggccttccttgatcacctgtgtaagcagaaatcagaagtggaggaagaaggggaagaagaggaagagggggaagacgaggcatctctggatccactgaagccatgttctcctaccaaagaagctcccactggagagcaagccactccagccccaccccagccatcctgtggttctgagggcctcctcaaggctatagggataccagagcaaacagtcatgcagcccgtgagcccttccagatccttccccatcttccagattctgaccagctttcctgtgaggcacaagatagcatcagggaaccgccagcagcagagaaaaagccagctcttctggggtctcccctctctgcacagcgagtccttggaggccatcttcctgagctcaggtggcccctatcctctgaagttgtctgtttgttcttctgtcttcttcaacaagcttgccttcctacctaggtccaacctgttgcttccccagtatcactcctcagcccagttttctacccatggggcccatactatggaagatctagaagggatggcccccgatcctcagctgcttccacctccatcttctccttctgtctcatcactactcctccatctgaggcccttccctgtggaccacaagggagttttatctggcgctgaggcacccacacagtcccctggaactagccccctggaagttctccctggatatgagactcatttggaaaccacaggacacaaaaagatgccccaagcttttgagcctccgatgccacccccctgccaatccccagcttctctgtcagaacccagaaaagttagccctgaaggaggacttgctatatctaaggacttctggggaaccgtgggatacagagagaaacctcaggcctctgagtcttcaatgccagtcccttgccctcccctagactccctgccagaactccagagagagagttccctggaagatccatccagatataagccccagtgggaatgcagagaaaactcaggaaacctctgggcttttgagtctccagtcttggacctcaacccagagctctctggaaccagccctgaatgtgtcccaccagcatctgagacaccatggaagggcatgcaaagtagagaaaatatttgggtccctgcagacccagtttcacctcccagccttccctcagtccctctcctggagtctctagtaatgggcccccagggagtcctgtctgaatccaaagctttgtgggagaccatggggcagaaagagaacctctgggcatctgattccccagaccctgttcatagcacacctccaaccacccttatggaaccacacagaatcaatcctggggaatgcctcgctacatcagaagctacatggaaggatactgagcattccaggaattcctcggcttctaggtctccatctctggccctcagcccacccccagctcttgcaccggagctgctcagagttagatccatgggggtcctgtctgattctgaagctagatgtggggacatacaaaagacaaaaaactcctgggcctctaagcacccagcttgtaacttaccccaagacctgcatggagccagccctctgggagtcttgtctgattctcagtctattgtaggggaaatggagcaaaaagaaaactgtgttcctgtgttcccaggtaggggctccagcccatcctcaaactctgtttcaaagtcccacgtaagtgagcctatcgcagaccaaagcaactataagcctgacggggaggcagtggagcaaagaaagaaccactgggccactgagctcccagcccccagctcactctctactcctctaccagagccacacattgaccttgaacttgtgtggagaaatgtgcaacaaagagaagttccccaaggccccagccctctggcagtggatcccctacacccagtaccccagcctcccaccctagctgaagctgtgaagattgaacgcactcatcctggtctacccaagggagtaacgtgcccaggggttaaggcagaggccccactctcccagagatggactgtcccagagttgctcacccatcctgggatccatgcctggcagtggagtagagagctgaaactcaggctgaagaaactgcggcagagccctgcctccagagcccctggcccaagtcaatcattttgcagctcccctattctgagctccacaattccagacttctggggactcccttcctgcccaccacagcagatttatccccccaatccatgcccccactcttcaagttgtcatcctcaagaagttcagcgcacagtacctcagcctgtccagtcctcccactgtcatcacttccaatcctcttcccagcttcagccacaggagtctggcagggcggaacaagggtctcagagaggggagaaaatgaaggggaagatggtgagccaggtcccatcccaagggccatgtgtacacatggaggctggtgtggactatctatctccaggcccaggagaaccctcaaactctaaggttctggtctcaggcaagagaaaggacaaggcttcagcctcatcctcagccaaaaagagagagcaccctaggaaacccaaagcaggagaccatagaagagggactgcaaggttggggttatccacagtcacagggaagaaccaccctgcccaggccagaagcctagtagaggcccctgtaagcacatttccccaaaggtctcaacacaggggccagagctctcaacacactgctcttccccagctgcttctccccaaagcttcgggtccccaggatcagccagaggcagggcgaagagcaagtgacatcctgacccctcgccactgtaagcactgtccttgggcccacatggagaagtatctctccttccctaccctcaaggcttcccttaccaggggtttgcaaaaggtgttagccaaatgcctggataaccatcgacccctacccaccaaatctagtcagtagagaaaaggctggtaatactagcacttggtatgccaagacctgaagccaaaccagggggaaggtggggatgtggagacaagaaatggaaattctaataaactagctgaattagataaatcccaaaaaaaaaaaaaaaa

SEQ ID NO: 62271 - DNA, 524 bp, Homo sapiens
gctccaaaccacaaaatctccaacgccggacagcgcggcctcggtcaccatacgctacaggcatcctgcaggccatcgcgtgtggtggagcgtccggcgcttatcgtgggatcgccacctctgccctctaccaggctccgggcccggtgccgaggactggccgccaagggttgcggactatggccctaaagctcatccacaaggagttcctcgaactggcccgcgacccccagccccactgctcagcagggccagtgtgggacgatatgctccactggcaggccaccataacgaggcccaacgacagctcctacctgggaggggtcttcttcctaaagtttccctccgactacctattcaaaccacccaagatcaaatttaccaacggaatttaccatcaacgttaacggaaatacgcgacaggagggagtatggcagaatagctaaagactggactcagtagtgtaccatgtaatttcaaaatataattccatcgccttaataataaagatgcagaaagtggc

SEQ ID NO: 62272 - DNA, 524 bp, Homo sapiens; identical to SEQ ID NO: 62271

SEQ ID NO: 62273 - DNA, 744 bp, Homo sapiens
agcgggttgccgacccccatgtgcagcactgtctggactctagaagatgctctgattcaagaggatgtaaagaaattctctaagccgataagaaaaatagaagaaacccaaatgggcaatgagtgcatgggaactcactcacctcagtggaaaggagggaatggcaagccagcccactgaagcccactggggacataggacaagtccgcaaagcagagacagcccctccaggaagagcgaccaggccttgagaggacatggccttaggaccagatccagggaagacacagtcactaacccctggctcatctggcaggtgtgggaagcagccaggcccgtggcttcaccagctccccccgatctctgccttcagctgtcctgcagcctgggtcaggcacctaggcagctttatggcaggcggagatgcaccacccacatcctctttccaggcagggcttgctgccctggctgtagcgagtgcggcagcaggtggcctccagctatcagcaacttcagagagctgccttgcctgaggtcccgtcccttctggggaagctcccatctgccagggggctacaaaagcacagtggacaccatgatgggcaattctggctgatgggagcaccacctggtggctgaggcattcttgggccacatagcagttgactgccctctccaccatcttttcacaagtgttaatcccaataaacacccatcctcttccatcccaaaaaaaaaaaaaaa

SEQ ID NO: 62274 - DNA, 3630 bp, Homo sapiens
cagcccagggccgggctgcccaccgtgccagcccagtttcaatgacccacctgagggtttccatcgtgggccaggggaccggcgcaggcgggcatccggagccaggcagtggccagcccatcccgggcagggtcataggtggggctgcaggcctcgaagccgccatgtgaaggcagcagcgaccccaggcagggcgggccaggttgaccttgcacctgctctcccctcagccccgcggccatgccgaccctggtcgtgggcacgccgcccacctgcctgggggacacacctcagccctgccacaagaacagccagaggcagggccccttctcccatggggccccagggagagcagccgactggaaggctgttgccaagcccaggctctgcgcacctgcagctgaggatgacgtggcagccctgaggtggcccgggccctcccagcagccagacccaccctgggcagctccccacgtggtcgggtctgacgacctcaaggaaccaggcccctgggggaaggcgtgcagcctgcccatgtggtccacaggcccggaggctagggatggggacagctcggtgtcatcgggccgcctctcgtgctcttcggggggccacgacgtgtgtgtgtcttggaaggagaggccaccccaggtgttggggccccagcagaggcccagaaagagtgacgcgcggctggagcagctgagagacaagatccgggcccaggcgtggcagcaggggagctgtgcgtccctgggcacctcagccccctccagcgcctccagactccacaaagcctccacgctgacgcttaggaggaaaggccaagaggcaaaaaatccccctccagcccctgaatgctcaggtttcagcatcttgagtgcagctgagcgcagagttgaagccaaggcatcccacggccaggggcgcgagctctccagggtctcccagcaccaggttcctgttctgagggaaaaacccaaaagggtcaaaagcagttcttgcaaaagagagaagacccccaagttgccctcccctagaagagcggccaaagacaaacacaaagacgaagattcggagctggttggtgtttacgcctggagaaagggacaagctctggtgaggtcgctgcttgggccccctcccgtcctccgcaggcaccatagcaaggatccctcgagagacccggctctcaccgtggacttaggagacagcgagaaagtcatagctgccaagtgctcaccggtttgtgcccagttgcccgatgccacctccgcccacagtgaccagcaggtgtctgggaacacacccagcctggcttccttcgaccagccagcgaccatacagacggccatggccatcctacaagacctgcgccagcaaatccaggctgggctggagctggcccaggcccgcaagggagggcaagagctcgggccatcaaagcggaggctgcaggacgtggcagggaggggccgctgcagggaccccaatgcccagagctccttctctaagagtccctgggccatgacagagaggaagcattcctctttagagagggctaggagtgtccacacctgggagccctggagctcctccactgcacgggagtcctgtccgcagagggcctggggggcccaaggacaggaccgctccttccagaggccggagagtccccatgagaggttgggccacttctcccagaggccctggagtgcactggctgggcaggcctgcagtccgcagagggcctggggggcccaaagacagggcccctcctcccagaggcctgggagcccccctgaaaagcggagccccttcccccagcagccctggagtgctgtagccacacagccctgtccacggagggcctggactgcctgtgaaacctgggaggaccctggccccagactgcggaaccctctggaaaggcccagtcctccagcccagcggccctggagcagctccggcgtgcagagggccggcccccagggcaagggcagaggcatcggctcccccgtctcggctgccaagcatgccctgccaaggcccaccgggagcttccctcagaacccacttgggaaggagaaggacacgctgcggccctgccccaggtcccgggggctcctgggaccctcgcacagctctgagtccttgcgggagttcatgcgccagaaggcgcaggcccggcggcggcaggccctggaggagaaggcctcggccctgcgcacacgggagctgaggagccggaggctgcaggaggtctaccggcagcagagggaggccgtcctcggcagggcggtccccgtggtctcccggaccacccctggcatcgtgacctttgtccccagttctgcacagtccgggggcctggaagcctccgggagcctggagtccccagtgctggaatggagcaaagtgacctctggcatggtgctggggggccaggaagccccaggcagcttctgcctgtgtttgaacagagcctggaaccatgctgagaccctagatcccccagggatggggggcccccaagatggccgggatgcccccgtgctgctgtcagcttcaccctctctgggatccctggagctccaggacctgaccacccgctacctaccccgggggatgtgcatctacctggacccgaaggaggctgagcacctgggcacttccagctccctgcacctccggcataagcaggcgcagctgcaggcgctagagaccacagccaaagtcctcaagcagcgggtcgatagcctcaccgccaagcttcagggtgccgaagcgccggacaccgtcagggacccagctgtgggcctgctgcgctcgtgcccccacagcctacctgccgcccccacgctcgccacccccacgcttgccaccccagcctgccctggagccttggggcccaactggggcagaggggcacctggggagtgggtgagcatgcagccccagccccttctgcccccgacctacttcctggagggcgagacactgtcgtggggccccagctgggagcaacagcagagtgtgagcccgagggcccactgcgagagcaagccccgaggtgtgtctcaggctcctctcctgctgtgatggcttgggtcccccgtcccgtgctcccggctgaccagggagtgaagccaggtgccctcttctccaaggttttccagaggagggacacgtggacgtgaaaccagacaaaaggctgcagagaggcgtggcccccttccaggccctcagcccctctgcggggagctcatatgcgggcccagccacgctgcaccctatctggggctccctgggactggaggagacgccgtcggtcggaggggcagattctgtggcgccctgcaccccccggagctgcggtaagggcgaccctgcggacaggccctgggctggctggtcgggtggccggggcatccaccgagaacaccttccactgcctagcactcgagcttggccctacggggtagagaaatccttttccacgtggagagcatccacgcctcgttattaaaggttttagaggctaaaaaaaaaaaaaaaaataaaaaaaaaaaaaaaaaaaaaaaaaaaaaaaaaaaaaaaaaaaaaaaaaaaaaaaaaaaaaaaaaaaaa

SEQ ID NO: 62275 - DNA, 3501 bp, Homo sapiens
ctgagctcccgggctccggcagcgcgctggcggggcgccgcattgcacactctgggggcgccgcagtgttcgtgggatggggcagcgggctgcagctggcggccggaatccgcgcgcagcccgggtgcaagttctctcctgttgccctgagtgcccactcccaggccctctgtatgagtgacacttcagtctgccatggaacctggccctgctctggcctggctcctgctcctgagcctgctggcggattgtctgaaagctgctcagtcccgagacttcacagtgaaagacattatctacctccatccttcaaccacaccatatcctggtggatttaaatgtttcacctgtgaaaaggcagcagacaattatgagtgcaaccgatgggctccagacatctactgccctcgagagaccagatactgctacactcagcacacaatggaagtcacaggaaacagtatctcagtcaccaaacgctgtgtcccactggaagagtgcttatccactggctgcagagactccgagcatgaaggccacaaggtctgcacttcttgttgtgaaggaaatatctgtaacttgccactgccccgaaatgaaactgatgccacatttgccacgacgtcacctataaatcagacaaatgggcacccacgctgtatgtcagtgatagtgtcctgcttgtggttgtggttagggctcatgttatagtggctcagtggctccatgtgttaatagcgatccatggggatctcgatggtccacagacctgcatgagtcattggcctgacagtaattacacatgtgagacacaacactcttggaggtcatcacagccaagcattgccacttaccatgaggaataaatgttgcttcattgtagccattttgagtctaaccgagactcatcaaagccttctgtcagtacagcccaagttccataccataaacgtttgttttcattccaagaagtagttctgcatttatcgagatctggggttcttaatttggaagaatacatgcatgagatgcagtaggtcctgagactgtaagatattaggagtatgttataggggcatgtatagatgtgggcttttcaggagaaaagtaaccattggtttaaatataatcatgagttcatttgtagctttagaattttaaaacattgactccaaactgaatggactatttccttggaaattctgactgagtccctggaagagtagtaattccaacaattccagccatttgttcaattaattttcccaacattcttctcccagtgctgggaatcacatttcctctgttctgtgcagaagacaaaaaggcaatcataaaagtttgttatatttgtgggggtgcctggaggaggattttcctcaacttaatggagccactgtccataaagtggctgttatcccttcatataattggtgagatcagccttctccttgacttggcacctaattatgcttcatgagatcctagattccacctgagtcaattgtgtccagagccccaaaccaggatggagttgttttccccagatatggggttctattcagccatagataatctagacagaggatttcagaatgaaaggaaaaatgtgtggagattagtcctagttcattctgagggccgactaagtggctcagccagcttcttactccatctgcagttcatactgccaaagagctcccacttccaaatccccagtgactttatggagaagattctgcattaaattgtctttcgaatgatggggaagcaaggcataatatgcgatgatgaggagaaagtagaccagtgaggtgattgcaagactaacaaggagactcaatgggaagtttttctttcttttagatattgcttttgaagtagatggtaaaatttttgtcatccttcttgtattttttgtaccccaagttacaatttttcttcttccttgtaaataatttaaacagtatttatttttgtaaggcataactagaaactaaaatatattctaaaaaattcattattctgaacaaagtgatcaaattagaatacatatttttcaacagtggtagagcttttaatatatgtttattgaaagttatctataatacttgcaccagtgttgaaaaaagttaacatgtaggcaagagcaatatgtttgtctcaaggatttttccatggtttcctcagtgatggtgtcctggaattattcaggtggtgaccatcactggtctaagtttgtgtgcagggttttcagacgtgtttttgtgaaacttggtagaaccatggctaataaagaggacagtgttgtcagggtccatctgccctccatagaaaaatgtctctggctcataaaatgagactccctcagggactaaatatgaactgacagcagtaactctgatacagaataatctaaattgcatcaaatggccttaattcagagtttgttaggcttatcagtatgttgcttttaattggggtgggaaagtagagggagagaaagcaagacatttattaagcacctcgtatgtgccaggcactatgctaagcactttacataagttaggattaatccctgcaagaatcctataaagaatgttactagcatttacacttcccaaatgaaggtaccaaagctcaaacgcaatgttgtgaagctgtttccttcagatttaggttatgtgggatgatgtgggattgaagaggaaagaaaggtgggattatccccctaggaagactttcaggcctgacttcataggaattcatccatcttatcatgtggagtttatctcaccctgctgttgcaggatgctatttgcatgtgtccccaggtgatgttttttctttggggagtaggggtttggcttcctcattcatccctcttgctaaaagaggagatagttgatgttgcatctaaagatgctataagacaatgaaagtttgatgttgtacatacctacaagtaccatttttgtgcatgattacactccactgacatcttccaagtactacatgtgattgaataagaaacaagaaagtgaccacaccaaagcctccctggctggtgtacagggatcaggtccacagtggtgcagattcaaccaccacccagggagtgcttgcagactctgcatagatgttgctgcatgcgtcccatgtgcctgtcagaatggcagtgtttaattctcttgaaagaaagttatttgctcactatccccagcctcaaggagccaaggaagagtcattcacatggaaggtccgggactggtcagccactctgacttttctaccacattaaattctccattacatctcactattggtaatggcttaagtgtaaagagccatgatgtgtatattaagctatgtgccacatatttatttttagactctccacagcattcatgtcaatatgggattaatgcctaaactttgtaaatattgtacagtttgtaaatcaatgaataaaggttttgagtgtaaaaaaaaaaaaaaaaa

SEQ ID NO: 62276 - DNA, 3207 bp, Homo sapiens
tctctgtcggcgcctggcagttcaggtgaacaacagtaacttctcagagctgttctccactcctgacttctcccagcctcgagaattgataacacactcttctggatcccagcagtgtccagaagaagaccaaggacagaacagagactagcttcggtgagattggacagattttgggaaagatcatgacgagccatcaaccgcagccccaggaagagcagagcccccagcggagcacctcagggtaccccctccaggaggtggtggatgatgaagtgtcgggaccatcagcccctggggtagatcccagccccccacgtaggtcccttggctgcaaaaggaagagggagtgtttggatgaatctgatgatgagccagagaaggagctcgcccctgagcctgaggagacctgggtggcggagacgctgtgtggcctcaagatgaaggcgaagcgacggcgagtgtcgctcgtgctccctgagtactacgaggccttcaacaggctgcttgcccctggggtagatcccagccccccacgtaggtcccttggctgcaaaaggaagagggagtgtttggatgaatctgatgatgagccagagaaggagctcgcccctgagcctgaggagacctgggtggcggagacgctgtgtggcctcaagatgaaggcgaagcgacggcgagtgtcgctcgtgctccctgagtactacgaggccttcaacaggctgcttgcccctggggtagatcccagccccccacgtaggtcccttggctgcaaaaggaagagggagtgtttggatgaatctgatgatgagccagagaaggagctcgcccctgagcctgaggagacctgggtggcagagacgctgtgtggcctcaagatgaaggcgaagcgacggcgagtgtcgctcgtgctccctgagtactacgaggccttcaacaggctgcttgcccctggggtagatcccagccccccacgtaggtcccttggctgcaaaaggaagagggagtgtttggatgaatctgatgatgagccagagaaggagctcgcccctgagcctgaggagacctgggtggcggagacgctgtgtggcctcaagatgaaggcgaagcgacggcgagtgtcgctcgtgctccctgagtactacgaggccttcaacaggctgcttgcccctggggtagatcccagccccccacgtaggtcccttggctgcaaaaggaagagggagtgtttggatgaatctgatgatgagccagagaaggagctcgcccctgagcctgaggagacctgggtggcggagacgctgtgtggcctcaagatgaaggcgaagcgacggcgagtgtcgctcgtgctccctgagtactacgaggccttcaacaggctgcttgaggatcctgtcattaaaagattcctggcctgggacaaaggtctgagggtgtcagacaagtatctcctggctatggtcatagcgtatttcagccgggccggcctcccctcctggcaataccaacgcattcatttcttcctggctctctatctggccaatgacatggaggaggacgacgaggcccccaaacaaaagatcttctacttcctgtacgggaagacccactctcacatacccttgcgccctaagcattggttccagttatgccgtcccatgaacccgagggccaggaagaactgctctcagatagccttgttccagaagcgtcggttccagttcttctgttccatgcgctgcagggcttgggtttccccggaggagttggaggagatccaggcttatgacccagagcactgggtgtgggcgcgagatcgcgcccacctttcctagagctccagggaccgtggaggcctgaggtcatcggcctgagagaagaacaccggacccaggggagatgtggattttcagcaggaactttattccagtgctaatggcagacatcaggaaggaggagaggagccatttgtgcagatcatctagaagaacctggaccattcttgacagagctgaatacagtgatcacgttgtcctccaaggagcaggggtggggtggggtacttctaggagtccttggagaaaagtaagaaaccaggagtgtttccagttccaccctttcctgcggcaccacctccctttttatattgctgaatgccaacctccctggggcggaacctggaggtcctgtttcttacggacttggttgccacagtccaggagcatttgaaggcacagtgcaggggctcagattggcacagaattctttgtgaaatatgagtgccacagactgtaacagatagcttcatgcacactatgcattttattggtttgtttggaaaatgttggccattgaatcattaataggtttatttcaaatagtttggaaattgttgtacttttgaaaacatgctgttcctgtagagttttttgatgagagttatagttgttatatatacataaagataattttcttttcatttttaagtgagaattctttttatcctaaatcttttattatctttaaatttttctctgtattattatatgtgctcctgaagcgagcactctttttatctatgatacttccataataatctcttctatttatagctattggtagttcccccaaattctggtcatagaaatttttatttgctgtttaggtttgtgactgaattgtgagaattcagttgtgatttttaacatgtcttagatatatatactaacatgtctaatatatactatctattttattgatttatttcgaaaaagatgggcaaagaattatttaaatattattttatttatttaaatatttattaaatatatttatttatttaaatatttattaaatatatttatttatttaaatgttattactttaaatattattttaaatattttggaaatactggtatttttgaatagatgctgtttctataaagctgtgtgatgggtattataactgttatatacacataaatataattttgttttcctttttaagagaggattctttttatcctaaatcttttacctttcaatctttgtatctattactacatatgctgctgaagggagcagactttttatctatgatacttagttaatgtatatattacatttatagctatgtggtagttcccctaaattcttgtaaaaataaatttttatttgatatttaaaaaaaaaaaaaaaaaaaaaa

SEQ ID NO: 62277 - DNA, 2778 bp, Homo sapiens
ggcggcagcggctgcgagaggcggcggcacgacgacggtccctcagcccagccaccatgagcaccaagcagatcacttgcaggtattttatgcatggtgtgtgtcgggaaggaagtcagtgcctattctcacatgacttggcaaacagcaaaccgtccaccatctgcaagtactaccagaagggctactgtgcctatggaactcggtgcagatatgaccacacgaggccctctgctgcagctggaggtgctgtgggcaccatggcccacagtgtgccctccccagctttccacagtcctcaccctccttccgaggtcactgcatccattgtgaaaactaactcacatgaacccggaaagcgtgaaaagagaacattggttcttagagaccgaaatctctctggcatggctgaaaggaagacccagccgagcatggtgagtaatccaggcagctgcagcgacccccagcccagccccgagatgaagccgcattcctacctggatgccatcaggagtggccttgatgacgtggaggccagcagctcctacagcaacgagcagcagctgtgcccctacgcagctgctggggagtgccggtttggggatgcctgtgtctacctgcacggggaggtgtgtgaaatctgtaggctgcaagtcttgcacccattcgacccagagcagaggaaggctcacgaaaagatctgcatgttgacgttcgaacacgagatggaaaaggcctttgccttccaggcaagccaggacaaagtgtgcagtatctgcatggaagtgatcctggagaaggcctctgcttctgagaggagatttgggattctctccaattgcaatcacacgtactgtttgtcctgcatccggcagtggcggtgtgccaaacagtttgaaaacccaatcattaagtcttgtccagaatgccgtgtgatatcagagtttgtaattccaagtgtgtattgggtggaagatcagaataaaaagaacgagttgattgaagctttcaaacaggggatggggaaaaaagcctgtaaatactttgagcaaggcaaggggacctgcccatttggaagcaaatgtctttatcgccatgcttaccccgatgggcggctagcagagcctgagaaacctcggaaacagctcagttctcaaggcactgtgaggttctttaattcagtgcggctctgggatttcatcgagaaccgagaaagccggcatgtccccaacaatgaagatgtcgacatgacagagctcggggacctcttcatgcacctttctggagtggaatcatcagaaccctaaagagtagatggttgccctgcatcttgggctccatcggccgaaactttcccaagccagggtgtgcggagcttccctgtactgcagccaaggtgacgtgtgacttggatttgagtggagttgggcttagccttagtctcattcaatctccattattacagccatggggaagagtgaaagatataaagtaacctaattaaatgtatggaattgctatttttatagctgatatagttacacctcaagcccctcaggggtaacaactaacaaacacccaaactgtttggattgattgctttaaaaaacaaacctggctcttacctttgatcttttcttccccagaaatagtaaacttgcagctgcccctaatgcagcatatttttcttaccaaaggagtcttcagccctataaaaggattcctctatagtgtatttctctagtgtatttagtgtgtcgtcaaaattttgatttatacagagctttcaagaacacacaatgcaaagtgagcgcagcatagctgttaacaaacatacaacttttttctagggctttaagggtggtcatttttttcaagttctctcaagtgtcccaaatcagggtagcaatcttgttgccacatgtgcagcaaacaaagtggaagtatagatcttcttctcccttagggaggctcttgaaggagcaggaggtacagtactgggtagcagtctggccctcctgtcgtctggttggtgttggggcctccagccagggccctctaggggaaccaagcctctgctctcacctgtgggttcttgcccatcagggtaattgtattgagaactcaaatatacgtgcacttacatgtgtggttcgtactcaagtgatctattatctagctgcaaagcctggctttgatttgaaattttgtaaaaatttcatggcacccaaggtttctgattctgacccagcagtggtcctgaagagagctgatggcaagtcttgtagtcattttgattttaattgaagggtgagcataaccttgtgaaccagcactagcttgttccaagctggaatttatctaatctatttttgtgtttaaaaaagctgtacctaccaaataaataaatagtttataaaatgtattacttaaggtattagctgagtttagagtactttctgcttaattaatttttatacttaactcttcagtagaggtttacaaagagtacaaaggttaaattacaaattcattcccagcctaggctctgggcacatttcctgttcttgaattctgctcctgaagagggtgaacaaatggggcattcaagttgtgagctcagaattactttaaaaggaggtaacagccagccattacacctaaatttaatttattttattaaaataacataattgagggaccatcagataactgtattttgtcaggtgcaataaaaacaaaattaaaacccaaatcatcaagaaaaaaaaaaaaaaa

SEQ ID NO: 62278 - DNA, 2547 bp, Homo sapiens
ggattggctgttcggagcggcgaggggcttggcgggagcttccagtcgctcgagagcggagagcggcaccatggccccgcgggggcggcggcggccgcggcctcacaggtctgagggcgcaagacgttcaaagaacactttagaaagaacacattccatgaaagataaagctggtcaaaagtgcaagcctattgacgtgttcgactttcctgataattctgatgtctcaagcattggcaggctgggtgaaaatgagaaagatgaagaaacttatgagacctttgatcctcctttacatagcacagctatatatgctgatgaagaagaattctccaaacattgtggactgtctctctcttcaactcctccaggaaaagaagcaaaaagaagttcagacacttctggaaatgaagcaagtgaaatcgaatctgtaaaaattagtgcaaaaaagccaggaagaaagctcaggcccattagtgatgactctgaaagcattgaagaaagtgatacaaggagaaaagttaaatcagcagagaaaataagtacacaacgtcatgaggttattcgaaccacagcgtcttcagaactttcagagaaaccagctgagtctgtcacttctaaaaagacaggaccccttagtgcccagccctctgttgaaaaagagaacttggcaatagaaagtcaatcgaaaactcagaaaaaagggaagatatctcatgacaaaaggaagaaatcaagaagtaaagccataggctcagatacttctgacattgtgcacatttggtgtccagaaggaatgaaaaccagtgacatcaaggagttgaatattgttttgcctgaatttgagaaaacccacctagagcatcaacaaagaatagaatctaaagtttgtaaggcagccatcgccacattttatgttaatgttaaagaacaattcatcaaaatgcttaaagaaagccagatgttgacaaatctgaaaaggaagaatgctaagatgatttcagatatcgaaaagaaaaggcagcgtatgattgaagtccaggatgaactgcttcggttagagccacagctgaaacaactacaaacaaaatatgatgaacttaaagagagaaagtcttcccttaggaatgcagcatatttcttatctaatttaaaacagctttatcaagattattcagatgttcaagctcaagaaccaaacgtaaaggaaacgtatgattcatccagccttccagctctgttatttaaagcaagaacacttctgggagccgaaagccatctgcgaaatatcaaccatcagttagagaagctccttgaccagggatgagaagagcagtctactaaaatgtgcctataggaagactagtctcatgctgttaccttctgaaactgtacctttataaatcaattgttttgcaaagaagttatggcctacttagaatctaaaatttgttattcaaattaaatggctgtgaacaatgttaaatagcatcagtttgtccaatagttttaaaggccataatcatcttttctggttaatatcttgagtaattttaaaatgttgacaccttaatcggtcccaggtatgagctataataaacttgtaaaattaagttgatgtgaacataattttgattaattaataaggcgatttctcctgaatttacaccaaagctaatttttaatgaaattggtttacagaagtaaaaaacaaaaattggaaagcaaagtaataaaacttagtttatataaacaggttgaatgatatatttatcaaatctcacagacatcaggcaaattatagcctggtgacaaaagtgttcatagtgaattagttactcttgtaatacttctataattagttcatcaggaatttcatccacttcactgttataactgagaagactgttctctgcagcttcagctaattcagcatcttcagtagcttctaaaaaataagcatcatcaatgccattatcccagacagcatcagcagatgcacctgttgacagcctgctaggtgatggtttatgaggattctgggtttcattgctcctagtttcatctgcttcatctgttgtaaactcttcttcctttatttcagtggtgaagggatagagagtgggataggaaaatatttactcaggatatgtgatttaaccttatactctatgttgaagtaaggtattaagtgacagatactaaagtgaatatgcaggaggaatgctgtctccgatatctcaccgtgggaatgagtgcactgattcaaacgttgctgcactgaagctcagacacacttgaaactccaaatttgaaattacctacagttctgtgcacatacttttcaatactccccgacggaagagcaagggtggatttaattttttaacaagtggacagtccagctgaagacaaatcagaagataaatttgctatcttgacaatggacttagtacccatgctttaaattttaaagtatttagcaaatcgtaaacatggattgaaaaaagattaaaaacagttgccaaaatataaaaaaaaaaaaaa

SEQ ID NO: 62279 - DNA, 1956 bp, Homo sapiens
ctactgtgaggggatgaaggtgctccctgcatctggccttgctgtcttcctcatcatggctttgaagttttccactgcagccccctccctagttgcagcctcccccaggacctggaggaacaactaccgcctcgcacaggcgtatcttgacaaatattacacaaataaagaaggacaccagattggtgagatggttgcaagaggaagcaattccatgataaggaagattaaggagctacaagcgttctttggcctccaagtcaccgggaagttagaccagaccacaatgaacgtgatcaagaagcctcgctgtggagttcctgatgtggccaattatcgcctcttccctggtgaacccaaatggaaaaaaaatactttgacatacagaatatctaaatacacaccttccatgagttctgtcgaggtggacaaagcagtggagatggccttgcaggcctggagtagcgccgtccctctgagctttgtcagaataaactcaggagaagcggatattatgatatcttttgaaaatggagatcacggggattcctatccattcgatgggcctcgggggactctagcccatgcatttgctcctggagaaggcctgggaggagatacacatttcgacaatgctgagaagtggactatgggaacgaatggttttaatttgtttaccgttgctgctcatgaatttggccatgccctgggcctggcccattccacagacccatcagcactgatgtacccaacttataagtacaagaatccctatggattccacctccccaaagatgatgtgaaagggatccaggcattatacggacctcggaaagtattcctggggaagcccactctgccccatgccccccatcacaagccatccatccctgacctctgtgactccagctcatcctttgacgctgtgacaatgctggggaaggagctcctgctcttcaaggaccggattttctggagacggcaggttcacttgcggacaggaattcggcccagcactattaccagctccttcccccagctcatgtccaatgtggatgcagcttacgaagtggctgagaggggcactgcttacttcttcaaaggtccccactactggataacaagaggattccaaatgcaaggtcctcctcggactatttatgactttggatttccaaggcacgtgcagcaaatagatgctgctgtctacctcagggagccacagaagacccttttctttgtgggagatgaatactacagctacgacgaaaggaaaaggaaaatggaaaaagactatccaaagaatactgaagaagaattttcaggagtaaatggccaaatcgatgctgctgtagaattaaatggctacatttacttcttttcaggaccaaaaacatacaagtatgacacagagaaggaagatgtggttagtgtggtgaaatctagttcctggattggttgctaaatagaaaagcctagtcttctcaagcaatgaggatgactacaagcagcctctaactggatcttaaggactaaagcagaatgtaggagagggattcttccaaaggccttcaaatcaaattagaattcactgagaataataatacttccaatttttttcatagttgtataatcagaatttcaatccacattagaaaagtttttatatgggcaactttatgcgaaatccaaatcaacacaatgcactctgcagttagacaccattattttttcttacctaatatactgaagcagattgatccgtttgatttttatttccaggaggaagactagtggtggattccatgacatatattgtaattcttttcataggaaatgtcattacagtatgaattataattatttacaagcaatggcttttgtggccatcatttggccatcatttgttataataaatataaatttcccaatttttacttaaaagacatcacaaca

SEQ ID NO: 62280 - DNA, 3910 bp, Homo sapiens
cggggcagcctaggccgggcgagggccatgctgagcctcgcagccaagctggtggccttcttctggaggacggcggacacccctagggaggaagccgggcagctggagcccgagctcgcggaaggtgacactaagctgaaaactgtacggggtgtcgtgacaaggtactgcagcgattatggcatgattgatgatatgatctacttctccagtgatgctgtgactagcagagtgcttctgaatgttggacaggaagtgattgcagttgtggaagaaaataaagtgtccaatggactgaaagcaatcagggtagaagctgtctctgataagtgggaagacgacagcagaaaccatgggagtccctcagactgcggcccccgagtgttgattggctgtgtgacttccctggtggagggcgcaggctgtatcagtcagaccacctacttctctctggagagtgtgtgcgaaggcttcgagccctgcaagggagactgggtggaggctgagtaccggatccggcctggcacgtggagcagcgaagccacctcagtgaagccactgagatacaagcgcgtggacaaggtctgcatctctagcctctgtggaaggaacggggtgttagaggaaagcatcttctttaccttggactccttgaaactgccagatgggtacacaccccggagaggtgacgtggtcaatgcagtggtggtggagagcagccagtcatgctatgtctggagggcgctttgtatgaccctagtgaagaggcgagacgccgcccctgttcatgaggccactcatttctatggaacgattttgctgaagaacaaaggtgatattgaagttacacaggtgacgcattttggaaccctaaaggaaggaagaagtaaaaccatggtgatctggatagagaataaaggagacattcctcaaaacttagtcagctgtaaactggctggctgggataaatctaaacaattcagattccaaatgctggataaagaccagatgtgccccgtggtatcttttgtttctgttcctgagaaggagaattcatcagatgaaaatattaattcattaaatagccacacaaaaaacaaaacctctcagatgtcggagagcagtttggtgaacaacagaggaatctctccaggtgattgtacctgtaaaggagaaaatggagaaaaagacaacattctatcaaggaagcagatgacagagcctgagcctggggggcttgtccctccagggggaaaaaccttcattgtggtcatctgtgacggaaaaaatcctggccgctgcaaggagctccttttgctttgtttttccgatttcctaattgggcgataccttgaagtaaatgttatcagtggggaggagtcactaattgctgcgcgcgaaccattttcttggaaaaagcttaaaagttcacaagcgttaacatccgcaaaaactacagttgttgtgaccgcacagaaaaggaactcaagacgacaacttccaagttttcttccccaatatccaatcccagatagacttagaaaatgtgtggaacaaaaaattgacatcctgactttccagccattacttgcagagcttctgaacatgtcaaattacaaggagaagttttcgactttgctgtggcttgaggagatttatgcagaaatggaactgaaagagtataacatgagcgggatcatcttaagaaggaatggggatctgctggttctggaggtcccagggttggccgaagggaggccttctctctacgcaggtgataaactgattttaaaaactcaagagtacaatggacatgccatcgaatacatcagctacgtgactgagattcatgaagaagatgtaactcttaaaattaatccagaatttgaacaagcctataactttgaacctatggatgtggaatttacatataataggaccacaagcagacggtgtcactttgcacttgaacacgtcatccacttaggtgtaaaagtgttgtttccagaagaaattattttacagtctccacaagtgacgggaaattggaaccatgcacaagacaccaaaagcagtggacagtccaccagcaaaaagaataggaaaacaatgacggaccaagctgagcatggaacagaggagaggcgtgttggtgacaaggacctgccggtgctggcaccctttactgcagagatgagcgattgggtagatgaaattcagacccctaaagcaagaaagatggagtttttcaacccagtgctaaatgaaaatcagaagttagcagttaaaaggattctgagtggtgactgccgtcccctcccgtatattctctttggacctcctggtactggaaagacagtgacaataatagaggctgttttacaggtacactttgccttgccggacagtcggattttagtctgtgcgccctccaacagtgctgctgacctcgtgtgtctgcggctgcacgagagcaaggtgctacagccggccaccatggtccgggtgaacgccacctgcaggttcgaggagatagttattgacgccgtcaaaccgtattgcagagacggagaagacatctggaaagcctcacgcttccggataatcatcaccacatgcagcagctcagggctgttttaccaaataggagtgagagttgggcacttcactcacgtgtttgtggacgaggctgggcaggcaagtgagccggaatgcctcattcctctggggctgatgtcggacatcagtggccagatcgtgctggcaggagaccccatgcagctcggaccagtcattaagtccagactcgccatggcctatgggctgaacgtgtcctttttggaacggctgatgtctcgacccgcgtaccagagggacgaaaatgctttcggtgcttgtggcgcacataatcccctgttggtcacaaagctggtgaagaactaccggtcccacgaggccctgctgatgctgccctcacggctgttctaccacagggaactcgaggtctgtgcggaccccacagtggtgacctccttgctgggctgggagaagttgcctaagaaaggcttccctctcatcttccatggtgtgcggggcagcgaggcacgggagggaaaaagcccatcgtggttcaacccggccgaggccgtccaggtcctgcgctactgctgcctcctggcccacagcatctccagtcaggtgtctgccagcgacattggcgtcatcacgccctaccggaagcaggtggagaaaatcagaattcttttgcgtaatgttgatctgatggatataaaggttggatcagtagaggagtttcaaggacaagagtatctggtcatcatcatttcgaccgtacggtcaaatgaagatagatttgaagatgatcgatattttttgggtttcttgtccaactcaaaaagatttaatgttgcaatcaccagacccaaagctttgctgatagtgctgggaaacccccatgttctcgttcgagacccctgttttggtgctttgctggaatacagtattacaaacggtgtttacatgggatgcgatttacctcctgcactgcagtctctgcaaaactgtggcgagggggtggcagacccctcctacccagtggtgccagaatccacaggaccagagaagcatcaggagcccagctgatctgcagtggctgacagcagggaggccatgtgctcagcctggccacgttgccgttacagtctgctccgtggctcctgtggcctgcccttgtctcgcagccaggcagggtcgtgtgtgggtgtggggctgccaggttggacgcagctgctgctgccctgactttggcatatgccagcctgttcctgccacagggcagtcactgccgcctaccctgaaataaaccctcgagtgacccccaaaaaaaaaa

SEQ ID NO: 62281 - DNA, 1243 bp, Homo sapiens
atggctgcccctgcttccgtcatgggcccactcgggccctctgccctgggccttctgctgctgctcctggtggtggcccctccccgggtcgcagcattggtccacagacagccagagaaccagggaatctccctaactggcagcgtggcctgtggtcggcccagcatggaggggaaaatcctgggcggcgtccctgcgcccgagaggaagtggccgtggcaggtcagcgtgcactacgcaggcctccacgtctgcggcggctccatcctcaatgagtactgggtgctgtcagctgcgcactgctttcacagggacaagaatatcaaaatctatgacatgtacgtaggcctcgtaaacctcagggtggccggcaaccacacccagtggtatgaggtgaacagggtgatcctgcaccccacatatgagatgtaccaccccatcggaggtgacgtggccctggtgcagctgaagacccgcattgtgttttctgagtccgtgctcccggtttgccttgcaactccagaagtgaaccttaccagtgccaattgctgggctacgggatggggactagtctcaaaacaaggtgagacctcagacgagctgcaggagatgcagctcccgctgatcctggagccctggtgccacctgctctacggacacatgtcctacatcatgcccgacatgctgtgtgctggggacatcctgaatgctaagaccgtgtgtgagggcgactccgggggcccacttgtctgtgaattcaaccgcagctggttgcagattggaattgtgagctggggccgaggctgctccaaccctctgtaccctggagtgtatgccagtgtttcctatttctcaaaatggatatgtgataacatagaaatcacgcccactcctgctcagccagcccctgctctctctccagctctggggcccactctcagcgtcctaatggccatgctggctggctggtcagtgctgtgaggtcaggatacccactctaggattctcatggctgcacaccctgccccagcccagctgcctccagacccctaagcatctcctgtcctggcctctctgaagcagacaagggccacctatcccgggggtggatgctgagtccaggaggtgatgagcaagtgtacaaaagaaaaaagggaagggggagaggggctggtcagggagaacccagcttgggcagagtgcacctgagatttgataagatcattaaatatttacaaagcaa

SEQ ID NO: 62282 - DNA, 2201 bp, Homo sapiens
ctctggggtggcacctggcacaacagttgcccctggaagtttcagcacagcagctacaacttctcctggagcaagtggagtgactggcactggacccactgcagagaccacaactttcctaggaggaagtagcaccactggagcagaaataaaatcaggagccaccactggagcaccaggaagtaagacaggcacagctaaagtgctctctggtacgacagttgcctctgggagctccaactcagaggctacaactttctctggaatcactgaagcagtaacagtcccaagtaaaaatggatctatgaccactgcactggggagccaactctccagcagtcaaacagtgattccaggttccagtggcaccatctctcacacaactgttgcacctggaagttctgttacaggaaccaccactggtgcatcagatgatcaagtcactggaagtaaaacaggcactactggtgtggccttgagcacaactgttgcacctggaagttccagtacagaagccacaacttccacaggagtccatagaaccactgtagtgggacagaagacaggagctaccactagagggtcagcaaagcaaggaactagaagcacaatagaagctacgacgtcctttagaggcactgggaccacaggaagtggaatgaatacaggtactactggagtggtctctggcaacaccatctcacctagcagtttcaacacagaagctaccagtggcacatctgagaggccaaaccctggaagtgaaataggcaccactggcatagtctctggcacaacagttgcacctggaagttccaacacagaagccacaacttctttgggcaatggtggaaccactgaggctggaagtaaaatagttaccactgggataactactggcacgaccattgtacctgggagtttcaacacaaaggctaccacttctacagacgttggagttgccactggagttggaatggcaactgggatcaccaacataatttcagggagaagccaacctactggaagtaaaacaggctacactgtaacaggctctggaacaacagccttacctggaggtttcagaacaggcaataccccaggatcaacgggagtcaccagcagccaagaaggaaccactgtggtatcaagtggaatcactggaatcccagaaacttccatctcaggtccttccaaggaagcatctgacaaaaccactgctcctggacctcctaccacagtcactgcttccacaggagtcaaagaaacttctgaaactggagtgcaaacaggctccaccttggttacagctggagtgccaacaagaccacaagtatcccagccagaaaccactgtcgtggcaaccagagaagtagaaaccgaaaataaaacagaatgtctagcctcacttccaccagctccagtttgtcacggtccattgggagaagagaaatctcctggagacatatggactgccaattgccacagaggtacctgtactgatgcaaagactatagactgtaaacctgaggagtgcccttctccacccacatgcaaaaccggcgagaagcttgtgaagttccaatctaatgacacctgctgtgaaatcggatactgtgaaccaagaacatgtttatttaacaatactgactatgagattggtgcttcattcgatgaccccagcaacccctgtgtctcctactcctgcaaagacacgggctttgctgcagtagtccaggactgcccaaagcaaacctggtgtgcagaagcaaacagaatctatgattcaaaaaaatgttgctatacatgtaagaataattgcagatcttcccttgtaaatgtgactgttatctacagtggttgcaagaaaagagttcagatggcaaaatgcacaggggaatgtgaaaagactgccaagtacaattatgatatcttactcttggaacattcatgcctttgctgccgagaagaaaactatgaactcagagacattgtacttgactgtcctgatggcagtacaatcccttaccaatacaagcatatcacgacctgctcttgtttagacatatgccaactatatacgaccttcatgtacagttaatgctgacatcaccttcccagttttaacaggcctggtatttattttataagtgaggaaaaataatcatttaaaaagtgagaataaactaaacaatgtgaga

SEQ ID NO: 62283 - DNA, 2201 bp, Homo sapiens; identical to SEQ ID NO: 62282

SEQ ID NO: 62284 - DNA, 5560 bp, Homo sapiens
ctagatcgaaagtcctttggtaatgatgtgtcatacattctagtcatcaaagacaccattttctgggcctgaagtgttctgctggtttttggaggaatgagaatccaatctctcataagccggattcagaaaataggtcatcgatgaaacatctgtatggattatttcactataatcctatgatgcttggacttgaatcacttccagatcccacagacacctgggaaattatagagaccattggtaaaggcacctatggcaaagtctacaaggtaactaacaagagagatgggagcctggctgcagtgaaaattctggatccagtcagtgatatggatgaagaaattgaggcagaatacaacattttgcagttccttcctaatcatcccaatgttgtaaagttttatgggatgttttacaaagcggatcactgtgtagggggacagctgtggctggtcctggagctgtgtaatgggggctcagtcactgagcttgtcaaaggtctactcagatgtggccagcggttggatgaagcaatgatctcatacatcttgtacggggccctcttgggccttcagcatttgcacaacaaccgaatcatccaccgtgatgtgaaggggaataacattcttctgacaacagaaggaggagttaagctcgttgactttggtgtttcagctcaactcaccagtacacgtctgcggagaaacacatctgttggcaccccattctggatggcccctgaggtcattgcctgtgagcagcagtatgactcttcctatgacgctcgctgtgacgtctggtccttggggatcacagctattgaactgggggatggagaccctcccctctttgacatgcatcctgtgaaaacactctttaagattccaagaaatcctccacctactttacttcatccagaaaaatggtgtgaagaattcaaccactttatttcacagtgtcttattaaggattttgaaaggcgaccttccgtcacacatctccttgaccacccatttattaaaggagtacatggaaaagttctgtttctgcaaaaacagctggccaaggttctccaagaccagaagcatcaaaatcctgttgctaaaaccaggcatgagaggatgcataccagaagaccttatcatgtggaagatgctgaaaaatactgccttgaggatgatttggtcaacctagaggttctggatgaggatacaattatccatcagttgcagaaacgttatgcagacttgctaatttacacatatgttggagacatcttaattgccttaaaccccttccagaatctaagcatatactctccacagttttccagactttatcatggggtgaaacgcgcctccaatcccccccacatatttgcatcagcagatgctgcttaccagtgcatggttactctcagcaaagaccagtgcattgtcatcagcggagagagtggctctgggaagacagaaagcgcccacctgattgttcaacatttgactttcttgggaaaggccaataatcagaccttgagagagaaaattctacaagtcaactccctggtggaagcctttgggaactcatgcactgccatcaatgacaactcgagccgttttggaaaatatctggaaatgatgtttacaccaactggagttgtgatgggggcaagaatctctgaatatctcctggaaaaatccagagttataaaacaggcagcgagagagaaaaattttcatatattttactatatttatgctggtcttcatcaccaaaagaagctttctgatttcagacttcctgaggaaaaacctcctaggtacatagctgatgaaactggaagggtgatgcacgacataacttccaaggagtcttacagaagacaattcgaagcaattcagcattgcttcaggattatagggttcacggacaaagaggtgcactcagtgtacagaattttggctgggattttgaatattgggaacattgagttcgcagctatttcctctcaacatcagactgataaaagtgaggtgcccaatgctgaagctttgcaaaatgctgcctctgttctgtgcattagccctgaagagctccaggaggccctcacctcccactgtgtggtcacccggggcgagaccatcatccgtgccaacactgtagacagggctgcggacgttcgagacgccatgtccaaagccctgtatgggaggctcttcagctggattgtgaatcgcattaatacactcctgcagccagacgaaaacatatgtagtgcaggaggtggaatgaatgtggggatcttggatatctttggattcgagaattttcagagaaattcatttgagcagctctgcataaacatcgccaatgagcaaatccagtactatttcaatcagcatgtttttgctcttgagcagatggaatatcagaatgaaggcattgatgctgtacccgtggaatatgaggacaaccgcccgctcttggacatgttcctccagaaacccctgggactgcttgcacttttggatgaggaaagtcggtttccccaagcaactgaccagaccctggttgataaatttgaagataatctacgatgcaaatacttctggaggcccaaaggagtggaactgtgctttggcattcagcattatgctggaaaggtattatatgatgcttctggggttcttgagaaaaatagagacactctccctgccgatgtggttgtggtcctgagaacgtcagaaaacatgcttcttcagcagctcttctcaatccctctgaccaaaacaggtaatttggcccagacaagagctaggataacagtggcctcaagttctttgcctccacatttcagtgctgggaaagccaaggtggacactctggaggtgatacggcatccggaagaaaccaccaacatgaagaggcaaactgtggcttcttacttccggtattctctgatggacctgctctccaaaatggtggttggacagccccactttgtgcgctgcattaaacccaatgatgaccgagaggccctgcagttctctcgagagagggtgctggcccagctccgctccacagggattctggagacagtcagcatccgccgccagggctattcccaccgcatcctttttgaagaatttgtgaaaaggtattattacttggcattcacagcacatcaaacacctcttgctagcaaagagagctgtgtggctatcttggaaaagtccagattagatcactgggtgctgggaaaaacaaaggtttttctcaaatattaccatgttgagcaattaaatttgctgcttcgagaagtcataggcagagtggttgtgctgcaggcatataccaaggggtggcttggagccaggagatacaaaaaggtcagagagaagagagagaagggagccattgccatccagtcagcctggagaggatatgatgctcggaggaaatttaagaaaataagcaacagaaggaatgagtctgctgctcataatcaagcaggggacacttcaaaccaaagcagtgggccacattcccccgtcgcagcaggtacgaggggaagtgccgaggttcaagactgcagcgagcctggtgaccataaagttctcaggggctctgtacatcgtaggagccattcacaagcagaatccaacaatggccgtacacagacttcaagcaactctcctgctgtcacagagaaaaatgggcattcacaagcccagagttctccaaaagggtgcgatatcttcgcaggacatgcaaacaagcactcggtttctgggactgatttgctgtcttctcggatatgccatcctgctccagatcagcaaggattgagtctctggggagcccctcaaaagcctgcctttccacattacggatgtaacttttatgggttcagaaaatggtcttgcacagaagcatcgaacacctcgccgacgatgtcagcagcccaaaatgctgagtagccctgaggacaccatgtactataaccagttaaatggaactctagaatatcaagggagcaagaggaagccaagaaaacttggccaaatcaaagtacttgatggggaagatgaatattacaaatctctgtcaccagtggactgtatccctgaggagaacaactcagcccacccttcctttttttcttcatcctcaaaaggagactcttttgctcaacattaaattgtgcttcctaaccctaaatctgtccagagtaggaacattcatggtaatcgactgtctgtcattgcgtaagaaagcactgatatggggtcagcttctttggacatatggtccatgcctgaaccttactgaaccacttgcagattccaaaacatcttatcctatcctctaccactctcccacatgtgttgtgcagcctgagctgggcgctgccttcctttctcatcccatggggccctgtgggacactgagaacacctttacaatagtttaaacagtcattcatgcccccagtgtctaggaagataacagccagtctcaccccagtctaatcatggaccctgataatattgcttgatttttcctatcaagttacttttcaatccattcagaatctgccccagtggagacccaggagttcctttcctgcactcttctccatcctcccacctttgctgggcttttctatcactcccacctcccccagagtcagggctccattgctgagtgccccatcctggaggattggccccaagatctcctagaacaggataattgcctgtgtttaggcagataggcctaaatctttcagattctttctacaaggcaaataacccctctcttgttaattatgatgctgagaaagcctctgtctctttatttcaccttgccaagacacccacactactttggtgatgaaaagaaaggaatgagagggaaagtttggacctgtcactttggtgacagggaaagtccaggtcactttattctgtaactctccattcactggtcaaataactccatgaggctatcagtggctacagtggaaggacctgatcttgtccatctttgtgtgcacagagcctagcacagggcttggtagagggtatatctagtgaatggagaatacatggagaaacttaactaagttacacaagcatatctgacaggaatgttaccttcaattgtatgttacatatgattagtcacttttcatacactataacctctgatttttcactcaagtttgggctgattatattgtaatgatgttagataatactcaacatgattcagtatgacaaacttttttgagcacctactttatataaaacatgacaaattgcagtgtgatgtaatcaaaaacaaagaagccctataagaccatttctctagaacagatgttcttaatatttttcttactctaaaatatgtggtagatagtatgcaagaaaagccgggtgcggtggctcaggcctgtaatcccagcactttgggaggccaagatgggcggatcatgaagtcaggagttcgagaccagcctgaccaacatggtgaaaccccgtctctactaaaaaaaa

SEQ ID NO: 62285 - DNA, 8473 bp, Homo sapiens
gcgtccgctcgcccggaccctgaggctgctgggcccaccctcccggaaccgtccgaccctcggtggcctcggctcgttctgccatctccggtcctaccctggggcggagggtggaaggcagcttccgtcgaagaggagggggctgcggtggccaccgcggcggagcccgagttattttaccaagaaaatggtttgcacgactttgaacatatactatccatgctgatgggacaggatccaatatgaatataaatgatggaggaagacgacgctttgaagataatgaacatacattacggatatatcctggggctatttcagaagggacaatctactgtccgattcctgccagaaaaaactccacagctgctgaggtgattgagtctcttataaacaaacttcatcttgacaaaacaaaatgttacgttctagcagaggtaaaggaatttggtggagaagaatggattctcaatccaacagattgtccagttcagcaaatgatgctgtggccccgaatggctctggaaaatcgcttaagtggagaagactaccgcttccttctgagagagaaaaaccttgatggatcaatccattatggtagcctgcagtcatggctacgggtaacagaagaacgtcgcaggatgatggaacggggttttcttccacagcctcaacagaaagactttgatgatttatgtagtttacctgatttgaatgagaaaactctcttagaaaacctacgagatcgctttaagcatgaaaaaatttatacctatgttggcagtattctaatagttattaacccattcaagtttcttcctatttataaccccaaatatgtcaaaatgtatgataaccaccaactgggaaaacctgagccccacatttatgctgtggctgatgtagcttatcatgccatgcttcagcgcaaaaagaatcagtgcatcgtgatttcaggagagagtggttctgggaagactcaaagcacaaactttcttattcaccaccttactgctctcagtcagaaaggatttgccagtggagtagaacagattattcttggagctggaccagtacttgaggcctttggaaatgcaaagacagctcataataacaattcaagtcgttttgggaagtttattcaagtaaattaccaggaaacaggcactgtacttggtgcctatgttgaaaaatatctactggagaagtccagactcgtttatcaggagcataatgaacggaactatcatgtattctattacctcctggcaggagcaagtgaagatgagagatcagcattccatcttaagcaaccagaggaatatcattatctcaatcagataacaaagaaacccctcagacagagctgggatgattattgctatgactctgagccggattgcttcacggtggaaggagaagatttgagacatgactttgagcgcctacaacttgccatggaaatggtaggatttcttcccaagacacgaagacagattttctctcttctctcagccatactacatttgggtaatatctgttacaaaaagaagacataccgggatgactccattgatatctgtaatcctgaagttctgcctattgtctcagaattattagaggttaaagaagagatgctatttgaagcattagttacaaggaagacggtgacagtgggagaaaagcttattttgccatacaagttggcagaggctgtgacagtgaggaactccatggctaagtctctgtatagtgccctgtttgactggatagtttttcgaattaatcatgcacttctgaatagtaaagatttagagcataataccaagacattgtctattggtgttcttgatatttttgggtttgaagattatgaaaataacagctttgaacagttctgtattaattttgctaatgaacgtttacagcactactttaatcagcatatctttaaattggaacaagaggaatatagaactgaaggtatcagctggcacaacatagattacattgataatacctgctgcataaatcttattagcaaaaaaccaacaggactgcttcatcttttggatgaagaaagcaactttccacaggctacaaatcaaacattgctagacaagtttaagcatcaacatgaagataattcttacatcgaatttccagccgtgatggagcctgctttcattataaaacattatgctggaaaagtaaaatatggggtaaaggatttccgggaaaaaaatacagatcatatgcgcccagacattgtagctcttctgagaagcagcaagaatgcatttatctctgggatgattggaattgatcctgtagctgttttccgatgggcaattctccgagcttttttcagagccatggttgctttcagggaagctgggaaaagaaacattcacagaaaaactggacatgatgatacagcgccatgtgcaattttgaaaagtatggatagttttagctttctccaacacccagtccaccagaggagcttagagattctgcagagatgcaaggaagagaagtacagtataacccggaaaaatcccagaacacctctttctgatctccagggcatgaatgctctaaatgaaaaaaaccaacatgatacatttgatattgcctggaatggcagaactgggattcgccagagcagactatcaagtggcacctccttgcttgataaagatggaatatttgctaattcaactagcagcaaactcctggagagagcccatggaattctcacgagaaacaaaaatttcaaatccaagcctgcccttccaaagcacttgctagaagtaaattctttaaagcacctgacaagactgacactacaagatcgcattaccaagtctcttcttcatttacacaagaagaaaaaacctcccagcatcagtgcccagtttcaggcatcattaagcaagctaatggaaacacttggtcaagcagaaccatattttgtaaaatgcattcgctctaatgctgaaaagctgcccttaaggttcagtgatgtcttggtacttagacagcttcgatacaccgggatgctggaaacagttcaaattcgccaatcaggatacagctccaaatattctttccaggattttgtgagccacttccatgtacttcttccccgaaatattattccatccaaatttaacattcaggatttcttcaggaaaataaatcttaatccagataattatcaagttggaaaaaccatggtctttctaaaggagcaggaacgacagcacttacaagatctgcttcaccaagaggtgctccgcagaatcatattgttgcagcgatggttcagggtcttgctgtgtaggcagcatttcctccatctgagacaagcatctgttattatccagagattctggaggaattacctaaatcagaagcaagtcagagatgcagctgtgcagaaggatgcttttgttatggctagtgcagctgctcttctccaagcttcctggcgtgctcacttagagaggcagcggtacttggagttacgggctgcagccatcgttatccagcagaaatggagagattactataggcgcaggcacatggctgctatttgcatacaagcaagatggaaagcctacagggaaagtaaaaggtaccaagaacaaaggaaaaaaattatccttttgcaatcaacatgtagaggattcagagcaagacaaagatttaaagctttaaaagaacaaaggctaagagaaacaaagccagaagttggattggtgaatattaagggatatggatctctggaaattcagggttcagacccttcagaatgggaggattgttcttttgacaacagaataaaagccatagaggaatgtaaatctgtaatagagagtaatcgaattagccgtgaaagttcagtggactgcttgaaggagtcaccaaacaagcagcaggagagagcccaaagccagagtggtgtggacttgcaggaagatgtgcttgtaagagagagacccaggtccttggaggatctccatcagaaaaaagtaggccgggctaagagagaaagtaggagaatgagagaactagagcaagctatatttagcttagaattgctgaaagttcgttctcttggtggtatttctccttcagaggatcgcagatggtctacagaattggtgcctgaaggccttcagtctccacggggtacacctgatagtgagagctctcaaggaagcttggaacttctgagctatgaggaaagccaaaagagcaaactagagtctgtcatttcagatgaaggagacttgcagtttccatcacctaagatatccagcagtccaaaatttgattcacgggacaatgccctcagtgcctcaaatgagactagcagtgcagagcatttgaaggatggaactatgaaggaaatggtggtctgcagttctgagtctattacctgtaaaccacagctgaaagactccttcatttcaaatagtctacctacttttttttatatcccccaacaagacccactgaaaacaaattcccaactagacacaagtatccaaagaaacaaactattggaaaatgaagacacagcgggggaagctcttactttggatatcaacagggaaactagaaggtatcactgctcaggaaaagatcagattgttccttctttgaatacagagtcttctaatcctgtgcttaagaagttagaaaagctaaacactgagaaggaagaaaggcaaaaacagttgcagcaacagaatgaaaaagagatgatggaacagattcgccagcaaacagatattttagagaaggagcgcaaagccttcaagacaattgaaaagccaagaattggagagtgtttggtggcaccatcttcctatcagtcaaagcaaagagtagagaggccatcctctctcctcagcttaaatacctcaaataagggagaacttaatgtactggggtccctatcattaaaagatgcagctcttgcccaaaaagacagttcctctgctcacttacccccaaaggaccgacctgtcaccgtgttctttgaaagaaaaggaagtccatgccaatctagtactgtcaaggaattatccaagacagacagaatgggcacccagctgaatgtagcctgtaaactctcaaataatcgcatttcaaaaagagaacactttaggccaactcagtcttacagccacaattctgatgacctttccagagagggaaatgctaggcccattttcttcactccaaaggataatatgagtattccccttgtcagcaaagaagccttaaacagtaaaaatcctcaactccataaagaagatgaaccagcatggaaacctgtgaagttagctgggccaggccaaagagagacatcacagcgattttcgtcagttgatgaacaagcaaaacttcataagactatgtctcaaggagagattaccaagttggcagtgagacagaaggcttcagattcagatataagacctcagagagctaagatgagattctgggccaaagggaaacaaggggagaagaagactaccagagtgaaacctactacccagtcagaggtttcgccactctttgcaggcacagatgtgattccagctcatcagtttccagatgaattagctgcatatcacccaacacctcctttgagcccagaactgcccggcagttgccggaaggaattcaaagagaacaaagaaccttctccaaaggctaagcgcaagcgaagtgtgaagattagcaacgtggctttggattctatgcattggcaaaatgactctgtccagatcatagcaagtgtcagtgatttaaaaagcatggatgaatttcttctgaaaaaggtgaatgacctagataatgaagacagcaagaaggatacactagtggatgttgtatttaaaaaagccctgaaggaatttcggcagaatatcttcagcttttattcatctgcattggcgatggatgatgggaaaagcatacggtataaagacctctatgcactatttgaacagattctggaaaagacgatgaggcttgagcagcgtgattcactgggtgaatctccagtgagagtttgggtcaacacttttaaagtgtttttagatgaatatatgaatgaattcaagacttcagattgcacagccacaaaggtgccaaaaacagaaagaaagaaaagaaggaaaaaggaaactgatttggtggaagaacacaatggtcacatctttaaagccacccaatatagcatccctacatactgtgaatactgttcttctttgatatggataatggaccgagcctctgtttgcaaattatgcaagtatgcttgccataagaagtgctgtctgaaaaccacagccaagtgctctaaaaagtatgatccagagctgtcatctcgacaatttggggttgaactgtcccgtttgaccagtgaagaccgaactgttcctttagtagtggaaaagctcataaactacattgaaatgcatggactgtatacagaaggtatttatcgaaagtctggttcgactaataaaatcaaggagcttcggcagggtctagatacagatgctgagagtgtaaatctagatgactataacatacacgtcattgcaagtgtattcaaacaatggcttcgagatttgcccaatcctctcatgacctttgaactctatgaggaatttcttcgagctatgggccttcaggagaggaaggagacaatccgtggtgtatactctgtgattgatcaactctcccgaactcatctcaatacactggaacgcctcatctttcatctagtcaggattgctctgcaggaagacactaatcgaatgtctgctaatgctttggccattgtgtttgcgccctgcattctccgctgccctgacaccactgacccactacaaagtgtacaggacatcagtaagactaccacttgtgtggaactgattgttgtggaacaaatgaataaatacaaggctcgtctcaaagatatcagtagcttggaatttgctgagaataaggcaaagaccaggttgtcactgattcgtagatcaatgggaaaggggcgtattcgtcgaggaaactatccaggtccatcgtctcctgttgtagttcggttgccttctgtgtctgatgtctcagaggagaccttgactagtgaggcagccatggagactgacatcacagaacagcagcaagcagctatgcagcaggaggagagagtactgactgagcagattgagaacctacagaaggagaaggaggagctaacatttgagatgcttgtactggaaccccgtgcctctgatgatgaaacccttgagtctgaggcctccattgggactgctgatagctcagagaatttgaatatggagtctgaatatgctatctctgagaaatcagaaagaagcttagcccttagctccctgaagacagctggcaagtctgaaccttccagcaagttgcgaaagcaacttaaaaagcagcaagactctttagatgtcgtggactcttcggtctcctctttatgtctgtctaacacggcatcatctcatgggaccagaaaactatttcagatttattccaaatctccattctaccgagctgcctcaggtaatgaggccctgggaatggaaggaccattgggccagaccaaattcctggaagacaagcctcagttcatcagcagaggaaccttcaacccggaaaagggcaaacaaaaattaaagaatgtgaaaaactcacctcagaaaaccaaagagaccccagaggggacagtcatgtctggccgcagaaaaactgtggacccagactgcacctccaaccaacagctagcactctttggaaataatgaatttatggtctgaaccggcagatgtgtgtccctccgtggctacagagtggtaaacaaatctcacctttggggctgcgtttcatcacctcgtccacaatagtcaatcctaattgtggtcctgcctcttttctaagcatatggctaagactgtatgtgctgaattcctgggcctcctgcagaagcagaaagcctgctggggatggtgccagctgtgccttggctgttgtatttgaattgagatttttactatacaaagccacctagggcctggggatttgggtcagttgtagttgcctctcccccaccctcttttcccttcccaaaggtgggtgttgaactaggggggatattgctgtcctgagggaccctctcatttctgacatttgaagaaaacgtataaatctttcttaaccgtgaaagcaaaagcctttgggtttattttgggatagttaggagctagggtagaatataatttttttccaaaaacttacttacaaacaaaaagcctaatccctctattttaagatttctgaaaaaacactccatgttatattctggggaaagcaaaaacaaaaaaaaaaaaaaaaaaaaaaaaaa

SEQ ID NO: 62286 - DNA, 2037 bp, Homo sapiens
agaaataatgtatggagggactacacaagggcatatatactagtaaaagtgttttctcaatagatcaccaaagaatttgccacacctgatatatagaaaagtttattgtgcagcacctctaccttcgctctcctgctcctgctctggccacataaaacgtgctggctcctcctttgccttctgctatcattggaagcttcctgatgcctcccaagaagcaaatgccatcatggttcctgtacagcctgcagaaccccccgaggtactgaagagtgagccgtatggggagaaggctgatgtctgggcagtaggctgcatcctttatcagatggcgactttgagtccccccttctacagcactaacatgctgtccttggctacaaaaatagtggaggcggtatatgaaccagtgccagaaggtatctactctgaaaaagtaacagacaccatcagcaggtgcctcactcctgatgcggaagctcgtccagatattgtagaagtcagttcgatgatatcagatgtcatgatgaaatatttagacaacttatctacatcccagttgtccttggaaaagaagctagaacgggaacgaagacgcacacaaaggtattttatggaagccaaccggaacaccgtcacatgtcaccatgagctggctgttctatctcacgagacctttgagaaggcaagtttgagtagcagcagcagtggagcagccagcctgaaaagtgaactttcagaaagcgcagacctgccccctgaaggcttccaggcctcctatggtaaagacgaagacagggcctgtgacgaaatcctgtcagatgataacttcaacctggaaaatgctgagaaagatacatattcagaggtagatgatgaattggacatttcggataactccagcagctccagttcaagccctctgaaagaatctacattcaacattttaaagagaagttttagtgcttcaggaggagaaagacaatcccaaacaagggacttcactggaggaacaggatcaagaccaagaccagctttgctgcctcttgacctgcttctgaaagtgccaccccatatgctcagggcccacattaaggaaatagaggctgagttagtgacagggtggcagtcccatagccttcctgctgtgattcttcgaaatctcaaagatcatgcatcagcaggaattgctgtgtcccagaggaaagtgcgtcagatcagtgatcctattcagcagatattaattcagctgcacaaaataatctatatcacacagcttcctccagctttgcaccacaatttgaaaagaagggttatagagagattcaagaaatccctcttcagccagcagagtaacccttgtaatttgaaatctgaaattaaaaagttatctcagggatctccagaaccgattgagcccaactttttcacagcagattaccatttattacatcgttcatccggtggaaacagcctgtccccaaatgaccctacaggtttaccaaccagcattgaattggaggaaggaataacatatgaacagatgcagactgtgattgaagaagtccttgaggaaagtggctattacaattttacatctaacaggtatcattcctatccatgggggaccaagaatcacccaaccaaaagatgaaaatgctgcattttgagtggacttgattttctcagtgaagttcaagttctggacttcagccgctattgcaagatgcccaaggattgggtgctgctagagggtgtggaaaagaccaagatgccatggggcctgcaggacttctttctgggggtcctgtgctggagtatatgacagctgcggtacttgagggcttcattgccagaacacattatatacaggatgtcagagctaccagtgtgctgctgggagaaaatgctgcaaaattcatcttttggagggtggggggaaaacccaaaaacaacaacaaaaaaactctcttacagaattttccttaacattaaaaaaaacttgtcatatttttcaaaggcaaaaaaaaaaaaaaa

SEQ ID NO: 62287 - DNA, 6683 bp, Homo sapiens
tcacatttatcttctgtgtccacccagttctgctgaaacccctggcaagatcgtggccctgttgtagcttgtcatgttttgaacagctgtctatggaaagaaagcaaacacaacctagagcaacattgatttgttttagaaagctcttttattttcagttctggctgtgttcaacatcttagcttacgtttttcatgttgtaatgatctgccgtacggacgatcacctctaagttagagagttctgtaatttggcttggattaaagatgcttggttagtgaaagctgctgctttttttatagtcaaaggactggttctgagagccttgttgcagatggctgaggtcaccgtcccaagggtgtatgtcgtgtttggcatccattgcatcatggcgaaggcatcttcagatgtgcaggtttcaggctttcatcggaaaatccagcacgttaaaaatgaactttgccacatgttgagcttggaggaggtggccccagtgctgcagcagacattacttcaggacaacctcttgggcagggtacattttgaccaatttaaagaagcattaatactcatcttgtccagaactctgtcaaatgaagaacactttcaagaaccagactgctcactagaagctcagcccaaatatgttagaggtgggaagcgttacggacgaaggtccttgcccgagttccaagagtccgtggaggagtttcctgaagtgacggtgattgagccactggatgaagaagcgcggccttcacacatcccagccggtgactgcagtgagcactggaagacgcaacgcagtgaggagtatgaagcggaaggccagttaaggttttggaacccagatgacttgaatgcttcacagagtggatcttcccctccccaagactggatagaagagaaactgcaagaagtttgtgaagatttggggatcacccgtgatggtcacctgaaccggaagaagctggtctccatctgtgagcagtatggtttacagaatgtggatggagagatgctcgaggaagtattccataatcttgatcctgacggtacaatgagtgtagaagattttttctatggtttgtttaaaaatggaaaatctcttacaccatcagcatctactccatatagacaactaaaaaggcacctttccatgcagtctttcgatgagagtggacgacgtaccacaacctcatcagcaatgacaagtaccattggctttcgggtcttctcctgcctggatgatgggatgggccatgcatctgtggagagaatactggacacctggcaggaagagggcattgagaacagccaggagatcctgaaggccttggatttcagcctcgatggaaacatcaatttgacagaattaacactggcccttgaaaatgaacttttggttaccaagaacagcattcaccaggcggctctggccagctttaaggctgaaatccggcatttgttggaacgagttgatcaggtggtcagagaaaaagagaagctacggtcagatctggacaaggccgagaagctcaagtctttaatggcctcggaggtggatgatcaccatgcggccatagagcggcggaatgagtacaacctcaggaaactggatgaagagtacaaggagcgaatagcagccttaaaaaatgaactccgaaaagagagagagcagatcctgcagcaggcaggcaagcagcgtttagaacttgaacaggaaattgaaaaggcaaaaacagaagagaactatatccgggaccgccttgccctctctttaaaggaaaacagtcgtctggaaaatgagcttctagaaaatgcagagaagttggcagaatatgagaatctgacaaacaaacttcagagaaatttggaaaatgtgttagcagaaaagtttggtgacctcgatcctagcagtgctgagttcttcctgcaagaagagagactgacacagatgagaaatgaatatgagcggcagtgcagggtactacaagaccaagtagatgaactccagtctgagctggaagaatatcgtgcacaaggcagagtgctcaggcttccgttgaagaactcaccgtcagaagaagttgaggctaacagcggtggcattgagcccgaacacgggctcggttctgaagaatgcaatccattgaatatgagcattgaggcagagctggtcattgaacagatgaaagaacaacatcacagggacatatgttgcctcagactggagctcgaagataaagtgcgccattatgaaaagcagctggacgaaaccgtggtcagctgcaagaaggcacaggagaacatgaagcaaaggcatgagaacgaaacgcacaccttagaaaaacaaataagtgaccttaaaaatgaaattgctgaacttcaggggcaagcagcagtgctcaaggaggcacatcatgaggccacttgcaggcatgaggaggagaaaaaacaactgcaagtgaagcttgaggaggaaaagactcacctgcaggagaagctgaggctgcaacatgagatggagctcaaggctagactgacacaggctcaagcaagctttgagcgggagagggaaggccttcagagtagcgcctggacagaagagaaggtgagaggcttgactcaggaactagagcagtttcaccaggagcagctgacaagcctggtggagaaacacactcttgagaaagaggagttaagaaaagagctcttggaaaagcaccaaagggagcttcaggagggaagggaaaaaatggaaacagagtgtaatagaagaacctctcaaatagaagcccagtttcagtctgattgtcagaaagtcactgagaggtgtgaaagcgctctgcaaagcctggaggggcgctaccgccaagagctgaaggacctccaggaacagcagcgtgaggagaaatcccagtgggaatttgagaaggacgagctcacccaggagtgtgcggaagcccaggagctgctgaaagagactcttaagagagagaaaacaacttctctggtcctgacccaggagagagagatgctggagaaaacatacaaagaacatttgaacagcatggtcgtcgagagacagcagctactccaagacctggaagacctaagaaatgtatctgaaacccagcaaagcctgctgtctgaccagatacttgagctgaagagcagtcacaaaagggaactgagggagcgtgaggaggtcctgtgccaggcaggggcttcggagcagctggccagccagcggctggaaagactagaaatggaacatgaccaggaaaggcaggaaatgatgtccaagcttctagccatggagaacattcacaaagcgacctgtgagacagcagatcgagaaagagccgagatgagcacagaaatctccagacttcagagtaaaataaaggaaatgcagcaggcaacatctcctctctcaatgcttcagagtggttgccaggtgataggagaggaggaggtggaaggagatggagccctgtccctgcttcagcaaggggagcagctgttggaagaaaatggggacgtcctcttaagcctgcagagagctcatgaacaggcagtgaaggaaaatgtgaaaatggctactgaaatttctagattgcaacagaggctacaaaagttagagccagggttagtaatgtcttcttgtttggatgagccagctactgagttttttggaaatactgcggaacaaacagagccgtttttacagcaaaaccgaacgaagcaagtagaaggtgtgaccaggcggcatgtcctaagtgacctggaagatgatgaggtccgggacctgggaagtacagggacgagctctgttcagagacaggaagtcaaaatagaggagtctgaagcttcagtagagggtttttctgagcttgaaaacagtgaagagaccaggactgaatcctgggagctgaagaatcagattagtcagcttcaggaacagctaatgatgttatgtgcggactgtgatcgagcttctgaaaagaaacaggacctactttttgatgtttctgtgctaaaaaagaaactgaagatgcttgagagaatccctgaggcttctcccaaatataagctgttgtatgaagatgtgagccgagaaaatgactgccttcaggaagagctgagaatgatggagacacgctacgatgaggcactagaaaataacaaagaactcactgcagaggttttcaggttgcaggatgagctgaagaaaatggaggaagtcactgaaacattcctcagcctggaaaagagttacgatgaggtcaaaatagaaaatgaggagctgaatgttctggttttgagacttcaaggcaagattgagaagcttcaggaaagcgtggtccagcggtgtgactgctgcttatgggaagccagtttagagaacctggaaatcgaacctgatggaaatatactccagctcaatcagacactggaagagtgtgtgcccagggttaggagtgtacatcatgtcatagaggaatgtaagcaagaaaaccagtaccttgaggggaacacacagctcttggaaaaagtaaaagcacatgaaattgcctggttacatggaacaattcagacacatcaagaaaggccaagagtacagaatcaagttatactggaggaaaacactactctcctaggctttcaagacaaacattttcagcatcaggccaccatagcagagttagaactggagaaaacaaagttacaggagctgactaggaagttgaaggagagagtcactattttagttaagcaaaaagatgtactttctcacggagaaaaggaggaagagctgaaggcaatgatgcatgacttgcagatcacgtgcagtgagatgcagcaaaaagttgaacttctgagatatgaatctgaaaagcttcaacaggaaaattctattttgagaaatgaaattactactttaaatgaagaagatagcatttctaacctgaaattagggacattaaatggatctcaggaagaaatgtggcaaaaaacggaaactgtaaaacaagaaaatgctgcagttcagaagatggttgaaaatttaaagaaacagatttcagaattaaaaatcaaaaaccaacaattggatttggaaaatacagaacttagccaaaagaactctcaaaaccaggaaaaactgcaagaacttaatcaacgtctaacagaaatgctatgccagaaggaaaaagagccaggaaacagtgcattggaggaacgggaacaagagaagtttaatctgaaagaagaactggaacgttgtaaagtgcagtcctccactttagtgtcttctctggaggcggagctctctgaagttaaaatacagacccatattgtgcaacaggaaaaccaccttctcaaagatgaactggagaaaatgaaacagctgcacagatgtcccgatctctctgacttccagcaaaaaatctctagtgttctaagctacaacgaaaaactgctgaaagaaaaggaagctctgagtgaggaattaaatagctgtgtcgataagttggcaaaatcaagtcttttagagcatagaattgcgacgatgaagcaggaacagaaatcctgggaacatcagagtgcgagcttaaagtcacagctggtggcttctcaggaaaaggttcagaatttagaagacaccgtgcagaatgtaaacctgcaaatgtcccggatgaaatctgacctacgagtgactcagcaggaaaaggaggctttaaaacaagaagtgatgtctttacataagcaacttcagaatgctggtggcaagagctgggccccagagatagctactcatccatcagggctccataaccagcagaaaaggctgtcctgggacaagttggatcatctgatgaatgaggaacagcagctgctttggcaagagaatgagaggctccagaccatggtacagaacaccaaagccgaactcacgcactcccgggagaaggtccgtcagttggaatccaatcttcttcccaagcaccaaaaacatctaaacccatcaggtaccatgaatcccacagagcaagaaaaattgagcttaaagagagagtgtgatcagtttcagaaagaacaatctcctgctaacaggaaggtcagtcagatgaattcccttgaacaagaattagaaacaattcatttggaaaatgaaggcctgaaaaagaaacaagtaaaactggatgagcagctcatggagatgcagcacctgaggtccactgcgacgcctagcccgtcccctcatgcttgggatttgcagctgctccagcagcaagcctgtccgatggtgcccagggagcagtttctgcagcttcaacgccagctgctgcaggcagaaaggataaaccagcacctgcaggaggaacttgaaaacaggacctccgaaaccaacacaccacagggaaaccaggaacaactggtaactgtcatggaggaacgaatgatagaagttgaacagaaactgaaactagtgaaaaggcttcttcaagagaaagtgaatcagctcaaagaacaagtgagcctacccggtcatctctgttcacccacctcacattccagctttaactccagttttacatccctttattgccattaactcgttaacttatgttgtctaataaaggcaaattctattataaaaaaaaaaaaaaaaa

SEQ ID NO: 62288 - DNA, 2604 bp, Homo sapiens
gccaatgggcgcgcggggaggcgcgggccgcggcggcgggctgggggctcggcgctcccgggcgtcagtcgggccgcggcgacggcggcaggagcgcgtcccggcgccgcctcgggctccgctcggctcgggggctgcttcgggaggaggagagccaagggaggcgccaggcccgcgggccgggcgcatggcttagggacgctcccggccgccgcagccccagcatggggaaacttcactccaagccggccgccgtgtgcaagcgcagggagagcccggaaggtgacagcttcgccgtgagcgctgcctgggctcggaagggcatcgaggagtggatcgggagacagcgctgcccgggcggtgtctcgggaccccgacagctgcggttggcgggcaccataggccgaagcacccgggagctcgtgggcgacgtgttgagagacacgctcagcgaggaagaggaggacgactttcggctggaagtggccctgcctcctgagaagactgacgggctgggcagcggagatgagaagaagatggagagagtgagcgaaccctgcccaggctccaagaagcagctgaagtttgaagagctccagtgcgacgtgtccatggaggaggacagccggcaggagtggaccttcaccctgtatgactttgacaacaacggcaaggtcacccgagaggacatcaccagcttgctgcacaccatctatgaggtggtggactcctctgtcaaccactccccaacatccagcaagatgctgcgggtaaagctcaccgtggcccccgatggcagccagagcaagaggagcgtccttgtcaatcaggctgacctgcagagcgcaaggccccgagcagagaccaagcccactgaggacctgcggagctgggagaagaagcagcgagccccgctcaggttccagggtgacagccgcctggagcagtctggctgctaccaccattgcgtagatgagaacatcgagaggagaaaccactacttagatctcgccgggatagaaaactacacgtcccaatttgggcctggctccccttccgtggcccagaagtcagaactgcccccccgcacctccaatcccactcgatctcgctcccatgagccggaagccatccacatcccacaccgaaagccccaaggcgtggacccggcctccttccacttccttgacaccccaatcgccaaggtctcagagctccagcaacggctccggggcacccaggacgggagcaagcactttgtgaggtcccccaaggcccagggcaagagtgtgggtgtgggccacgtggccagaggggcaagaaacaagccccctctgggacccgccatccctgcggtgtccccctccgcccacctggctgccagcccggccctcctcccctccctagcccccctcgggcacaagaagcacaagcaccgagccaaggagagccagcagggctgccggggcctgcaggcaccactggcctcaggtggccctgtcctggggcgggagcacctgcgggagctgcccgccttggtggtgtatgagagccaggccgggcagccggtccagagacatgagcaccaccaccaccatgaacatcaccaccattaccaccacttctaccagacatagagcccctccccagggccccaccctgccatatgaaggaccccacccccgacaccacaaggcattattattctattaattattgttattatgatgattattgttattaataattattgttactccactaatatttagctagcctacatgtagaagatctatggaaacacagaactaaacttttatttatatgttgtggggactgcataactagcccaggaaatgactctggttttgagtggcctgtaatgggcagaggctccctcggggctcgggatctgcagcatctatgtggatcagcccacacccttcccagagccagggagcccttagcctcaactctgccccaccccagcctcttccaggagagcacccttacttggcccggcttccagagaccctcgaaatctccgagaagataaacagctgctacctcttagtattattctgattttattttgcccttaactgattgttatatgctacaagggatttcagtggactgcagagtgcgaacgtcttgctgttgtgtttttatgtcccaacctagaaaccttagctgtcttttctggagttgtctttcatgcttttccagtgggatcaagcccttttccccaagagtcccatctcttctgccatgcacgacatgaaaatccacttctcttccttctccttcttctctctctactttacagtgatacacacacgtatttaaggactatccctgagaccatccctctcattttggaaactgctagggagggaaccaaccacttaaacaagcgtggttttccaagatccaggcaattgtgtgctgttggttgtggtggaggatgtggcacatatatacgtacctacacggttctctaacagagctttctgtatctatagatagatgccatctgtccatttctatgtatctttctataaatatacactctcaggtatctttaaaaaaaaaaaaaaaaaa

SEQ ID NO: 62289 - DNA, 1857 bp, Homo sapiens
ccggacctcggctttcaaagcggcctgggtgggaagagctgtttatataaacagagattccgctgtaaatgcgctaatatcccggctgccagcgcatggcgagcgcctcccacgcccatccgtaggagcggcgtcccggccgcccctccgttcccagcctgccctgcccccgcctccttcccctcctcggccatggccacctctggacgcctgagcttcaccgtgcgcagccttctagatttacccgagcaggacgcgcaacacctgccgaggcgggagccagaaccacgcgccccccagcccgacccctgcgccgcctggctggattcggagcgcggccactacccttcctcggacgagagcagcctggagaccagcccgccagactcgtcgcagcggccgtccgctaggcccgcgtctccgggctcggacgccgagaaaaggaagaagcggcgggtgctattctccaaggcgcagacgctggagttggagcggcgcttccggcagcagcggtacctgtctgcgcccgagcgcgagcagctggcgagcctgcttcgcctcacgcccacgcaggtcaagatctggttccagaatcatcgctacaagctgaagcgcgctcgcgctccaggggcggcggagtcgcctgacctggcagcatccgccgagctgcacgccgcgcccggcctgctgcgtcgcgtggtggtgccggtgcttgttcgcgacgggcagccgtgcggcggcggcggcggtggcgaggtgggaaccgccgcggcccaggagaagtgcggcgcccctccagccgccgcctgccctctgccgggctaccctgccttcggtcccggctcggcgcttggcctcttccccgcctaccagcacttagcatcccccgccctggtctcctggaactggtgaggccgcagggcggcacctggggctaccctcgactttggagcgcgctctgcgattggagcagggccggagccgaacgcctggaacgctctccgtccgcctccctgcagccccatctccttgggcgccagggtccctggcgcgccctcatcagccgtcgcgcaagcacacacgagggacgtgtgccagagccccctccctcaccttccctccaccgccagccccagagttagattttatgcttgggccttatttgtatatttttaaatagcgatttgtataggaagcaagttatttttttaaaaaatagagtatttttcctcgtagttcgagaataaaatgtgtggggttgggtcccctgcgcgcctgcggggaacgtaggcgggagtcgtgccccccagaccggtgttcgcatcgctggctcgccccttgactggctaagtggggcccggccccagctggatcgaagggcgggttgcagtcccgacacggctttaggaagatacctgggggatggaggggtggtgatgtcagggttgggcgcgggaagaaaaggagaggaggaagctgaggcaactttgggattcttgtcagcgggaggcgtcactggccccagagtgactccgactctccgctgggctcccagagctgctggcgtttcgaataccgaaaagtcaaccctgtggaccacgacagggcagaaggagtttctccggagatgagccggcgaggccaggtgcggggcgcgctgcaccggagcagcccaggccgggccgcaagctgtttccagagtgcaggagccaagtgctcggggaccctttgaaaagtgcctggggacctgaagagcaccggggaatttgtaacccctatttaagcctgcaagtgcctaagttaaaaaaaaaaaaaaaaaaaaaaaaaaaaaaaaaaaaaaaaaaaaaaaaaaaaaaa

SEQ ID NO: 62290 - DNA, 1744 bp, Homo sapiens
atgcacgcccactgcctgcccttccttctgcacgcctggtgggccctactccaggcgggtgctgcgacggtggccactgcgctcctgcgtacgcgggggcagccctcgtcgccatcccctctggcgtacatgctgagcctctaccgcgacccgctgccgagggcagacatcatccgcagcctacaggcagaagatgtggcagtggatgggcagaactggacgtttgcttttgacttctccttcctgagccaacaagaggatctggcatgggctgagctccggctgcagctgtccagccctgtggacctccccactgagggctcacttgccattgagattttccaccagccaaagcccgacacagagcaggcttcagacagctgcttagagcggtttcagatggacctattcactgtcactttgtcccaggtcaccttttccttgggcagcatggttttggaggtgaccaggcctctctccaagtggctgaagcgccctggggccctggagaagcagatgtccagggtagctggagagtgctggccgcggccccccacaccgcctgccaccaatgtgctccttatgctctactccaacctctcgcaggagcagaggcagctgggtgggtccaccttgctgtgggaagccgagagctcctggcgggcccaggagggacagctgtcctgggagtggggcaagaggcaccgtcgacatcacttgccagacagaagtcaactgtgtcggaaggtcaagttccaggtggacttcaacctgatcggatggggctcctggatcatctaccccaagcagtacaacgcctatcgctgtgagggcgagtgtcctaatcctgttggggaggagtttcatccgaccaaccatgcatacatccagagtctgctgaaacgttaccagccccaccgagtcccttccacttgttgtgccccagtgaagaccaagccgctgagcatgctgtatgtggataatggcagagtgctcctagatcaccataaagacatgatcgtggaagaatgtgggtgcctctgatgacatcctggagggagactggatttgcctgcactctggaaggctgggaaactcctggaagacatgataaccatctaatccagtaaggagaaacagagaggggcaaagttgctctgcccaccagaactgaagaggaggggctgcccactctgtaaatgaagggctcagtggagtctggccaagcacagaggctgctgtcaggaagagggaggaagaagcctgtgcagggggctggctggatgttctctttactgaaaagacagtggcaaggaaaagcacaagtgcatgagttctttactggattttttaaaaacctgtgaaccccccgaaactgtatgtgaaagttgagacatatgtgcatgtattttggaggtgggatgaagtcacctatagctttcatgtattctccaaagtagtctgtgtgtgacctgtccccctccccaaagattaaggatcactgtatagattaaaaagagtccgtcaatctcattgcctcaggctgggttgggggagccccacagctttctggctggccagtggcaatctactggccttgtccagaggctcactggagtggttctctgctaatgagctgtacaacaataaagccattgtctagttaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 62291 - DNA, 1903 bp, Homo sapiens
gcggcgcggaggggcgcggagcggcgcggagccgggcggctcggggcccagagagagccgcggccgggagctcgcgggctcctgacaacctcctcccctcggcggacgacgaccacggcgactagggcgccggtcatggcggagcaacaaacccggcgcggaccctaggcaccaccgcatggagcgggacgaaccgccgcctagcggagggggaggcggcgggggctcggcggggttcctggagcctcccgccgcgctccctccgccgccgcgcaacggtttctgtcaggatgaattggcagagcttgacccaggcactaatgatcgggctgaacaacgaacctgtctcatttgtggggaccgcgctacaggcttgcactatgggatcatctcctgtgagggctgcaaagggtttttcaagcggagcatttgcaacaaacgggtatatcgatgcagtcgtgacaagaactgtgtcatgtctcggaagcagaggaacaggtgccagtactgccgcctgctcaaatgcctccagatggggatgaaccggaaggctatcagagaagatggcatgcctggaggccggaataagagcattgggccagtccagatatcggaagaagaaatcgaaaggatcatgtctgggcaggagtttgaggaagaggccaatcactggagcaaccatggtgatagtgaccacagttcccctgggaacagggcttcggagagcaaccagccctcaccaggctccacactgtcttccaggtctgtggaactgaatggattcatggccttcagggaacagtacatgggaatgtctgtgcctccacattaccaatatataccgcacctttttagctattctggccactcaccacttctgccccaacaagctcgcagcctggatccccagtcatacagtctgattcaccagctgttatcagccgaggacctggaaccattgggcacgcccatgttgattgaagatggatacgctgtgacacaggcagaactatttgccctgctttgccgcctggccgacgagctgctctttaggcagattgcctggatcaagaaactgcctttcttctgcgagctctcaatcaaggattacacgtgcctcttgagctctacgtggcaggagctaatcctgctgtcttccctcaccgtttacagcaagcagatctttggggaactggctgatgtcactgccaagtactcgccctccgatgaagaactacacagatttagtgatgaagggatggaggtgatcgagcggctcatctacctctatcacaagttccatcagctaaaggtcagcaacgaggagtatgcttgcatgaaagcaattaacttcctaaatcaagatatcaggggtctgaccagtgcctcacagctggaacaattgaataaacgatactggtacatttgccaggattttactgaatataaatacacacatcagccgaaccgctttcctgatctcatgatgtgcttacctgagattcgatatattgcaggaaagatggtgaatgtgcccctggagcagctgcccctcctctttaaggtggtgctgcattcctgcaagaccagtgtgggcaaggaatgacctgttccaggcgccctcctcaggccaaccacagcgtcttgggtgggcaggacaggctctggagggaaaagccagagagaccaagatggaggctgtggagcagcatttcccgttgcctccatagcaagaagagtttttgtttgtttgtctgtttttttaacctcatttttctatatatttatttcacgacagagttgaatgtatggccttcaacatgatgcacatgcttttgtgtgaatgcagccaatgcattttcttacagtttacagaatgtgaagatgaaaaaaaaaaaaaaaa

SEQ ID NO: 62292 - DNA, 1918 bp, Homo sapiens
gcggcgcggaggggcgcggagcggcgcggagccgggcggctcggggcccagagagagccgcggccgggagctcgcgggctcctgacaacctcctcccctcggcggacgacgaccacggcgactagggcgccggtcatggcggagcaacaaacccggcgcggaccctaggcaccaccgcatggagcgggacgaaccgccgcctagcggagggggaggcggcgggggctcggcggggttcctggagcctcccgccgcgctccctccgccgccgcgcaacggtttctgtcaggatgaattggcagagcttgacccaggcactatttctgtttcagatgatcgggctgaacaacgaacctgtctcatttgtggggaccgcgctacaggcttgcactatgggatcatctcctgtgagggctgcaaagggtttttcaagcggagcatttgcaacaaacgggtatatcgatgcagtcgtgacaagaactgtgtcatgtctcggaagcagaggaacaggtgccagtactgccgcctgctcaaatgcctccagatggggatgaaccggaaggctatcagagaagatggcatgcctggaggccggaataagagcattgggccagtccagatatcggaagaagaaatcgaaaggatcatgtctgggcaggagtttgaggaagaggccaatcactggagcaaccatggtgatagtgaccacagttcccctgggaacagggcttcggagagcaaccagccctcaccaggctccacactgtcttccagtaggtctgtggaactgaatggattcatggccttcagggaacagtacatgggaatgtctgtgcctccacattaccaatatataccgcacctttttagctattctggccactcaccacttctgccccaacaagctcgcagcctggatccccagtcatacagtctgattcaccagctgttatcagccgaggacctggaaccattgggcacgcccatgttgattgaagatggatacgctgtgacacaggcagaactatttgccctgctttgccgcctggccgacgagctgctctttaggcagattgcctggatcaagaaactgcctttcttctgcgagctctcaatcaaggattacacgtgcctcttgagctctacgtggcaggagctaatcctgctgtcttccctcaccgtttacagcaagcagatctttggggaactggctgatgtcactgccaagtactcgccctccgatgaagaactacacagatttagtgatgaagggatggaggtgatcgagcggctcatctacctctatcacaagttccatcagctaaaggtcagcaacgaggagtatgcttgcatgaaagcaattaacttcctaaatcaagatatcaggggtctgaccagtgcctcacagctggaacaattgaataaacgatactggtacatttgccaggattttactgaatataaatacacacatcagccgaaccgctttcctgatctcatgatgtgcttacctgagattcgatatattgcaggaaagatggtgaatgtgcccctggagcagctgcccctcctctttaaggtggtgctgcattcctgcaagaccagtgtgggcaaggaatgacctgttccaggcgccctcctcaggccaaccacagcgtcttgggtgggcaggacaggctctggagggaaaagccagagagaccaagatggaggctgtggagcagcatttcccgttgcctccatagcaagaagagtttttgtttgtttgtctgtttttttaacctcatttttctatatatttatttcacgacagagttgaatgtatggccttcaacatgatgcacatgcttttgtgtgaatgcagccaatgcattttcttacagtttacagaatgtgaagatgaaaaaaaaaaaaaaaa

SEQ ID NO: 62293 - DNA, 1840 bp, Homo sapiens
gcggcgcggaggggcgcggagcggcgcggagccgggcggctcggggcccagagagagccgcggccgggagctcgcgggctcctgacaacctcctcccctcggcggacgacgaccacggcgactagggcgccggtcatggcggagcaacaaacccggcgcggaccctaggcaccaccgcatggagcgggacgaacctccgccgccgcgcaacggtttctgtcaggatgaattggcagagcttgacccaggcactaatgatcgggctgaacaacgaacctgtctcatttgtggggaccgcgctacaggcttgcactatgggatcatctcctgtgagggctgcaaagggtttttcaagcggagcatttgcaacaaacgggtatatcgatgcagtcgtgacaagaactgtgtcatgtctcggaagcagaggaacaggtgccagtactgccgcctgctcaaatgcctccagatggggatgaaccggaaggctatcagagaagatggcatgcctggaggccggaataagagcattgggccagtccagatatcggaagaagaaatcgaaaggatcatgtctgggcaggagtttgaggaagaggccaatcactggagcaaccatggtgatagtgaccacagttcccctgggaacagggcttcggagagcaaccagccctcaccaggctccacactgtcttccagtaggtctgtggaactgaatggattcatggccttcagggaacagtacatgggaatgtctgtgcctccacattaccaatatataccgcacctttttagctattctggccactcaccacttctgccccaacaagctcgcagcctggatccccagtcatacagtctgattcaccagctgttatcagccgaggacctggaaccattgggcacgcccatgttgattgaagatggatacgctgtgacacaggcagaactatttgccctgctttgccgcctggccgacgagctgctctttaggcagattgcctggatcaagaaactgcctttcttctgcgagctctcaatcaaggattacacgtgcctcttgagctctacgtggcaggagctaatcctgctgtcttccctcaccgtttacagcaagcagatctttggggaactggctgatgtcactgccaagtactcgccctccgatgaagaactacacagatttagtgatgaagggatggaggtgatcgagcggctcatctacctctatcacaagttccatcagctaaaggtcagcaacgaggagtatgcttgcatgaaagcaattaacttcctaaatcaagatatcaggggtctgaccagtgcctcacagctggaacaattgaataaacgatactggtacatttgccaggattttactgaatataaatacacacatcagccgaaccgctttcctgatctcatgatgtgcttacctgagattcgatatattgcaggaaagatggtgaatgtgcccctggagcagctgcccctcctctttaaggtggtgctgcattcctgcaagaccagtgtgggcaaggaatgacctgttccaggcgccctcctcaggccaaccacagcgtcttgggtgggcaggacaggctctggagggaaaagccagagagaccaagatggaggctgtggagcagcatttcccgttgcctccatagcaagaagagtttttgtttgtttgtctgtttttttaacctcatttttctatatatttatttcacgacagagttgaatgtatggccttcaacatgatgcacatgcttttgtgtgaatgcagccaatgcattttcttacagtttacagaatgtgaagatgaaaaaaaaaaaaaaaa

SEQ ID NO: 62294 - DNA, 1613 bp, Homo sapiens
ctgcctgtcagatgcctcattcccacctgtgatgctcagagagaaaccatgagccctcaaaaacaccatattgttttgtgatgtcacctctggaatgttctgagtgttttggtgaccaacttctgcataggacctatacctggcaactcacattgcactcaaggccaaattatacaagaaaaagagataccagatctgaaagcctagaaattccaatcagtgtggttctacctcagaggggcacagccgaacccttcccgaggctccacaacttgtacagcacccctcgctgcgcgcagcaggccgccctgccccggctgagccgcaggatggcgagccagcactcctatccactgaaccgcttctcctccgtgcctttagaccccatggagcgccccatgtcccaggccgacctggagctggactacaacccgccgcgggtgcagctcagcgacgagatgttcgtgttccaggacgggcgctgggtaaatgagaactgccgcctgcagtctccctacttctccccatccgcctccttccaccacaagctgcaccacaagaggctggccaaggagtgcatgctgcaggaggagaacaagtctctgcgggaggagaacaaggccctgcgcgaggagaaccggatgctcagcaaggagaacaagatcctacaggtcttctgggaggagcacaaggcctcgctgggccgagaggagagccgggccccctcgccactgctgcacaaagacagcgcgtccctggaggtggtgaagaaggaccacgtcgccctgcaggtgccccgtggcaaggaggacagcaccctgcagctcctccgggaggagaatcgcgcgctgcagcagctgctggagcagaaacaggcctactgggcgcaggcagaggacacggccgcccctgccgaggaaagcaagcccgccccctcaccccacgaggagccctgcagccccgggctgctgcaggaccagggctccggcctctcctcccgcttcgaggagcccaaagggcctccggcccggcaggaggactccaaggagctgcgcgccctgcggaagatggtcagcaacatgtccgggccctccggggaggaggaggccaaggtgggcccgggcctgcccgacggctgccagcccctgcagctgctgagagagatgaggcaggcgctgcaggccctgctcaaggagaaccggctcctgcaggaggagaacaggaccctgcaggtgctacgggcagagcacaggggcttccaggaggagaacaaggccctgtgggagaacaacaagctgaagctgcagcagaagctggtcattgacaccgtgaccgaggtcaccgcgcgcatggaaatgctcatcgaggagctctacgccttcatgccggccaggagccaggaccccaagaagcctagcagggtctgaggcctcggccttgcaccgggacgccgagtttgggacaccgaacactgggcaaaagagaatcccctgccttcccttgtcgtcctcgccttccccagccagttcgtacctattgaaaagcagcgttagcagccttcctaaactcagagttttaataaaggtgtgaggaggctggggccagttgacacc

SEQ ID NO: 62295 - DNA, 3795 bp, Homo sapiens
gagttccgtattctagttctgtgtgatctgatctttaccttcccttccttggatccctgtgcacctactggagccaggttactctgggtcctggacctgactgcctcattctggaggcttccagacagccacagttagtgcccaaacctgagaggatggcttcagatggagcatctgcattgccgggaccggatatgagcatgaaacctagtgccgccctgtctccatcccctgcacttccctttctcccaccaacttctgacccaccagaccacccacccagggagccacctccacagcccatcatgccttcagtattctctccagacaaccctctgatgctctctgctttccccagctcactgttggtgacaggggacgggggcccttgcctcagtggggctggggctggcaaggtcattgtcaaagtcaagacagaaggggggtcagctgagccctctcaaactcagaactttatccttactcagactgccctcaattcgactgccccgggcactccctgtggaggccttgagggtcctgcacctccatttgtgacagcatctaatgtgaagaccattctgccctctaaggctgttggtgtcagccaggagggtcctccaggccttccgcctcagcctccaccaccagttgctcaactggtccccattgtgcccctggaaaaagcttggccagggccacatgggacaaccggggaaggaggtcctgtggccactctatccaagccttccctaggtgaccgctccaaaatttccaaggacgtttatgagaacttccgtcagtggcagcgttacaaagccttggcccggaggcacctatcccagagtcctgacacagaagctctttcctgttttcttatcccagtgcttcgttccctggcccggctgaagcccactatgaccctggaggagggactgccattggctgtgcaggagtgggagcacaccagcaactttgaccggatgatcttttatgagatggcagaaaggttcatggagtttgaggctgaggagatgcagattcagaacacacagctgatgaatgggtctcagggcctgtctcctgcaacccctttgaaacttgatcctctagggcccctggcctctgaggtttgccagcagccagtgtacattccgaagaaggcagcctccaagacacgggccccccgccggcgtcagcgtaaagcccagagacctcctgctcctgaggcacccaaggagatcccaccagaagctgtgaaggagtatgttgacatcatggaatggctggtggggactcacttggccactggggagtcagatggaaaacaagaggaagaagggcagcagcaggaggaggaagggatgtatccagatccaggtctcctgagctacatcaatgagctgtgttctcagaaggtctttgtctccaaggtggaggctgtcattcaccctcaatttctggcagatctgctgtccccagaaaaacagagagatcccttggccttaattgaggagctagagcaagaagaaggactcactcttgcccagctggtccagaagcgactcatggccttggaagaggaggaagatgcagaggcgcctccaagtttcagtggcgctcagttggactcaagtccttctggttctgttgaggatgaagatggggatgggcggcttcggccctcacctgggcttcagggggctgggggcgccgcttgccttggaaaggtttcttcttcaggaaaacgggcaagagaagtgcatggtgggcaggagcaagccctagatagccccagagggatgcacagggatgggaacactctgccatcccccagcagctgggacctgcagccagaacttgcagctccacagggaactccgggacccttgggtgtggagaggagagggtctgggaaggttataaaccaggtatctctacatcaggatggccatctaggaggcgctgggcctcctgggcactgcctggtggctgataggacttcagaggctctgcccctttgttggcagggaggcttccagcctgagagcactcccagtttggatgctggacttgcagagctggctcctctgcaaggacaagggttagaaaagcaagtcctgggattgcagaaaggacaacaaacagggggtcgtggagtgcttcctcaagggaaggagcctttagcagtgccctgggaaggctcttcaggagccatgtggggagatgacagaggtacccccatggctcagagttatgatcagaatccttcccctagagcagctggggagagggacgatgtctgtctcagcccaggagtttggctgagcagtgagatggatgctgtaggcttggagctgcctgtacaaatagaggaggtcatagagagcttccaagttgagaagtgtgtaactgagtatcaggaaggctgccagggactgggctccaggggcaacatttccctgggtcctggagaaaccctagtacctggggatacggagagcagtgtgattccctgtggaggcacagttgcggcagctgccctagaaaagagaaactattgcagcttgccaggacctttgagggccaacagcccacccttgaggtccaaagaaaatcaagaacagagctgtgaaaccgtagggcatcccagtgatctgtgggcagaaggttgcttcccattgctagaaagtggtgattccacactggggtcttccaaagaaacccttccacccacatgccaaggcaatctccttatcatggggactgaggatgcctcctccttgcctgaagccagtcaagaggcagggagcagaggcaattccttttctcctctgttggaaaccatagaacctgtcaacatactagatgttaaagatgactgtggcctccaactaagggtcagcgaggacacctgcccactgaatgttcattcttatgacccccaaggagaaggcagggtggatcctgatctgtccaagcctaaaaaccttgctcctttacaagagagtcaggagtcttacacaactgggactcccaaagcaacatcttctcaccagggccttggaagcactttgcctagaaggggaaccaggaatgccatagttccgagagaaacttctgttagtaaaacacacaggtcagcagacagggccaaaggaaaggagaaaaagaaaaaggaagcagaggaagaggatgaggaactctccaactttgcttacctcttggcctctaaacttagcctctcaccaagggagcatcccctcagtcctcaccatgcctcaggaggtcagggcagccagagagcatcccacctgctccctgctggagcaaaaggccccagcaaacttccatatcctgttgccaagtctgggaagcgagctctagctggaggtccagcccctactgaaaagacaccccactcaggagctcaacttggggtccccagggagaaacccctagctctgggagtagttcgaccctcacagcctcgtaaaaggcggtgtgacagttttgtcacgggcagaaggaagaaacgacgtcgtagccagtagggagcagcgggaccatctgaccccacttgccagtccctaaaggtgggtgccccagagtagattccacccctgctgcccaccaatggagaatcccaatgttgaatctcatcccaatgttgttttgttgttctgcaaaagtggcaagcatggagagagaggtcagactggctaggctgcagggggaattacctttggaaggagctatatagaaaaaaaatgaataaagtgttttgttggaaaa

SEQ ID NO: 62296 - DNA, 2884 bp, Homo sapiens
cctcctcctctgggatcttgaaaacgtagaattcccagagactctgctgatggacagaatccggctccaggaactggcattccagttgcaccagttaactgtcctggcctcagtcttgctagtggccagaagcttctctggtgaagttttattcagatcacctgaatttgtggatagactgaaatgcaccaccaaggccctaactgaggaatttatctccaggcctgaagagactatgctgagtgtgagtgaacaggtgtctcaggaagtccatcaaggccttaaggacatgggcctcactactctgagcagtgaaaacacagcatctcttctaggccaactccagaacatcaccaagaaagagaactgcattcgtagcattgttggagtctctgctacactttcctggaggcctcattctcattgaaaaggagttggcagaactgggctggaagtttctcaatctgatgcatcataatcagcagagtcatttttcacaaaacgaaatctttccagaagatcacgaataagagagatcaaagctaggcagcttgagttgaagtagagctggaagaaggagttttgaggactgtttcaaaaccactggactagatgatctctaaaggatcttatccaggacgcttcattgcatttggtcttcatttctccttagtctcctccaggctgacatttcctcaatctttattggtcttccacagccctgacacttttggagataccagtcagcatttccaagttcgttctgtgagactgtagtgtcaggacaaagcaacaacaaaatgtgctctactctaaagaagtgtgggacatacagaactgaagttgcagaatgccatgaccatggtagcacttttcaaggaagaaagaaaggtgggagttctttccgggataattttgacaagaggagctgtcattatgaacatggtgggtatgagcgcccgccttcacactgccaggagaatgatggaagcgtggagatgagggatgtccacaaggaccaacaactaagacacactccttatagcatccgatgcgaaagaagaatgaaatggcatagtgaagacgaaatccgtattaccacgtggagaaatagaaaacctccggagagaaaaatgagtcagaacacacaggatggatacacaaggaactggtttaaggtcacaattccttacgggataaagtatgacaaggcatggctaatgaattcaatccagagccattgcagtgaccgcttcactccggttgatttccactacgtccgaaatcgggcatgcttctttgtccaggatgctagcgctgcctccgcattgaaggatgtcagttataagatttatgatgatgagaaccaaaagatatgtatatttgtcaatcattctactgcgccctactctgtgaagaataagttgaagccaggccaaatggagatgctaaagctgaccatgaacaaacggtacaatgtctcccagcaagctcttgatctccagaatctccgctttgacccagacttgatgggccgtgacattgatataatcctgaatcgaagaaactgcatggctgccaccctgaagatcattgaaagaaatttccctgagctgttgtctttgaacttgtgcaacaacaagctgtaccagctggatggcctttctgacattacagagaaggctcccaaagtcaagaccctgaatctctccaaaaataagctggagtcggcgtgggagttgggcaaggtgaaagggctgaagctcgaagagctatggctagaagggaacccgttgtgcagcaccttctcggaccagtccgcctatgtaagtgccatccgggattgtttccccaagttgttacgcctggacggccgagagttatccgcaccagtgattgttgacattgacagctctgagacaatgaaaccctgcaaggaaaactttactggatctgagaccctaaagcatttagtcctgcaattcctgcagcagtattactcgatctatgactctggagatcgacagggtctcctcggtgcttaccacgatgaggcctgcttctccttggctattcccttcgaccccaaggactcagccccgagcagcttgtgcaagtactttgaggatagcaggaatatgaaaacactcaaggacccctacctgaagggggaactgctgaggcgcacaaaacgtgacattgtggactccctcagtgcgttgcccaaaactcagcatgacctcagctccatcctggtggacgtgtggtgccagacggaaaggatgctctgcttttctgtcaatggggttttcaaggaagtggaaggacagtctcagggttctgttctcgccttcacccggaccttcattgctacccctggcagcagttccagtctgtgcatcgtgaatgacgagctgtttgtgagggatgccagcccccaagagactcagagtgccttctccatcccagtgtccacactctcctccagctctgagccctccctctcccaggagcagcaggaaatggtgcaggctttctctgcccagtctgggatgaaactggagtggtctcagaagtgccttcaggacaatgagtggaactacactagagctggccaggccttcactatgctccagaccgagggcaagatccccgcagaggccttcaagcaaatctcctaaaaggagccctccgatgtcttctttgtcttcgttcacatcctctttgtttcctcttttcaccagcctaaggcctggctgaccaggaagccaacgttaacttgcaggccacgtgacataaccacccaaagagccagttgctctgtgtattcgccccactcatgatcaccattttattttcataataaagagtgacgttacacgtt

SEQ ID NO: 62297 - DNA, 2346 bp, Homo sapiens
ttgtggcaagattctgaggggaagtgtagctcccaggttggttccaagtcttcttccaattaggatcttatccaggacgcttcattgcatttggtcttcatttctccttagtctcctccaggctgacatttcctcaatctttattggtcttccacagccctgacacttttggagataccagtcagcatttccaagttcgttctgtgagactgtagtgtcaggacaaagcaacaacaaaatgtgctctactctaaagaagtgtgggacatacagaactgaagttgcagaatgccatgaccatggtagcacttttcaaggaagaaagaaaggtgggagttctttccgggataattttgacaagaggagctgtcattatgaacatggtgggtatgagcgcccgccttcacactgccaggagaatgatggaagcgtggagatgagggatgtccacaaggaccaacaactaagacacactccttatagcatccgatgcgaaagaagaatgaaatggcatagtgaagacgaaatccgtattaccacgtggagaaatagaaaacctccggagagaaaaatgagtcagaacacacaggatggatacacaaggaactggtttaaggtcacaattccttacgggataaagtatgacaaggcatggctaatgaattcaatccagagccattgcagtgaccgcttcactccggttgatttccactacgtccgaaatcgggcatgcttctttgtccaggatgctagcgctgcctccgcattgaaggatgtcagttataagatttatgatgatgagaaccaaaagatatgtatatttgtcaatcattctactgcgccctactctgtgaagaataagttgaagccaggccaaatggagatgctaaagctgaccatgaacaaacggtacaatgtctcccagcaagctcttgatctccagaatctccgctttgacccagacttgatgggccgtgacattgatataatcctgaatcgaagaaactgcatggctgccaccctgaagatcattgaaagaaatttccctgagctgttgtctttgaacttgtgcaacaacaagctgtaccagctggatggcctttctgacattacagagaaggctcccaaagtcaagaccctgaatctctccaaaaataagctggagtcggcgtgggagttgggcaaggtgaaagggctgaagctcgaagagctatggctagaagggaacccgttgtgcagcaccttctcggaccagtccgcctatgtaagtgccatccgggattgtttccccaagttgttacgcctggacggccgagagttatccgcaccagtgattgttgacattgacagctctgagacaatgaaaccctgcaaggaaaactttactggatctgagaccctaaagcatttagtcctgcaattcctgcagcagtattactcgatctatgactctggagatcgacagggtctcctcggtgcttaccacgatgaggcctgcttctccttggctattcccttcgaccccaaggactcagccccgagcagcttgtgcaagtactttgaggatagcaggaatatgaaaacactcaaggacccctacctgaagggggaactgctgaggcgcacaaaacgtgacattgtggactccctcagtgcgttgcccaaaactcagcatgacctcagctccatcctggtggacgtgtggtgccagacggaaaggatgctctgcttttctgtcaatggggttttcaaggaagtggaaggacagtctcagggttctgttctcgccttcacccggaccttcattgctacccctggcagcagttccagtctgtgcatcgtgaatgacgagctgtttgtgagggatgccagcccccaagagactcagagtgccttctccatcccagtgtccacactctcctccagctctgagccctccctctcccaggagcagcaggaaatggtgcaggctttctctgcccagtctgggatgaaactggagtggtctcagaagtgccttcaggacaatgagtggaactacactagagctggccaggccttcactatgctccagaccgagggcaagatccccgcagaggccttcaagcaaatctcctaaaaggagccctccgatgtcttctttgtcttcgttcacatcctctttgtttcctcttttcaccagcctaaggcctggctgaccaggaagccaacgttaacttgcaggccacgtgacataaccacccaaagagccagttgctctgtgtattcgccccactcatgatcaccattttattttcataataaagagtgacgttacacgttaaaaaaaaaaaaaaaaaaaaaaaa

SEQ ID NO: 62298 - DNA, 1915 bp, Homo sapiens
atcttctccaaactcccgtccccaggccacacagattctcctcaagagagccctataaggacattggtaaaatgtcactgccttcaggacacactacgggtcacactgatcaagttgttcaaagaagagcaagatgttgggatatttaccaaaggagatttagcagtaggtctgaacctgtcaatcctggcatgcattcttcatcccatcagcagcaagatggagatgcagcaatgcatggtgcccacatggactctccagtaagatacactccctatactatttcaccctataatcggaaaggcagttttcgtaaacaagaccaaacccacgttaacatggagagagagcaaaaacctccagagagaagaatggaggggaacatgccggatgggaccttagggagctggttcaagatcacagttccctttggcataaaatacaatgagaagtggctgctgaatttgattcagaatgaatgcagtgtacccttcgtcccagttgagtttcactatgaaaacatgcatgccagcttctttgtggagaatgccagcatcgcctatgcactgaagaatgtcagtggcaagatttgggatgaggataatgaaaagatatcaatctttgtcaaccctgctggcataccccactttgtgcacagggagctgaagtcagaaaaggtggagcagataaagctggccatgaaccaacagtgtgatgtctcccaggaagctcttgatatccagagactcccattttacccagacatggtgaaccgtgatactaagatggcatcgaatcctagaaagtgcatggctgcctccctggacgtccatgaagagaacatacctacagtgatgtctgcaggggagatggacaagtggaaagggatagagccaggagagaagtgtgcggacagaagcccagtgtgcacgaccttctcggatacctccagcaacataaactccatcctggaattgttccccaaattattatgcctggatggccagcagtcacccagagcaactttatgtggtactgaagcccacaagaggttaccaacctgtaagggaagcttctttggatctgagatgttgaagaatctggtcctgcaattcctgcagcagtattacttgatctatgactctggagatcgacagggtctccttagtgcttaccacgatgaggcctgcttctccctgagcattcccttcaatcctgaggactcagccccgagcagcttctgcaagttcttcaaggatagcaggaatataaaaattctcaaggacccctaccttcggggggagctgctgaagcacacaaaacttgatattgtggactccctcagtgcgttgcctaaaactcagcatgacctcagctccttcctggtggacatgtggtaccagacggaatggatgctctgcttttctgtcaacggggtgttcaaggaagtggaaggacagtctcagggttctgttctcgccttcacccggaccttcattgctacccctggcagcagttccagtctgtgcatcgtgaatgacaagctctttgtgcgggataccagccaccaagggacccagagtgccttgttcaccctagtgcccacagccttctccagctccgtgcctgccttctcccaggagcagcagaaaatgctgccttcgtaacaaccagtgtgactacgtcagagctcctcatgttcttgcatggcccaagatgtatttccctgtgactgaaccaggagatctggctggggctaagaagccgaagcccaactcacagggctgactctcatccttccaaaggggccagttgttctgtgcacttgtccacccctgttacccccaggatctctgttccttttcacaataaagtatggtgtcttgttatgtcaaaaaaaaaaaaaaaaaaaaaa

SEQ ID NO: 62299 - DNA, 4358 bp, Homo sapiens
gttcagacccctggcctcgggaagtccgccggctgcggggttgggggccaaccgttctgtgggcggagtcctctcgcaacatccgccaggtagcttctcagttgctgcccctagctctaggagctcctgagtgcacacgccgtacccgtcccttgtcgggaatcctgtcgcaggtttttaagcaacagtcctcaggagggccaagggagtctgacggtgatgtcttcccccaggctcattcccctgtggaaagatttaaaactcctcctaaatgacaccataaataaaagcaagcaaccttcggaagacccaaagaactgcctgattgtgctgagtgaccggtcccaggctgtagcatggatgaagagcaaaactgaggacatggttgagaaaagaacattctccatgactgaacgattgccacccatccagtccatggtccatgcaggctcctttcatatcctcgtggtctactgtggtgacctgatcctgcgactctttggggaccactttcgggcattcaaacccctgggtaaagtgccctgccgcttcaacatcagctgcctctgctatgacccggaaatgaagatgcttctgtctggcatcctgggggcagtggtgacctgggtcattgagctaggtggcacgggcctccaaatagcccacatggtctccatgccaggtgatgagcttgtccaggacatcgtgctgaatggtcccagtggctccctcctggccctgtgtgagacggtggtgagggtccttatgcaccagggcaagggccagctgggagaggtaaagaggttcacgtccaccagcagcggctcctccatcacctgctgcttcacctgttttgatcagggctttctctatgctggaaaccaagctggggaaatccaagtttggagcctccagcagggccatccactccacagtttccaggcccatcaatcaggagtgatctgtatccgcagccgaccagaggcccacaccctgctaacagctggtagtgacagcctaatcaaggagtggaacctgacttcagggagcctgcttcggcggctagagcttggtgaggagctataccggctccagtttattgacagcattactttcttctgccaaactgcccatagtttttccttgcaccgcctgccctgcttctacagcctcttcaatgtctgtggctctgctccccagcagttgcgtcgggtctgctgtggaaataactggttccggatcctgtgtaccactgaggatggcttgttgcgctttgtgtccccagtaacaggggaccttctggttatcacctggcccttctcaatcctggaccaggctgtggattgggcctacgacccaggtaaagaggagctctttgtagcaacaggcagctcagaggttctggtatttgacacaacccgctgcccttgcccagccaagtatctcttaggcacctcaccaaattctcaggactttgtacaatgcctggcttatgggcatttcaacttggggcggggtctagagggactgatattctctgggcaccagagtggtgtgataagagtgctctcccagcacagctgtgctcgattagaaaaattcatgcactttggcgctgtactggcactctccacgctgtctggagggatttttggtggccaaggaaactctctgctctgttcctatggaatggatgactatgtgcacctgtcagaagctgtgcttgatggggtcaaagtacaactgcggcctctcgccagcattctcagcagctgtcacctaacacatctgatactcttgcccaagtctgtgggtgccatcacagagacaaactgcctgcgtctctggaagttccatgattttctgtcctctgggtcacagaatggcttgaaattcatagaaacactgcctctgcacctgtgtgccatcacatcctttgatgtctgcctctccttgagtctttttgtcacaggttctgccgatggctctgttcggatctgggacttccatggcagactcataggcattctggactcatcactgcactttggcccagtctgttttgcaaatgaccggggtgacctgcttgtgacttttaaccagagtctttacctagtgtcctgtttaaaattgcttcccccagccctgctgactcgcctttcctttatgagcatatcagatgaagtactggaagtccctaagcctttcataccaagcttcttcttctcctttgagaccatgtttgtgcccaagtacatctaccctggacaagcgcaacagaaattagtgggtctggagaaacttgtcaacaaccgggccattgcctttgaccattctgtgccacatgtgatagaagaagatgaggaagggagcccagtgttactgcgttcctccatgcattattctttgcaggacatggaagattggatgcaggtgagcaaacgttaccaatgccattatgtgcttcctccccagctacaactgactagctgggatggactcaacccctatcagatattgcgatactactttggtcatgggcgggaatggctttttgcccctgactgctatatccccaattcagtgattcgtgcccgtctttggccagagggcaccccaatatacctacagtgcaacctgcatgcaccccagcgggagctggaatgggacaggtctcaagaattctttttctggcacagcagggtaagagctataagtaatacagaatatccaaagaataaggaggaggatgaacacttcctagaaatgagactttccaaggatgtaacctacagtgtccttacagatggagcaaaccgaagttggctgggaagaaagatgagtgaaataaccattaatagcatgattgagacaatgctcaatattatggtccatgcttccttgctgaagtaccagtgctgtgttggtgcactagggcaaatctttgcctcttaccaggtgtccccagccctacgctctgagacagcccgtcggctactgaatgatacaaccaattccaacccgctgatccgagaactagcttgggaagggctgaagcgtctaggaatgattactcatctttttgccatgcctctggctcaaggattaatggacaaggatgaaagagtgaggatcaagaccctaagcctcatggctgagattggaatccactctaggacctcactcttacagctgacccaaaaacaagagacttttcgggagatgcagcagcagatgatcggggaggaacccctggaccatctactggggatgcgggccacagatctccaaatcctttccactcaagtggagcagagattgaatgaaaacctgaccctgtcacatagagatgaaaagccggctttttctttagatgtctcaatgccttctgaacttaaatcctccctgaaacctcctacagtttctgaagaatctgaagtggccatcaagcccagcaaaggccaaagacgaggccaagcaggggtcaaaaagcatagccaaaaatggttgcggggtctcaagaagacgaaagagagagactctaaacagatgagcacagagccaggcctcttagaggatgaaagtgggactgaggccgcaccaattgagatggaggaagcatccgtctattcccaatggtcttcaagcaccagtgtaataaagctctcaaaagatgttgattctcaagagaaagatatctcgaaggatcacattgcattgaccctgaagaggctgcagaaaatacgtgacaaaagagacaagaaagcaacagctcagaaactcaaaaagaagcacaaaaagaagggaaaagaagccaaagttataaatgaggaaactacacctcctgtaatggaacagccagttactaaaaaggttaaaatccaagggcggggagcctctggaatatctggccgcaggtcaaccgctggagatggctcatcatggagggacgatctatgtcgtcttatggccctgaggatatctggttcccaaacaaaaatgtcagaaaacctaaacgctgagctagtgacatttgctcaggagatgctggtagataggcaccccagctgggaactctttcaggagatctgccccctattgaagaaagaaagtaaggttctgcttgaggaccttgattgggatgtagtcccgccagagaagaaaccatttttatccaggaaggagcaattagagaggacatgatacaaggtgtgacccaagaggtgatcagacacaaggaagtgatgccaagggaagaagaacaagcacaaaagaaagcaagagacatgctgggcttggaggaaacccaagtgattttgaaaaagggccaagaaagttatttttttagaaccaggtaa

SEQ ID NO: 62300 - DNA, 1578 bp, Homo sapiens
tgagtccagaagcaagacctgtgagagtgcacagtgccacttcgccccatggctgaagatggtttgcccaaaatttattctcatcctccaacagaaagcagtaaaacaccaactgcagcaaccattttctttggggctgacaatgctattcccaaatcagaaacaactattacttcagaaggagaccacgtcacttcagtaaatgaatatatgctagaaagcgatttttcaacaactacagacaacaaactgacagctaaaaaggaaaaactcaaatcagaagatgatatggggaccgactttattaagtcaacaactcacctacagaaagaaattacctctctgactggcactacaaactccataacaagagactctattaccgaacatttcatgccagtgaaaattgggaatatttcatcaccagttactactgtttctttaatagatttttccactgacatagcaaaagaagatatcctcttagctaccattgacacaggagatgcagagatctcaataacctctgaagtctctggcacactaaaggacagcagtgctggtgttgctgacgctcctgcctttccacgtaaaaaggatgaagctgatatgagcaattataattcctccatcaaatccaatgtccctgctgatgaggctgtccaggtcactgattccattattcctgaggctgaaatccctcctgctcctgaagaaagcttcactactattccagacataactgcccttgaagaagagaaaataaccgaaattgacctaagtgttttagaagatgacaccagtgctgtggctacattaactgactctgatgagaagtttatcactgtgtttgaactcactacctctgctgaaaaagacaaagataaacgggaagatactctgctaactgatgaagaaactaccgagggagccagtattgggatggagagagatactgcaaatgaagcagagacccattctgttttgcttactgctgttgaatccagatatgacttcgttgtccctgcatcaatagctacaaacctagtggaagaatcatctacagaagaagatttgtctgaaactgataatacagagactgtacctaagatcactgagccattttctggaactacctctgtattagataccccagactataaggaagacacctccacaactgaaacggatatctttgaactactgaaagaagaacccgatgagttcatgatttaaaagcaacaaaagggataccatgtagaattgtgcaatagtctagccagctagccttaacatctaagaaatttttccaacaagcaaaaacctttagaaatgaaagaatgtgggcatttaaggtcttaaacactgaatatcacactcttcttatgactcttgttagcgattcaaggacataaatcttcattcttttctggcacagactacttaaatgggtctgttttcactttgctcatttttcttcaataaatctttttggcaagcaactgaaaaaaaaaaaaaaaaaaaaaaaaaaaaaaaaaaaaaaaaaaaaaaaaaaaaaaaaaaaaaaaaaaaaaaaaa

SEQ ID NO: 62301 - DNA, 676 bp, Homo sapiens
cgcccagtgacctgccgaggtcggcagcacagagctctggagatgaagaccctgttcctgggtgtcacgctcggcctggccgctgccctgtccttcaccctggaggaggaggatatcacagggacctggtacgtgaaggccatggtggtcgataaggactttccggaggacaggaggcccaggaaggtgtccccagtgaaggtgacagccctgggcggtgggaacttggaagccacgttcaccttcatgagggaggatcggtgcatccagaagaaaatcctgatgcggaagacggaggagcctggcaaattcagcgcctatgggggcaggaagctcatatacctgcaggagctgcccgggacggacgactacgtcttttactgcaaagaccagcgccgtgggggcctgcgctacatgggaaagcttgtgggtaggaatcctaataccaacctggaggccctggaagaatttaagaaattggtgcagcacaagggactctcggaggaggacattttcatgcccctgcagacgggaagctgcgttctcgaacactaggcagcccccgggtctgcacctccagagcccaccctaccaccagacacagagcccggaccacctggacctaccctccagccatgacccttccctgctcccacccacctgactccaaataaag

SEQ ID NO: 62302 - DNA, 689 bp, Homo sapiens
cgcccagtgacctgccgaggtcggcagcacagagctctggagatgaagaccctgttcctgggtgtcacgctcggcctggccgctgccctgtccttcaccctggaggaggaggatatcacagggacctggtacgtgaaggccatggtggtcgataaggactttccggaggacaggaggcccaggaaggtgtccccagtgaaggtgacagccctgggcggtgggaagttggaagccacgttcaccttcatgagggaggatcggtgcatccagaagaaaatcctgatgcggaagacggaggagcctggcaaatacagcgcctatgggggcaggaagctcatgtacctgcaggagctgcccaggagggaccactacatcttttactgcaaagaccagcaccatgggggcctgctccacatgggaaagcttgtgggtaggaattctgataccaaccgggaggccctggaagaatttaagaaattggtgcagcgcaagggactctcggaggaggacattttcacgcccctgcagacgggaagctgcgttcccgaacactaggcagcccccgggtctgcacctccagagcccaccctaccaccagacacagagcccggaccacctggacctaccctccagccatgacccttccctgctcccacccacctgactccaaataaagtccttctccccca

SEQ ID NO: 62303 - DNA, 1149 bp, Homo sapiens
gggttggggccttctcttggatcaagagtctcttatttgatcgaggtctgttattagacttcctcattctttctcagacctcaggctgcatggtggcagctgatgaaaatatccaaaagatgagaagagacaattgagtctggtgagggaaaggggagacagagggtgaagtggtgctcaagatggatgcagagtactctgggaatgagttccccaggtcagaaggagaaagagaccaacatcagagacctggaaaggaaaggaagagtggggaggcaggatggggcacaggtgagctgggacaagatgggagactgctgtcctccaccctctccctcagtagtaacaggtccttgggccagcgccagaactctccgctgccctttcaatggagaatcacacacagcttccgctggatggcccaggtgttggcctctgagctcagcctggttgcctttatcctactattggtcatggccttctccaagaaatggctggacctctctaggagcctcttctaccagcgctggcccgtggatgtcagcaacagaatccacacatcagcccacgttatgtccatggggctcctgcacttttgcaaatccaggagctgttctgacttagagaatgggaaagtcaccttcatcttctccaccctcatgctattccccattaacatctggatcttcgagttggaaaggaatgtatccatccccataggctggagctatttcattggttggctggtgcttatcctatacttcacctgcgcgatcctttgctacttcaaccataaaagtttctggagtctgattctgagccaccccagtggtgccgtgtcctgcagcagcagtttcggctcagtagaagaatctccaagggcacagacgatcacagacacccccatcacccaggagggagtcctggatcctgagcagaaggatacacatgtgtaatcttttctgaactcctggcaccaagttctgtccattcatctgaccccatctcctcatcctcccccagcccttgaataggttggtcctcatcattgcaaggaatgagaaagggaggattttgcactcctctgctttctccctgccttgattgagcttgagtgatgtggaataaattgtccgtctcttctttctc

SEQ ID NO: 62304 - DNA, 3455 bp, Homo sapiens
atatgtaatcatgacttagtgacatatcacaagcataggaagcttctggttcagtggtcctcaaatgcaactcacaaaatatcatctggggaagttctgaattaagtcgttgagagtgttacctgggcatcaggatatttaaaatgagaatctacagttgtaggcaagccgttcaccatcatctcttgcttttgtcaccgctgggtgtttggctggatcggctgccgctggtatggatgggctggatttttctttggctgtggaagccttatcaccatgactgctgtcagcctggatcgatatttgaaaatctgctatttatcttatgttctgacttctggagcaacacagaaccaatctactaatctactccctcctgtacttgacagcctttcaccatactggaatgggtttggctgaaaagaaagcacgcctacatctgcctggcagccatctgggcctatgcttccttctggaccaccatgcccttggtaggtctgggggactacgtacctgagcccttcggaacctcgtgcaccctggactggtggctggcccaggcctcggtagggggccaggttttcatcctgaacatcctcttcttctgcctcttgctcccaacggctgtgatcgtgttctcctacgtaaagatcattgccaaggttaagtcctcttccaaagaagtagctcatttcgacagtcggatccatagcagccatgtgctggaaatgaaactgacaaaggtagcgatgttgatttgtgctggattcctgattgcctggattccttatgcagtggtgtctgtgtggtcagcttttggaaggccagactccattcccatacagctctctgtggtgccaaccctacttgcaaaatctgcagcgatgtacaatcccatcatttaccaagttattgattacaaatttgcctgttgccaaactggtggtttgaaagcaaccaagaagaagtctctggaaggcttcaggctgcacaccgtaaccacagtcaggaagtcttctgctgtgctggaaattcatgaagagtgggaataacaaatgttctggttgtgaagagtgcatctgaagtgcttacacggcgtctggcatatgcagagaaattagcttacaaatgttatttttctgacttctcgcctccactccacttaccctgtcaggaaaaaataattcacaaggaatatcaaaacaatgatgcaccctaggagtatccaagtatcttaactgagttatctcattctggtatagtggcagagttataactaaagagtgccagaaacccacgctttaaacatcctgcagtgcacacctcggtctcgtcagtaaggacttcactttcttctgaactggggcttgtgaaagctggcctgaaaagcctgattcaaggagatcaggctgtgtctctgactggagcagctacactccccatctgtaatttgatttgttctattgcagatgatgtactgggcagaggtgagtgtggattggtgaaaatctgtttttatgactggcaaagcagtgcaggggggtctttcactgataagaagcatcatcagtagggtttgtccctgatgcctttacaacagcatctgagcacctctcaagtttttccaggccagctccagtttcagtgaggagagtgtgggctttctattccccaaatattcttactacagttaatatgtaggttactgccccagcccaactgcaggttcccagatgtgagttccatgtaggcagaaactgtccagttcttgaaattgaattacttccttgtgtatgtgtttttttcctacttaaagctcctcgggatgcttcctctcaaaagtctttgaagaataagaggttaagctaagacaacctgaatcaatttttttttttttgtcaaatgcgattgaaattatccccataattcaataaaatagctttttcccttctttctttttactttgttggaaactatgcaacagaaacaaagtaagaagactctaccttaattttaaaggtaactcttacataaagaagaaagtcattatgccaggccagggggagagtggaaaggggaaatttagagaatagaaacaaacttaagcatcttgtaaattttgagtgaattgtaaacacataatgaatgaatgagaagggccagccaggagtctgtgaaatggtccagttgggaaatgcctaatgcataaacacaaatcttggtgacaggtaggttagttatctgtgaactttctaaagattaaataaacaataataggattttgttaatgtgccaaagtgagtttaaaccatgaaagacacgatgcaaatatgcaagtacctttaattgggcataataaaaagtagtgaggtatggttaaaataacatttagaacaagagagaagttagggagaatttttgtctaaaaagccaaaaagtgatagttgattggtgattttgttgttatcaggagagagaattttcttaatgtaataagttaggtactttggcaagtgaaatgggttctaggccaattgcaagtccttaggattccctggcagctagaaaccttggcactcccaaaagacagcttcagttaaaatgacagatgaacatgagtcttcaagtcaaaactactgttgtaccacgtccattgaatgtttggtgattcaagtctctgttattcaagaactgattctgtttttcctcctgtcaaaaccttggttgattttgactgtagtagcacatctggcaggaatatgacagaaaaaaattaagttaaaaatataatttctattcccctattttttctgtaaaaggctttatggggaagaagggaagaaggttgacatgagtagagatgatacttgcctctggatgacccagttgggttctcctttgactgccattcaccacagttgacctcattaggctccgaagtatgagaagagcttcattgccaagttagtgaaagaagcagatgatttacttttgctcgagtgggtctgtagacctcgggaggttagccatttctcttagagtttggtgtatgtattaagatacagcatgtatgtaggtatatataatacatatatgtgtgtatacatatatatatatttctggtttgtttaatatcttttaaaaaattttaatggaattttttgaacatgtacaaaagagaaagaatcctacgatgaactcccatgtatccatcatccagcctcaatagtgatcaacccatagcatattgtggttcatgttgacactcatccacctctttccttccccatctctccccattattttgagacgaatgagatcctgggatttcgtgaaaatattatgaatatcttatttgtgagaacaagatttcccaaagcatgatccccagaaacctagtcctgcaaaactactgcaaaaataaagtgttctaatctccaaaaaaaaaaaaaaaa

SEQ ID NO: 62305 - DNA, 3473 bp, Homo sapiens
acagaatggcgttaaatcacactgccctgcctcaggacgagcgcctgccccattaccttcgagatggggatccttttgcttccaaactttcttgggaagcggatttagtggctggcttttacctaacaataattgggattctgtccacatttggaaatggatatgtcctttacatgtcttctagacgaaagaagaagctgagacccgctgaaataatgactatcaatttagcagtctgtgatctggggatttcagttgtaggcaagccgttcaccatcatctcttgcttttgtcaccgctgggtgtttggctggatcggctgccgctggtatggatgggctggatttttctttggctgtggaagccttatcaccatgactgctgtcagcctggatcgatatttgaaaatctgctatttatcttatggggtttggctgaaaagaaagcacgcctacatctgcctggcagccatctgggcctatgcttccttctggaccaccatgcccttggtaggtctgggggactacgtacctgagcccttcggaacctcgtgcaccctggactggtggctggcccaggcctcggtagggggccaggttttcatcctgaacatcctcttcttctgcctcttgctcccaacggctgtgatcgtgttctcctacgtaaagatcattgccaaggttaagtcctcttccaaagaagtagctcatttcgacagtcggatccatagcagccatgtgctggaaatgaaactgacaaaggtagcgatgttgatttgtgctggattcctgattgcctggattccttatgcagtggtgtctgtgtggtcagcttttggaaggccagactccattcccatacagctctctgtggtgccaaccctacttgcaaaatctgcagcgatgtacaatcccatcatttaccaagttattgattacaaatttgcctgttgccaaactggtggtttgaaagcaaccaagaagaagtctctggaaggcttcaggctgcacaccgtaaccacagtcaggaagtcttctgctgtgctggaaattcatgaagagtgggaataacaaatgttctggttgtgaagagtgcatctgaagtgcttacacggcgtctggcatatgcagagaaattagcttacaaatgttatttttctgacttctcgcctccactccacttaccctgtcaggaaaaaataattcacaaggaatatcaaaacaatgatgcaccctaggagtatccaagtatcttaactgagttatctcattctggtatagtggcagagttataactaaagagtgccagaaacccacgctttaaacatcctgcagtgcacacctcggtctcgtcagtaaggacttcactttcttctgaactggggcttgtgaaagctggcctgaaaagcctgattcaaggagatcaggctgtgtctctgactggagcagctacactccccatctgtaatttgatttgttctattgcagatgatgtactgggcagaggtgagtgtggattggtgaaaatctgtttttatgactggcaaagcagtgcaggggggtctttcactgataagaagcatcatcagtagggtttgtccctgatgcctttacaacagcatctgagcacctctcaagtttttccaggccagctccagtttcagtgaggagagtgtgggctttctattccccaaatattcttactacagttaatatgtaggttactgccccagcccaactgcaggttcccagatgtgagttccatgtaggcagaaactgtccagttcttgaaattgaattacttccttgtgtatgtgtttttttcctacttaaagctcctcgggatgcttcctctcaaaagtctttgaagaataagaggttaagctaagacaacctgaatcaatttttttttttttgtcaaatgcgattgaaattatccccataattcaataaaatagctttttcccttctttctttttactttgttggaaactatgcaacagaaacaaagtaagaagactctaccttaattttaaaggtaactcttacataaagaagaaagtcattatgccaggccagggggagagtggaaaggggaaatttagagaatagaaacaaacttaagcatcttgtaaattttgagtgaattgtaaacacataatgaatgaatgagaagggccagccaggagtctgtgaaatggtccagttgggaaatgcctaatgcataaacacaaatcttggtgacaggtaggttagttatctgtgaactttctaaagattaaataaacaataataggattttgttaatgtgccaaagtgagtttaaaccatgaaagacacgatgcaaatatgcaagtacctttaattgggcataataaaaagtagtgaggtatggttaaaataacatttagaacaagagagaagttagggagaatttttgtctaaaaagccaaaaagtgatagttgattggtgattttgttgttatcaggagagagaattttcttaatgtaataagttaggtactttggcaagtgaaatgggttctaggccaattgcaagtccttaggattccctggcagctagaaaccttggcactcccaaaagacagcttcagttaaaatgacagatgaacatgagtcttcaagtcaaaactactgttgtaccacgtccattgaatgtttggtgattcaagtctctgttattcaagaactgattctgtttttcctcctgtcaaaaccttggttgattttgactgtagtagcacatctggcaggaatatgacagaaaaaaattaagttaaaaatataatttctattcccctattttttctgtaaaaggctttatggggaagaagggaagaaggttgacatgagtagagatgatacttgcctctggatgacccagttgggttctcctttgactgccattcaccacagttgacctcattaggctccgaagtatgagaagagcttcattgccaagttagtgaaagaagcagatgatttacttttgctcgagtgggtctgtagacctcgggaggttagccatttctcttagagtttggtgtatgtattaagatacagcatgtatgtaggtatatataatacatatatgtgtgtatacatatatatatatttctggtttgtttaatatcttttaaaaaattttaatggaattttttgaacatgtacaaaagagaaagaatcctacgatgaactcccatgtatccatcatccagcctcaatagtgatcaacccatagcatattgtggttcatgttgacactcatccacctctttccttccccatctctccccattattttgagacgaatgagatcctgggatttcgtgaaaatattatgaatatcttatttgtgagaacaagatttcccaaagcatgatccccagaaacctagtcctgcaaaactactgcaaaaataaagtgttctaatctccaaaaaaaaaaaaaaaa

SEQ ID NO: 62306 - DNA, 3009 bp, Homo sapiens
gtttgcttttagttctcattgtgagatcacaagtggaggctccaaccagtccagaagttcctttctatggggaagctgtggcagcaaggccgtgaagagagtctgacttaattgcaaagacgaggtttcaccatgttgaccaggctgatctcaaacatctgacctcaggaagtcagaggcaccaatgtgaggttccacctgctttccagcacattcttggtttcctcacttctgctagacaacgtttgatcagaaggaacagggaacgagaaggagctgctggatgacgataagcctgggaaagggaggctgggtgagcagagacagaaaagaaacacctacctgctgtgacctcacaaacacccaggctgagttttgataagacaggttgaatcacactggggtgacagcctcatccctccaggtacaaacaagaacaggccatggttaaccaaagctcccccatgggcttcctccttctgggcttctctgaacacccagcactggaaaggactctctttgtggttgtcttcacttcctacctcttgaccctggtgggcaacacactcatcatcctgctgtctgtactgtaccccaggctccactctccaatgtactttttcctctctgacctctccttcttggacctctgctttaccacaagttgtgtcccccagatgctggtcaacctctggggcccaaagaagaccatcagcttcctgggatgctctgtccagctcttcatcttcctgtccctggggaccactgagtgcatcctcctgacagtgatggcctttgaccgatacgtggctgtctgccagcccctccactatgccaccatcatccacccccgcctgtgctggcagctggcatctgtggcctgggttatgagtctggttcaatcgatagtccagacaccatccaccctccacttgcccttctgtccccaccagcagatagatgactttttatgtgaggtcccatctctgattcgactctcctgtggagatacctcctacaatgaaatccagttggctgtgtccagtgtcatcttcgtggttgtgcctctcagcctcatccttgcctcttatggagccactgcccaggcagtgctgaggattaactctgccacagcatggagaaaggcctttgggacctgctcctcccatctcactgtggtcaccctcttctacagctcagtcattgctgtctacctccagcccaaaaatccgtatgcccaagggaggggcaagttctttggtctcttctatgcagtgggcactccttcacttaaccctctcgtatacaccctgaggaacaaggagataaagcgagcactcaggaggttactagggaaggaaagagactccagggaaagctggagagctgcttaatatactttcgaaagtaagaagagtttcttcaagatttatgaacatgttaagttttccagactactacccttcccacatacacctgagccactgtggtgggtcacagtgtggctatgttatctatgagagggagaatgagaaagagagggacagagagataaaagaaattgggtgagaggagataggtagctccataaggcacacaaattcaaatattatcattcctatcactgtccattcttaatatttctatcctccattctgttctttttactgtcatcacttctatagatttcctaactccaccatgcctatttctggttatataattgctctccaattgtcatgtcagtgtaggggaactactccatcatagcattctggacaccttgcatgtatctacgtaggtcatgtaagcaaaggcttgaagaacagctaatctgagatttagaagaatgctttttgatcctcctggaatatgagaggatgggaggccctttagagcctgcctcaatgccatctctcactctccttcttatatccctgggagtatgtcatgtgacaagtctttactgtctcccaggttttggatggagcatggggttttctgccccacaccctttaggatatagctgaagaatataatgaggaatagctggattctagaactgactcctcaccagtggtatattccacaacagtgtcacagtcgtctggcccctttggtttccgtgtcatcctttttggtgtgtaggacaaggagccagggaattggcacgtttggcttttacttcttttttatatgtaaataataagccatctaagtgtaaaagtggctcatatcttctccagccaaatcagctaggccatggccttgccttgcttctcatgagtgtgcttgacagtcatcaccgtcactctatcttcatttctggttcttaccgtgttagcttagttcattcaagctactatcacaagctacacataaattgggtggtttataaataacaaacatttctttcttacagttctggaggctggaaactccaagattaaggcagatttcatgcctattgagggcctgctttctgattatagaaggtgacttcttgctgtgcccacacatggtgaaagggactaccaactctctggagtctcttttatgagggcactaattccaattatgaagcctcttccctcatgacctaatcactgcccaaaggccccatgttctaatgccatcatcttggtggtttaggatttcaacatatgaattttggaaggacataagcattcaaccccctgcacatgtcttctttcctacttcctcaaggttctttctgtccagttgctccttcttctattgacccttttttgccttctctttctccttcactgcctcaagttacagccagaggaaaggaggaactaaaacttagcaaatctataatcacatgcaaatacacagaatggattgttacaaccaaaatgcaggctctattgttttcaatttagcagcctttcaaatgtatatggttctggccacattaaagttgcaaataacactttttttgagactgaaataaaggtgaaatattggaaaaaaaaaaaaaaa

SEQ ID NO: 62307 - DNA, 3938 bp, Homo sapiens
tgagcctgtcaggctgggcgggtccatatccgggtggaccgggtgggtgaggctgcccctccctccaggtcccgaggtggataaggggtggggagtgacgtgcagagattccctttcgccccttcggatccaagagagggtggcagaaggaatgcgtgggtgacttggcgtggatttagggcgtgcccaccctgcagatcggcctcctagagtgtcccgagggcctgagaggccgcagggacacgaaggaagagaaggcatttcccggggatttggagcaggcacgcgcggcccgggcgtccggagctgtagcagcagcagcagccgccgtgccggggccgccaccgcggcgggcacccgcgtcccgggcgcccacggaccatggagagggcagtccagggcacagacggcggcgggggtagcaacagcagcagccgcagcagcagccgtgctacctcggcgggctcctcgccctcctgctctctggcgggccggggggtctccagccggtcggcggcggccgggctcggcggcgggggaagccgcagcagcccgggctctgtggccgctagcccgtccgggggaggcggccgcaggagggagccggcgctcgagggcgtgctcagcaaatacaccaacctcctccagggctggcagaacaggtacttcgtactggatttcgaggctggcatcctgcagtattttgtgaatgagcaaagcaaacaccagaagcctcgaggagtcctgtctttatctggagccatagtgtccctgagcgatgaagctccccacatgctggtggtgtactctgctaatggagagatgtttaaactgagagctgctgatgcaaaagagaaacaattctgggtgactcagcttcgagcttgtgccaaataccacatggaaatgaattctaagagtgctccaagctcccgaagccgaagtctcactttgctcccacatggaacacccaattctgcgtctccctgtagccagagacacctcagtgtgggggcccccggtgttgtcacaatcacgcatcacaagtcgcctgcagccgcccgaagagccaagagtcagtattccggccagcttcacgaagtcagagagatgatgaaccaggtggaagggcagcagaagaaccttgtgcacgccattgagtccctgccagggtccggccccctcactgccttggaccaggacctgctgctcctgaaagctacctctgctgccaccctcagctgccttggggagtgcctcaacttgttacagcagagtgtgcaccaggcgggccagcccagccagaagccaggagcctcggaaaacatcctgggatggcacgggtccaagtcacattccacagagcagctgaaaaatgggacacttggctctttgccatcagccagtgccaacataacctgggcaattttaccaaactctgctgaagacgaacaaacctcacagccagagccagagccaaactcaggctctgaattggttttgtctgaagatgaaaaaagtgacaatgaagataaggaagagacggaattgggcgtcatggaggatcagcgtagtataattcttcatctcatttcacaactcaaacttggaatggatttgaccaaggtggtgcttcccacctttatcctggagaagcgatctttgctggagatgtatgcagatttcatggcgcacccagacctactgctggccatcaccgctggggccacaccagaggagagagtcatttgcttcgttgagtattatctcacagcctttcacgagggccgcaagggcgctttagccaagaagccctacaaccccatcataggcgagacatttcactgctcctgggaagttcccaaggacagggtcaagcctaagaggactgcttcccgctctcctgccagctgtcacgaacacccaatggccgatgacccttccaaaagctacaaactaaggtttgtggctgagcaagtgtcccatcacccacccatctcctgcttctactgtgagtgcgaggagaagagactgtgcgtcaacactcatgtatggaccaaaagcaagttcatgggcatgtccgtgggggtctctatgataggggaaggtgtgttgaggctcctggaacacggggaggagtacgtattcaccctgcctagtgcctacgcccggtccattctcaccatcccgtgggtggagctcggaggaaaagtcagcatcaactgtgccaagactgggtactcagcgacagtgatattccacacgaagcctttctatggagggaaagtccacagggttaccgcagaagtgaagcacaacccaaccaacaccattgtttgtaaagcccatggggaatggaatggtactttagagttcacctacaacaatggagaaaccaaagtcatcgacacaaccacactgccagtgtatcccaagaagatcagacctcttgagaagcagggacccatggagtccaggaacctctggcgggaggtgacccgatacctgcggctgggggacattgacgcagccaccgagcagaagcggcacctggaggagaagcaacgggtggaggaacggaagcgcgagaacctccgcacaccatggaagcccaaatattttatccaggagggcgatggctgggtatacttcaatcccctctggaaagcacactgatggggtggaggtgcagagctttccagtatagccctgtttttgtaggaatattaaagtagtagagtatcagggttttgttggcattcactgagaccttgtattagcatccaagaaatgatgagagagagagaaattatatactatgaaaagtgcacccccacactctgctagaggaatgaatttattcaagagccattcggggcacgtgtgtgtacacaccgtatacgttcacacacatgcactatgtaaacatctgagtatgattacacatttaaatactgcactcaccaaggttaaagtgggtaatcataagctcctttttatcaatgaagtttgaagtttttctatttttcactttgccaaaaatgttttacactcacaaagatattctcacttagtcaactcctgtcaaaatgaaggtgaactggcatggcccgatcactgtccataagggagaaagtggctcattcctggtagaagtatgggtggttatcatttcaaaattattgtgattctcacctccctccccacctcagtgttttgtctgtccgcgcccaagaaagataagcaagtatttcctgctggatgggggttggcaggaagctgttaaagatttatgccagagccttgcaggatggagcacctctgggacaactaagagccaaggcccaccaaggagttttccacccgtctctcatggtcacagcgctagtcattcatttttgagaagttgcttcttttacatcagaaaaccagtcaatcatatggagacttcttttgtgatgaaaaagggctttagaagttaaatacatgcatgcacatgaaaacatgcacaaccacagcctcaatcttgtatttagtttggggaaagagaagagaatttcctgtggattattttttcctcaagtgcacctctctggttaacccaaactctgcaagaaagcactgtgactaaaacatacataacgcctgcataaatattccatggtttcagttaaatttcagtttttagcctttacacatgaggtcaaaggagtgacgaaaatacaaagcaaggaaaaaatgaaatatctggtttttgctgaatgcttaatttattttttactgtgccactccaatatttatcaaatccaaatagcatgaatgcttctctgtagtaatactaattttgtgccttttgtctgctttcttaagaccagttgttcacactttgtagatattagacaaatatatttcgattgaatacaaaaaaaaaaaaaaaa

SEQ ID NO: 62308 - DNA, 3420 bp, Homo sapiens
atgggcctgctggccagtgctggtttgttgctgttgctggtcatcggccaccccagaagcctaggactgaagtgtggaattcgcatggtcaacatgaaaagtaaggaacctgccgtgggatctagattcttctctagaattagtagttggagaaattcaacagtgactggacatccatggcaggtctccctaaaatcagatgagcaccacttctgtggaggaagcttgattcaagaagatcgggttgttacagcagcacactgcctggacagcctcagtgagaagcagctgaagaatataactgtgacttctggggagtacagcctctttcagaaggataagcaagaacagaatattcctgtctcaaaaattattacccatcctgaatacaacagccgtgaatatatgagtcctgatattgcactgctgtatctaaaacacaaagtcaagtttggaaatgctgttcagccaatctgtcttcctgacagcgatgataaagttgaaccaggaattctttgcttatccagtggatggggcaagatttccaaaacatcagaatattcaaatgtcctacaagaaatggaacttcccatcatggatgacagagcgtgtaatactgtgctcaagagcatgaacctccctcccctgggaaggaccatgctgtgtgctggcttccctgattggggaatggacgcctgccagggggactctggaggaccactggtttgtagaagaggtggtggaatctggattcttgctgggataacttcctgggtagctggttgtgctggaggttcagttcccgtaagaaacaaccatgtgaaggcatcacttggcattttctccaaagtgtctgagttgatggattttatcactcaaaacctgttcacaggtttggatcggggccaacccctctcaaaagtgggctcaaggtatataacaaaggccctgagttctgtccaagaagtgaatggaagccagagaggaaagggtattttagacatggaaaagcaagttggatgtgatcatgactatgtatctttacgatcaagcagtggagtgctttttaatcagagatctctcatggaagacgatggaaaacaaaacaaacgtgtctgtggaaaaatattgccttcaccattgctggcagagaccagtgaggccatggttccatttgtttctgatacagaagacagtggcagtggctttgagcttaccgttactgctgtacagaagtcagaagcagggtcaggttgtgggagtctggctatattggtagaagaagggacaaatcactctgccaagtatcctgatttgtatcccagtaacacaaggtgtcattggttcatttgtgctccagagaagcacattataaagttgacatttgaggactttgctgtcaaatttagtccaaactgtatttatgatgctgttgtgatttacggtgattctgaagaaaagcacaagttagctaaactttgtggaatgttgaccatcacttcaatattcagttctagtaacatgacggtgatatactttaaaagtgatggtaaaaatcgtttacaaggcttcaaggccagatttaccattttgccctcagagtctttaaacaaatttgaaccaaagttacctccccaaaacaatcctgtatctaccgtaaaagctattctgcatgatgtctgtggcatccctccatttagtccccagtggctttccagaagaatcgcaggaggggaagaagcctgcccccactgttggccatggcaggtgggtctgaggtttctaggcgattaccaatgtggaggtgccatcatcaacccagtgtggattctgaccgcagcccactgtgtgcaattgaagaataatccactctcctggactattattgctggggaccatgacagaaacctgaaggaatcaacagagcaggtgagaagggccaaacacataatagtgcatgaagactttaacacactaagttatgactctgacattgccctaatacaactaagctctcctctggagtacaactcggtggtgaggccagtatgtctcccacacagcgcagagcctctattttcctcggagatctgtgctgtgaccggatggggaagcatcagtgcagatggtggcctagcaagtcgcctacagcagattcaagtgcatgtgttagaaagagaggtctgtgaacacacttactattctgcccatccaggagggatcacagagaagatgatctgtgctggctttgcagcatctggagagaaagatttctgccagggagactctggtgggccactagtatgtagacatgaaaatggtccctttgtcctctatggcattgtcagctggggagctggctgtgtccagccatggaagccgggtgtatttgccagagtgatgatcttcttggactggatccaatcaaaaatcaatggtcctgcttcacttcagacaaataataaatgcaaaaccttaaaacaacaattgccaccacccacaccttcaccagacagtgcatcttggccaggttgttgctctgaagcagagctagaaaagcctagaggcttttttcccacaccacggtatctactggattatagaggaagactggaatgttcttgggtgctcagagtttcagcaagcagtatggcaaaatttaccattgagtatctgtcactcctggggtctcctgtgtgtcaagactcagttctaattatttatgaagaaagacacagtaagagaaagacggcaggtggattacatggaagaagactttactcaatgactttcatgagtcctggaccgctggtgagggtgacattccatgcccttgtacgaggtgcatttggtataagctatattgacttgaaagtcctaggtccaaaggacagtaaaataaccagactttcccaaagttcaaacagagagcacttggtcccttgtgaggatgttcttctgaccaagccagaagggatcatgcagatcccaagaaattctcacagaactactatggggtgccaatggagattagtagcccctttaaatcacatcattcagcttaatattattaacttcccgatgaagccaacaacttttgtctgtcatggtcatctgcgtgtttacgaaggatttggaccaggaaaaaaattaatagcttcattcgctggaactctggcaatgatactgacaaaagacatattaaaaagagaaaaactgaattttattaacacatatatcatgcatatatgggaaaattcagtgtatgataatgtaagaagtgttggaaaaagaaaacagaagaaatttgcatcaaatttaagttatagtatggaggctgagaagtccaggatccaggtgccagcagatttggtgcctgctaagggctcactttctggttcttaggcacagcccattctc

SEQ ID NO: 62309 - DNA, 500 bp, Homo sapiens
gggggcccgccatcttgattctttctcactgaccaagactcagccgtgggaaatatgagtgagcttctaagagcaagatcccaatcctcagaaagaggaaatgaccaagagtcttcccagccggttggatctgtgattgtccaggagcccactgaggaaaaacgtcaagaagaggaaccaccaactgataatcagggtattgcacctagtggggagattgaaaatcaagcagtgcctgcttttcaagggcctgacatggaagcttttcaacaggaactggctctgcttaagatagaggatgagcctggagatggtcctgatgtcagggaggggattatgcccacttttgatctcactaaagtgctggaagcaggtgatgcgcaaccataggtttcaagcaagacaaatgaagactgaaaccaagaacgttattcttaatctggaaatttgactgataatattctcttaataaagttttaagttttcgaaaaaaaaaaaaa

SEQ ID NO: 62310 - DNA, 742 bp, Homo sapiens
cttcattctttctcactgactgggactcagctggtaggtccgcagatcagtcctcctgggaatttagttgtgagtgaatgtgaaggggagccagcgggctttggacaggtcctgcggcacagaaaccacagtccgtggcttctgagagaaaagggcctcgccgtcgacgtccggctcctcccaggtcgcgacgccccatgggcctttgtcgtcgtttctgggccaggacgacggaggaaggtggaccgtagaggggaggaatcacgtgaagatggggcgagtgctgggcgtgctgttggagagtgaaacatgagtggacatcaaagaacaagatccagatctagagaaagaagagatgatcaagactctaatcatccagtaggggctgtggttgcccaggagctgcccagtaatgaccagcttcaacaagaggaaccaccaattgaaagtcaggattatacacctggtcaagagagagacgagggagcactggacttccaagtgctaggcctggcagcctatctctgggaactgactcggtcaaagactgggggtgaacgtggagatggtcctaatgtcaagggagaatttctgccaaatctggagcctgttaaaataccagaagcaggtgaagggcaaccatcggtttaaatgaagacaagctgaaaccatacatgcagtctttatgttggaaacttcaccagtaaaattctctcaataaagtttcacaattgtctgcaaa

SEQ ID NO: 62311 - DNA, 560 bp, Homo sapiens
agagctctgcaaggagaggttgtgtcttcgttctttccgccatcttcgttctttccaacatcttcgttctttctcactgaccgagactcagccgtgagagatatgagtgagcatgtaacaagatcccaatcctcagaaagaggaaatgaccaagagtcttcccagccagttggacctgtgattgtccagcagcccactgaggaaaaacgtcaagaagaggaaccaccaactgataatcagggtattgcacctagtggggagatcaaaaatgaaggagcacctgctgttcaagggactgatgtggaagcttttcaacaggaactggctctgcttaagatagaggatgcacctggagatggtcctgatgtcagggaggggactctgcccacttttgatcccactaaagtgctggaagcaggtgaagggcaactataggtttaaaccaagacaaatgaagactgaaaccaagaatattgttcttatgctggaaatttgactgctaacattctcttaataaagttttacagttttctgcaaagaaaaaaaaaaaaaaaaaaaaa

SEQ ID NO: 62312 - DNA, 760 bp, Homo sapiens
cagagctctgcaaggagaggttgtgtcttcgttctttccgccatcttcgttctttccaacatcttcgttctttctcactgaccgagactcagccggtaggtctgcagagtggtcttcctggtaatttagttgtgagtgaatgtgtggaggagccagcgggcttaggacaggtcctgtggcacagtccgtggctttgagggaaaagggcctcgcggtggtcctccgccttcccccaggtcgtgatgcaggcgccatgggccggtaatcgtggctgggctggaacgagggaggaagtgagagatatgagtgagcatgtaacaagatcccaatcctcagaaagaggaaatgaccaagagtcttcccagccagttggacctgtgattgtccagcagcccactgaggaaaaacgtcaagaagaggaaccaccaactgataatcagggtattgcacctagtggggagatcaaaaatgaaggagcacctgctgttcaagggactgatgtggaagcttttcaacaggaactggctctgcttaagatagaggatgcacctggagatggtcctgatgtcagggaggggactctgcccacttttgatcccactaaagtgctggaagcaggtgaagggcaactataggtttaaaccaagacaaatgaagactgaaaccaagaatattgttcttatgctggaaatttgactgctaacattctcttaataaagttttacagttttctgcaaagaaaaaaaaaaaaaaaaaaaaa

SEQ ID NO: 62313 - DNA, 2733 bp, Homo sapiens
gctttctaaggcggtcgctccgggaaatccgggccctaggattgtccactcatcccagtatcagcgagatacggggagatagagttagcgacaacgtgagccagagctggagcacgtttggtgagagaccagaaagcaatggaggccggagaggggaaggagcgcgttccgaaacaaaggcaagtcctgatattctttgttttgctgggcatagctcaggctagttgccagcctaggcactattcagtggccgaggaaacggagagtggctcctttgtggccaatttgttaaaagacctggggctggagataggagaacttgctgtgaggggggccagggtcgtttccaaaggaaaaaaaatgcatttgcagttcgataggcagaccggggatttgttgttaaatgagaaattggaccgggaggagctgtgcggccccacagagccctgtgtcctacctttccaggtgttactagaaaatcccttgcagttttttcaggcggagctacggattagggacgtaaatgatcattccccagttttcctagacaaagaaatacttttgaaaattccagaaagtatcactcctggaactactttcttaatagaacgtgcccaggacttggatgtaggaaccaacagtctccaaaattacacaatcagtcccaatttccactttcatcttaatttacaagacagtctcgatggcataatattaccacagctggtgctgaacagagccctggatcgcgaggagcagcctgagatcaggttaaccctcacagcgctagatggcgggagtccacccaggtccggcacggccctggtacggattgaagttgtggacatcaatgacaacgtcccagagtttgcaaagctgctctatgaggtgcagatcccggaggacagccccgttggatcccaggttgccatcgtctctgccagggatttagacattggaactaatggagaaatatcttatgcattttcccaagcatctgaagacattcgcaaaacgtttcgattaagtgcaaaatcgggagaactgcttttaagacagaaactggatttcgaatccatccagacatacacagtaaatattcaggcgacagatggtgggggcctatctggaacttgtgtggtatttgtccaagtgatggatttgaatgacaatcctccggaactaactatgtcgacacttatcaatcagatcccagaaaacttgcaggacaccctcattgctgtattcagcgtttcagatcctgactccggagacaacggaaggatggtgtgctccatccaagatgatcttccttttttcttgaaaccttctgttgagaacttttacactctggtgataagcacggccctggaccgggagaccagatccgaatacaacatcaccatcaccgtcaccgacttcgggacacccaggctgaaaaccgagcacaacataaccgtgctggtctccgacgtcaatgacaacgcccccgccttcacccaaacctcctacaccctgttcgtccgcgagaacaacagccccgccctgcacatcggcagcgtcagcgccacagacagagactcgggcaccaacgcccaggtcacctactcgctgctgccgccccaggacccgcacctgcccctcgcctccctggtctccatcaacgcggacaacggccacctgttcgctctccagtcgctggactacgaggccctgcaggcgttcgagttccgcgtgggcgccgcagaccgcggctccccggcgttgagcagcgaggcgctggtgcgcgtgctggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctgttcggcgtgtgggcgcacaatggcgaggtgcgcaccgccaggctgctgagggagcgcgacgctgccaagcagaggctggtggtgctggtcaaggacaatggcgagcctccgcgctcggccaccgccacgctgcacgtgctcctggtggacggcttctcccagccctacctgctgctcccggaggcggcaccggcccaggcccaggccgacttgctcaccgtctacctggtggtggcgttggcctcggtgtcttcgctcttcctcttctcggtgctcctgttcgtggcggtgcggctgtgcaggaggagcagggcggcctcggtgggtcgctgctcggtgcccgagggcccctttccagggcagatggtggacgtgagcggcaccgggaccctgtcccagagctaccagtacgaggtgtgtctgactggaggctccgggacaaatgagttcaagttcctgaagccaattatccccaacttcgttgctcagggtgcagagagggttagcgaggcaaatcccagtttcaggaagagctttgaattcacttaagtgttaataaggatctactgaggctagtctcgtttaatttgtggaaagtccttttttactgctttgcccattggaggtgtctccttttattagaaagtaaccatcttattccaattctatgcatgttactggtatttataaatgtatgagtttttttgcggtataataaatgtaaattttctttgtattctaaaaaaa

SEQ ID NO: 62314 - DNA, 2674 bp, Homo sapiens
cccactcggcggtttggcgggagggaggggatttgcgcaggccccgctcccgccccgcctccatgcggcccgccccgattgcgctgtggctgcgcctggtcttggccctggcccttgtccgcccccgggctgtggggtgggccccggtccgagcccccatctatgtcagcagctgggccgtccaggtgtcccagggtaaccgggaggtcgagcgcctggcacgcaaattcggcttcgtcaacctggggccgatcttccctgacgggcagtactttcacctgcggcaccggggcgtggtccagcagtccctgaccccgcactggggccaccgcctgcacctgaagaaaaaccccaaggtgcagtggttccagcagcagacgctgcagcggcgggtgaaacgctctgtcgtggtgcccacggacccctggttctccaagcagtggtacatgaacagcgaggcccaaccagacctgagcatcctgcaggcctggagtcaggggctgtcaggccagggcatcgtggtctctgtgctggacgatggcatcgagaaggaccacccggacctctgggccaactacgaccccctggccagctatgacttcaatgactacgacccggacccccagccccgctacacccccagcaaagagaaccggcacgggacccgctgtgctggggaggtggccgcgatggccaacaatggcttctgtggtgtgggggtcgctttcaacgcccgaatcggaggcgtacggatgctggacggtaccatcaccgatgtcatcgaggcccagtcgctgagcctgcagccgcagcacatccacatttacagcgccagctggggtcccgaggacgacggccgcacggtggacggccccggcatcctcacccgcgaggccttccggcgtggtgtgaccaagggccgcggcgggctgggcacgctcttcatctgggcctcgggcaacggcggcctgcactacgacaactgcaactgcgacggctacaccaacagcatccacacgctttccgtgggcagcaccacccagcagggccgcgtgccctggtacagcgaagcctgcgcctccaccctcaccaccacctacagcagcggcgtggccaccgacccccagatcgtcaccacggacctgcatcacgggtgcacagaccagcacacgggcacctcggcctcagccccactggcggccggcatgatcgccctagcgctggaggccaacccgttcctgacgtggagagacatgcagcacctggtggtccgcgcgtccaagccggcgcacctgcaggccgaggactggaggaccaacggcgtggggcgccaagtgagccatcactacggatacgggctgctggacgccgggctgctggtggacaccgcccgcacctggctgcccacccagccgcagaggaagtgcgccgtccgggtccagagccgccccacccccatcctgccgctgatctacatcagggaaaacgtatcggcctgcgccggcctccacaactccatccgctcgctggagcacgtgcaggcgcagctgacgctgtcctacagccggcgcggagacctggagatctcgctcaccagccccatgggcacgcgctccacactcgtggccatacgacccttggacgtcagcactgaaggctacaacaactgggtcttcatgtccacccacttctgggatgagaacccacagggcgtgtggaccctgggcctagagaacaagggctactatttcaacacggggacgttgtaccgctacacgctgctgctctatgggacggccgaggacatgacagcgcggcctacaggcccccaggtgaccagcagcgcgtgtgtgcagcgggacacagaggggctgtgccaggcgtgtgacggccccgcctacatcctgggacagctctgcctggcctactgccccccgcggttcttcaaccacacaaggctggtgaccgctgggcctgggcacacggcggcgcccgcgctgagggtctgctccagctgccatgcctcctgctacacctgccgcggcggctccccgagggactgcacctcctgtcccccatcctccacgctggaccagcagcagggctcctgcatgggacccaccacccccgacagccgcccccggcttagagctgccgcctgtccccaccaccgctgcccagcctcggccatggtgctgagcctcctggccgtgaccctcggaggccccgtcctctgcggcatgtccatggacctcccactatacgcctggctctcccgtgccagggccacccccaccaaaccccaggtctggctgccagctggaacctgaagttgtcagctcagaaagcgaccttgcccccgcctgggtccctgacaggcactgctgccatgctgcctccccaggctggccccagaggagcgagcaccagcacccgacgcctggcctgccagggatgggccccgtggaaccccgaagcctggcgggagagagagagagagaagtctcctctgcattttgggtttgggcgggagtgggctggggggagaggctggagcaccccaaaagccaggggaaagtggagggagagaaacgtgacactgtccgcctcgggcaccgcgtccaacctcagagtttgcaaataaaggttgcttagaaggtgaaaaaaaaaaaaa

SEQ ID NO: 62315 - DNA, 1140 bp, Homo sapiens
ggggagagagaggccggtcctggtctggccgctgcggctgctagcccgaggtctccaagccgggctgcggctccatcctcggctcctgggcaccgtctgcgaggctccgccgaccagagtgagaaagccgcgggcggcgaccgccgcatcatgtcagccaaggacgagcgggccagggagatcctgaggggcttcaaactaaattggatgaaccttcgggatgctgagacagggaagatactctggcaaggaacagaagacctgtctgtccctggtgtggagcatgaagcccgtgttcccaagaaaatcctcaagtgcaaggcagtgtctcgagaacttaatttttcttcgacagaacaaatggaaaaattccgcctggaacaaaaagtttacttcaaagggcaatgcctagaagaatggttcttcgagtttggctttgtgatccctaactccacaaatacctggcagtccttgatagaggcagcacccgagtcccagatgatgccagcaagcgtcttaactgggaacgttatcatagaaacaaagttttttgacgacgatcttcttgtaagcacatccagagtgagacttttctatgtttgaaagaagaatgtgtgtacatttcaagaatttgggttttttggagggaggaggaaactgtttacttttttcctccacacgtttgatttttgacacatacacccctaattccctcaacagcagaacctacctgcagccaccaggggaccagctctgtgtaggtaaccagatggctctttttcccaagccaccatcttccagctgaccagactaaactcccaaccccagaccagggcaggggacaggtctcaagtccttcccagcatacacacagggaacaaacacataccacaaaccggtaactgtacctgtcaccctccttgtctcctccttgggccctacaggctacacatctacctttggcccctggttttggaaaaattccgtgttcctgacccatgtttagttttttcctaccatttctatttcatacattctcatacatttaacttgtaaaatagactgtgatattattacataatgtaattaaaaatatgaattaaaatattcctacagtcaaaaaaaaaaaaaaaaaaaaaa

SEQ ID NO: 62316 - DNA, 1398 bp, Homo sapiens
caggccttccggcggtcgttacgggacgccgctgccatctacagcactccgtgaagaatatgctggccgccttcatctcccgcgtgttgaggcgagttgcccagaaatcagctcgcagagtgctggtggcatcccgtaactcctcaaatgacgctacatttgaaattaagaaatgtgatctttatctgttggaagagggtccccctgtcactacagtgctcactagggcggaggggcttaaatactacaggatgatgctgactgttcgccgcatggaattgaaggcagatcagctgtacaaacagaaattcattcgcggtttctgtcacctgtgcgatggtcaggaagcttgttgcgtgggccttgaggccggcataaacccctcggatcacgtcattacatcctatagggctcatggtgtgtgctatactcggggactttctgtccgatccattctcgcagagctgacgggaagaagaggaggttgtgctaaaggaaaaggaggatcgatgcatatgtataccaagaacttctatgggggcaatggcatcgtcggtgcacagggccccctgggcgctggcattgctctggcctgtaaatataaaggaaacgatgagatctgtttgactttatatggggatggcgctgcgaatcaggggcagatagccgaagctttcaatatggcagctttatggaaattaccttgtgttttcatctgtgagaataacctatatggaatgggaacatctactgagagagcagcagccagccctgattactacaagaggggcaattttatccctgggctaaaggtcgatggaatggatgttctgtgtgttcgtgaggcaacaaaatttgcagctaactactgtagatctggaaaggggcccatactgatggagctgcaaacctaccgttatcatggacacagtatgagtgatcctggagtcagttatcgtacacgagaagaaattcaggaagtaagaagtaagagggatcctataataattctccaagatagaatggtaaacagcaagctcgccactgtggaagaattaaaggaaattggggctgaggtgaggaaagaaattgatgatgctgcccagtttgctaccactgatcctgagccacatttggaagaattaggccatcacatctacagcagtgattcatcttttgaagttcgtggtgcaaatccatggatcaagtttaagtccgtcagttaaagggaggctacgtgtgaatttatcatcagtctctcaatggaatgttcatggtcaaatttaagaaactgtgttctcaactcaaggaggaataaaactcataaaacaaaagccttgtaagcatttattaaaagagattattaaaagagattgaaggacaaaaaaaaaaaaaaaa

SEQ ID NO: 62317 - DNA, 3529 bp, Homo sapiens
ggtcccggccacaagctgtcggctcggttcggtcgcgttacagggcaggcgccggggccaaggcagggagggatcttaggagagatcgtaggacatctgaagagctgccatgtctggggcatcttcctcagaacagaacaacaacagctatgaaaccaaaaccccaaatcttcgaatgtcagagaagaaatgttcatgggcctcctacatgaccaactccccgactctgatcgttatgattggtttgccagcccggggtaaaacctacgtgtccaagaaactaacacgctacctcaactggattggagtccccaccaaagtgtttaatcttggggtgtatcggcgtgaagcagtcaagtcctataagtcctacgacttctttcggcatgacaatgaggaggccatgaagatccgcaaacagtgtgctctggtggcgctggaagatgttaaggcgtatctcactgaggagaatggtcagattgcggtgtttgatgccaccaatacaacccgggagaggagggacatgattttgaactttgctgaacagaattccttcaaggtattctttgtggaatccgtctgtgatgatcctgatgtcattgctgccaatattctggaggttaaggtatcaagccctgactatcctgaaaggaacagagagaacgtgatggaggacttcctgaagagaattgaatgctacaaagttacctaccgacctcttgacccagacaactatgacaaggatctttctttcatcaaggtgataaacgtgggccagcgatttttagtcaacagagtccaggactacatccagagcaagatagtctactacctcatgaatatccacgtccagcctcgcaccatttacctttgccggcatggagaaagcgagttcaatctcttggggaagattgggggtgactctggcctctcggtgcggggaaagcagtttgcccaagctctaaggaaatttctggaggaacaggaaataacagacctcaaagtgtggacaagccagttgaagaggaccatacagactgctgaatctctcggggtgccctatgagcagtggaagattctgaatgagattgatgctggtgtgtgtgaagagatgacctatgcagagattgagaaacggtacccagaagagtttgcacttcgagatcaagagaagtatctgtatcgatatcctggtggggagtcataccaggacctggtgcagcggctggagcctgtcatcatggagctggaacgtcagggcaatgtcctcgtcatctcccaccaggctgtcatgcgctgcctcctggcctacttcttggataagggcgcagatgagctaccatacttgagatgccctctccataccatcttcaaacttactcctgtggcctatgggtgcaaagtggaaacaattaaacttaacgtggaggctgtgaacacgcaccgtgacaagccaactgcagcagagaccacactggctgtgcgcagacgcccctccgcagcgtccctcatgttgccttgctaatgatgtggatgttcaggcctcacctctccaaacgactgggatctactgaaaagcttgggatgtcagcttcacagaggctagaacaggaagttaagtgggaactggactttgggggccaccaaaacgaggcctggagaaacgtcaccatatttcctcccctcctgcctaatgggaatatcagttacactgaaaaatttaacttccctgtgcctcaaaacatttagcaacctgaaccagtgactttttgtcatctctgtgctgagtttggtccaagttggtcaatctcattctgtataggcatttaacatcctacctgtgactgtctgcatcctttgctggctcttttttgcccaaagtgcaaatgcacttcttcagatttacttttcaagtgagaaggtaagagctggtctctgccactgttccaggcgagcaggctagagtctaatatacttatgctagcagttaccatttgccacattggaagcaagagacaaatcaccaggtgaatggagggtcttctgagaaattcagtccctaaaacatcttctctgccttgatagaagaacagtgtcagtggcaaccttttcatttagagaagtttttcttgttccaggcccttcaggacaggatctgactgcaagactccccaaaatgggtacccatcttctaagttcccttttgtagctactgtacttttgacttgatgcatgtgcctctcatgcatcaagatggggctgatgtggttctcctgggtggttgggaatgtggactagacagaaaagtagagtgccatttatatcacgtgagtaagtcaagaaagctccttgagaatcagcccgatcagggagtgttttggcttcagaacaggtggaaggagacacgcccctctgtgggctctgtcaccatgatacagtccttgagagagctgtggctgtgacttggagggcagtagtctcctgatacctgcctcttggccactggtcactattgtggtcactgatctctcatataaaagtgagggtggcggggtcatggaccagcgcctcagtgcattagtcattcgcttttccttacagacaaatcagataactcttccccagtgattgtcaaatgtatgaatgtatctctgtaaatgtggttttgacatgtcactgttactgaaggagagtatggaatccccacaggatattatatcttgcaaggaaagtctattttttaaagaatagtatgtttttagctttacttttctttcttttccttttcactcaaatgctcacttgctgggcaaaagggtgagtagcaagaaaagtaatgatatgtagcttttctcaaatggttcttttatactgtggatgatacaggactctgttacctaagatgtgataagctgggctgcaggcggttcagcatccagcaactaggagctgcttttctacgtacaaagctgccttcaggaaggctccttaccctgtagcagatgattttcatctggctgcctaccgcatgctgtactataatgatttagttgtgatatggatttctctctgcatcgaaaactgtcttttgatgatcagacaatgtttatatttagttatttattctatccatgtaaggcatttttgagttttcttgtcactgtttgcatgtatttaatcagaatgtaatataatttatgttgtcaggtttttttttgtttgtttgtttggggttttttttgtagaaatttaggtagttagagcttttaagtctaatgtcatattaacttaagttaaatttccagaacgtagatatctgtcttctgtaaaaggaaaataacgatgttaagggacagtgaattttttttgaatactttgtttctcattgatttttattgtaagtgtaaaccaagagatgcatttctctggagaagtgtttatctcctggattaataaaatcatgctaaaatatgcgagtaatatgtattgcttttgtaataagaacataaaataaaattatttttaatta

SEQ ID NO: 62318 - DNA, 3908 bp, Homo sapiens
atgtgtcaagtgcctatgaaggggactgcccatgaagtgaaagtcaagtgtgtgttgctgcggcagccacggaggccaaggacctcacgggagtaaaagatgacgagactggcttcgggagaaacaccatccagaagagacctttcaaaaaacttctagagactccccaagacgtatgagatgaaaggcttcttctgtctgtgtgcgtttaactcatttctccttagccccgagattacgcgctgctgtgcctgcgactgcagcgtttacgccgagataactcgtggattacagtgccaaccttactcccaaagtttgccacgaaatatctcgcttctgttattttcgcatggttctggtatattgacttttgaaacaaaagacatcattctgtttatagcattctgtttttagtagtgggatttccatctacaaaatatagtaattctcgatcgctgaaatgtcaaatcctagaaaacgtagcattcctatgcgtgatagtaataccggtctcgaacagttgttggctgaagattcatttgatgaatctgatttttcggaaatagatgattctgataatttttcggatagtgctttagaagccgataagatcaggcctctgtcccatttagaatctgatggaaagagctctacatcaagtgactcagggcgctccatgaaatggtcagctcgtgctatgattccacgtcaaaggtatgactttaccggcacacctggcagaaaagtcgatgtcagtgatatcactgacccattgcagtattttgaactgttctttactgaggaattagtttcaaaaattactagagaaacaaatgcccaagctgccttgttggcttcaaagccaccgggtccgaaaggattttcgcgaatggataaatggaaagacactgacaatgacgagctcaaagtcttttttgcagtaatgttactgcaaggtattgtgcagaaacctgagctggagatgttttggtcaacaaggcctcttttggatacaccttatctcaggcaaattatgactggtgaaagatttttacttttgtttcggtgcctgcattttgtcaacaattcttctatatctgctggtcaatcaaaggcccagatttcattgcagaagatcaaacctgtgttcgactttcttgtaaataaattttccactgtatatactccaaacagaaacattgcagttgatgaatcactgatgctgttcaaggggccattagctatgaagcagtacctcccgacaaaacgagtacgatttggtctgaagctatatgtactttgtgaaagtcagtctggttatgtgtggaatgcgcttgttcacacagggcctggcatgaatttgaaagattcagcggatggcctgaaatcatcacgcattgttcttaccttggtcaatgaccttcttggccaagggtattgtgtcttcctcgataactttaatatatctcccatgcttttcagagaattacatcaaaataggactgatgcagttgggacagctcgtttgaacagaaaacagattccaaatgatctgaaaaaaaggattgcaaaggggacgactgtagccagattctgtggtgaacttatggcactgaaatggtgtgacggcaaggaggtgacaatgttgtcaacattccacaatgatactgtgattgaagtaaacaatagaaatggaaagaaaactaaaaggccacgtgtcattgtggattataacgagaatatgggagcagtggactcggctgatcaaatgcttacttcttatccatctgagcgcaaaagacacaaggtttggtataagaaattctttcaccatcttctacacattacagtgctgaactcctacatcctgttcaagaaggataatcctgagcacacgatgagccatataaacttcagactggcattgattgaaagaatgctggaaaagcatcacaagccagggcagcaacatcttcgaggtcgtccttgctccgatgatgtcacacctcttcgtctgtctggaagacatttccccaagagcataccagcaacgtccgggaaacagaatccaactggtcgctgcaaaatttgctgctcccaatacgacaaggatggcaagaagatccggaaagaaacgcgctatttttgtgccgaatgtgatgttccgctttgtgttgttccgtgctttgaaatttaccacacgaaaaaaaattattaaataccgatcatcatacacatctgttccattaggattagagacaagttctgtttagaaataactccaagattgggaggccgacctgggtggatcacctgagatcaggctagtcttgacctcccgacctcaggtgatccgcctatctgggcctcacaaagtcctgggattataggcatgagccactgcgcctagcaccaagaacagtttttatattttattttcacattgaaaatcagtcagatttgcttcagcctcaaagagggtgtttatgtaaaactaaatgagtgcaggcagcgagctacacttttttttttcctaaatggaaaatgggaaggagatactgtctctgaacaaaaatagctggaaaaacacataactgttaactaagggttgcctctagtgaaaaggattggaagacaatttatctgatgctacactattcttcctgttgtgattgttttactgtgaacataacaaggttgtattggggaggagggcaggggttgattgctgccaatgttgattgctgaggccttagccaagatttcaggcatcatttgctccagtcctttcattttctttatggtggaaagtgaagtgacttgcccaagatctttgttggccctaaacatcgctgtctctgctacagattcctattgagagcaatgcatgttttagccttgtgcactcttagagtcagcatcatgggaaagagtaacagcaattgaaaaaagagattcaagagccaagtactcagccctggcaggggatggggacatgatgcccagagccacccctatactccagtctccctggcatcagctactgcagtactggggtacttgccttcatcttttttctgaagatagttacttcttcatatttgatcatcggaaggagcagcattgctcagaaacacacacacacacacacacacttgactttcttgtctgccaaataaatttcttatttgctagggaactggtaatctaggctcaagaagtgtgtggagaaggtttattttcattctttttactttaaaatatgccttagtttttgaatagataagacattcaagtgtcagaaagtaaaagtcagttcaggactgagaaaggaaagatcagtgctgattttaatcagactgtaatgtaccaactagatacagacagggccagtggcaaggccatcagaaaacttcttcccaaggccacaccacacctgcaaaatgcctaacaaccttcttcttttcagtgattaccactttcttaccaatgacttcgctttgttcctcgtgcctctgaacagactgctgagatacccaatcaagagccaatccttgcttccctagactctcctcaatcattcaacagaagcccaaatcttgtaaaagttcctttctgggccgggcacagtggctcacgcctgtaatcccagcactttggaaggccgagatgggcgaatcacaaggtcaggagtttgagactagcctggccaacatggtgaaaccctgtctctactaaaaatacaaaaaaaaattagctgggcatagtggtgggtgcctgtaatcccagctacttgggaggctgagacaggagaatcacttgaacccgggaggcagaggttgcagtgagccaagatcgcaccactgcactccagccctggcgacagagtgagactccatctcaaaaaa

SEQ ID NO: 62319 - DNA, 5279 bp, Homo sapiens
gccgagcggcggcgcggcgcggcaacatggcgacggtgcccgtgtactgcgtctgccggctcccctacgacgttacccgcttcatgatcgagtgcgacgcctgcaaggactggttccacggcagctgtgttggggtggaagaggaggaggcgcccgacatcgacatataccactgcccaaactgtgagaaaacccatgggaagtccaccttaaagaagaagcggacctggcacaaacacggcccggggcaagcgcctgacgtcaagcccgtgcagaatggcagccagctcttcatcaaggagctgcggagccggacctttcccagtgctgaagacgtggtggcccgtgtgccaggaagtcagctcacgctgggctacatggaggagcacggcttcaccgagcccatcctcgtccctaagaaagacgggctgggtctggctgtcccggcccccacgttctatgtcagtgacgtcgagaactacgtggggccggaacggagtgtggatgtgacagatgtcaccaagcagaaggactgcaagatgaagctgaaggagtttgtggactattactacagcaccaaccgcaagcgggtcctcaacgtcaccaacctcgagttctctgacacccgaatgtccagcttcgtggagccacctgacattgtaaagaaactgtcatgggtagaaaactactggccagatgatgcattgctggccaagcccaaagtgaccaagtactgcctaatctgcgtgaaggacagttacaccgacttccacatcgactctgggggcgcctctgcctggtaccacgtgctcaagggggagaagaccttctatctcatcaggccggcctcggccaacatctccctgtatgagcgctggcggtctgcctctaaccacagcgagatgttctttgctgaccaggtcgacaaatgctacaagtgcatcgtcaagcagggccagaccctcttcatcccctcaggctggatctacgccacactcacccctgtggactgcctggccttcgcgggacatttcctccacagcctgagtgtggagatgcagatgagagcatatgaagtggaaaggaggttgaaactgggcagcctgactcagtttcccaactttgaaactgcgtgctggtacatggggaagcacctgctggaggcattcaaaggctctcacaaatctgggaagcagctgccccctcatctagtccaaggagctaaaattctcaatggtgctttccgatcgtggacgaagaagcaggctttggcagagcatgaggacgagctcccggagcacttcaaaccttcacagctaatcaaagacctggccaaagagatccggctcagtgagaatgcctccaaagccgtccgaccggaagtgaatactgtcgcctcgtcagatgaggtgtgtgacggggaccgggagaaggaggagcccccgtctcccattgaggccaccccgcctcaatccctcctggagaaagtgtccaaaaaaaagactcccaaaactgtgaagatgcccaagccatccaaaatccccaagcccccgaagccccctaagcccccaaggccccccaaaacgctgaagctcaaagatggaggcaagaagaaagggaagaagtcccgggagtcagcctcacccaccatccccaacctggacctgctcgaagcccacaccaaggaggcactgaccaagatggagccgcccaagaagggcaaggccacaaagagtgtcctgagtgtgcccaacaaagatgtggttcacatgcagaatgatgtggagaggctggaaattcgagagcaaaccaagagcaagtcagaggccaagtggaagtacaagaacagcaaacctgactccttactgaagatggaagaggagcagaagctagagaagtcgcctctagctggaaacaaagacaataagttctctttttctttctccaacaagaaactcctcggctccaaggctctcaggcccccgacgagccctggtgtgttcggggccttgcagaacttcaaggaggacaagcccaagcccgtgcgggatgagtatgagtacgtgtcggatgacggtgagctcaagatcgacgagtttcccatcaggaggaagaaaaacgccccgaaaagggacttgtccttcttgttggataagaaggctgtgctgcccacgcctgtcacgaagccaaagctggactcggcagcgtacaagagtgatgactcctcggacgagggttcgctgcacatcgacacagacaccaagcccggccgcaatgccagagtcaagaaggagagtgggagctcggcagctggcatcttggacctgctgcaggccagtgaggaggttggcgcgctggagtacaaccccagcagccagcccccggcctcccccagcacacaggaagccattcagggaatgctgtccatggccaacctgcaggcctccgactcctgcctgcagaccacgtggggagctggccaggccaaggggagctcgctggctgcccatggtgcccggaagaatgggggtggcagtggcaagagtgcaggcaaacgactgctgaagagggctgccaagaacagtgtcgacctggacgactacgaggaagagcaggaccacctggatgcctgcttcaaggactcagactacgtttacccctcactggagtcagatgaagacaaccccatctttaagtcccggtcgaagaaaaggaaaggctcagacgacgctccctacagcccaacagcaagggtcggcccatcggtgccaagacaggacaggcctgtgcgtgagggtacacgggtggcttccatcgagaccgggctggcggctgctgcagctaagttgtcccagcaggaggagcagaaaagcaagaaaaaaaagagtgccaagaggaagctgactcctaacaccacctccccttccacctccacctccatctctgccggcaccacctccacctccaccacgccagcctccaccacgccagcctctaccaccccggcctccaccaccccggcctccaccagcacggccagcagccaggcctcgcaggagggcagctcgccagagcccccgcctgagtcgcatagcagcagcctggcggaccatgagtacacagccgctggcaccttcaccggggcccaggctggccgcacctcccagcccatggcccctggggtctttctcacacagaggcggccctccgcatcgtctccaaacaacaacaccgctgccaaaggaaaacgtacgaaaaagggcatggcgaccgccaagcagaggcttgggaaaattttgaaaattcatcggaacgggaaactactcctttaagatttggaaagccaggatccttctgctccgctcaggacccccggagccccgcgaaaacatctgcctcccaggagggtgccgagctgcctcaccagggagggccttgcctcttcccggctgccatctccccaacaagcgtctgtcccttcagccggcagagcgagcccagcgtggcccctcaatttgaaaatggacgtcttttctcaagttgctaagagtgatctgtcccagaaaagcggccctgcaagtttgaggaccgcttattccactttaaggacagccttcaggccccctgagcgtgggtgtgattgcagggcctctgcagctctgctgagagcatgagtccttcaaggaagacagagtgagccaatgctcaccagccccagagtcagagctggccacaggctggcagcctccaggggcttaaaaaaaaaggcaaagaacacagaaagaggaggagcaagtgggatgtttatgtccccccttctcttcctgagtgattctcagccaagtccagacagtgctcggcgggtgaggaagggtctgccccgagctttctggttggcaggtggcagcaggatggtgggtgttcagcctgaatgcccaggagcatttctggggggcagctaagactggcagctgggttggtgtgttagcgggcaggggagccattgtggggtccccaggaaagggcaagggctcagccacatcttggggtctgggaggcccaggctaagccatgtggcagggaccgtcttgccctgctggccacactctggagaagcacttctcagccaaggcacccctgccctgggactggcagggcaggggcaggggcagggacagtggccaggcggcccgaggacttacggtcggcacttctctgttctcccgtgtcagcgtgtggtgtcgcctgcatgggtcgtacctggatggtgtgtccaccatcgacacggaggggctggatttgtttctcaggcaatcctgtattttaattttagatgtatttcctgaagcatatttttcatagaatgtagcgtgtaaatagctttttaaataacttcttttttataagagtaaaagtatctttaggaatttctttctatagagttcttcattaacatttatacgagttttttgctgagtcagatggacagttgggttctgatgctttttccttctcctttccttttattattattatttttttcttttaagaactaaggtattgcctgaaaaacaagtgatgtctgtgcagccttacactctgtctttacagaagcaaatagtacacaaaagatctatttcagacacattttgaagatgaatcttcaactttaataccagctctttgttttccttgtatgatgaggggattgggggatacagttattttactagcaccttgtgaagtgtttccgtgttttgtgatgctgtaatttattaatgtttgtagctttttatatttgtacatttcttatgagctttgtttatatacccattacctggatgtttttgtccactgggagaggcagcttggtggaggccttatccactcccacttgtcctgtttggagggacgcagtccctagggcccgagactgggtgggagagggggagtctcacggggccccaggcttattcagaactggtgtttttaaagtttcctttaccctgcccttgttgaacatttatataatctaacctggacatcaagctgttctctctctctcttttttttaattttattattattattttggcaacatgtacatttctaacaaagtttatcgtggctattaaagtgttttatttcccaattcatattactcttgtatcgagtccatgaggtctaaggcaacttagatcaaagttttaaaaaagtaaaaatatttcaggttttgtacaaaaaaaaaaaaaaaaaaaaaaaaaaaaaaaaaaaaaaaa

SEQ ID NO: 62320 - DNA, 5238 bp, Homo sapiens
cgagcggcggcgcggcgcggcaacatggcgacggtgcccgtgtactgcgtctgccggctcccctacgacgttacccgcccccgcgcggcccggcccccggcccggcccggaccgacccgggcagcgcagcggcggggccgagcggcggcgcccgacatcgacatataccactgcccaaactgtgagaaaacccatgggaagtccacagtaaagaagaagcggacctggcacaaacacggcccggggcaagcgcctgacgtcaagcccgtgcagaatggcagccagctcttcatcaaggagctgcggagccggacctttcccagtgctgaagacgtggtggcccgtgtgccaggaagtcagctcacgctgggctacatggaggagcacggcttcaccgagcccatcctcgtccctaagaaagacgggctgggtctggctgtcccggcccccacgttctatgtcagtgacgtcgagaactacgtggggccggaacggagtgtggatgtgacagatgtcaccaagcagaaggactgcaagatgaagctgaaggagtttgtggactattactacagcaccaaccgcaagcgggtcctcaacgtcaccaacctcgagttctctgacacccgaatgtccagcttcgtggagccacctgacattgtaaagaaactgtcatgggtagaaaactactggccagatgatgcattgctggccaagcccaaagtgaccaagtactgcctaatctgcgtgaaggacagttacaccgacttccacatcgactctgggggcgcctctgcctggtaccacgtgctcaagggggagaagaccttctatctcatcaggccggcctcggccaacatctccctgtatgagcgctggcggtctgcctctaaccacagcgagatgttctttgctgaccaggtcgacaaatgctacaagtgcatcgtcaagcagggccagaccctcttcatcccctcaggctggatctacgccacactcacccctgtggactgcctggccttcgcgggacatttcctccacagcctgagtgtggagatgcagatgagagcatatgaagtggaaaggaggttgaaactgggcagcctgactcagtttcccaactttgaaactgcgtgctggtacatggggaagcacctgctggaggcattcaaaggctctcacaaatctgggaagcagctgccccctcatctagtccaaggagctaaaattctcaatggtgctttccgatcgtggacgaagaagcaggctttggcagagcatgaggacgagctcccggagcacttcaaaccttcacagctaatcaaagacctggccaaagagatccggctcagtgagaatgcctccaaagccgtccgaccggaagtgaatactgtcgcctcgtcagatgaggtgtgtgacggggaccgggagaaggaggagcccccgtctcccattgaggccaccccgcctcaatccctcctggagaaagtgtccaaaaaaaagactcccaaaactgtgaagatgcccaagccatccaaaatccccaagcccccgaagccccctaagcccccaaggccccccaaaacgctgaagctcaaagatggaggcaagaagaaagggaagaagtcccgggagtcagcctcacccaccatccccaacctggacctgctcgaagcccacaccaaggaggcactgaccaagatggagccgcccaagaagggcaaggccacaaagagtgtcctgagtgtgcccaacaaagatgtggttcacatgcagaatgatgtggagaggctggaaattcgagagcaaaccaagagcaagtcagaggccaagtggaagtacaagaacagcaaacctgactccttactgaagatggaagaggagcagaagctagagaagtcgcctctagctggaaacaaagacaataagttctctttttctttctccaacaagaaactcctcggctccaaggctctcaggcccccgacgagccctggtgtgttcggggccttgcagaacttcaaggaggacaagcccaagcccgtgcgggatgagtatgagtacgtgtcggatgacggtgagctcaagatcgacgagtttcccatcaggaggaagaaaaacgccccgaaaagggacttgtccttcttgttggataagaaggctgtgctgcccacgcctgtcacgaagccaaagctggactcggcagcgtacaagagtgatgactcctcggacgagggttcgctgcacatcgacacagacaccaagcccggccgcaatgccagagtcaagaaggagagtgggagctcggcagctggcatcttggacctgctgcaggccagtgaggaggttggcgcgctggagtacaaccccagcagccagcccccggcctcccccagcacacaggaagccattcagggaatgctgtccatggccaacctgcaggcctccgactcctgcctgcagaccacgtggggagctggccaggccaaggggagctcgctggctgcccatggtgcccggaagaatgggggtggcagtggcaagagtgcaggcaaacgactgctgaagagggctgccaagaacagtgtcgacctggacgactacgaggaagagcaggaccacctggatgcctgcttcaaggactcagactacgtttacccctcactggagtcagatgaagacaaccccatctttaagtcccggtcgaagaaaaggaaaggctcagacgacgctccctacagcccaacagcaagggtcggcccatcggtgccaagacaggacaggcctgtgcgtgagggtacacgggtggcttccatcgagaccgggctggcggctgctgcagctaagttgtcccagcaggaggagcagaaaagcaagaaaaaaaagagtgccaagaggaagctgactcctaacaccacctccccttccacctccacctccatctctgccggcaccacctccacctccaccacgccagcctctaccaccccagcctccaccaccccggcctccaccaccccggcctccaccagcacggccagcagccaggcctcgcaggagggcagctcgccagagcccccgcctgagtcgcatagcagcagcctggcggaccatgagtacacagccgctggcaccttcaccggggcccaggctggccgcacctcccagcccatggcccctggggtctttctcacacagaggcggccctccgcatcgtctccaaacaacaacaccgctgccaaaggaaaacgtacgaaaaagggcatggcgaccgccaagcagaggcttgggaaaattttgaaaattcatcggaacgggaaactactcctttaagatttggaaagccaggatccttctgctccgctcaggacccccggagccccgcgaaaacatctgcctcccaggagggtgccgagctgcctcaccagggagggccttgcctcttcccggctgccatctccccaacaagcgtctgtcccttcagccggcagagcgagcccagcgtggcccctcaatttgaaaatggacgtcttttctcaagttgctaagagtgatctgtcccagaaaagcggccctgcaagtttgaggaccgcttattccactttaaggacagccttcaggccccctgagcgtgggtgtgattgcagggcctctgcagctctgctgagagcatgagtccttcaaggaagacagagtgagccaatgctcaccagccccagagtcagagctggccacaggctggcagcctccaggggcttaaaaaaaaaggcaaagaacacagaaagaggaggagcaagtgggatgtttatgtccccccttctcttcctgagtgattctcagccaagtccagacagtgctcggcgggtgaggaagggtctgccccgagctttctggttggcaggtggcagcaggatggtgggtgttcagcctgaatgcccaggagcatttctggggggcagctaagactggcagctgggttggtgtgttagcgggcaggggagccattgtggggtccccaggaaagggcaagggctcagccacatcttggggtctgggaggcccaggctaagccatgtggcagggaccgtcttgccctgctggccacactctggagaagcacttctcagccaaggcacccctgccctgggactggcagggcaggggcaggggcagggacagtggccaggcggcccgaggacttacggtcggcacttctctgttctcccgtgtcagcgtgtggtgtcgcctgcatgggtcgtacctggatggtgtgtccaccatcgacacggaggggctggatttgtttctcaggcaatcctgtattttaattttagatgtatttcctgaagcatatttttcatagaatgtagcgtgtaaatagctttttaaataacttcttttttataagagtaaaagtatctttaggaatttctttctatagagttcttcattaacatttatacgagttttttgctgagtcagatggacagttgggttctgatgctttttccttctcctttccttttattattattatttttttcttttaagaactaaggtattgcctgaaaaacaagtgatgtctgtgcagccttacactctgtctttacagaagcaaatagtacacaaaagatctatttcagacacattttgaagatgaatcttcaactttaataccagctctttgttttccttgtatgatgaggggattgggggatacagttattttactagcaccttgtgaagtgtttccgtgttttgtgatgctgtaatttattaatgtttgtagctttttatatttgtacatttcttatgagctttgtttatatacccattacctggatgtttttgtccactgggagaggcagcttggtggaggccttatccactcccacttgtcctgtttggagggacgcagtccctagggcccgagactgggtgggagagggggagtctcacggggccccaggcttattcagaactggtgtttttaaagtttcctttaccctgcccttgttgaacatttatataatctaacctggacatcaagctgttctctctctctcttttttttaattttattattattattttggcaacatgtacatttctaacaaagtttatcgtggctattaaagtgttttatttcccaattcatattactcttgtatcgagtccatgaggtctaaggcaacttagatcaaagttttaaaaaagtaaaaatatttcaggttttgtaca

SEQ ID NO: 62321 - DNA, 2070 bp, Homo sapiens
gcggctccggctccggctccggctcccgggcatttaaaggggacgcggcggctgcccgggggggatgaggggcaagtggaggggacggctcagacgcacatcatcctcagtccctcgggactggagggactcgtgagccggagcccagaaatccgggggtggataagacaccgcgtcccctccaattcccgtaagcaccccttgctccatcctgcgccccaatacctcagctagcccccttccccacttcttacactccaaactcagccgggacagcaagtggaggggacggctcagacgacctctgctgccgccgcccccacgaacgtgtgacgacggctggaggccaacagagtccctacaggtggtgctcacggtaatgcaccgacaatgagtggctgttttccagtttctggcctccgctgcctatctagggacggcaggatggccgcgcagggcgcgccgcgcttcctcctgaccttcgacttcgacgagactatcgtggacgaaaacagcgacgattcgatcgtgcgcgccgcgccgggccagcggctcccggagagcctgcgagccacctaccgcgagggcttctacaacgagtacatgcagcgcgtcttcaagtacctgggcgagcagggcgtgcggccgcgggacctgagcgccatctacgaagccatccctttgtcgccaggcatgagcgacctgctgcagtttgtggcaaaacagggcgcctgcttcgaggtgattctcatctccgatgccaacacctttggcgtggagagctcgctgcgcgccgccggccaccacagcctgttccgccgcatcctcagcaacccgtcggggccggatgcgcggggactgctggctctgcggccgttccacacacacagctgcgcgcgctgccccgccaacatgtgcaagcacaaggtgctcagcgactacctgcgcgagcgggcccacgacggcgtgcacttcgagcgcctcttctacgtgggcgacggcgccaacgacttctgccccatggggctgctggcgggcggcgacgtggccttcccgcgccgcggctaccccatgcaccgcctcattcaggaggcccagaaggccgagcccagctcgttccgcgccagcgtggtgccctgggaaacggctgcagatgtgcgcctccacctgcaacaggtgctgaagtcgtgctgagtctggccgcctgcaggggggtacccgggccaacggcggagggggcggggaagggagattcggcaaagacagctttactactcccttttccctttggctttgttatgtccctctgggaatttctggaatctcgtatttgggggcttggggaagggggctcagagccgtccctatctattcagttaacccacctcggctgcctcccccactccactgtgcacggttgagttctggagtctgacccatcgcggggtggcgcgcaaaccttggaaggcagcagtatttcctggtcctcccaactgggaggaaggggcccccccggcaggtgagagaaggaacatctcccgccgctgtaacttgttgcctcgggctgcgtgaccgcccctcctccagtctactgtggagggaacccaggatcctgaaattctcctggccgcaagaactccccacagaggcagaagagggtctccacctatggccccaggcctttgcgatcttgcttcacccaccgcgaccccacactatttctgtgctgtccacactctcttgcctcccgacccccgcactcccttctagcacccccaaaggaaaagccagaggaacaatcgcctcctggtggtggtacgaggtagcgcaccgtccggctcgggtccggacagccagtaacctcgcagagagtgacggtgtctccttgcatcccagcctcgtctatgcagcaagagaccagggacttcaccaaagtcaccctcgcgggctgggccttccacgcatcccccccaccccccatggaacagaaagccatgtttttaagcagaaccagcgaaacccaagcccctccttcctctggtgttttacaactataaaggaggtgaaggg

SEQ ID NO: 62322 - DNA, 7660 bp, Homo sapiens
atgaggcctgggcccgctctcctccttctgggcgtgggcctgagcctgagcgtcggccgcctcccgctgccgccggttcctcgcggggcacaagccgccgtctccggggcgcccggtggcctcctcaggggcgccccgggcctcggggtgcgcggcggccgcgccctcctcagtctgcggcccagcgcggtgcgggcgggcggcgctgtcctgagcggccgcggcagcctctgcttcccccatggcgggaccgggcggcgctggtactgcctcgacttgcgcgtcctgctcagcgcccaacgcctgccctggccggccgcgcccgcgctcgcgctcgtcgacctgcagctctccgcgcgcggcggccgcctctccctgacgtggtccgtgcggctgccgcgctcgcccgggcgcctggcctgggccttccgcctgcggctgctcggacccggcgccgcccgcccggcctcccccgcggcccgcgtctccccgcgctccgccgcgccaggcccgcggccccagcagggcttcgtggcccgcaccgagtgccccacagacggccccgcgcgcgtgatgttgcaggccgtcaactcgtccagccacagagccgtcgagtcgtccgtgtcctgtcagataaacgcctgcgtcatccagcgcgtgaggatcaacacggaccagaagggcgcccccgtgcgcctgagcatgcaggcggaggccaccatcaacgcctcggtgcagctggactgcccggccgcgcgcgccatcgcccagtactggcaggtgttctccgtgcccgccgtgggtcaggcgcccgactggacgcagcccttggatctgccccagctcgagatcaggaacagccccttgttcattcacatccccaataattcgttacagtggggagtgtatgtgtttaatttcacggtgtccatcaccacagggaaccccaagatgcccgaggtgaaagactcggacgccgtctatgtctggatcgtcaggagttccctgcaggcggtgatgcttggcgatgccaacataacagctaatttcacagagcagctgattctggacgggtccacgtcctcggacccagatgcggacagcccgttacagggactccagttcttttggtactgtaccacagatcccagaaactacggtggggatcgaataatcctggggagcaaggaagtctgtcaccccgagcaggccaatctgaaatggccctgggcctcgggccctgtactgacacttttgccagaaacacttaaaggcgaccacgtgtatttcttcagaatggtgattcggaaggactctaggacagcgttttctgataagagggtccacgtgctccaaggaccaaaagccatagcacacatcacatgtatcgaaaattgtgagagaaacttcattgtctctgatagattttctttgttcctaaattgcacaaattgtgcaagccgtgatttctataaatggtcaattttgtcttcttcaggtggtgagatgctatttgattggatgggggaaactgtaacaggaaggaatggtgcttatctgtctataaaagcttttgcttttcggcattttttggaagctgagttttcgatttctctgtatctagcatgttggagtggagtgacctcggtcttcaggcattcttttattattaaccatggccctcagatcggagaatgcaaaattaatccagctaaaggaattgcacttattactaaatttgttgtccagtgtagtaattttagggataagcacgtccctcttacatataaaataattgtttctgatttgcacagtgttggtgaaatcagttcagtaaaagagaacaccctggggaccatcctgtacttggggcctcagtccacagtacccccttcctttctccctgttggtatgttggctagtcaatatggcttgaagatatatgcccaggtctatgattctctaggagctttttctcaggtgactttgcatgccaccgcacaggctcccactgacaaaaattcatcaaagacagtgttgaatcagttactcagtttcaccgtgggaccaagttcattgctgtctactttgattcaaaagaaggattttttacctgcaggttacttactgtatatagtagcttccgttttgaataacatgaaaactgaattacctctccgagatgacagagtcaatctccgaaaacacctcatcgatcagtctttccttcttcctgtaagcactttggtagaaattggccaggtagtcatgactattaccaaattaacccagaaaccctctgaattcacttgggatgctcagaaacgtgccaccatgagggtatggcaagcaaatcaagccctacaagagtatcagcaaaaagataaacgctttcgatctgaacaaatagaaatcgtgagtactggaatactaatgagtttgtctaatattcttaaaatgacttctcctcaccaagtagttaaagatcctttctatgtaatagaatctctatcagacacaatactggctaataaagtgccagggaacaaaaccacctcaatgagaacccccaatttcaacatgtatgtcaagaaagttgaaaagtggggtatcaaccagctcttcagaaatgagaaacactgcagaaattgtttttatccaacactcaatgtgagcagtgttcctggtctgtctgcaaatggtcccatttctacaatgttttgtgatttcacaaatgacctctttccttggttaaatgatcaggaaaacacttcggtggaggtgtctggattcagaatgacaggagttgcagataacggtagtgtgctagagatcacacctgatgtagcggaagtgtaccttgtcaggaaaaacttgacctttgcagcttttaatctcacagtgggacccaacagcgaggttgatgggtccttgaagaagacgacaggtgggtttagctttcaagtggacagcacagtgcttagggaggttctggtccacatagtaacagaagtgatggtgctgttcacagtgttggtgtacacaggcagtcagatcactcccacagcgctggtcgccaccttcctggtgcctcatgacatccctccatttgccagccagagtgccctgtttgacccagcctgcacagtgaagaaggcccgtgtagtctgcctccctgtgtccctgctgcaactcatagctcagcacagccactctccccactgtactgtatccatagttctgcaggcacctcgttttgtcatgaagctcaatgacaagctagtgagaatttctattttcagcgtccagtgcttggacatgtatgggatccagagtgaatggagagagggttattgcattcttggtgagaagaccagctggtatgaggtgcactgcatctgcaagaatgtagtaagggctaggcggcagctgggcacaatcggactcacgggcattcacctgcatacccactatgtgatggccaaggtgattgtgatccctaatcctgtggatctacggttaaacatcatcaagagccttcaccaaaaccccgtgaccctcttcactgtgcttttcattattctcttatacgtgggcctagctttttgggctttatacagggatgaaatggaccagcatcttcgggggcatgtgatagttctaccagataatgatccttatgataatttatgctacttggtgactatttttacaggaagtcgttgggggtctgggaccagggccaatgtctttgtgcaacttagaggaactgtgagtaccagcgacgtgcattgtttaagccatccacatttcacaactctctaccgaggtagcatcaacactttcctcctaacgacaaaaagtgacttgggggacatccattccatccgtgtgtggcacaacaacgagggtcgatcgcctagctggtatttaagtagaatcaaagtggaaaatctgtttagcaggcacatttggctgttcatatgccagaaatggctttctgttgataccactttggacagaacatttcacgttacccatccagatgagcgtctgactagaaaagactttttctttatagatgtgagtagtaatctccggaaaaaccacatgtggttctctatttttgctagtgttgttgctaaaacattcaataggctccagagattgtcctgttgtttagcaatgttgcttagctctcttctttgtaacattatgttctttaatctaaatagacaagaacaaactgagtcaagagagaggaaatacatgagatcaatgatgataggaattgaaagtgtcttaattacaatccctgtgcaattattaataacttttttgttcacctgttcccagaggaaacctcaagcggatctaaaggaggtatctcctcaaaagcatcctctaatgtcagaagcaagtgagcactgggaagaatacttgagaaagtggcatgcttacgaaactgctaaggtgcaccccagggaggttgcaaaacctgcatctaaaggaaagcccaggcttccaaaggcttctcctaaggcaacctccaaacccaagcacaggcataggaaagcacaaatcaagaccccggagaccctcgggccaaatacaaattccaataacaacatagaagatgatcaggatgtccattccgaacagcacccttcccaaaaggatctccagcagcttaagaaaaagccccggatcgtcctaccttggtggtgtgtttatgttgcatggtttttggtttttgctacttctagcatatcctcattcttcattgtattttatggactgacttacggctatgacaagtcaatagaatggctctttgcatctttttgttcattctgtcagtcagttcttctggtgcagccatctaaaattatactcctgtcaggcttcagaacgaataaacccaagtattgcaaaaacctttcatggtcaaccaagtataaatatactgagatcaggttggatggaatgcgtatgcatccagaagaaatgcagaggatacatgaccagatcgtccgaatccgaggcacgaggatgtaccaaccccttacagaagatgaaatcagaatattcaaaagaaagaagaggatcaagagaagagcactcctgtttctgagttacattctaactcactttatctttctagcccttctgttgatccttatcgtcttactacgtcacactgactgcttttactataaccagtttattcgtgatcggttctctatggatcttgctactgtgactaagctggaagacatctatagatggctaaacagcgtgctgttgcctttgttacacaatgacctgaatccaacatttcttcctgaaagctcgtctaaaatccttggccttccattgatgaggcaagtgagagcaaaatctagtgaaaaaatgtgtctacctgccgaaaagtttgtgcaaaacagcatcagaagagaaattcattgtcaccccaaatatggcattgacccagaagacacaaaaaactattctggcttttggaatgaagttgataagcaggctatagatgagagtaccaatggatttacttataagcctcaaggaacgcaatggctatattattcctatggactactacacacctatggatctggaggatatgcactctatttttttccagaacagcagcggtttaattccacactgaggctcaaagaacttcaagaaagcaattggctggatgagaagacatgggctgtggttttggaattaacaacttttaatccagatataaatctgttctgtagcatttcggtcatatttgaagtctctcagttaggagttgtcaacacaagcatatctctgcactctttttcacttgctgattttgacagaaaagcttcagcagaaatctacttgtatgtggccattctcatttttttcttagcctacgttgttgatgagggttgtatcattatgcaagaaagagcctcctatgtgagaagtgtgtataatttgctcaactttgctttaaagtgcatatttactgtgttgattgtgctctttctcaggaaacatttcctggccactggcataattcggttttacttgtcgaacccagaagacttcattccctttcatgcagtttctcaggtagatcacattatgaggataattttgggtttcctgttatttctgacaattttgaagaccctcaggtattccagattcttctacgatgtgcgcctggctcagagggccatccaggctgccctccctggcatctgccacatggcatttgttgtgtccgtgtatttcttcgtatacatggcttttggttacctggtgtttggtcagcatgaatggaactacagtaacttgattcattccactcagacagtattttcctattgtgtctcagctttccagaacactgaattttccaataacaggattctgggggtcctgttcctctcatctttcatgctggtgatgatctgcgtcttgatcaacttatttcaggctgtaattctgtctgcatatgaggaaatgaagcagcccgtgtatgaggagccatcggatgaagtggaagcaatgacctatttgtgccgtaagctgagaaccatgttcagctttctgacctcgcaatctaaggccaaagatgagcctgagttctttattgacatgctgtatgggcagccagagaagaacagccaccgttatctggggctgaagaccagaaacatcaacgggaagaaaatggtttaccttgttgtttgatgaatgatggtttcatgagtcacaagcaagcgttcccccaactgctgagtctgtgggattaaggggattagggagtgtcagtggcctagtcatgctttctactcatgtccttcacaaggcacatcccctacatttggaagaatccccaatcttgtcctctgctcttgggagtgtaaaagttgggagtgtagtgtagcatctggggagacagcaggatcacagtgtgggattcctggactgatttccctttagaggggagttatgtgactccccgtacaagggcaaccctgtttctttggtgcctgcagtttagagaaggcagagccactggttttgagaaccagatttgagagagggacctggccagggtggagcattgtctgggtgtttctgcgcttgacccatgctggaagctaatggcctgttgctcctgacagagccccaaactcctcggcctcactgggaggcccctttgtagaccagggctcccctcctcttgttccccctgggcttagggcctcgtggggagttccaggacttgcttcatgcttgagaatgcagatgtggtgcttctcatttattcttaaagctactggtagttaaagtaaaattcagtaacattttctgaccaagagacatgttttgttaaacaacaaaaaggtacatatgggttcacattgaaatatgtctatatgctgaatatagcaacatatgcatctaagatttgggcatttggttattaatagcgtgctggactattcaggaataaggaaaatgtggtttatcacttaagagaaacaagggctggtagctgtactattttcactcagaagcatgttcatttatgtagatgccactttaagctttatcagaattaaatgtgagatttcttctttga

SEQ ID NO: 62323 - DNA, 6065 bp, Homo sapiens
ttgaaagatgcatgagtgtgatgcagtccgggacacagatgatcaagctgaaacgtggaaccaaagggcttgtccgcctcttttacctggatgagcaccggacacgcctccgatggcgaccctctaggaagagtgagaaggcaaaaatacttattgattccatttacaaagtgactgagggccggcagtctgaaatattccacagacaagctgaggggaacttcgaccccagctgctgcttcaccatctaccatggcaaccacatggagtccctggacctcatcacctccaaccccgaggaggcccgcacctggatcacaggcctcaagtacctgatggctggcatcagtgatgaagactcccttgccaaaaggcagaggacccatgaccaatgggtgaagcagacctttgaggaagctgataagaatggtgacggcttgctgaatattgaagagatacatcagctgatgcataaactgaatgttaatctgccccgaagaaaagtcagacaaatgtttcaggaagccgacacagatgagaatcagggaactttgacatttgaagagttctgtgttttttacaaaatgatgtctttgagacgagacctttatttgttacttttgagctacagtgacaagaaagatcacctaactgtggaagaactggctcagtttttgaaggtggagcaaaagatgaataatgtgacaacggactattgtcttgacatcataaagaagtttgaagtttcagaagaaaataaggtgaaaaatgttcttggcatagaaggcttcacgaacttcatgcgtagtcctgcctgtgacatatttaacccattgcaccatgaagtgtaccaagacatggatcagcccctctgcaactactacattgcttcctctcacaatacatacctgactggagaccagctcctttctcagtccaaagtggatatgtatgcacgggtgctgcaagagggctgtcgctgtgtggaagttgactgttgggatggcccagatggagagccagtagtacatcatggttacactctcacttcaaaaattctcttcagagatgttgtggagaccatcaacaagcatgcctttgtgaagaatgagtttcctgttatattgtctatcgagaatcactgcagtatccagcagcaaaggaagattgctcagtacctgaaaggaatattcggagacaaactggacctgtcatctgttgatacaggggagtgcaagcagcttccaagccctcaaagtttgaaaggcaaaattctagtgaagggtaagaagttgccttatcaccttggggatgatgcagaggaaggggaagtttccgatgaggacagtgcagatgaaattgaagacgagtgcaaattcaagctccattatagtaatgggaccactgagcatcaggtggaatctttcataaggaaaaaactggagtcactgttaaaagaatctcaaattcgagataaagaagatcctgatagtttcacagtgcgggcactactgaaggccacgcatgaaggcttaaatgcacacctgaagcagagtccagatgtaaaggaaagtggaaagaaatcacatggacgatccctcatgaccaactttggaaaacataagaaaactacaaaatcacggtctaaatcttacagtactgatgatgaggaagacacacagcagagtactggcaaggagggtggccagctgtacagattgggtcgccgaaggaaaaccatgaagctctgccgagaactctctgatttggttgtgtacacaaactccgtggccgctcaggacattgtggatgacggaaccacaggaaatgtgttatcattcagtgaaacaagagcacatcaggttgttcagcaaaaatcagagcagttcatgatttataatcaaaagcaactcacgaggatttacccctctgcctaccgcattgattccagtaacttcaaccctctcccctactggaacgcaggctgccagctagtggcactgaattatcaatctgaaggacgaatgatgcagttaaaccgagccaaattcaaggcaaatggcaattgtggctatgtcctcaaaccccagcaaatgtgcaaaggtactttcaaccctttctctggtgaccctcttcctgccaaccccaaaaagcagctcatcctgaaagttatcagtggacagcaactccccaaacctccagactccatgtttggagatcgaggcgagatcattgacccttttgttgaagttgaaattattggattgccagtagattgttgtaaagatcaaacccgtgtggtagatgacaatggatttaaccctgtgtgggaagaaacactgacatttacagtacacatgccagaaatagctttggttcggttccttgtgtgggatcacgatcccattggacgagactttgttggacaaagaactgtgaccttcagcagcttagtgcctggctaccggcatgtctatttggaaggactgacagaagcatccatatttgtacacataaccatcaatgaaatctatggaaagaacagacaactccagggtctgaagggactgttcaataagaatcctaggcacagttcttcagaaaacaattcccattatgtacggaagcgatccattggagatagaattctgcgacgcacagctagcgccccagccaaaggcaggaaaaagagcaaaatgggcttccaagaaatggtggagataaaggattctgtgtccgaggccacaagagatcaagatggcgtgctgaggaggaccacacgcagtttgcaagcacgccctgtctctatgcctgttgacagaaaccttctgggagctttgtcgctgcctgtatctgaaacagcaaaagacattgaaggaaaagaaaactctctagcagaagataaagatggcagaagaaaagggaaagcaagtataaaagatccacattttctaaatttcaacaaaaagttatcatcctcctccagtgctctgctccacaaagataccagccaaggggacaccattgtatctactgcccacatgtcagtcacaggagaacagctgggcatgtcaagtcctaggggtgggagaaccacatcaaatgccacaagcaattgccaggaaaacccctgtcccagcaagtctctctccccaaagcagcatttggctcccgatcctgtagttaaccccacacaagatctgcatggtgtgaaaatcaaggaaaagggtaatcctgaggactttgtggaagggaaaagcatcttgtcaggaagcgtcctttctcatagcaacctagaaattaagaacctggaaggtaataggggtaagggccgagctgcaacatccttttctttgtcagacgtctccatgctctgttctgacatacctgacctacattcaactgcaattctgcaggagagtgtaatttcccatcttattgacaatgtcactttaacaaatgagaatgagccgggcagttccatctcagccctgattggccagtttgatgagaccaacaatcaggctctcacagttgtttctcatcttcataataccagtgtgatgtcaggccattgtcccttgcctagcctgggcctaaaaatgcccatcaagcatggtttttgcaagggaaaatccaagtcttccttcctgtgctcatctccggagctgatagcactctcgagttctgagaccaccaaacatgcaacgaacacagtttatgaaactacctgcactcccatctctaaaaccaaaccagatgatgacctttctagtaaggccaagacagcggccttagaaagcaacctgcctggatcccctaatacttctcgtggctggttaccaaaaagtcctaccaagggagaagactgggaaacactgaagagctgcagccctgcctcttcccctgatttgaccctggaggatgtaatagctgatcccactctctgtttcaattctggggagagcagccttgtggaaattgatggagaatcagaaaatctttctctaacaacctgtgaatataggagagagggcacaagtcaacttgcttctcctttaaaactcaagtacaatcagggtgtggtagaacactttcaaagaggtttgagaaacggctactgtaaagagaccctccgcccttctgtccctgaaatattcaacaatattcaagatgtcaaaactcaaagtatttcttatctagcctatcagggtgctggctttgtgcataatcatttctcagattcagatgcaaaaatgttccagacctgtgtgccccagcaatctagtgctcaagatatgcatgtccctgtacccaagcagttggcacatcttcctttgcctgctctgaaactgcctagtccttgcaaatccaaaagtctgggggacttaacatcagaggacattgcctgcaattttgagagcaagtaccagtgtattagtaagagttttgttacaactggcattagagacaagaagggcgtgactgtgaagacaaagtcgttagagcctatagatgccctgaccgagcagcttcggaagcttgtgtcctttgaccaggaagacaactgccaagtgctatattcaaagcaggatgccaatcagctcccccgggcactggtcaggaagttgtcatccagaagtcagagcagagtgcgcaatattgctagtcgtgccaaggagaaacaggaagccaacaagcagaaagttccaaaccccagcaatggggcaggagtggttcttagaaacaaaccctcagcacccacccctgcagtgaatcgccactccaccggctcctacatcgcaggctacctgaagaacacgaaagggggtggccttgaaggccggggcatcccagagggggcatgcacggctcttcactatggccacgttgaccagttttgttcagataattctgttttgcagactgagccaagcagtgatgataaaccagaaatttattttcttttgagactgtgaattatttaaaactgcattcttaaggttttcaaggtattctgtagaatgtcagagttttcagtaaataagttccttggctttggaatgattttcaaatgtatttttaaacttgtatttgggtctccctttgacttcatgtgttctccctgttaatgcgtttgtatatagatttggtgacatttcccatgtacctattatgatctttctcccttgagttgttgtaaactgtatcagtatgaaatatgtgcatgccctagatgtgaaactcctcagcagctcgggttataatgtgtgtgtgtttcaccaagatgtcctttactgtgtcctcagattgcagtcacaaatgtagtcatttttactctctaactgttgagttgattaagagactttgcaaacgacaaagggatgaattccttactttaatctgttatcatttttcctatgtttccctctttgttcagaagcccagatgcatttttataactcagttttaaaaactttaaaatagttaccttgccttttaggatgttcttatcccacccataatgagagttgaaaggggatggatagctgctccccatgcccttcccactttttggaataggccgtgagggtgtgaggaagaaggctgtcttttgtacataaggacaaaattgtttgttttacataaattttgttacatatttttgctaatggctttgtatgtaacaagaagcgagttgccaaactacctgttgtacttttgaattttctgattgaattacagactgcgaacaacggctttcagaatgagggacttccatcagactctaatgataatagtagcacaaattgaaaacttccccaaagctttcacagaatattttctcataataaaatccaagtgaacagataattagaagaaacccttttccttcagggaaccaagcaactctattttagtactgacatgcattattttcactgtgaattcacttttttattgcatgttcagatgtccctctttgttttttttttttgtaacattaactgcaatgatgttcttcctggaattcatgaaaatataattaaaacacatttttaaac

SEQ ID NO: 62324 - DNA, 1265 bp, Homo sapiens
ggccgaatggagaatgaagccttttcaaattcacctcccagtgaaccaccctcaaaatagaagtgaatgtgaaaccacagatatttcattaaaacatatctgaagataaaaacatacctcaagcttcacagatataggacttctgagctgagaggacctcccggacatattgtctaccctaagcaccaggctggacacactgggaaacaggctgaccacctgggctcccaggccttctacccaggacgtcagcatgactacctagtcccacctgctggcacagctggcattcctgttcaaaatcagccaggtagacctgaaggggtaccatggatgccagcaccaccaccaccattaaactgtccgccaggattggaatacttaagtcagatagatatgatactaattcatcagcaaattgaacttctggaagttctattcagttttgaaagtagtaacatgtatgaaatcaagaacagctttgggcagaggatttattttgcagcagaagatactaatttctgtatccgaaattgctgtgggcggtctagaccttttaccttgaggattactgataatgtgggtcgagaagtcataactctggaaagaccactaagatgtaactgttgttgttgcccctgctgccttcaggagatagaaatccaagctcctcctggtgtaccagtaggttatgttactcagacctggcacccatgtctaacaaagtttacaattaaaaatcagaaaagagaggatgtactaaaaattagtggtccatgtatcgtgtgcagctgtattgcgggtgttgattttgagattacatctcttgatgaacaaattgtggttggcaggatttctaagcactggtctgggtttttaagagaggcatttactgatgctgacaactttggaatccaattccctagagaccttgatgttaaaatgaaagccgtgatgattggtgcctgtttcctcattgactacatgttttttgaaagaactaggtaatgactggaatgtcagagtgtgggagtggattaatgattccggatctttggctaggcaaaatgaaactataactgatctaaacggttccttccttcttctactgtgcaaggaagatgtaaggaaaaactcgcacactatctgtggaactcatttaaattcaaatcctagataaacatttcgcattgaatatttacatggagaaaaatcatcaaacatcaacaattatcaagttaattaataaaaatactaggtattgc

SEQ ID NO: 62325 - DNA, 3405 bp, Homo sapiens
gggataggggatgtggtttgttacaaaggatgagtattttgatagcttctcattccttgaactattctgcaggtttataacaaagctcagaaaatactaaaggttaaaggagaattgagagctgccaaggaaatgaaagatgaggcgggggagagagacagagaagtgagcagcctgaacagcaagctgttaagcctgcaacttgacatcaagaatctgcacgatgtctgcaagagacagaggaagaccttgcaggacaatcagctctgcatggaggaggcaatgaacagcagccacgacaagaagcaagcacaggcattagcattcgaggagtcagaggtggaatttgggtccagtaaacagtgtcatctgagacaactccagcaactgaagaaaaaattgctggtccttcaacaagaactggagtttcacacagaggagttgcagacttcttactattctctccgccagtatcagtccatcctagagaagcagacttccgacctggttcttctgcaccatcactgcaaactgaaagaagatgaggtgattctctatgaggaggaaatgggaaatcacaacgagaacacaggggagaagctccatttggcgcaggagcaactcgccttggccggggacaagatcgcctctctagagaggagcttaaacctctacagggataaataccagtcttccctgagcaacatcgagttactagaatgccaagtgaagatgttgcagggggaactcggcgggatcatgggtcaggagcctgagaacaagggtgatcattcaaaggtacggatatacacttctccttgcatgattcaagagcatcaggagactcagaaacgactgtctgaagtctggcaaaaggtctctcaacaggatgatctcattcaagaacttcgaaataagctggcctgcagtaacgctttggttctggagcgtgaaaaggctttgataaaactacaagccgattttgcttcctgtacagccacccacagataccctcctagctcctcagaagagtgtgaagacatcaaaaagatactgaagcacttgcaggagcagaaagacagccagtgcctgcatgtggaggagtaccagaacctggtgaaggatctgcgcgtggaactagaggccgtgtcggaacagaagagaaacatcatgaaggacatgatgaagctggagctggacctgcacggactgcgggaggagacatctgcccacattgagaggaaggataaggacatcaccatcctgcagtgccggctgcaggagctgcagctggagttcaccgagacccaaaagctcactttgaagaaagacaagttcctccaagagaaagatgagatgctgcaagagctggagaagaaactgacacaggttcagaacagcctcctgaaaaaggagaaggagctggagaagcagcagtgcatggccacagaacttgaaatgacagtcaaggaggctaagcaggacaagtccaaggaggcggagtgcaaggccctgcaggctgaggtccagaagctgaagaacagtctcgaagaggccaagcagcaggagaggctggctgctcagcaagcagcccagtgcaaagaagaggctgcactggcaggctgtcacctggaggacacccagaggaaactgcagaagggtctcctcctggacaagcagaaggcagacaccatccaggaactacagagagaacttcagatgctgcagaaggagtcctcgatggctgagaaggaacaaacctccaacagaaaacgggtggaggagctgtcattagaactctctgaagccctgaggaagcttgaaaattcagacaaggaaaagaggcagcttcagaagacagtggctgagcaggatatgaaaatgaatgacatgcttgatcgtatcaagcaccagcacagggagcaaggctccatcaaatgcaagttagaagaagatcttcaggaggccacaaagcttctggaggacaaacgggagcagttgaagaagagcaaagagcatgagaagctgatggagggagaacttgaagctttgcggcaggaatttaaaaagaaagacaagacgttgaaagagaattccagaaagttggaggaagaaaatgagaatctccgagcagagctacagtgttgttctacacaactggaatcctctctcaacaaatacaacaccagccagcaagtcatccaagacttgaataaagagatagcccttcagaaggagtccttaatgagcctgcaggcccagctggacaaagctctgcagaaggagaagcactatctccagactaccatcaccaaagaagcctatgatgcattatcccggaagtcagccgcctgccaggatgacctgacacaagccctcgagaagctcaatcacgtgacctcagagacaaagagcctgcagcaaagcttgacacagacccaagagaagaaagctcagctggaagaggaaatcattgcttatgaggaaaggatgaaaaagctcaatacggaattaagaaaactgcggggcttccaccaggagagtgagctggaggtgcacgcctttgacaagaagctagaggagatgagctgccaggtgctgcagtggcagaagcaacaccagaatgacctcaagatgctggcagccaaagaggagcagctcagggagttccaggaggagatggccgccttaaaagagaacctccttgaggacgataaggagccctgctgcctgccccagtggtctgtgcccaaagacacctgtaggctctaccgagggaatgatcagattatgaccaacttggagcaatgggcaaaacagcagaaggtcgccaatgagaaactaggaaaccagctccgagagcaggtgaactacattgccaagctgagtggcgaaaaggaccacctccacagtgtaatggtccacttgcagcaggaaaacaagaagctgaagaaggagatagaagagaagaagatgaaagccgagaacacaaggctatgcaccaaagccctaggcccgagcagaacggagtccacacagagggagaaagtgtgcggcaccttgggctggaaggggttgccccaggatatgggtcaaagaatggacctcaccaagtacatcgggatgccccactgcccgggttcctcatactgctagaatccacatctagccctgagcagcatttccacgggtgtttcttcagaggacagtgagttcccagccctccctctctcttgacctggatcagctcttacaggagtatatcacggtcccagcctattttgcaagacactaacttttgttgagttttgtccacttcctgccatggagtgagctttagaaccatactaccatctccaggcccaaactctgaaataaagacatgagcatgagcaaaaaaaaaaa

SEQ ID NO: 62326 - DNA, 1098 bp, Homo sapiens
acagcaggctggccctgatagataacggaagtgaggaagggtgagagttatctatcttctctgttttatagactacttcagcttctgctgttaccaatgcctcagcaaccactgaaagttcagatatcacccttcttgtaactaatcaaatcaaggaagagatctacaaaatagtggtggtggttccagctagaaattttcactcacaatggtgcatgtttcaaatagaagtatccagggtatgaacatacttttctcctcctgggccgtagtcttaatggtgatgggaatcaccttagataaatgggttgaattgatttcagaagatgaaagagccaagatgaaccacagtccttggatgatgtgttgccctgctctttggccagaagatgacctgaaagtggtcaggattatgatgacgtcgagccttggcctttccttcctccttaacttaatcctgggtatgaaattcacctatctgattcctcaaaataaatatatacaactcttcactaccatcctcagtttcttctcaggtatctctctgctctgggcactcatactatatcacaataagctgaagcaaggtcaatccatgcacttctctaattataggatcacctggatcatgtatactgcttacttaaatgttttcttcttgtctgtctgtggagtcctctctctcctagagtgcaagttgtctaccagtagctgtacctgcctgaacatccataaatctgacaacgaatgtaaggaatctgagaattctatcgaagatatttcattaccagaatgcactgcaatgcctcgtagcattgtccgtgcacacactgtgaattccctaaacaaaaaagtccaaacacgtcacgtaacctgggctctgtgatttggcaatctatttcttgcagtatatgctcatctttatggaaaaagctttgtgggtgtgtgctgtgtctccaaccatgttgtctctatttggaattatggttggggtttgtaaaaagatctggaagatggttttttaaaaaatcctggcctgctgaacgaatagtttcttctgcaacatttgttgttaatataataaatattatcatataa

SEQ ID NO: 62327 - DNA, 1108 bp, Homo sapiens
tggtagtgtttggggtcaccgggcgtccccgggcgcggccatggcaaggccgcagccgtgcgggcccccgcacgctaggtgcggctcgccgtcgctgccggagcggccgctgcaggtgaaggtggtggggctcttcagctgccccaactttcagattgcgaagagcgccgctgagaatctgaagaataatcatccatccaaatttgaagatcctatattagttcctcttcaagaatttgcatggcatcaatatctacaggagaaaaaaagggaactcaaaaatgaaacctgggaatattcttcctctgtgatttcttttgttaatggtcagtttctgggtgatgcattggatctgcagaaatgggcccacgaggtgtgggatatagttgacattaaaccctctgcactttatgacgcactcactgaggatttttccgctaagttcttaagagacaccaagcatgatttcgtgtttttggacatttgtattgattcttctccaattggaagattgatttttgagctatactgtgatgtgtgtcccaaaacatgtaaaaattttcaggtcttgtgcacaggaaaagcagggttttctcaacgtggcataagactacattacaaaaattccatttttcatcgaatagtacagaatggctggatacaaggaggggatatagtgtatggaaaaggagataatggagagtcgatttatggtccaacatttgaagatgaaaacttttcagttcctcataataaaagaggagtacttggaatggccaacaaaggccgtcacagcaacgggtcacaattctatatcacactgcaagcaactccttatctagatagaaaatttgtggcttttgggcaactgattgaaggaacagaagtgcttaaacaactagaattagttccaacacagaatgaaagaccaatacatatgtgtagaattactgacagtggagatccttatgcttgattttcatatcaatattttctgtgataatttattactttgtatctgatcagctgtttgtggatttaattaaaaagtacttgataaattgtaatttgaaaaaaaaaaaaaaaaaaaagaaaaaaaaaaaaaaaa

SEQ ID NO: 62328 - DNA, 1067 bp, Homo sapiens
gtgaagaggcacacaattagcgtattgttcctttctgtattgtgctgagaggatccaagggattggtgggggaacaggcaagccaggcatcaccgtggatgttgaagaagggggttactcaaacctcggcatcttcacttgctcgatctggaattacagctatttattacgaagcactctgtgtggcttagtggagtgtgtctgaggaaacacatcccggacaccacttagggttagtctttctgagctcttcacatctctgactaattatcatcattaccatggagcccaacagtcccaaaaagatacagtttgccgtgcctgtattccagagtcagattgcacctgaagcagcagagcagatcaggaaaagaagacctacaccagcatcacttgtgattctcaatgagcataaccccccagaaatagatgacaagagggggcccaacacacaaggggaattacagaatgcatcccctaagcaaaggaagcagagtgtgtacacaccacccaccataaaaggggttaagcatctgaaaggccagaatgaatcagcattccctgaagaagaagaaggcaccaatgaaagagaggagcagcgggaccattaattactggtctgcagcaagaaggcttcttggaaataactgaactattaacttttctgagtataccatggaattccactgcttgacttccagaagcatcctccatctctgcaccccacactcatacagtagctatgcacatcctggaagtctccttgactgaactttagaactaagtacacattgttccacatcacttataattaaagaataagcatttattttacagtgattcttctttttaactatgtaaaaatttgcatacatgtgactgttctaactttaatactgccagagcttaatccttgatgtcctactgataaggtttgcattctaacaacacatgtaaataacatcactttaagagtaaaaaataaatagtaaacacatttagacatgagtgtgtgtgtgtgtgtgtgtgggtttagcttaaagagaaatatctaataaagcttttag

SEQ ID NO: 62329 - DNA, 1088 bp, Homo sapiens
gtgaagaggcacacaattagcgtattgttcctttctgtattgtgctgagaggatccaagggattggtgggggaacaggcaagccaggcatcaccgtggatgttgaagaagggggttactcaaacctcggcatcttcacttgctcgatctggaattacagctatttattacgaagcactctgtgtggcttagtggagtgtgtctgaggaaacacatcccggacaccacttagggttagtctttctgagctcttcacatctctgactaattatcatcattaccatggagcccaacagtcccaaaaagatacagtttgccgtgcctgtattccagagtcagattgcacctgaagcagcagagcagctgggcttttgtcgttcacagatcaggaaaagaagacctacaccagcatcacttgtgattctcaatgagcataaccccccagaaatagatgacaagagggggcccaacacacaaggggaattacagaatgcatcccctaagcaaaggaagcagagtgtgtacacaccacccaccataaaaggggttaagcatctgaaaggccagaatgaatcagcattccctgaagaagaagaaggcaccaatgaaagagaggagcagcgggaccattaattactggtctgcagcaagaaggcttcttggaaataactgaactattaacttttctgagtataccatggaattccactgcttgacttccagaagcatcctccatctctgcaccccacactcatacagtagctatgcacatcctggaagtctccttgactgaactttagaactaagtacacattgttccacatcacttataattaaagaataagcatttattttacagtgattcttctttttaactatgtaaaaatttgcatacatgtgactgttctaactttaatactgccagagcttaatccttgatgtcctactgataaggtttgcattctaacaacacatgtaaataacatcactttaagagtaaaaaataaatagtaaacacatttagacatgagtgtgtgtgtgtgtgtgtgtgggtttagcttaaagagaaatatctaataaagcttttag

SEQ ID NO: 62330 - DNA, 1067 bp, Homo sapiens; identical to SEQ ID NO: 62328

SEQ ID NO: 62331 - DNA, 1088 bp, Homo sapiens; identical to SEQ ID NO: 62329

SEQ ID NO: 62332 - DNA, 1560 bp, Homo sapiens
atgggcaacgcccccgccaagaaggacaccgagcaggaggagagcgtgaacgagttcctagccaaagccagaggagatttcctctacagatggggaaaccccgctcaaaacaccgccagctcggatcagttcgaacggctcaggacgctgggcatgggctccttcgggcgggtgatgctggtgaggcaccaggagaccggcggccactacgccatgaagatcctcaacaagcagaaggtggtgaagatgaagcaggtcgagcacatactgaacgagaagcgcatcctgcaggcgatcgactttccgttcctcgtcaagctccagttctcctttaaggacaactcctacctgtacctggtgatggagtacgtgccgggtggggagatgttctcccgcctacagcgcgtcggaaggtttagcgagccccatgcctgtttctatgccgcccaggtcgtcctggccgtccagtacctacactcgctcgacctcatccaccgcgacctgaagcccgagaatctcctcatcgaccagcagggctacctgcaggtgacggacttcggtttcgccaagcgcgtgaagggccgcacttggaccttgtgcgggaccccagagtacctggcccccgagatcatcctgagcaaaggctacaacaaggccgtggactggtgggccctaggggtgctcatctatgagatggccgtgggcttcccacccttctacgccgaccagcccatccagatctacgagaagatcgtctctgggagggtgcggtttccctccaaactcagctctgacctcaagcatctgctgcggagcctgctgcaggtggacctcaccaagcgcttcggaaacctcaggaacggggttggcgacatcaagaaccacaagtggttcgccacaaccagctggatcgccatctatgagaagaaggtggaagctcccttcatcccgaagtacacaggccctggggatgccagtaactttgacgactacgaggaggaagagctccggatctccatcaatgagaagtgtgccaaggagttttctgagttttaggggtgtgcttgtgcccctgtgggttttctttcctttttgtttttggtggtttgggggatgggagggttggattgaacagccagagggccccagagttccttgtatctaatttcatcctcaccccaccctccagggttgggggagcaggaagcccagatatttggaggaacagaaacaccagctgctccctcaccccccgccccatgccttcctggtccctctgtgcttctctctttctcctcccacagggtcccccttgccccagcccccttctgcctgttttaaacgagtttctcagctctattcaggccaggtcttgctgttgtatcaagggacacggtgtggaaagaggggctcaaacttaactccagccctgaacaggcaccacttactaagagaggatgaatgaaaagcacacctaccctttggagtaatcctgcctgggaaggagagaggtttagtgccatgttcagtgggctgtttgctagaataaaaaattaaaac

SEQ ID NO: 62333 - DNA, 2353 bp, Homo sapiens
gtccctagagacagcctggaaagattgggtgccagctgcagagaggagagcaaggcgaccaaacgcagggtaaggtctggaggtgctcatagttcactacgggacatgtacatggaagtgaataattatgtcacaaggtgccaagggggctagttacctcacataggatcttagaaaaggtctcctggagaccatgtctgagctggtcctgaggtgtgagtagggattctccgcagggcggggaaggacttgaaagagtctggcaatatggagcacatcaggattatggaaggtgagcttggagaagaaggcagagtctagcctgtgaaaggcctcttgcaatttgttgaggatccatgaccttctcccatgcatggtgaaatgcccttaaaggattttgaatagatttaaaagacactcaaaaacaaaaaacggtagattcaaaatagacggtagggatcgctttcttccgttttctttgaaggatcagaagtgtttaccaccacctggattgtttttgggctttcagctgtggctgcctgcagcccatcctgcccccagcacctagagtcatctttagaaatgcaagcctgatcgtggaatccaccttcctaacacccttcagtgccctcctcttcgttacacccttactatacaaacgatagtccatggaccagcagcatcaacataaccagggagcttgttagaaatgtagaatctggtccatcccaaacctgacgaagcagaagctgcattttgccaagatcccagggaatgtgtgtgcccgttatggtttgcgaagtgcttcccaagagaacatacggcaagccagagggatctttgcagatcttgctcctttcattctctggcctcatcttgtcgctctcctccatccgtgcccacatccccactgtactggaccgcttgcagctccttgaatgcagcatagtcttgttttcttttttgcagtgattctacatctttcccatcttctccacctggatgcctccatccatcctttcagacttcccttctctagcaaacctttcttgctaattcccatgtctaacacaacacttccccatactgcatggccattatcctttctgcatcagactgtgagcaccttgaaggcagtggcagtgactcattcattgtggcatctgcagattccagtggactgccaggcatgcaatagaaaatcaaaaaagatttactgctaaataatcctcaactccagtggcagctccatgtgccatttctcttccgctctggcctcggctcttcctgtgcctacctggggcttggctttcacctaggtgtctgcatggaagggagagcgacctggaggaccatcgccaatccatcaatagcctcccggttgagatgacttcagctctgatttggaagagctatgatattgtttataggagtgaattaatatgtgtaaaggttacaaagtaaacagttaaattaaattaattgtgctggagcaggtcaaacaggcttctgagagatgaacatacacatctctattaactccacattcggtgagtgtgggtaacttgaaattggctgggtcaccatttacatcatagaaattggcaaatagtacaaattagggctccctcacccctactcgggcatagagctggtacactagcacacctctggttatacatgcatgcgtgtgccaccagaacaaaacacctaacagcaggcacgttgcctctgttgcccaccattacagctcccgcacggagcagacagactcatggcaggaattgaatgcatgtttgtcgagtggaagcatgaacaaatccacaaaatgcccaagatgaggcaaagaaggacattggctcaaatgttaaacataagttaggagctgagataatgcccagaggaaaaatgttctgtaattctaagtaaaacccatctctaaggcaggatgctgcttatgagggctccacagacagatgggggaggcctgggtcctgcccttggaaagagtctgacagctcgacttctggaaacagccatctgcacaggtcaacatcttcttagctgacagggagcagatttgcagaccacatcacatttgaaattccagaagaaacttcttggagtctgctcttgtgcaaatgagcctagaaagcccgttaactttgggtggaggcttccactgtttggctatcccaagtgggcccaaagctaaggaaaacccaccagccctttgcttcctgcttcctctatttgtttgccccaggaaatcagaggtgatgacatgatttggcttgggcacgacaggaataaacgatatttaagagacgtcaaaaaaaaaaaaaaaaaaaaa

SEQ ID NO: 62334 - DNA, 3996 bp, Homo sapiens
gctgcgcggagggctcggcgatcagcggcggcggcggcagtggggaggccgcagcgccatgggggggcgttagacaggctgcggcggccgaggcgaggggcggcagcggttatctggtccgcggcgaccttcggccgggcccgggggtgggaaggcctggggcgggggtcgtccctggttgcacggggccgcggggcggggctcgccggccgtcggggtgcaggaggcctgggccgctgaaaggagaaggcgccgtcggtcgccaggccctgccgccgggccgcttgacgacgacgctcccgcgggggccccgcctgaggaggacgcggcggcggtggcggcgaggccgcgggaggccgcggaggatggaggagcggaaggaggagggcgaggccgagatccaggagcacgggcccgagcactggttctccaagtgggagcggcagtgcctggccgaggccgaacaggacgagcagctgccccccgagctgcaggaggaggcggcggccgccgcgcagcccgagcacaagcagcagaagctgtggcacctcttccagaactcggccaccgccgtggcccagctctacaaagaccgagtgtgtcagcagccaggactttctctctgggtccccttccaaaacgcagccaccgccgtcaccaatctctacaaagaaagcgtggatacccatcaacgaagttttgatattggaattcagattggctatcagcgacgcaataaggatgtgttggcttgggttaaaaaacgcagaagaactattcgtcgagaagatttgatcagcttcctgtgtggaaaagttcctccaccacgaaactctagagctcccccaagactgactgtagtgtcccctaaccgagctacttcaacggaaactagctcatctgtagagactgatttgcaacccttccgggaagccatagctctgcatggtcttagtggtgcaatggctagtataagcgtgcgttcgagtaccccaggctctcctacacatgtaagcagtggatcgaatgctagtcgaaggagaaatggactccatgatgtcgatttgaacactttcatatcagaagaaatggcactccacttggacaatggtggaactagaaagcgtacctcagcccagtgtggcgatgtcattacagactcaccaacccataaacgcaacagaatgatctaaactgcaaacattttcacacccaccatgctgcttgaaagccacttgatcctcaacatatactataattgcaaaggaaacatgaggccatcttcccttgttcactgtttaagacaagtgaattctatagtggttgccataaaaggaagttctaggtatttatagtagatgcctcttgtaattatggctttcttaaaactataatcctagcagaggacatcagatattgtgtagtcgttagcaagatcatcataggcaaacatatatccgttccaaggctaaaagtgaccttaactgtatttattctcaaagggaaaggaaatatcagatgtttatttggttatagaatgctttttttttttttgggtccatttcctgctgtgttgagtattttgcttcaacagtattgccaggttcctaaaattgtctaaaaacatgatttggcttccatttttgcagctgcactgtaccatgcacctggtttctatatagtaacagtgtgcaattctaattattggactgtgccctgtttttagttttcaaatcaatttctaattctggtgattgtgtgatgtaaagaggtgctatgatggtcatgcaattaatactaaatattgaatcaatgcccagagctttattggattcactttgtgtgtgttagtgctctaaagtagcagtattattattaaactgtccccagagtaaccctgtaggcctaaagtactcagttttaagacaaacactacttcccatgcggggtactttccttatggtaaatgtaaacatgtagactgcattcgaggtgacctaaagtagagaggtcatgaactttgagaatgggcttcctttttggttcagtattagtgagagggagagggagatggatggtggggtaggttttctagtctatcattttacatttttcatggagtccctgcttagtgcagtttccattggaatgggtggaagatgataaagctctcttttttatctactaataatgtgattgcaacttaaaatagcaaaacccaactctccctgtccctccaatccctctcctaaaaagttcagtttggaatctcattctggaaaagatggaatcgcatggagattctctagctgttaggtagacctaaataaaaagttctcaatagattcctcttttgagtaaatataagacctcttgtagctacaatgttttagagcatgtttcatcttcatttttaatatcctgaactgaatgatagtgtttttttagatgaagaactgatgtcagcctgccaggtactgtaatttattctatcatattattatattatatatcaagtaggacagtgaaaaatgtttccttgcaaacttgtagtccagtatcagttacttcctatttttatccttaaaagaccattgcaaatcagtgtaagggtttttccagtaattactcacagcactttgttaaagtttgcaatttcttcagccatttaataatatctttctgtgaagaaactttgctgagttaaccataaatgttcattcattgactgggtgggatgtgaatggaatgttagaaatgttgtgtgaattgaagttctgtattcattatagatgtagcccttatttaaaaaagtgaattccatactaaaactaggaatgaaagtgagagatttctaaacttttgcgaaagtgggtcattttttgtttgactataatagcaggaagaattatagcaatctgtcattttacctgaaacagacaagcctatgtattatgaatactttcaagcttccctttggaatatacaagacatgcgtttggagttacctttgtttttctatcgtaaatttagattctggaattggggtttggtggtgcaatgtgttgctcacaagtggccagaactcctattcctaaaaggattttgagatggaggaacacatatttaattcccctttatgccttggttcttgctcctctttccacgttggataacaattttttggttgttttgtttaagttggtgctctgaagcttaatctcagtaccctttactctgaattgtcaaattttgataaaacgtgccattttctttggtaagagaaagcaggtcttaatgtctgccagaacacaatttatatgccttattggcttcattaaacttttagaaaactttagcatttgttacttttttccattgcatttactttcaaatgcacctaatgaatttgtcacccagtcgcaacttttcccttctctgtcccattgctttctcctttccccgacgcacagaataaacatgaagctcagcagtagaagcgtaatgatttccctcaggaaaaacttctgacagctaggtttttcaagggtttccctgtgctagctgagatgcaaaacaaatcatggaagattgcatacctgtgtggtattttaaaaacaagttgactttttcagtttcttgaacggttaagggtggatttaaaaactagacagtttagttttggggaacagaagctctcttcgtcttaagccagattctctgattcttttagacgtcatagctccttagttctgctcctgtcgccctaacttggcatgggcaagttgaagttcatccttagactgcagcgttctgagcatggctgaagtattaaaatgtttaatattttttagagcaaaattgatggaaagcatttggctgaatctaaagacctgcagtcagattcttcaatgtggtttacccaactggagtagtgataaacaccttaatcataaaatgaataaaaacaaaaaaaccaaaaaaaaaaaaaaaaaa

SEQ ID NO: 62335 - DNA, 1833 bp, Homo sapiens
cctcgcagcggtctgcggctccttcccagcccccggcctagctctgcgaacggtgactgcccatccttggccgcaatgagccaccacccgtcgggcctccgggccggcttcagctccacctcataccgccgtaccttcggtccaccgccctcactatcccccggggccttctcctactcgtccagctcccgcttctccagcagccgcctgctgggctccgcgtccccgagctcctcggtgcgcctgggcagcttccgtagcccccgagcgggagcgggcgccctcctgcgcctgccctcggagcgcctcgacttctccatggccgaggccctcaaccaggagttcctggccacgcgcagcaacgagaagcaggagctgcaggagctcaacgaccgcttcgccaacttcatcgagaaggtacgctttctggagcagcagaacgcggccctgcgcggggagctgagccaagcccggggccaggagccggcgcgcgccgaccagctgtgccagcaggagctgcgcgagctgcggcgagagctggagctgttgggccgcgagcgtgaccgggtgcaggtggagcgcgacgggctggcggaggacctggcggcgctcaagcagaggttggaggaggagacgcgcaagcgggaggacgcggagcacaacctcgtgctcttccgcaaggacgtggacgatgccactctgtcccgcctggaactagagcgcaagattgagtctctgatggatgagattgagttcctcaagaagctgcacgaggaggagctgcgagacctgcaggtgagtgtggagagccagcaggtgcagcaggtggaggtggaagccacggtgaagcccgagctgacggcagcgctgagggacatccgcgcgcagtacgagagcatcgccgcgaagaacctgcaggaggcggaggagtggtacaagtccaagtacgcggacctgtccgacgctgccaaccggaaccacgaggccctgcgccaggccaagcaggagatgaacgagtcccgacgccagatccagagtctaacgtgcgaggtggacgggctgcgcggcacgaacgaggcgctgctcaggcagttgagagagctggaggagcagttcgccctggaggcggggggctaccaggcgggcgctgcgcggctcgaggaggagctgcgacagctaaaagaggagatggcgcggcacctgagggagtaccaggagctcctcaacgtcaagatggccctggacatcgagatcgccacctaccgcaagctgctggagggcgaggagagccggatctccgtgcccgtccattcttttgcctccttaaatataaagacgactgtgcctgaggtggagcctccccaggacagccacagccggaagacggttctgatcaagaccattgagacccggaatggggaggtggtgacagagtcccagaaggagcagcgcagtgagctggacaagtcttctgcccacagttactgaaccccttggtccggagccttgactctgccctaggcctgctcaaagcccaaaccctaagaccactcctgaattgtctcctctccctctgcatgtgtctaaaaggtggtaccaggcatccctttcctggcttatggccaagccctacccggccagcagtcgctgggcctctccctgccctgacacttgatgtgacctatgtgcttcccttttcatgtcccgataagaagccaatgatcccccctcaggacaaatctactccagccacgatgagaagtgggtgagccagggtctgagtttcacatttgaaccaaataaaatgctgtcaagagaaaactctccagtgca

SEQ ID NO: 62336 - DNA, 1091 bp, Homo sapiens
attagagtctgtgcttcacttccgttccagcctcagcggcagctggatcgctcgacggagtgcctctggtagttggccaagacgccgaatatcaaaatcttcagcggcagctcccaccaggacttatcccagaaaattgctgaccgcctgggcctggagctaggcaaggtggtgactaagaaattcagcaaccaggagacctgcgtggaaattgatgagagtgtgcgtggagaggatgtctacatcgttcagagtggttgtggcgaaatcaacgacagtctaatggagcttttgatcatgattaatgcctgcaagattgcttcagctagccgagttactgcagtcatcccatgcttcccttatgcccgacaggataagaaggataagagccggtccccaatctctgccaagcttgttgcaaatatgctctctatagcaggtgcggatcatatcatcaccatggacctacatgcttctcaaattcagggcttttttgatatcccagtagacaacttgtatgcagagccaactgtcctgaagtggataagggagaatatccctgagtggaagaactgcattattgtctcgccagatgctggtggagctaaaagagtgacctccattgcagaccagttgaatgtggactttgctttgattcataaagaacggaagaaggccaatgaagtggactgcatagtgctagtgggagatgtgaatgatcgtgtggctatccttgtagatgacatggcagacacttgtgttacaatctgcctcgcagctgacaaacttctctcagctggagcaaccagagtttatgctatcttgactcatggaatcttttctggcccagccatttctcgcatcaacactgcatgctttgaagcagtggtagtcaccaataccatacctcaagatgagaagatgaagcattgctccaaaatacgagtaattgacatctccatgatccttgcagaagccataaggagaactcataatggggaatctgtttcctacctgttcagccatgttcctttataacagaataacttctaggttatgctattttaaaataaaataagattaataaaaaa

SEQ ID NO: 62337 - DNA, 1165 bp, Homo sapiens
gctgggagtagagggcagagctcccaccccgccccgcccccagggggcgccccgggcccggcgcgagaggaggcagagggggcgtcaggccgcgggagaggaggccatgggcgcgcgcggggcgctgctgctggcgctgctgctggctcgggctggactcaggaagccggagtcgcaggaggcggcgccgttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaacctatagtgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgaggcactgccatctccccacaccctccaggaagttcaggtcgccatcataaacaactctatgtgcaaccacctcttcctcaagtacagtttccgcaaggacatctttggagacatggtttgtgctggcaatgcccaaggcgggaaggatgcctgcttcggtgactcaggtggacccttggcctgtaacaagaatggactgtggtatcagattggagtcgtgagctggggagtgggctgtggtcggcccaatcggcccggtgtctacaccaatatcagccaccactttgagtggatccagaagctgatggcccagagtggcatgtcccagccagacccctcctggccgctactctttttccctcttctctgggctctcccactcctggggccggtctgagcctacctgagcccatgcagcctggggccactgccaagtcaggccctggttctcttctgtcttgtttggtaataaacacattccagttgatgccttgcagggcattcttcaaaa

SEQ ID NO: 62338 - DNA, 1159 bp, Homo sapiens
gctgggagtagagggcagagctcccaccccgccccgcccccagggggcgccccgggcccggcgcgagaggaggcagagggggcgtcaggccgcgggagaggaggccatgggcgcgcgcggggcgctgctgctggcgctgctgctggctcgggctggactcaggaagccggagtcgcaggaggcggcgccgttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaactgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgaggcactgccatctccccacaccctccaggaagttcaggtcgccatcataaacaactctatgtgcaaccacctcttcctcaagtacagtttccgcaaggacatctttggagacatggtttgtgctggcaatgcccaaggcgggaaggatgcctgcttcggtgactcaggtggacccttggcctgtaacaagaatggactgtggtatcagattggagtcgtgagctggggagtgggctgtggtcggcccaatcggcccggtgtctacaccaatatcagccaccactttgagtggatccagaagctgatggcccagagtggcatgtcccagccagacccctcctggccgctactctttttccctcttctctgggctctcccactcctggggccggtctgagcctacctgagcccatgcagcctggggccactgccaagtcaggccctggttctcttctgtcttgtttggtaataaacacattccagttgatgccttgcagggcattcttcaaaa

SEQ ID NO: 62339 - DNA, 1135 bp, Homo sapiens
gctgggagtagagggcagagctcccaccccgccccgcccccagggggcgccccgggcccggcgcgagaggaggcagagggggcgtcaggccgcgggagaggaggccatgggcgcgcgcggggcgctgctgctggcgctgctgctggctcgggctggactcaggaagccggagtcgcaggaggcggcgccgttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaacctatagtgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgaggcactgccatctccccacaccctccaggaagttcaggtcgccatcataaacaactctatgtgcaaccacctcttcctcaagtacagtttccgcaaggacatctttggagacatgggtgactcaggtggacccttggcctgtaacaagaatggactgtggtatcagattggagtcgtgagctggggagtgggctgtggtcggcccaatcggcccggtgtctacaccaatatcagccaccactttgagtggatccagaagctgatggcccagagtggcatgtcccagccagacccctcctggccgctactctttttccctcttctctgggctctcccactcctggggccggtctgagcctacctgagcccatgcagcctggggccactgccaagtcaggccctggttctcttctgtcttgtttggtaataaacacattccagttgatgccttgcagggcattcttcaaaaaaaaaaaaaaaa

SEQ ID NO: 62340 - DNA, 1055 bp, Homo sapiens
atgagctcgtcccggagatgccgagttaaggacattctgggcctggacaggctgcaaaaggcaaaagctgtgcctggaaaagtcgccgtggggcatgagcttggcctaaagaggccattgcaaggcaggagctgggcccgtagaggctgccgaaaggcaggagcttcgcctgaggatgccacagaagacactggccatgttcgtgcagcggcagtatgtcatgatatgacataccttgaagagaagttaacagatgaggaagttgataaaaatgatcagagaagcaaaatactggcagcgacactcaacttcagctcctctgtcacttgtccgcgttggcatcacctcctcatggaagacttccttgactccccagattctcaggagcatggcagggagctggtaagtcgcctacaggagcgaaatgttcaggttttcctaatatctggtggctttaggagtattatagagcatgttgcttcaaagctcaatatcccagcaaccaatgtatttgccagtaggctgaaattctaccttaatggtaagatgttaacggatgctttcattggatttggaggaaatgtgatcaggcaacaagtcaaggataacgccaaatggtatatcactgattttgtagagctgctgggagaaccggaagaataacatccattgtcatacagctccaaacaacttcagatgaatttttacaagttacacagattgatactgtttgcttacaattgcctattacaacttgctatagaaagttggtacagatgatctgcactgtcaagtaaactacagttaggaatcctcaaagattggtttgtttgtttttaactgtagttccagtattatatgatcactatcgatttcctggagagttttgtaatctgaattctttatgtatattcctagctatatttcatacaaagtgttttaagagtggagagtcaattaaacacctttactcttaggaatatagattcggcagccttcagtgaatattggtttttttccctttggtatgtcaataaaagtttatccatgtgtca

SEQ ID NO: 62341 - DNA, 1055 bp, Homo sapiens; identical to SEQ ID NO: 62340

SEQ ID NO: 62342 - DNA, 4340 bp, Homo sapiens
ccggttggggcggcgggcgcggggcggggcagggggcggggcgctgacgtcgcggcgcggcccgcggccagcggcccggtgaggcggggaggcggcggccggtcggcccggcccagcccagcccgcagctgcggcggcgctcagagttggttcctgaccgccttctgccgcggccgggtttgtcaccaggtcctggggtctgcaccggctcggccagacctcgccccccgcttctccgccatggccctggtgcggggcgcggagccggcggcggggccttcccgctggctgcccacgcacgtccaggtgacggtgctgcgggcccgcgggctgcggggcaagagctcgggagcgggcagcaccagcgacgcgtacacggtgatccaggtgggccgcgagaagtacagtacgtcggtggtggagaagacgcacggctgtcccgagtggcgtgaggagtgctccttcgagctgccgccgggggccctggatggcctgctgcgggcgcaggaggccgacgcgggcccggcgccctgggccgcgagctccgccgccgcctgcgagctggtgctcaccaccatgcaccgctcgctcatcggcgtcgacaagttcctgggccaggccacggtggcgctggacgaggtcttcggcgcaggccgcgcccagcacacgcagtggtacaagctgcactccaagccaggcaagaaggagaaggaacgcggcgagattgaagtcaccatccagttcacgcgcaacaacctgagcgccagtatgtttgacctgtccatgaaggacaagccaaggtctcccttcagcaagatcagggacaagatgaagggcaagaagaagtatgatctggaatctgcctctgccatcctcccaagcagcgccatagaggatcctgacctgggcagcctgggcaagatgggcaaagccaaaggcttcttcctccgcaacaagctgcgcaagtcgtccctgacccagtccaacacctcgctgggctcggacagcaccctgtcctcagccagcgggagcttggcctaccagggacctggcgccgaactcctcacccgctcaccaagccgtagcagctggctgtccactgaagggggcagggactctgcacagtcccccaagctgttcacccataagaggacctacagcgatgaggccaaccagatgcgagtggctcctcctcgggcccttctggaccttcagggccacctggatgctgcctcccgctcttcgctctgtgtcaatgggagccacatttacaatgaggagccccagggccctgtgcggcaccgcagctccatctcgggctcgcttccatcctctggctccttgcaagctgtctcttcccggttctccgaggaggggcctcgttccacagatgacacctggcccagaggcagtcgtagcaacagcagctcagaggcagtgcttggacaggaggagctgagtgctcaggctaaagtcctggcccctggggccagccaccctggagaggaggagggggcccggctaccagagggcaagccagtccaggttgccacacccatagtggcctcctctgaggctgtggcagagaaggagggagcccggaaggaggaacgcaagccccggatgggtctcttccaccaccaccaccaaggcctaagtcggagcgagttgggtcgccgaagctctctgggggaaaaggggggtcccatcctgggggcctccccacatcactcatccagtggggaggaaaaggccaagagtagctggtttggcttgagagaagccaaggacccgactcagaaacccagtccccaccccgtgaagcccctcagtgccgcccctgtggagggcagccccgacaggaagcagtcccgctccagtctgagcatagccctgagcagtgggctggagaagctcaaaacagtcacatctgggagcattcagcctgtgacccaggccccccaggctggccagatggtggacaccaaaaggctgaaggactcagctgtgctggaccagtcggccaagtactaccacctgacccacgatgagctcatcagcctgctcctgcagcgggagcgggagctgagccagcgggacgagcatgtgcaggagctggagagctacatcgaccggctgctggtgcggatcatggagacctcacccacgctgctgcagatccccccgggcccccccaaatagccttcctcaccctacccccaggagggttggcatggacctattgctgcctgccctctctcctcctgaactctctcatctgcagtggggcatcgtctgtcttgccttgtcactccttgctcctctccctcctgcctcaactggggctgctggaagggggccctctggattccctttggaggcatcaggttctgtgcacaacttgtgtgtctttgggagccctgggtctttcccacctgcctgttttcatatccctcagctttgggggccccagggaattggaactcttcccccaagacagagcaggggtgaactgtagcttgatgcagtaatctgggacaagactggttgctagcacatactttattatcccccaaggatggtcagccatttcttcccacagccaaagccccatccccttcatttccctccagtccctggaggggcttctagtattactgggacaatgaccacgctgcctgtttgtctgtgagttacgggcaaccagcctcttcagcctcacacccattcccctgagagcaagaagcctgtgtggtctgggccagtctctgccatgtcctgagtctgcttcagtctggagctgtttgtggggcgagtgccatgtggacagtggtggatgatgtgtgtgcttcaggctgctccctgacccctctgacctttccacgagtgtcacatgggaatgtgtggggcgcaggggcgggtgcggagagagcacctttttgcttttcgagctcttgaccacctccaatgtgtaggtccctccaggctggggcttgggactgcttatgatttggggatcaagcctccatgtctattcttgttgcctgtccagatgccaaaactctgtgttgctgcagggtttgaacttttggaaaccaattaaaatgtgcctttggtgggcggggtcaagagcccctggatgtcgacctctcccgctgtgtggcgtccccctcccacctgttgaatacatagggatggctctctcagggccctgggaatgggaatggacagcactgctgtgggctgttcccttcccctaaagttaatctcttggtctggccaagttgctgctccctcaaccttcctgctgtcttcccctccctcaaccccaataggaggatcccaggataaacactgctgggcaggcgggcaggcaggcctggggctgccctgctcactctcattgtctggcctcaggacttagccatactagaccagtcagcttgcctggaagagggaggtcccactatgcctttgggagacacctatacttaggaaaaagcctttgttgtcctcccatccatccattaagctgctatctcagcctgtcccttctgccccaggggcttgcctggcttggctgcagtgcactttgaaatgaagtatctgtcctttggcccagcccctggtttgcttgtagaaaacatggtaggcttccccaaggcatctgcagggaactttggcagcttggggcaccctgaattagcaaaaatggggggtgatgaggtgctgaagaaggatacttaacagcttagtgaggaggcaagagctcctctgggaccaccacttcttcaggagagggcctgtgggcttgcttttggaaggcctcaggcagacacgtgccctctgggtgatgtctgtctgctgccaggatggagcagaggagcgccacacatggaggaaagcccctgtaacgttacctaccttaaactccactcatcaaatctgagaaaagtatccactggtccccagggtttcagtcatgcttttgggggtcattgggtattagagaagtaagtatcttttctgagagagggggagtcaccccccctactggggattcctctgggctttattcactcccagccctggccctgacctttgtgggcctccctaatgcccagggcatggatggcttcagaggagtttttgaatcgaagcccagggtccttgttgatgtttcttctccgagccacacttggaggaaagttgcaggtgggttgggcagggagcaggcatggttctgctttgctgtttgtcttcctagttaaggctctttataaagagcttcttcttcatgttttaagcactttatgaagaataaaacattcatgtactgc

SEQ ID NO: 62343 - DNA, 2893 bp, Homo sapiens
cgtcgagctgaggcgcgccttccgagcctgctttttagggcggatggcagccatgctgaagtgcgtgatgagcggcagtcagtatttgggaaagcagttcaagctctatcacgaattagtgacgagttctggctagacccatctaaaaaaggtcttgctctaagatgtgtgaattcttctcggtcagcatatggatgtgtcctgttctctcctgtgttttttcagcattatcaatggtcagctttagtgaaaatgagtgaaaatgaacttgacacaacactgcatttaaaatgcaaattgggaatgaagtcaattttgcccatctttagatgtctgaattcccttgaaagaaatatagagaagtgcagaatattcaccagatctgataaatgcaaagtagttattcaattcttctacagacatgcaacgtggatggaactagaggtcactatgttaagtgaaataagccaggcatggaaagtcaagtattgcatgttctcacaatgtggacgctaaaaagttgatctcatggaggtagagagtagaatggtagataccagaggctggtaatggtgtgtgggtattaaaagaactcataatatatgttttcaagaaagtcagcctttgcaagttatttttgacaagaatgtttgtactaatacgctaatgattcaaccaagattgcttgctgatgccattgttctttttacatcaagtcaagaggaagttactcttgctgttactccactgaatttttgcctcaagagttctaatgaggaatcaatggatttgagcaatgctgtacacagtgagatgtttgttggctcagatgagtttgacttctttcaaattggaatggacactgagataacattttgtttcaaagaattgaagggaatactgacattttcagaagctacacatgctcctatatccatttattttgatttccctgggaaacctctggctttgagtattgatgatatgttagtggaagctaactttattttggccacattagctgatgaacaaagtagagcatcttcaccacagtcactgtgtctttcacagaaacgaaaaaggtcagatctgattgaaaaaaaggctggcaaaaatgtaactggccaggccctggaatgtatttcaaaaaaagcagcaccaagaaggctttatcctaaggagactctcacaaacatatctgcattggaaaactgtggcagccctgcaatgaaaagagtggatggagatgtcagtgaagtatcagaaagcagtgtcagcaacacagaggaagtgccagggtctctgtgtctcagaaagttttcttgcatgttctttggagcagtttcttctgaccagcaagaacacttcaaccaccctttcgacagtctggcaagagcaagtgacagtgaagaggacatgaataatggcagtttctctatattctaatgcttaatgatggctgagctgggccccagcccagtgactggctcatttgcccctcaagcacgagtttgcatgtttagtgtctaaaagaggttgtccaggacttccttttaatggaggatgggcttttaaaccacatcatcttgtacaacaaccatatctagaaatagctgtttgtcaagtgtatgtaacttgctttaaatccattatgctacttgtgaggcagaagagttttctgtgaaggaaaaaagcccattagagttcttcaattcaatgcacgttcaccctagagcttttaacatctttgctagttttataaaggtatttaaactttattcaacagccatttagagtgccatcaagatggcttgaaatggaattttgtgatttgtagtcaggtatcttttgtatttgattgcaaacatttggattttagttttctcatgtaataccatggccttttttgtgcattgttttttatattttaagactttaagtagaataaaccctggaaaaaagatcaagagtaaaaatatatagtcactttcacttggcttttttagacggagtctcactttgtcactcaggctcaagtgcagtggtgcaatctctgctcactgcaacatctgcctcccaggtccaagcgattctcctgcctcagcctcccgtgcagctgggattgcaggtgcgtgccaccatgcctggctaatttctggtattttgtagagacagggtttcgccatgttggccagggtggtcttgaactcctggcctcaagtgatctgcccacctcggcctcccaaagtgctgggattacagacttgagccactgcgcccaacctggagtgtttttacatattgtaaaattttatttcctaacctcaaattgttctgattttcagatgtgattttttattttgcagtgtgctgcaggaaagaatttaatggaagtgatgccaaatatttctgtattatctgacatagaacagtatcctccactgccaagacagcctgagtttggagtggaataaggtggaagacaaatgtctctgttctttggccctttaagagttagctttttacctgcacaaatggactaaaaaatctggcacaaaacattgttatgtaatgtcttatgatgtgtgcctctccctcccccaaacctgtttacagtcaattataacctgacaaacgagacttttgtaacatattattgttacatctttctgaaaccttcaaaccgtaaggaagtgttaactggcaagcagttgtactttagactttgtgagaaattcataaaggtggctgagtggatttgcatgctttagaactgtgaatagagttctaactgaaaccagaattaatttggctcttgtagcttagtaatgagtcatagctacccacaataacctaataaaaactcaagttcatcccaaaaaaaaaaaaaaaa

SEQ ID NO: 62344 - DNA, 1895 bp, Homo sapiens
agctccagctgtccctcccgcagttggccctgtggtgttccgaagccggttacgtacggcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgcgaaagatatgaatggaacgtctttgcatggaaaagcaataaaagtagaacaagccaagaaaccatcttttcaaagtggtggtaggcggagaccaccagcttcttcgagaaacagaagcccttcaggaagtctgagatctgcaagaggaagcagtggaggaacaagagggtggcttccctcacatgaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcatcgaagttcccgagaaactagggagtatgctccaccatctagaggccatggataccgtgattatggtcattctcgtcgacatgaaagttattctagaggatatagaaatcatccaagttcccgagaaaccagggattatgctccaccacatagagactatgcataccgtgattatggtcattctagttgggatgaacattcctctagaggatatagttatcatgatggctacggtgaggcccttggtagagatcattctgaacatctaagtggaagttcttatagagatgcacttcagagatacgggacctctcatggtgcaccacctgcaagagggcctcggatgtcttatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatatggtagctcaagttatgtggcatctatagtagatggtggggagagtcgatctgaaaaaggagactcgagcagatattaaagcaagcattgaaaataatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaattttacatgtactgcaaaaaaaaaaaaaaaa

SEQ ID NO: 62345 - DNA, 1880 bp, Homo sapiens
agctccagctgtccctcccgcagttggccctgtggtgttccgaagccggttacgtacgcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgcgaaagatatgaatggaacgtctttgcatggaaaagcaataaaagtagaacaagccaagaaaccatcttttcaaagtggtggtaggcggagaccaccagcttcttcgagaaacagaagcccttcaggaagtctgagatctgcaagaggaagcagtggaggaacaagagggtggcttccctcacatgaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcatcgaagttcccgagaaactagggagtatgctccaccatctagaggccatggataccgtgattatggtcattctcgtcgacatgaaagttattctagaggatatagaaatcatccaagttcccgagaaaccagggattatgctccaccacatagagactatgcataccgtgattatggtcattctagttgggatgaacattcctctagaggatatagttatcatgatggctacggtgaggcccttggtagagatcattctgaacatctaagtggaagttcttatagagatgcacttcagagatacgggacctctcatggtgcaccacctgcaagagggcctcggatgtcttatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatatggtagctcaagttatgtggcatctatagtagatggtggggagagtcgatctgaaaaaggagactcgagcagatattaaagcaagcattgaaaataatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaattttacatgtactgcaa

SEQ ID NO: 62346 - DNA, 1166 bp, Homo sapiens
ggcgcaatgctggggcgagggttagccgcgcaggtgcggtgaagggaggatggcggagttggtaccttttgcggttcccatcgagagtgacaaaaccttgctagtgtgggagctgagctccggacccacggccgaggctttgcatcattctctgttcacagcattttctcagtttggccttctgtattcagtccgggtcttcccaaatgctgcagtggcccatcctggtttctatgccgtcattaagttttattctgcaagggctgcccacagagcccaaaaggcatgcgaccggaagcagctttttcagaaatctccagtcaaggttcgtcttggcaccagacataaggcagttcaacatcaagcccttgccctgaacagttccaaatgccaagaactggcgaattactactttggtttcaatgggtgttccaaaaggatcatcaagcttcaggagctttctgaccttgaagaaagggaaaatgaagatagcatggtgccacttccgaagcaaagcctgaagttcttctgtgctttagaagtggtgttgccatcctgtgattgcaggagtcctggcattggcttggtggaggagcctatggataaggtggaggaaggaccattatcattccttatgaaaaggaagacagcccagaagcttgctattcagaaggctttgtcagatgcattccagaaactgttgattgttgttctagaaagtggtaaaatagctgtggagtacagacccagtgaagacatcgtaggtgtcagatgcgaagaagaactacacggtttaattcaagtcccttgctctccctggaagcagtatggccaagaggaggaagggtatctctcggatttcagcttggaggaggaagagttcaggctgccagaacttgactagcatttctgaatatcccaaggcgaggtcatgtaacttccttgggaagctctgtcgtgcccctaccccacgccgccccaccactataggctgctggagtcctggaaccacctgggtcggccgcccaaatctttcctggcgaaggggagggaaggggtgttctggtggagtgggaagggaggcttgggtaggattgtgggataagatcgccctggtgacgaggagcggatctcgaacggaacttaataaaggttgcctagataaa

SEQ ID NO: 62347 - DNA, 1139 bp, Homo sapiens
aacttttactttgaaaaagaagtacgtctgaaccagattcacatgtttgatatttggatgcagagaaaatggggcagaaagcatcgcaacagttggctctgaaggacagcaaagaggtgcccgtcgtctgtgaggtggtcagtgaagctatagtccatgcagctcagaaactgaaggagtaccttggatttgaatatcctccaagtaaactctgcccagctgcaaatactctgaatgagatcttcttaatccatttcatcactttctgccaagaaaagggagttgatgagtggctgaccaccaccaagatgaccaagcaccaagccttcctgtttggtgcagactggatttggaccttttggggatccaacaagcaaataaagcttcagctcgcagtacagactctgcagatgtcttcacctcctcctgtggaatctaagccttgtgacctttccaatccagaatcaagggtagaggagtcttcctggaagaaaagtagatttgataagctggaagaattctgtaacttaataggagaggattgcctgggtctgtttatcatctttggtatgccaggaaagcctaaagacatcaggggagttgtcctggacagtgtcaaaagtcagatggtgaggagccatctgccaggagggaaggctgtggctcagtttgtcctggaaactgaagattgtgtgttcatcaaagagctgctcagaaattgtctgagtaagaaagacgggctgagagaggtgggcaaggtttatatcagcattctctgacttggatatgtattatgtgagtggcctgtaagaggaaaagaaaaaaagattctaataagcaagctcacctatttgcatcattccagcatgggattttttttcatttgttttcccattgattgaaaatgattactgggatcaaagtacattcatgtcgcaattacagagagagagagaaaaaaagaaaaccctggctctgcctatgatttaaaaacagttcaggaaaagttataatttagtttaatatttcattcacttattcaataataaaaatggaagagagataataaagtcacatttaaagtttgatttgcaaaaaaaaagtgtctgtttgaaataataagtctagcactcaaaagt

SEQ ID NO: 62348 - DNA, 3381 bp, Homo sapiens
aggtgggaaggcagttatgacagttgagaagtagtagaagacacggaaggcacagaaggcagacttcgctcagcacaaagaattttctgataaccatactggcaaaatgaactgggctgccttcggagggtctgaattcttcatcccagaaggcattcagatagattcgagatgcccactaagcagaaatatcacggaatggtaccattactatggcattgcagtgaaagaaagctcccaatattatgatgtgatgtattccaagaaaggagctgcctgggtgagtgagacgggcaagaaagaagtgagcaaacagacagtggcatattcaccccggtccaaactcggaacactgctgccagaatttcccaatgtcaaagatctaaatctgccagccagcctgcctgaggagaaggtttctacctttattatgatgtacagaacacactgtcagagaatactggacactgtaataagagccaactttgatgaggttcaaagtttccttctgcacttttggcaaggaatgccgccccacatgctgcctgtgctgggctcctccacggtggtgaacattgtcggcgtgtgtgactccatcctctacaaagctatctccggggtgctgatgcccactgtgctgcaggcattacctgacagcttaactcaggtgattcgaaagtttgccaagcaactggatgagtggctaaaagtggctctccacgacctcccagaaaacttgcgaaacatcaagttcgaattgtcgagaaggttctcccaaattctgagacggcaaacatcactaaatcatctctgccaggcatctcgaacagtgatccacagtgcagacatcacgttccaaatgctggaagactggaggaacgtggacctgaacagcatcaccaagcaaaccctttacaccatggaagactctcgcgatgagcaccggaaactcatcacccaattatatcaggagtttgaccatctcttggaggagcagtctcccatcgagtcctacattgagtggctggataccatggttgaccgctgtgttgtgaaggtggctgccaagagacaagggtccttgaagaaagtggcccagcagttcctcttgatgtggtcctgtttcggcacaagggtgatccgggacatgaccttgcacagcgcccccagcttcgggtcttttcacctaattcacttaatgtttgatgactacgtgctctacctgttagaatctctgcactgtcaggagcgggccaatgagctcatgcgagccatgaagggagaaggaagcactgcagaagtccgagaagagatcatcttgacagaggctgccgcaccaaccccttcaccagtgccatcgttttctccagcaaaatctgccacatctgtggaagtgccacctccctcttcccctgttagcaatccttcccctgagtacactggcctcagcactacaggagcaatgcagtcttacacgtggtctctaacatacacagtgacgacggctgctgggtccccagctgagaactcccaacagctgccctgtatgaggaacactcatgtgccttcttcctccgtcacacacaggataccagtttatccccacagagaggaacatggatacacgggaagctataactatgggagctatggcaaccagcatcctcaccccatgcagagccagtatccggccctccctcatgacacagctatctctgggccactccactatgccccttaccacaggagctctgcacagtacccttttaatagccccacttcccggatggaaccttgtttgatgagcagtactcccagactgcatcctaccccagtcactccccgctggccagaggtgccctcagccaacacgtgctacacaagcccgtctgtgcattctgcgaggtacggaaactctagtgacatgtatacacctctgacaacgcgcaggaattctgaatatgagcacatgcaacactttcctggctttgcttacatcaacggagaggcctctacaggatgggctaaatgactgctatcataggcatccatatttaatattaataataataattaataataataataaacccaacacccatcccccagaagactttatctctatacattgtaactcatgggctattcctaagtgcccattttcctaatgaacatgaggatgggatcaatgtgggatgaataaactttagttcagaaacaggacttactaaaagtcagtgggactgggtttctgtagccaagccagacttgactgtttctgtagagcactatctcgggcaggccattctgtgccttttccctctgttccatgactttgctttgtgttggcaaccacttctagtaagctactgattttcctgttgacaaaatctctttagtcttgaaggatggatactggagacagaatctggtttgtgttcttggatgggcacataatttaccaagagcattcaccttgccatctgtcttgtcattgtactgtacaaggaacagccctcagacgtgttctgcacatcccttcttcctggtggtaccatccctatttcctggagcaccagggctaaatggggagctatctggaaactctagattttctgtcatacccacatctgtcacagtacctgcattgtcttggaatgtaagcactgtcttgagggaaggaagaggtctgttctgtattgccttaagttgattgaggtttgtaggagactggttcttctacatacaaggatttgtcttaagtttgcacaatggctagtgtcagcaaaaggcaggagagggtttttgttttttttttaagttctatgagaatgtggatttatggcattgagtatcacactcagctctgctgtgttaactttgtgaaactggatggaacaaactttaacttaccaagcaccaagtgtgaaagtgactttcacggttccttcataaaactataataatatccgacactttgatagaaaaaaattcaaagctgtgcctttgagcctatactatactgtgtatgtgtggaaataaaaatgtattgtacttttggagaattttttgtaggcatttttctgtcagatttgtagtaatttgtgaggtttgttagagattaatataggttttctttctgtattataaaatgcaccaagcaattatggtggacctattaccctatgggtaagaaataaatggaaatatgacatcggatgtttcagcaactgttctgtaaataaaatctttgatcacaccactcagtgtgataattgtgtctacagctaaaatggaaatagttttatctgtacagttgtgcaagatatgaatggtttcacactcaaataaaaaatattgaaacgaaaaaaaaaaaaaaaa

SEQ ID NO: 62349 - DNA, 3623 bp, Homo sapiens
tctagcacaggggatccccaaacatcaggacttttggggggcgcctgtgctgtccatgggaagagcatgcattgtgggttactggaggaacccgacatggattccacagagagctggattgaaagatgtctcaacgaaagtgaaaacaaacgttattccagccacacatctctggggaatgtttctaatgatgaaaatgaggaaaaagaaaataatagagcatccaagccccactccactcctgctactctgcaatggctggaggagaactatgagattgcagagggggtctgcatccctcgcagtgccctctatatgcattacctggatttctgcgagaagaatgatacccaacctgtcaatgctgccagctttggaaagatcataaggcagcagtttcctcagttaaccaccagaagactcgggacccgaggacagtcaaagtaccattactatggcattgcagtgaaagaaagctcccaatattatgatgtgatgtattccaagaaaggagctgcctgggtgagtgagacgggcaagaaagaagtgagcaaacagacagtggcatattcaccccggtccaaactcggaacactgctgccagaatttcccaatgtcaaagatctaaatctgccagccagcctgcctgaggagaaggtttctacctttattatgatgtacagaacacactgtcagagaatactggacactgtaataagagccaactttgatgaggttcaaagtttccttctgcacttttggcaaggaatgccgccccacatgctgcctgtgctgggctcctccacggtggtgaacattgtcggcgtgtgtgactccatcctctacaaagctatctccggggtgctgatgcccactgtgctgcaggcattacctgacagcttaactcaggtgattcgaaagtttgccaagcaactggatgagtggctaaaagtggctctccacgacctcccagaaaacttgcgaaacatcaagttcgaattgtcgagaaggttctcccaaattctgagacggcaaacatcactaaatcatctctgccaggcatctcgaacagtgatccacagtgcagacatcacgttccaaatgctggaagactggaggaacgtggacctgaacagcatcaccaagcaaaccctttacaccatggaagactctcgcgatgagcaccggaaactcatcacccaattatatcaggagtttgaccatctcttggaggagcagtctcccatcgagtcctacattgagtggctggataccatggttgaccgctgtgttgtgaaggtggctgccaagagacaagggtccttgaagaaagtggcccagcagttcctcttgatgtggtcctgtttcggcacaagggtgatccgggacatgaccttgcacagcgcccccagcttcgggtcttttcacctaattcacttaatgtttgatgactacgtgctctacctgttagaatctctgcactgtcaggagcgggccaatgagctcatgcgagccatgaagggagaaggaagcactgcagaagtccgagaagagatcatcttgacagaggctgccgcaccaaccccttcaccagtgccatcgttttctccagcaaaatctgccacatctgtggaagtgccacctccctcttcccctgttagcaatccttcccctgagtacactggcctcagcactacaggagcaatgcagtcttacacgtggtctctaacatacacagtgacgacggctgctgggtccccagctgagaactcccaacagctgccctgtatgaggaacactcatgtgccttcttcctccgtcacacacaggataccagtttatccccacagagaggaacatggatacacgggaagctataactatgggagctatggcaaccagcatcctcaccccatgcagagccagtatccggccctccctcatgacacagctatctctgggccactccactatgccccttaccacaggagctctgcacagtacccttttaatagccccacttcccggatggaaccttgtttgatgagcagtactcccagactgcatcctaccccagtcactccccgctggccagaggtgccctcagccaacacgtgctacacaagcccgtctgtgcattctgcgaggtacggaaactctagtgacatgtatacacctctgacaacgcgcaggaattctgaatatgagcacatgcaacactttcctggctttgcttacatcaacggagaggcctctacaggatgggctaaatgactgctatcataggcatccatatttaatattaataataataattaataataataataaacccaacacccatcccccagaagactttatctctatacattgtaactcatgggctattcctaagtgcccattttcctaatgaacatgaggatgggatcaatgtgggatgaataaactttagttcagaaacaggacttactaaaagtcagtgggactgggtttctgtagccaagccagacttgactgtttctgtagagcactatctcgggcaggccattctgtgccttttccctctgttccatgactttgctttgtgttggcaaccacttctagtaagctactgattttcctgttgacaaaatctctttagtcttgaaggatggatactggagacagaatctggtttgtgttcttggatgggcacataatttaccaagagcattcaccttgccatctgtcttgtcattgtactgtacaaggaacagccctcagacgtgttctgcacatcccttcttcctggtggtaccatccctatttcctggagcaccagggctaaatggggagctatctggaaactctagattttctgtcatacccacatctgtcacagtacctgcattgtcttggaatgtaagcactgtcttgagggaaggaagaggtctgttctgtattgccttaagttgattgaggtttgtaggagactggttcttctacatacaaggatttgtcttaagtttgcacaatggctagtgtcagcaaaaggcaggagagggtttttgttttttttttaagttctatgagaatgtggatttatggcattgagtatcacactcagctctgctgtgttaactttgtgaaactggatggaacaaactttaacttaccaagcaccaagtgtgaaagtgactttcacggttccttcataaaactataataatatccgacactttgatagaaaaaaattcaaagctgtgcctttgagcctatactatactgtgtatgtgtggaaataaaaatgtattgtacttttggagaattttttgtaggcatttttctgtcagatttgtagtaatttgtgaggtttgttagagattaatataggttttctttctgtattataaaatgcaccaagcaattatggtggacctattaccctatgggtaagaaataaatggaaatatgacatcggatgtttcagcaactgttctgtaaataaaatctttgatcacaccactcagtgtgataattgtgtctacagctaaaatggaaatagttttatctgtacagttgtgcaagatatgaatggtttcacactcaaataaaaaatattgaaacgaaaaaaaaaaaaaaaa

SEQ ID NO: 62350 - DNA, 5425 bp, Homo sapiens
ggcaaagggcctcagccccgccctactgactgtgaattctacaacatatggagcgcctaccttgtgcaaggcattgtggcccttcagagacttgaagacagtgtgtgactctcctgtgagttaagagcactggctgagtcagacagacccgagtgacaagcccagcttcgctccctctcagcggtgagagccaagattttcttgcctcctgggctccctccacactatcctgtggctgtggcagatatgtcaatacccttacattcactgcgattcaacaatacaatgagggaggaaaatgttgagccccaaaacaagcagatggccttctgtagaccaatgacagagaccagagcagacgtacagattctgcattctcatgtacagttgcctatagtctcaacttcagcctcagaccctggagggacatccacacagttgatgacatctccagtctttgacaccatgtctgcacctctaatgggagtaccaaactctggagcattgtccccacccctaatgccagcctcagactctggggcactttccccattgctaatgccagcctcagactctggggcactgtccccattgctaatgccagccttagattctggaacattgtccccattgctgtccacttcagagtatggggtaatgtccccagggatgatgacaattcctgattttggaacgatgtccgcaacgctaatggtagcaccagattctgcagagatatcaccattggcaatgccagctccatcctctggagtggtgtgtacacctataatgagcacttcatcctctgaggcaatgtccacaccattaatgctagccccagattctggagagttatccccaattctaatgcaagatatgaatcctggagtgatgtctacacagccagtgccagctcccagctctgaggcaatgtccccattgcaaattacagatgaagacaccgaagcaatgtccaaagtgctaatgactgctctagcctctggagagatatcttcgctgctaatgtcaggcacggactctgaagcaatatcctcactgataatgtcagctgtagcttctggaggaacatcaccccagccaacaagcacccaaaactctgggggaatacctaccccgctcatgtcagatctagactctggaataatgtcatcgcttttaatgtcatctccaggctctgaagtaatgtccacaccgctactgtcagtcccagatgctggagaaatgtccacattaccaaagccagctccagatgctgaagcaatgtccccagcactaatgacggccctaccctctggagtgatgcccacccaaacgatgccagccccaggctctggggcgatgtccccatggtcaacacaaaatgtagactctgaaatgatgtctaatccgccagtgagagcaacagcctctggggtgatgtctgcaccaccagtaagagctttagattctggagcaatgtccacaccgctaatgggagccccagcctctggaaatatgtctacattgcaaaagacagttccagcctctggagccatgaccacctcactgatgacagtcccaagctctggagtgatgtccacagagcaaatgtcagccacagcctctagagtaatgtccgcacagttaacaatggccaaaacttctggagcaatgcccacaggctctatgaaagccgtggcaaaacaatacaagagagccacagcctctggaaagatgtccacgccactgaggagagctccaacttctggagcaatgtccacccaaccagttacggcaacagcctctgaaacaatgtccatgccacaattgacagtcccagcctctggatcaatgtccatgctgcaaatgagagcccctgtctctgaagcaatgtccatgccacaaatgagaaccatggcctcaggattgacatctgcagcacagatgaaagccatgacttctggagcaatgtccaccccactaatgacagcccaaacctctggatcaacatccacgctgttaatgagagacacagcctcaggagtgatgtcctgtccacaaatgagatctctggcctctggagcattgtccaagccactaatgacacccaaagcctcaggaacgatgttcacggagaaaatgacaaccacagcttctgaagcaatgcccacactgctaatgagagacacagtttctggagctctgtccatgccgcaaatgacagacacagcctctggagggttgtctgcatcgctaatgagagacacagcttctggagcaatgtccacatcacaaatgacagccacagtctctggagggatgtccatgccactaatgagagctcaagacccaggagtaatgcctgcctcactaatgagagccaaagtgtctggaaagatgctcagtcagccaatgagcacccaagatcctggagggatgtccatgtcgcccatgaagtccatgaccgctggagggatgcagatgaattccccaacctctgatgtgatgtccacaccaacagtgagagcctggacctctgaaacaatgtccacaccactaatgagaacctcagaccctggagagaggccctcactgctcacaagagcttcatcctctggagagatgtccctaccactaatgagagctccagcttctggagagatagccacgcctctgagatccccagcttatggagccatgtctgctccacaaatgacagccacagcctctggaatgatgtcatccatgccacaagtgaaggctcccatctctggagcaatgtccatgccactaacaagatccacagcctctggagggatgtccatgccactgatgagagccccagactctagagtgacatccacatcacaaatgatgcccacagcttctggagacatgtgcacactaccagtgcgagccccagcctctggaggggtgtcctcaccactagtaagagctccagcctctggaactatgtccacaccactaaggagaccctcagcctgtgagactgtgtccacagagttaatgagagcttcagcctctggacatatgtccactgcacaaacaacagccatggtctctggagggatgtccaagccattaatgagagccccggcctctggaacaatgcccatgcctttaatgtcagccatggcttctggagagatgtctatgccgctaatggaaaccatggcctctggagcaacgtccacattgcaaaccagtgttgcgaactctagatctatgtccttgtcacaaacaacatataccgtgtctggaaggatggccacagcgccaattagagcctctgcttctggagcaaggtccacatcatttatgagagcctcagtttctggatcgatgcccatgccactaccaagagccacagcctctggatgtggcatgggtatgtccatgccacaaatgacagccacagactctagagggatgtccacaccactaatgagggcctcaggccctggaacaatgtccacaccacagacagcctttggagtgatgtccactccggaaatcaaagccacagactctggagaggcatccacctctcacattaacatcacagcctctggatcaaagcccacatcgcacatgactgccacaactcctgaaactgcgaaaccaccaccaaaggaagtgccatccttcggaatgttgaccccagcactctgctacctcttagaagagcaggaagcagcccggggctcatgctctgtggaggaagagatggagattgatgaggagaagcaaatgaaggggtttttggacgattcagagagaatggcatttctggtatctcttcatctgggagcagcagagaggtggttcatcttgcaaatggaggtaggagaacctctctcacatgaaaataaatctttcctgagaagatcccagggcatatatgactccctatctgagatagacatcctcagtgctgttctttgccatcccaaacagggccaaaagtcagtcaggcagtatgccactgacttcctgctgctggcccgacatttgtcttggtctgatgccattctacggaccaggtttctggaaggactctcagaagctgttaccaccaaaatgggtcggatcttcctgaaggtggctggcagcctaaaggagctgatagacaggtctctgtacaccgagtgccagctggctgaagagaaggattccccaggcaactcaagccaggttctgccaacagcctgtaagcggaataatgaggaggccatggggaatgaactgagctctcagcagcagactgaggagcaccagcatgtttccaaacgctgttactacctgaaagagcatggagacccccaagaaggtcttcatgatcaccttggacagagcacaggccatcatcagaaggcccataccaacaagtaaaactccatggaatcttctcctgtgatatctgactcgaccgctaactggaggactggttcctggacccattccattaaactacattataaaccttgttgccttcacccttcagcctcccgctccaggcacatcccaccttacctctcacttggctgatttgaccttctctttcacccacatgcctaagacctgccctgacaatcagagtatggactacaagagtgtatggtgtatgaggttctgaactcccatcaccaccgaggccagtcctagttcttggtccagggagaagtctaggcaggataaatcatatcttacctcaaaaaacccttagcgtatcttgccatgtgtcagcaggcaaacttgaggaagccctggttctatttcacctggcaggggagcctataaggagagcgatgcccactcctataccacccttgtaacccagtagacttgccccatatgccccaactcatagcacctaaaatgggtctccagggtccttgccctgtttatagtatccatcctgaaccattcgttttgacccataataatagtgatagtataatggctaccagttattgataatgtatcatgtgacaggcattgggctaaactcttgacaagcaccatctcactacattcttacagtaacacaacttgttcttgtgttgtcagcttctgacctcttgatctgttgtttatggcctttgtcttgtccctcagtgggggttctctagctctgacctctgggtgaccccctcagttgttgattgctctcactccccttggctgttgtgcttcatggccagcactcttgatgagggtcttggtctataaacaggcatagatagctagaacataatgtgagcagtgtttgccttcaggtggtggggttatgggtagtttttattttcttccttctacttctctatacatttcagattctctacagtaagcatgtgttacatttgtaattataaaagtaaataaacttcatttatgaaaaaag

SEQ ID NO: 62351 - DNA, 2161 bp, Homo sapiens
gtcaacatgaccgagtgcgtcccggtgcccagctccgagcacgtcgccgagatcgtgggtcgccagggctgcaagatcaaggccctgcgggccaagacaaacacctacatcaagaccccagtgcggggcgaggagccggtcttcatcgtgaccggccggaaggaggacgtggagatggccaagcgtgagatcctgtcggcggccgaacacttctccatcatccgcgccacgcgcagcaaggccgggggtctgcccggcgccgcccagggcccgcccaaccttcccggacagaccaccatccaggtgcgcgtgccctaccgggtggtggggctggtggtggggcccaagggcgccaccatcaagcgcatccagcagcggacgcacacctacatcgtgacgcccgggcgcgacaaggagccggtgttcgcggtcactgggatgcccgagaacgtggaccgcgcgcgcgaggagatcgaggcgcacatcacgctgcgcactggcgccttcaccgacgcgggccccgacagcgacttccacgccaacggcaccgacgtctgcctggacctgctcggggcggccgccagcctctgggccaagacccccaaccagggacgacggccccccacggccacggccggcctccgcggggacacggccctgggcgcccccagcgcccccgaggccttctacgcgggcagccgcggcggcccctccgtgccggacccaggccccgccagcccctacagcggctccggcaacgggggcttcgccttcggcgcggagggtcccggtgccccggtggggacggccgcccccgacgactgcgacttcggcttcgacttcgacttcctggcgctggacctgaccgtgcccgccgcggccaccatctgggcgccttttgagcgcgccgcccccttgcccgccttcagcggctgctccacggtcaacggagccccgggacctcccgccgccggcgcccggcgcagcagtggggccgggaccccccgccactcgcccacgctgcccgagcccggcggcctccgcctggagctcccgctgtctcgccgtggcgccccggacccggtgggcgcgctgtcctggcgacccccgcagggccccgtatccttcccaggcggcgccgccttctccacggccacctcgctgcccagcagccccgcggccgccgcctgcgcccccctggactccggcgcctccgagaacagccgcaagcccccttcggcgtcctcggccccggccctggcgcgagagtgcgtggtgtgcgccgagggcgaggtgatggctgcgctggtcccctgcggccacaacctcttctgcatggactgcgccgtccgcatctgcggcaagagcgagcccgagtgtcccgcctgccgcacgccggccacccaggccattcgcgtggagacggagaccccgcagcccggcggcgcctcagcccttcaacgacagtattgagtggtcaggttacaataaaccggagagaaaaggtccgcttgcactttttttagttttcttatttttagacacccctcccctccagggtgatctttaaaaaagcaaaacaaaaaacacgacttttccagcgctcagcgttttttcctttcgtccgaagccgttttctgatttgacttttctcgccggccggtctcaggccgcacagacgttccagaggaggagggtgacatttttactccctttttggggctaaccatttatgcttttgtacatcaaccgtgcgcggccggagggggcaggggggcgggggcgaggggcgttccaatcaaatttctaactttctgttaattattaatcccctttttactgcggtttctgttgtcatttttaaaatttttttaattttttttttttttttacttttactttttacctcttgtgtatatgtagggaatttatagggaaatatgtactttatggaataaattttaagaactaaaatatattttattttaaataaagtaatggacctttaatcttacacagctaaattactgattatatatttgctgagctgatttaagggttaaaaaaattgtatcaagagttttattttttgacttcaaagccttcttaataaagcctcttttctacatgtgaaaaaaaaaaaaaaaaaaaaaaaaaaaaa

SEQ ID NO: 62352 - DNA, 1377 bp, Homo sapiens
cggtgttggcggcccgagcggctgcagttgcaggggcgggggaggcggcggcggggcccgggagaggggtggcgtgggggaccggcgcgtagccgggaccatggaggggcagagcggccgctgcaagatcgtggtggtgggagacgcagagtgcggcaagacggcgctgctgcaggtgttcgccaaggacgcctatcccgggagttatgtccccaccgtgtttgagaactacactgcgagctttgagatcgacaagcgccgcattgagctcaacatgtgggacacttcaggttcctcttactatgataatgtccggcctctggcctatcctgattctgatgctgtgctcatctgcttcgacattagccgaccagaaacactggacagtgttctcaagaagtggcaaggagagactcaagagttctgccccaatgccaaggttgtgctggttggctgtaaactggacatgcggactgacctggccacactgagggagctgtccaagcagaggcttatccctgttacacatgagcagggcactgtgctggccaagcaggtgggggctgtgtcctatgttgagtgctcctcccggtcctctgagcgcagcgtcagggatgtcttccatgtggctacagtggcctcccttggccgtggccataggcagctgcgccgaactgactcacgccggggaatgcagcgatccgctcagctgtcaggacggccagaccgggggaatgagggcgagatacacaaggatcgagccaaaagctgcaacctcatgtgaggggctaggagagggcagagtgtgaagaggggtggtgagggacacaattgttcccctgcctgcgcccaggcttcctgacctcctgatcctggctgggaagttagggcaggcagagcgagcaattctgggcaggggagctggagggcagaagggtatcatcgtttctcatctcctcctccctcctcttctccagtggatgttgagggagctaacagggctggcatctggggcatgaactgggatggggcaggtgggcgttagggaagctggtatcaaatggtgaccttggtggagtctcctatgtgaagagtaccctccctctccacccccagtccccatatcctggttctggcccaaggaaaatgtccattctatgaccttctcttttcctctcctctcacttctgcagctattctcacacatctaacctctaggcaacatgcactaaattcaaaagcaaggagaagcccttgccccccatcagtccaccagccctagaacctcccttgcctcaacagtcacctaataaagcccacctccatggaaaaaaaaaaaaaaaaaaaaaaaaaaaaaaaaaaaaaaaaaaaaaaaaa

SEQ ID NO: 62353 - DNA, 1393 bp, Homo sapiens
ggcacggccgttgggagcctgagactcaaacatggcagcgccaccttctccaggaaggacggccgaccaagcagaccaggtatgcaccttcctcttcaaaaagcctggacggaaaggggctgcaggcctcagaaagcgcccggcctgcgaccccgagcacggagagagcagcagcagcggggacgagggcgacacagtggctcagcccccgcgggtggcaccgaggccccggggcctccacagctggcagaaggcggctcacggcgacaggaggggcgaggaggcggcgcctgagagcctcgacgtggtgtacaggtccacccgctcggcgaagcctgtggggccggaggacatgggggccaccgctgacttcgagcaggacaccgagaaggagcaccatacgccgaccatcctcaagtgcagccagcgggtccaggaggcactgcggggtcgggagcacgaccacatctaccggggaatccacagctacctgaggtacctgaagcccaaggacacgtccatgggcaactcctcctcggggatggcgaggaagggccccatacgtgcgccagggcatctgcgcgccactgtgcgctgggattaccagcctgacatctgcaaggactacaaggagactggcttctgtggcttcggggacagctgcaaattcctccacgaccgttccgattacaagctcgggtgggagattgaacgggagcttgaagagggtcgctactgtatctgcgaggacgaaaaccatgaagtgggaagcgaggaagaggaaataccattcaggtgtttcatatgtcgccaggccttccaaaacccagtcgtcaccaagtgcaggcattatttctgcgagagctgcgcgctggagcacttccgggccaccccgcgctgctacatctgtgaccagccaaccggcggcatctttaaccccgccaaagaactgatggcgaaactgcaaaagcttcaggctgcagaaggaaaaaagagataagaaagactcaagtctgtatgtacactggggagaagcagcctgttgagtaagatgagagagatgacagtcttcctgcaatcccatgcctgagtatgtaaccaaaagaattgaaatccggatctcaaagaggtatgtgcactcccatgttcactgcagtattatttgcaaaagccaagaggtgtaaacaacccaagtgtccatggatggatgaatggacaaacaaaatgcgatacacacacacaatggaatgctattaagccttaacgggaaggaaatcctcttaaagatttaaactgatccttttaaggatcacatgctacaactagaatgaaccttgaagacgacactgctaagtgaaataaactagtcacaaaacgaaaaaaaaaaaaaaaa

SEQ ID NO: 62354 - DNA, 1446 bp, Homo sapiens
gcagtatctagagttaacagtaggggatttatttttcaatctaaagtttttcacctctctctagtaagacatctgaaactcataagccatctttaagaatttcttacaaaaacatgctggaagacagtggatcttgtttgtatcctgaagatttttttctcttcgttattttaaattaattgtcaacagatgtgcaactgttaggttggttcttaagtcactcggagaagagagagatgcatctactcaaggttggcacttggagaaacaacactgcctcttcctggcttatgaagttcagtgttctttggcttgttagtcagaactgttgcagagcaagtgttgtttggatggcttatatgaacatatcatttcatgttgggaatcatgtgttgtcagagttgggagagactggagtctttggaagaagctccactttgaagagagtggcaggagttatagtgccaccagagggaaaaatccaaaatgcatgtaatcccaataccattttcagccgatcaaagtactcagagacctggcttgcacttattgaacggggaggttgtaccttcacacagaaaattaaagtggcaactgagaagggagccagtggagtgatcatctataacgttccaggtactggcaaccaggtgttccccatgtttcatcaggcatttgaagatgtcgttgtggttatgattggtaacttaaaaggcacggaaattttccatttaattaagaagggagttctcattacagccgtggttgaggtggggagaaagcacatcatctggatgaatcactatttggtctcttttgtgattgtcacaactgctaccttagcatatttcatcttttatcacattcatagactttgtttagcaaggattcagaaccggagatggcagcgattaacaacagatcttcagaacacatttggacaactccaacttcgagtagtaaaagagggggatgaagaaataaatccaaatggggatagctgcgtaatttgctttgaacgctataagcctaatgacatagttcgtattctgacttgtaaacattttttccacaagaattgcattgacccctggattttaccccatgggacatgccccatttgcaaatgtgatattcttaaagttttggggattcaagtggttgttgaaaatggaacagaacctttgcaagttctaatgtcaaatgaactgcctgaaaccttatcacctagtgaagaggagacaaataatgaagtttctcctgcaggaacctcagataaagtaatccatgtggaggagaaccctacttctcagaataatgacatccagcctcattcagtagtggaagatgttcatccttcaccttgatggcatgacttttgaggaagtgtattaaacctgtatgtgaaatcaggtcctaatactgacaagcagtttgtctgttaaa

SEQ ID NO: 62355 - DNA, 804 bp, Homo sapiens
cgcagatcatgggtggcgggtatgatctcaacctcttcgccagccctcctgacagcaacttcgtgtgctccgtctgccatggggttctcaagaggccagcaaggttgccatgcagccacatcttctgcaaaaagtgcatcctccggtggctagccagacaaaagacctgtccgtgctgtaggaaagaggtgaaaaggaaaaaggttgtccacatgaataaactccggaaaaccattggccgcctggaagtcaagtgcaagaacgccgacgctggctgcatagtgacatgccccctggcccatcgcaaggggcaccaggactcatgcccctttgagctaacggcctgccccaacgagggctgcacctcgcaggtgccgcgtgggaccctggcagagcaccggcagcattgccagcaagggtcccagcagcgctgccccctgggctgcggggccaccctggacccggccgagcgtgctcgccacaactgctaccgggagctgcacaacgcctggagcgtgcgccaggagcgccgtcggcccctgctgctgtccctcctgcggcgtgtgcgctggctggaccaagccaccagtgtcgttcgtagagagctggcggagctcagcaacttcctggaggaagacaccgctctgctggagggtgccccacaggaggaggccgaggctgccccagaaggcaacgttggggctgaggtggtgggggagcccagggccaacataccttgtaaataggtaaataaaagcagacccccggcctgcctgcctctgtgcctgcggccctcataaatta

SEQ ID NO: 62356 - DNA, 3090 bp, Homo sapiens
gaaaccggaggacgcccggtagccgcccccaccgcctccgccccaggcaaggccggccggcgccgcggaaagcagcctcggggaaggaggaggaagaggggcaggtgtagggagtgaagaagcaaaaagaggaggaggaagaggagctcagggccgtccccgcgcaattaatgggcggctcctgcgccctggaccggcccgcccgcccagcccctcgacccctgtagccccggcaggggaggaagggcagacccacaggtcagggattaggaatcatgttgcatgacgcaagggacaggcagaagttcttcagcgatgttcagtatctgcgggacatgcagcataaggtggactctgagtatcaggcttgtctgagacgacaggaatatagaagagacccaaatgagaagaaacgcgatcagttttgggggcaagagacaagttttgagagatcccggttttctagcaggtcatcttccaaacagagttctagtgaggaggatgctctaactgaaccaaggtcatctatcaagatatctgcatttaagtgtgactccaaacttccagcaattgaccaaacatcagtcaagcagaaacataaaagtaccatgactgtaaggaaagcagagaaagtggaccccagcgaaccctctccagcagaccaagcaccaatggttttattaagaaagaggaagccaaacctgaggagatttacagtcagcccagaatcgcacagcccgagagcatctggggacagaagcagacagaaacagcagtggcctgcaaaggtgccggttcccaggggagcagatcaagtagttcaacaagaaggcctgatgtgtaacactaagctgaagaggccaaatcaagagagaagaaacttggtcccatcgtcacagccaatgactgagaacgcccctgatagagccaaaaaaggagacccgagtgctccttcccagagtgagctgcatccagccctgtcccaggccttccaaggaaaaaatagtcctcaagtattgagtgagttctcggggccaccactcacacccaccactgtaggagggccaagaaaggcatcatttaggttccgagatgaagacttttattccattttgtcattgaacagcagaagagaaagcgatgacactgaagaggaaacccagtctgaagaatgtctgtgggttggtgtgcgctcaccctgttctccttcccatcacaaaagaagtagatctggggggacatcgacccctcaggccaaaaataaaaattttgaagaaaatgctgaaaattgcagaggtcattcttcaagaagaagtgagcccagtcatggctcattgagaataagcaatgcaatggagccagcaacagagcggccttctgctgggcaaaggttgtcccaagaccccgggctgcctgatagggaatctgctacagagaaggacagaggtggcagtgaaaatgcgaaaaagagccctctttcgtgggacaccaaatccgagcccagacaagaggttggtgtcaatgctgaaaatgtatggagtgattgtatttctgtggaacataggcctggcacccatgattctgaaggatactggaaagactatttaaacagttctcaaaattctcttgactactttatttctggcagaccaatatctccaagatcatcagtgaattcatcctataaccctcctgcatcattcatgcattctgctctgagagatgatattccagtagacttgtcaatgtcatcgacttcagttcacagctcagactcagagggaaactcagggtttcatgtttgccaaccactgtctcccattagaaataggactccatttgccagtgccgaaaaccataattatttcccagtaaatagtgcacacgaatttgctgtcagggaagcagaagatactactttaacaagccagcctcagggggctccactatatacagatctcttactaaatccacagggcaatttgtccttagtggattcttccagctcctctccatcaagaatgaactcagaaggccatttgcatgtgtctgggtctctgcaagaaaatacaccatttactttctttgcagtgtctcatttcccaaatcaaaatgataatgggagcaggatggcagcctctggtttcacagatgaaaaggaaaccagtaagataaaggcagaccctgagaaactcaagaaattgcaagaaagtctcctggaggaggactccgaggaggagggagacttgtgtcgcatctgtcagatagccgggggttccccaagcaaccccctcctggagccttgcggctgtgtgggaagcctgcagtttgttcatcaagagtgcctgaaaaagtggctgaaagtgaaaataacatcaggagcagatcttggtgccgtgaagacctgtgagatgtgtaagcaaggcctgctggttgacctgggtgactttaacatgattgagttctaccagaagcaccagcaatctcaggcacaaaacgagctgatgaattcaggcttgtacctggtgctgctgcttcacctctatgagcagaggtttgcagaactcatgaggctcaaccacaaccaggtggaaagagagaggttgtcaagaaattacccacaacccagaacagaggaaaatgaaaattcggagttgggagatggaaatgaaggcagcatttctcaaagccaggtcgtctagcaaggaagccaactgtggagctcggcggagacctctcccgccagcccttctttctacgtccccaagtgcctccctccctcctcctctttactgaaactgaaaccaaagcgttcacagttagattttcaccttgtgccactctcttttggggtctggcttgagcatctatgggcagccacagcgaccagtctagtcccagacagcacaggtcaagcagcgtgggactgtggagcccctggcaggctggcctggtgctgctcccttagcccagaagccctgccaggtccagtggcctggggtcccactgctgagggcacctgccaggcctcactccaccctgaatggactcgagccatgtattcattcagtaaactgacattattctccc

SEQ ID NO: 62357 - DNA, 4153 bp, Homo sapiens
gcggggcggggcccctgcgggcttgcagcgggctactgtttgccggagcctcccggcgcgcccccgcgagccccctcccgtctggcgcgcgaccccgccgcttcgaatgttgtgaatcaaatgtggggtttgttacattccgctgccgccgcggacagttcttaaagggccagccgccggctgccgcgcagacccagctgcgtcctgcgccgcctcccgctccctgagggcctgggccgagagagactgatcgcgcgtgggcctcgcgaggcagacgccgtcgggcggacaacaaagagagaggccccggaaggagccgggctgcccccggacccgggggtggggaggggagcacattgttccgcagggcgggagctcttaaaggatccagacaggcaccccccccctcccccgccccctgcccagtttggccgtcctagatcgggaacaaaggagtcaacgtgtggccgggcggccaaagggttgtgagtcccggcccagcccctccacccccctgcccccccgatgcgaccatgggctctggcagtgactaggtggccaccctccgcccccgtgggccagcggcgattctctgcgggacctggcagcaccccgggccagctctggggaagccctggcctcgagggccccctggccagcccgcctgcccgggatgagcgcttaccctcccagcagccgccgtcccgacctccacacctccccgtagaggagcgccgagcctcggctcctgccggcgggagcccccgaatgctgcacccagccacccagcagagcccgttcatggttgatctccacgagcaggtgcaccagggacctgtccctctgtcctacacggtcaccacagtgacgacccaaggcttccccttgcctacaggccagcacatccctggctgcagtgcccagcagctcccagcatgctccgtgatgttcagtgggcagcattaccccctctgctgcctcccgcccccgcttatccaggcgtgcaccatgcagcagctgcctgtgccctatcaggcctacccccacctcatctccagtgaccactacatcctgcaccccccaccaccggccccacccccccagcccacccacatggcgcccctggggcagtttgtgtctctgcagacccagcaccctcggatgcccctccagcggctcgacaacgacgtggacctgcgtggggaccagccctccctgggcagcttcacctactccacctctgcgcctggcccagccctttccccgtcggtgcccctgcactacctgccccacgatccgctgcaccaggagctgtcctttggtgtgccatattctcacatgatgccacggagactgagcacccagagataccgcctgcagcagccactgcccccgccgcccccacccccacccccaccaccctactaccccagcttcctgccctacttcctctcgatgctgccaatgtcaccaacagcaatggggcccaccatcagcctggacctggacgtggatgatgtggagatggagaactatgaggccctcctgaacctggccgagcggctgggagatgccaagccccggggtctcaccaaagcagacatagagcagctcccgtcgtaccgctttaacccggacagccatcagtcggagcagacgctgtgtgtggtctgcttcagtgacttcgaggcgcggcagctgctccgagtcctcccctgcaaccatgagttccacaccaagtgtgttgacaagtggttgaaggccaaccggacgtgtcccatctgccgggccgacgcctccgaggtgcccagggaggctgagtgaggccacgcagccgcctgcccgggagaaccctgcctgaagctctggaaacttgtgggtggggcccagggaggatggggagggagtggcccaggcctgccccttcgctcctgcctgcatttccagagctggtgccagggtcagcccagcgaggagtccctgcaataagcccctgcatttgccaagctccaaagactccctccctagtctgcctgcctgcccgcccgccacggagctgcctgagtgtccctgatcgggtctccctcctgtgcaccctcaggtccctccttttcctgctggcactgagtgccaggggtccgctccctcagtggggccggtggagatccttggccccaggatgggcagacagagcaccatcctgggtcagaaggtctcatgctctgaaatggcgtgccctctgcccaggtggcactgccaggtgcgtagacagacggtgtcacgagccatttcctgagccccagggctgaatcccccctccttgaccccgaacagtgaactcaggcagctggctctgtgttggctgctgtgagggctgagtctggttccctaggggaccctcatcccaggaacaacattccagccccaccctcaggctggagggcgtcccagcctaatcccgagctggggcacacgtatcctgaggggcttgggccatacggggagagggagccctgtgttcccggtggttgtccctcccagggatgcagccagacccgtgcccaatctcctctccctctgttgttttgcatgaacgtgaggagcagcagtttttgttcattcatttggcccaaaatcacgtgtaggatttggggatgtggatatttaagacaatttcttttttcttttggtttaataggggcgggtatagggaccaactgggaccgagtgcccagggggccgagcacggtcatgctggccggcctgcatgcatgcgtgtgccgggctgggctgggcggccggcggtcgtggggcagggttgggggtctgtgctcagctgataactgccatgcactgtactgcacacgtccctagagcctaccgggacccgacgcttttcagggcatttctccctccagccagggcccaactcccacctgcctgggcgaatctcctccaaggaagtcccaggaggatggggaccaggaaggctgtggacccccatctccagggggccttcccagcctgatccctgtcctccaagttctggaggaggccgctgtagggtctggctgagcttcccacccactttccctggtcccaatcctttcttgtcctatacccagctggggttgctgccctgaacgaactgcgtgtggggccggcacatcctagcaggcagcccctggcgcctgctgcctcagggatgctccaaccaccctcgttctcctcgcagtggccctggctcccacctcccgccccagcctgccgtggggcccgtcagcctggtcccacccccatggagaacccaaagtcttactgtatataactccaggtgacgtttctatatttatagcagtgttgaaaacccacgtgttttacacagaaccaccctctccaacccctcccttcccgaccccaacaaaacgttttcaaaccccttacagttcctggggcaggcggaaacaggctcacagattgtgtgtcggctgcagcagtgattccaacaagcagctattgggggggaaacacagcatttaaaaagatcatcattaaaaaacaagatttatacaacaattacttaggatgtttgtgatctgccgaccttgctatagatgccatgttaccaatgatttcctgtggtgggggcttgccattgtttactctcttatttaccaacttctggcctaggcatgacagtgggcaccttcccccagccctggctgggcccagcgcctgtgttctgtgttagaaaggttttatatatatataaaattacatatatatgtagaaatatatgtaattttgggggccctgttccttgcacattttacagttacctcatttttcccatgtatgtatttgagaaaatgctaatatatagagaaaaaaatggttcttaaagcttaaatgtgtggttttttccattccatgggattcacattggtttgtagcatttaacataactagtatgttgtattatatatatgtgtatactgattgaaatttttaacagatttgtactttttttaaaatgaaagttgctagttctgcttgaccaagtagtgcaatcattattttttttaatattgttgctgatttcagagggatattcactaataaatgtatgatgtataccaacgaccgcccacgc

SEQ ID NO: 62358 - DNA, 1018 bp, Homo sapiens
gccaggcgaaggcggagcgctaacgtctaacgctaacggcggtcgtgccccgccgctgctgtcacccccggccgctgctgccctccccgccgaggttctactgctctccttcttaagaagggtgggaggcactcggtctctccccacacctctcgcctgaggccaggcgccaggtgtcgcctgaagccagacagccggtttgggagcgagcctgaggtcaaccaatcaatggctcagacagataagccaacatgcatcccgccggagctgccgaaaatgctgaaggagtttgccaaagccgccattcgggcgcagccgcaggacctcatccagtggggggccgattattttgaggccctgtcccgtggagagacgcctccggtgagagagcggtctgagcgagtcgctttgtgtaactgggcagagctaacacctgagctgttaaagatcctgcattctcaggttgctggcagactgatcatccgtgcagaggagctggcccagatgtggaaagtggtgaatctcccaacagatctgtttaatagtgtgatgaatgtgggtcgcttcacggaggagatcgagtggctgaagtttttagcccttgcttgcagcgctctgggagttactattaccaaaactctcaagatagtgtgtgaggtcttatcatgtgaccacaatggtgggttgccccgaatcccattcagcaccttccagtttctctacacgtatattgccgaagtggatggggagatctgtgcatcacatgtcagcaggatgctaaactacattgaacaggaagtaattggtcctgatggtttaatcacggtgaatgactttacccaaaaccccagggtttggctggagtaacagcacaattttggcaattttaaaggaagatacagaggtgattgtacttcagaatgataaacccatataccacctaaaatcaattttcttgtacaactggtacacactaataaacaaacatgtgagatcagaaaaaaaaaaaaaaaaaaaa

SEQ ID NO: 62359 - DNA, 805 bp, Homo sapiens
tccttgtgcctcttggacttttttgtgtgtttaggtgcccaatggggagcaaactgacttgctgcctgggccccagcgggggcctcaactgtgactgctgcaggccagatgtgggaccctgccatgagtgtgagattcctgagactgtggcagccacagcaccagcatccaccactgcaaagcctgccaaattggatttgaaagctaagaaggcccaactcatgcagtacctcagcctcccgaagacgccgaagatgctgaagatgtccaaaggtttggacgcccgctccaagcgctggttaaaaataatatggagacggcacgggatttggcctctagaaaatataggtcccactgaagatgtgcaggcgtctgcacacggcggtgtggaggagaatatgacatcagatattgaaatacctgaggccaagcacgaccaccgtcccactgaagatgtgcaggtgtctgcacacggcggtgtggaggagaatataacgtcagatattgaaatatctgaggccaagcacgaccaccatttggtcgaagatctcagtgaaagcctatctgtctgtcttgaagacttcatgacatcggatctcagtgaaagcctatctgtctctcttgaagacttcatgacatcaggtctcagtgaaagcctatctgtctctcttgaagacctcatgacaccggagatggcaaaggagagatatgaagattacctctgctgggttaagatggcacggtctcggctcaatgaacccatcagcagccaggttctaggacttctccggctttagtgttccaa

SEQ ID NO: 62360 - DNA, 3156 bp, Homo sapiens
aagtgctgtctgtgatgtttggcaagcctggtttatatccatctacaaggtttgcgaacccatgttgccaacaactcccttggtacaataaaaaagacgagtatttacttttcattgaaagtggagaacctgaaaaggaacctggaaagaagcagctggaaaaggtgagaggaaaacctagagtgtgtgttatcctgcaagccaattgagaatggagcttgcttgatatttcactagataaagaatttaaggcgagtatctatctttgttctccttggcaactgagagtctgcccttggaaacatcaggcaccatggggaagcgggataatcgggtagcctatatgaatcctatagcaatggccagatggagaggcccaactcaatctgtgggcccaacaatccaagattatctaaatcgaccaagacccacctgggaagaagtaaagaaacaattagaaaataaaaaaacaggttcaaaagcattagctgaatttgaagaaaaaatgaatgaaaattggaagaaagaacttgaaaaaagcagagagaaattattaagtggaaatgagagctcatctaaaaaaagagaaagaaagaaaaagagaaagaagaaatcttgtcggtcttcatcttcttcatcaagctctgattcttcaagcagttcttcagattctgaggatgaggaaaagaaacaaggaaaaaggagaaagaaaaagaagaaccgttcatacaaatcatcccaaagctctacgcatgaatcagaatcagagagcaaggagtctgtaaaaaagaaaaagaagtcaaaggatgaaacagagaaagaaaaggatgtaagaagcctcagcaaaaaaagaaagaaaagttaccctgatgataaacctttatcgtctgagtcctcatctgaatcagattatgaagaggatgtgcaagcaaaaaagaagagaaggtgtgaagagcgagaacaagcaaaggaaaaagtaaagaagaagaagaagaaacagcacaagaaacatagtaagaagaagaaaaagaagtctggatcaagtcacaagtcaaggtaacatcaagaaaaaaagcaagaatgagtttgccgagttcccctgtgttagtagaattatttctggactttgagttgcctatcaaatcccactgtgccagtaaggggcatagtggctgctggcaacttcaatatacatttttgtttgtttgcttgtccttccttctaatggttaattcctctgagagctaaaattctgttgtcataccagtgaataaaatgtttgaaattaaagtaaaatgtgttagataatgaataacttcgacaaaaaaaagtgtatctaaggttaaatgtatctaattcgaatacatctttgaaatatcaccatcaatgaaacataaatgtaatttccagacaattgtagttggtatttttgatgcaaggacttaatattgatgtctcaaattccttgcttttgtaaataagtttagttcattttccttttttctttaatgaatctttgtttacatggggaaagagcatgtggggtgggaagggcaagtgtttgctaatcactgtggctagctgaatagtgtgcctttgactcttacacatcctatttttgccagagcagcagccgtccttttcttactttatgaaattctggggtgttgtatgctgcttcaagtgaacaagaaggacaggagtttacagcataagtaagcccccatatctatgaaatttacctcttcttcagcactgtttactatacagtactgaataatatttagtattacaatattacatgatttgaaataactttatacccattttgtatgggaaccattctaaacagaccctgatgttgtttgattaagaaatattctgaaattttttttgcatgttttatactgttaagttttaattatctgaccatattctatataactgatgatccttttttaagatatgatttatgcttaggatataagtttcaagtttttagtttcttagccttgctatattaatttcattactgtgtttaattgcacccttgccaaaatatttagcatgtgaaaaggttttttttaaaaaatatgtaatgccttcatattgaagctggttactgtacgcaagttgagtgccagacctctagtacgccgtatgttacatgaaactactgccaaaatcttagtaagattgttgttgaaaagattgttgtcttaagcattaatattgaatttatatagaagttaaatgtagatgataatgacatcattgatcttcctgtgtccgtattttcctacaatttggtgccttgtatctgttgctgattcacttttaccactagtgtaaaaataagtgaaaaaatatttttactttacatttttatatatcagagtaacataaattataaatttgtgtctcaaaaccacctgtgatggaggatgtgctaattgtaatgtcataggtacaaagtattttggcatgatgaaaagctcaatagctattgtttttcaatagcagattttatctcggctaccttcaatcacaagtaaaattataaagataaaaaacatctacataaacatgttggctgccaaattttttgcattggaaatactggaatctctcattaaagttcttggaacattatagtgatgccatgttagattaccttggagcttcataactttagctttttcctaaaaatatatgtttatgctgataaaaactattacatttatgggatattttgtatccatatagagtttttcagaattgttcattaaaatgctttttataagcttatattatttgtagaatatggcaaaagcatttacagctcatcatgtatctatctgctcctgttcacttccaaacctcttgtagttaggcaatgccatttgactacttcaagcagagggattgtaaacagaagtgattttctatttccatgttggactgtaaaaagttctgcatgaccctccagttttcttttgcctgtcatggtgacctgaaagcaagatgttccaaatggcatacttacaagacggatgcaacctgggtccttaggtcgctgtttagaagggacctgactggagtgctgatggacttgcagtaaactttttaagtgtaagaaataaactgttatgtgtt

SEQ ID NO: 62361 - DNA, 3428 bp, Homo sapiens
tttccgtcctcccaccttccctgacgcctccgtcacctccccctcaacgactgcaaaagagcctaaaccaaaatcccctagtttctattgaacactatcgctgtgtgtaccaattcctggactaggtcggcgtaagagaggaagtaggtgaaaaaaataaagaggcgctcccctccacgtgatcccagccctgcctctttagtgaggcacgcggccgggcggctccaaggctgccggctagggtgagcagcggagcgcttgggcttggagtagcaaagaacgcgctctccagagaaagtatagccactgcttagacagccagggaaacgtgtgcggggaagtggaggactcaggctctcgtgcgagagcggagttggacgtgcagggccgctggggtcacgcggagctctcccgcctcccctccgcgtgagctctgggatggtccgcgccgggagcgcgcgcgaggcttgaagcgcgggtgaagcgcgcaggtcggagtgacagctgcgctgccggcccggctgcggtcagcaacgcgccatggacgcagagctggcagaggtgcgcgccttgcaagctgagatcgcggccctgcggcgagcgtgtgaggacccaccggcgccctgggaagagaagtcccgagtccaaaaatcttttcaagccatacaccaattcaatttggaaggatggaagtcttcaaaagatctgaaaaatcagcttggacatttagaatcagaactttcatttctaagtacgcttactggcatcaatataagaaatcactccaagcagacagaagacctaacaagcactgagatgacagaaaagagtattagaaaagttctacagagacacagattatcaggaaattgccacatggttacatttcaacttgaatttcagattctggaaattcagaataaggagagattatcttctgctgttactgacctcaacataataatggagcccacagaatgctcagaattaagtgaatttgtgtctagagcagaagagagaaaagatctgttcatgtttttccgaagcctgcatttttttgtggagtggtttgaatatcgtaagcgcacgtttaaacatctcaaggaaaagtacccagatgccgtgtacctctcggaggggccctcctcctgctccatggggatccgcagcgccagccggccagggtttgaattagtcattgtttggaggatacaaatagatgaagatgggaaggtttttccaaagctggatcttctcaccaaagtcccacagcgagccctggagctggacaagaacagagccatagaaactgctcctctcagcttccgaaccctggtaggactgcttggaatcgaagctgctctggaaagcctgataaaatcgctttgtgcagaggagaacaactagttccaaaacagtgaacgtggaggatgaagatgctgcgtggaggaacatgcaattttattcaatataaacatttgctattttctgcttagaaaccacaccctgaagacgtgctgtctatgcagttatggcacattatatggaaactctcatgacatgaaaaataaatacaactagttaagtataaaatgccaaataaaagtgacacgtacaatgtggtttataaaaataagcttaacatctgagaaaatgtaccaagtggttgtgtgtcctcagatgtgtggggaggatccatcccccacccactgcagcctcacaccgagtccaccttggacatggtggccacattactcagctgggagaagccacccttatcctggttcctgcctcctgggggctctggagacggatgcctatggcgcctcatctttaaactgtccttagtagcccaggggagccacaccctcactccctgcctccccccggtccgcatggtggcaccgtgaggcagtctcagcaagtcctcatgctgttcttggtcttccacaagaaagtgaagctgtcagcttaataacaagaatggcctaagacagcaaagacagcactgttcctgggctgggacgcaaggaatgaggtcctttatgaaagaaagacccccctgcatagcctaagtgctatatcgatcgtcccggatgtgccttaagaaccgtgacctcatcagtcgcccatttagcattgttaagatctgtgaacgcgtgttgtctcaaaccagtcagggccgtcatgactacgcagcagcagcagtttccaagacgggccagaaacgcatccacagcagtggcacccgcggctcaggggctcctcacagcccgggctggtgggagccaagaccagacagagtgggggtctccatctgttttctcttctccctcaaatacaggctgttttcatcgtgtctagtccagccctgtctgggccctgtgctaggcaataactcttgcagccctgaaggacctagggagcccagcccaccttcccacggactggggttccctcacatgtgcacttgaacccaggacccagcatcctccacacaccgtgacaatgggcaaaatcatcccaaaccaggctgccccagccccagcccagcaacagtgaactcccttgggtcaagacagtactcaacggccactacctccacgcttcccagagcctgcggcttgtccgtgagctccgtgcacttcaccaaagcccccatcccagcacacaggacccgtgtgtatgagacggtgtcattggaagtgagaagaaaacagtaaaagtgtccagttagataagtatctttttgcacctctgagagtagaattagaagtaaatatgacagaattgaacaataaattctagaagagttgccttgattcaaacaagtataattctcaagttatcacaaaatttcccacaaaaatttacaatcagcaaaatagtttccttatttctcatgtatcattttcatataattccatggtttcactaatattatatgttacaataagcctccattagtccctcaaaacgatgatataaataagtctgtacaacctagcatagaataaaaaactgaaaccaagattcccaacgtttttcatagcagccgggcacactttggtgaccccaacgagaaccctctcggcagcagccaggagctgttcaccttccagaagcagggcctgtggcagcctaacagggagaggccacggggcccaaaaacgcaacacgtctcaaggcaaacccgagggaggaacttggtctgggaggaagagagaactcgctcctcaaccaccccagacactggagtgtcaggaaagcactgagctgttggggcacactgcccagcccggccacagcagctcagccagtcacagctccacctccaacttctacagcagcaatttttagtgggaaagaacagctcatctccccctcatgtgaaagattaaattgtaaagcaaaaaaaaaaaaaaaaa

SEQ ID NO: 62362 - DNA, 4327 bp, Homo sapiens
ctggcgctgagctgtaggcgcgcgcctaaccgctttactgggctcactctatcgagaggtcggaggctgcgagtgtcgctgctgaaggctgtagtggaccgggctggatcgcggattctgagctacatcgcgggtttgggggtgcatcttggatttaggggtggatcgctgggtggggagggggatctcgaatttggagctgggtgggggtggaaaggccacgaggagccgcggcgtctcaggagcgggtggtgggcatctgagaagtcgccaccatgaggaagctcctcagttttgggagacgcctgggccaggcgctcctgagctccatggaccaagagtatgcgggtcgggggtaccacattcgggactgggaactgcggaagatccacagggcggccatcaagggcgacgccgcagaggtggagcactgcctgacgcgcaggttccgggacttggacgtccgcgacagaaaagacaggactgttctacatttggcctgtgcccatggccgtgtgcaagtggtcactctcttgctggacagaaaatgccagatcaacatctgtgacagactaaacaggacacctttaatgaaggctgtacactgccaggaagaggcttgtgccattattctcctgaaacgtggcgccaatccaaacattaaggatatctacggcaacactgctctccattatgccgtgtataatgaggggacttcactggcagaaagactgctttcccaccatgcaaatattgaagcactaaacaaggagggaaacactccacttttgtttgctataaattccaggagacagcatatggtggaatttttattgaagaaccaggcaaatatacatgccgttgacaatttcaaaagaacagccctcatacttgcagtacagcataacttgtcaagtatcgtcaccctcctgcttcaacaaaatatacatatctcttctcaagacatgtttggccaaactgccgaggattatgctttttgttgtgatttgagaagcatccaacaacaaattttggaacataaaaataagatgcttaaaaatcatcttcgaaatgacaatcaagaagcagcagccatgaagaatgaaagttttaaaacacaaggagcaagttcaaaagtctcgctctatcaccagtctggagtccagtggcatgatctcagattactgcagccttcacctcccaggttcaagcaattctcctgcctcagcctcccgaggagctgggacaacaggcacatgcgaccatgcccagaaacagcagctatgaagcctgaaaatttgaaaaaaagaaaaaaaagaaaaaaattgaaaaaaagaaaagaaggtgcaaaagaacacaacttaaaagtggcttcagaggaaaagcaagaaaggcttgaaagaagtgaaaataaacagccgcaggattctcaaagttatggaaaaaagaaggatgagatgtttggaaattttatgttgaagagagacattgccatgctcaaagaggaattatatgcaataaaaaatgacagtctcagaaaggaaaagaaatatattcaggaaattaaaagtattacagaaataaatgctaactttgaaaagagtgtaagactcaatgaagaaatgataacaaaaaaagtggcccagtattcgcaacagcttaatgatctgaaagctgagaatgcaaggctgaattcaaaattggagaaggaaaaacacaacaaagaaagactagaagctgaagttgaatccctccattctaacttggccactgctataaatgagtacaatgaaattttggaaagaaaagacctagaactagttttatggagagcagatgatgtttctagacatgaaacaatgggttctaatatttctcaactaacagataagaatgagttgcttactgaacaggtccataaagctcgggtgaagttcaataccttaaaaggtaagctccgtgagacaagagatgctctcagggaaaagacattggctttagaaagtgtacagctggacctaaagcaagcgcagcatcgaataaaggaaatgaagcagatgcatccaaatggggaagctaaagaaagtcaatccattggaaagcagaactcttcagaggagagaatacgtcaacgagaacttgaaaatctcttgcttgaacgacaactagaggatgctcgtaaggaaggtgataataaagagatagtcattaatatccacagagactgtcttgagaatggaaaggaagatcttctagaagaaagaaataaggaattaatgaatgaatataattatttaaaagaaaaactgcttcagtatgaaaaagaaaaagcagaaagagaagtgattgtgagagaatttcaagaagaactggtcgatcatcttaaaaaattttcaatgtcagagtctccactggaaggtacatcacattgtcatattaatttggatgagacatggacttcaaagaagaaattatttcaagtagaaattcaacctgaagaaaaacatgaagaattcagaaaagtttttgaattaatatcattactgaactatactgcggatcaaataagaaagaaaaatcgtgaattagaagaagaggcaactggatataagaaatgcctagaaatgacaataaatatgttaaatgcatttgcaaatgaagacttcagttgccatggagacttaaatacagaccaactgaaaatggatattctgtttaagaagctaaaacagaagtttgatgatcttatggccgagaaggaagctgtatcttcaaaatgtgtcaatttggccaaagacaatgaagttcttcatcaggagttattatctatgggaaaagtacaagagaaatgtgaaaaacttgagaaggataaaaagatgttggaagaaaaagtattaaatcttaagacacatatggaaaaagatatggtagaacttggtaaagtacaagaatataaatcggagctggatgaaagggcaatgcaggcaatagaaaaattagaagaaatccatttacagaaacaagcagaatatgaaaaacaattagagcagttaaacaaggataatacggcttcactaaaaaagaaggaactcacacttaaagatgtggaatgtaaattctccaaaatgaaaacagcttatgaagatgttacaactgaattagaagagtataaggaagcctttgcagtagcattgaaagctaacagttccatgtcagaaaaaataacgaaatcggataagaaaatagctgtgatcagcaccaagctctttatggagaaagagcggatggaatattttctcagcactcttcctatgaggccagacccagagttaccttgtgttgaaaatcttaatagtatagaactcaacagaaaatatattcccaaaatggccataagaattcctacttcaaacccacagacttcaaataactgcaagaactccttgactgagatggagctggactgtgcagaacaaataattacagaaacaaagaaaatcatcaacctatgtatcccctccaccagaaagcccatgatattgacacaaaacttttgctgcgttgggcccttgctcctatctactttcttctctagaatccactgccctagaatgagtaatttttcttaaaagcagagttggagccaccgaggaagcacaggcgagctcttcccatcatgcgctcactagtccccaacagaagaaccactgtcgcatccactgagcaggctcctgttgtggtgggttgtgtcatcccacgatgtcactcttgctgagtccccatcgcctctgtgttttggagcagttagagacacacagcagtctctgtgagtggctctgcgtgaaggattgttttctaggtgagatgcacatctcaacacagctgactgctcagactcagcaattccattctgcatctcctctggacacccccaggaccaccaggacaaccccatcatggccctgtcaccaggcccagtctggctccatgataaccaagatgcaggtccagagacaaccgccctacttggtgcctgcatctgaccccccttggtgggtagtgaccagcccaacatggaagaagccagggcagcatgcagccagctgccctgcagccccagatggcacctgggccttgggaagtcattctcaaaggggaagctggaaactttgatgtccctggagggaagggtgaacgtggcatctgaacaaccctggcagccagcagcatcttctcatccaacctgtgggacagaggccccctgcttgggaatgagatccatacctaaagggtcctggcccagtcaggcctcatcctgggccctggg

SEQ ID NO: 62363 - DNA, 1969 bp, Homo sapiens
aggttccctgagagctaccggccaggggtcgggaggctatgggagctcagggcaggcacctcccatgctcccgcgggagccaccaggacatgaaggcctcaggagccgggacactccctgagtcctctgggagcccttaagccacactgagaacacagaccctgggagaagcagccagcagtgaggaatcctggaaccccttcccagggagagccttcccatgacccccatgaagagatcagtgcaaacacaggtgtcagagcccttcatggagtcctggggtgaggagtccctgccggagctacccgcagagcagtccctgacggagtactctgacctcgaggaggctccctcggcgcacactctctatgtgggccatctgaacccccagttctcagtgccggtgcttgcctgcctgctgcgagacaccctggagcggctggagatgccggtggcgcgggagcacattgaagtggtgaggcggccgcggaaggcctatgcactggtgcaggtgactgtccacagggacaccctggcctccctcccctggcgcctgcagacggccctggaggagcacctaatcctcaaggagctggcagccagtgggaaggacctgctattgagtgaggcccaagggcccttcagccacagagaggagaaggaggaggaggaggaggacagtggcctgagccctggccccagtccaggctctggtgtcccgctgcccacctggcctacacacacgctgcctgataggccccaggcccagcagctgcagagctgccagggccggcccagcggcgtgtgctccgacagtgccattgtgcaccagcagatcgtgggcaaggaccagctcttccagggtgccttcctgggcagcgagacccgcaatatggagttcaagcggggtagcggcgagtacctcagcctggccttcaagcaccacgtgcggcgctacgtgtgcgccttcctcaacagcgagggcggcagcctgctcgtgggagtagaggacagcggcctggtgcagggcatccgctgcagccaccgtgacgaggaccgcgcacgcctgctggtggactccatcctgcagggcttcaagcctcagatctttcccgatgcctacactctcaccttcatccctgtgatcagtacctcggagaccagcgtccccctcaaggtgatccgcctgaccgtgcacacccccaaggcccagagccagccgcaactctaccagacagaccagggggaggtgtttctgcggcgcgacgggagcatccagggcccgctgtctgccagcgccatccaggagtggtgcaggcagaggtggctggtggagctgggcaagctggaagagaagatgaaggcgctgatgatggagaaggagcagctccagcagcagctgcagcagcacgggcctgtgtcctgcacctgctgtgtcctgtgagggccctggggagcaggcaggacggcacggcactctccacctgagacccagggatttcctgtttgagtgtaaggccaaccagtaaagcccatgcgggctgctgagaggcggacagggactccttcaacatggcacatgagcaggcacccatgtggcttcaaccctgacagacccatctgtgtagccaagaaactgctctcagccctgtccccaaatgaccttactttcagaaagaatgtgtaaaaccctgcccagagctcccctagggctaagctataagggattgtccttctccctaaaatgctcatttggcccaggctgaggtctgtgactccagttggctacacagtgccagaaaggaatctgtcatctcaggaaagcccctcaaagatggcgaggcatatttgatgactgtggttacagggcaagaggccaccctgcagcccccacccctgacttgctggaacttgtgactgtcaaagctccattaataaattacatgcacctggaaaaaaaaaaaaaaaa

SEQ ID NO: 62364 - DNA, 1665 bp, Homo sapiens
agcgggtggggcgagcgccggggctcccggagcggatccctacctgtttcaaggacctgccagtctgagaagcttcttgtcataaggccatccaggggccacgcacccctaccttgccagcctccagcatgcaggataccgtaacgacatcagcattgttggaccccagccactcctcagtctccacccaggacaattcctccactggaggacacacttcaagcacaagcctacagctctcaaagccttcaatcacaccagtccctgcaaagtccaggaacccacgtcccagggccaatatccgtcggatgcgccggatcattgctgaggatcctgagtggtcactggccatcgtgcccctcctcacagagctctgcattcagcacattatcaggaacttccagaaaaaccctatcctgaagcagatgctcccggaacaccagcagaaggtcctgaaccacctgtcccctgacctaccactggctgtgaccgccaacctgatagacagtgagaactactggctccgctgctgcatgcatcgctggcccgtgtgccacgtggcccaccatggcggcagctggaaacgcatgttcttcgagcggcacctggagaacctgctaaagcactttatcccaggcaccacagaccctgcggtgatcctcgacctgctgccgctctgccggaattacgtgcgcagggtccacgtcgatcagttccttccgccggtgcagctcccggcccagctccggccgggcgaccagtccgactcaggcagcgagggagagatggaggagcccaccgttgaccactaccaactgggcgatctggtagctggcctgagccacctggaggagctggacctggtgtacgatgtcaaggactgcggcatgaatttcgagtggaatctcttcctcttcacctaccgcgactgcctctccttggcagccgccatcaaggcatgccacaccctcaagatcttcaagctgacccgaagcaaggtggatgatgacaaggcacgcatcataattcgaagccttctggaccacccagtcctcgaggagctggacttgtcacaaaacctcattggagaccgtggtgcacgaggcgctgccaagctgctgagccacagccgcctgcgtgtgctcaacctggctaacaaccaggtgcgtgcacccggtgcccagtccctggctcacgctctggcacacaacaccaacctcatttccctcaacctacgtctcaactgcatcgaggatgagggtggccaggctcttgcccatgccttgcagaccaacaagtgcctcaccacgctgcacctcggtggcaatgagctgtctgagcccaccgccacactcctgtcacaggtgctcgccatcaacaccacactcaccagcatcaacctgtcctgcaaccacatcgggctggacggtgggaagcagctcctggaaggcatgtcagacaacaagaccctcctggaatttgacttgcgcctgtcagatgtggcccaggaaagcgagtacctcattggccaggccctctacgcaaaccgagaagcagcccgccagcgggccctgaatcccagccacttcatgtcaaccatcactgccaatggccctgagaactctgtgggataaaatgacctgacttggaaaaaaaaaaaaaaaa

SEQ ID NO: 62365 - DNA, 7398 bp, Homo sapiens
atggctgaatcactaagtgaaatttctgacagtctggatgttctggaggccggtgatgagggaaagaagaaatgcaaatttaaagcccttaagagcttttttgttaagaagaaggaaaaagaagccgaagatacccaggaagaagaaatgctagaactgagcttgtccagcagcaacattaacatctcttctctgcagcccgttcgggaaaatcaaccaactaaggccagggccaagagcagcatggggagcaaagccctatcccatgatagcatcttcatgttgggtcctgagcctgaaagatcagcaagtaaaatgtttccttctatggatccccagagaggcagacctcagcagagatcccatatttccagaactctgcctaaacctaggagtaaggttcctggagttgtgtctggagccatgtcaggagctgtgcttcaaaatgtgcctacaagtgcagtctgggttgctggccccaagatcactgagaacccaccatcgcgccgacgccgactcagcatcatcccacctgttatccaacctgaaataatttctaagaacttggtagaaatctctctcgatgatgagtcacctaagaatccacaaaagaaggctttaccacataagagtttgacagcgactcagagcttctctgagttatcatctggacctgattgctcacagtccttgactgcatttgccacacttgcctctaccagtagcacccagctgcccattggtttcagcaccccagccaccacccagggctgtttggattcttcagctgctcgccacaaaatgactttaaatccccgcaaacaaaagaagaaccttcaagtgattattcgtggccttccagtgtggttcagtcatttccagggtattttagagggatccctgcagtgtgtcactcagacattagaaactccaaacctggatgaaccacttccagtggaaccaaaggaggaggagccaaaccttccattggtttctgaagaagaaaagagcataaccaaaccaaaagaaatcaacgaaaagaagctgggaatggacagtgcagattcctcaagccagaaacagaacaacaaaactgagatgtatgataagaagacaacagaccaggctccaaacactgatgcttctcggagtcagggctatccaatgtcagcagcatatggaagaagatggagaagaaaaggagcaagtgtttcaggattgagtgggtgtgaattcaaaggaagaagccttaaacaatccagtgaagggtatggcctgggcgatagagctgggtcttcacctaccaataagactgccaggaatgtccctttctcgcacttgtccttagagaaggacaacatggagcagcctacaacttcacaaccagaaaccactacccctcaggggttgctttcagataaagatgacatgggaaggagaaatgctggcatagatttcggatccagaaaagcatcagcagcacagcccatacctgaaaacatggacaattccatggttagtgatccacaaccataccatgaagatgcagcttctggagctgagaagacagaagccagagcttctctctcactgatggtggaaagcctttctacaacccaagaggaggccattctctcagtagcagcagaggctcaggtgtttatgaatccttctcatatccagttagaagatcaagaagctttcagctttgatttacaaaaggcccaatccaaaatggagtcagcccaggatgttcaaactatctgcaaagaaaagccttctggaaatgttcaccagacctttacagcaagtgttttgggtatgacaagtactacagccaaaggagatgtttatgccaagactctgcctcccagaagcctttttcagtcctcaaggaagcctgatgctgaagaagtctcctcagattcagagaatattcctgaggagggggatggttctgaagaactggctcatggtcactcttcccagtccttggggaagtttgaagatgaacaagaagtcttctcagaatcaaaaagttttgttgaggacttgagcagctctgaggaggagctggacctcagatgcctctcccaggctttagaggagcctgaagatgcagaagtcttcacagaatcaagcagttatgttgaaaagtacaacacttctgatgattgcagcagctcagaggaagacctgcctctcagacaccctgctcaggccttgggaaagcccaaaaaccaacaagaagtctcctctgcttcaaataatactcctgaagagcagaatgattttatgcagcagctgccttccagatgcccttctcagcccattatgaatcctactgttcagcaacaagtccccaccagttcagtgggcacttctataaaacagagcgattccgtggagccaatccctccaagacaccctttccagccatgggtgaaccctaaagtggagcaagaagtttcctcatctccaaagagcatggctgttgaagagagcatttctatgaagcctctgcctcctaaacttctttgccagcccttgatgaatcctaaagttcaacaaaacatgttctcaggttcagaggacattgctgttgagagagtcatttctgtggagccactactccccagatattctcctcagtccttgacagatcctcaaatccggcaaatctcagaaagcacagctgttgaggaaggcacttatgtggaaccgctgcctcccagatgcctttcccagccctcggagaggcctaagttcctggactcaatgagtacttctgcagaatggagcagtcctgtggcaccaacaccttccaaatacacttccccgccatgggtgacccctaaatttgaggaactgtatcaactctctgcacatccagaaagcactactgttgaagaggacatttctaaggagcagctgcttcccagacatctttcccagttgactgtgggaaataaagtccagcaactgtcctcaaatttcgagcgggctgctattgaggcagacatttctgggagtccattgcctccccaatatgctacccagttcttaaagaggtctaaagttcaggaaatgacctcacgactagagaaaatggctgttgaaggcacttctaacaaatcaccgattcccaggcgtccgacccagtcattcgtgaaatttatggcacagcaaatcttttcagagagctctgctcttaagaggggcagtgatgtggcacctctgcctcccaatcttccttccaaatctttatcaaagcctgaagtcaagcaccaagttttctcagattcagggagtgctaatcctaagggaggcatttcttcaaagatgctacctatgaagcaccctttacagtccttggggaggcctgaagacccacagaaagttttctcttattcagagagagctcctgggaagtgcagcagttttaaagagcagctgtctcccaggcagctttcccaggccttgaggaaacctgagtatgagcaaaaagtctcccctgtttctgccagttctcctaaagagtggaggaattctaaaaagcagctgcctcccaaacattcttcccaagcctcagataggtctaaattccagccacagatgtcatcaaagggcccagtgaatgtacctgtaaagcagagcagcggtgagaagcacctgccttcaagtagtcctttccagcaacaggttcattcaagttctgtgaatgctgctgctaggcgatctgtttttgagagcaattctgacaattggttcctaggaagagatgaagcttttgcaatcaaaaccaagaaattcagccaaggttccaaaaaccccataaagagcattccagcccctgctaccaaacctgggaagttcaccattgctcctgtcaggcaaacatccacttctgggggcatttactctaagaaagaagatcttgagagtggtgatggtaataataaccagcatgcaaacctatccaatcaggatgatgttgaaaagctttttggagttcgactgaaaagagcccctccctcgcagaagtataagagtgagaaacaagataacttcacccagcttgcttcagtgccctcgggcccaatttcatcctctgtaggcaggggacataaaatcagaagcacttcccaggggctcctggatgctgcagggaacctcaccaaaatatcttacgttgcagataagcaacagagcaggcccaaatctgaaagcatggccaagaagcaacctgcttgcaagaccccaggaaagcctgctggtcaacagtcagattatgctgtctcagagccggtttggataactatggcaaagcagaagcagaagagtttcaaggcccacatttctgtgaaagagctgaaaactaagagcaatgctggagccgatgctgagactaaggagcctaaatatgagggagctggctctgcaaatgaaaaccaacctaaaaagatgttcacttccagtgtccataaacaggagaagacagcacagatgaagccacctaagcctacaaaatcagttggatttgaagctcagaagatactgcaagttcctgccatggaaaaagaaaccaaacgatcttcaactctcccagccaagttccagaacccagttgagccaattgagcctgtctggttctcactggccaggaagaaagccaaagcatggagccacatggcagaaatcacgcaataaagagctcttgtgtggagcatcagcatttattttatttagtttttttttttttttttttttttgagacagagtctcgctctgttacccagattggagtgcagtggcgcgatctccgctcactgcaagctccgcctcccgggttcacgccactctcccgcctcagtctcccgactagctgggactacaggcgcccgccatcacgcccggctaattttgttttcgtatttttagtagagacggggtttcaccatgttggccaggatggtcttgatctcctgacctcgtgatccgcccgcctcagcctcccaaaagctgggattacaggcgtgagccaccgcgcccggccaagcatcagcgttttaaatgataattgctaatagctgtattaattctatgtagtgatctttttactgtgaccacttgtattaagcaaaataagtattaagcaaactaagaatttattaagcaaaataagaatttattaagcaaaatagccttagaaatgcaaattaaaacataattatttgaatgaaataaatgccatgaatgcttaaccttccacgtagtcactgccagcacccagaaacccagcatttcctctattaaaactatcgaaaacatttgcactgctgtaaaattgcaaaatctttaactttggacaatgtgctttagaagggagaaagcaaaaacattttgttggagcaactagaaaattgtcatttccctcaaccaaataaagtaattctaatggaaacattcagatgatttgacctaaagattggcctttaggttttatgagcctagatagatgccgcaattatttggttgttgctctaagctttgcaagggatcctaaaagaggcggtggaagtgaaaattctgggtctccaagaaaatttctgcacagccagttctccaatcagcctatcaccccttgaaacatcttccctgtgtccctgggggcccctgatgctttctccttgggtgatagtaacatgcagagcacttacacaaagctccctctttggacataccccacgtcgacctgtcacaggcctggctgtagcgagcacctccctatgacgcagaatgcttcttgggaattatcttactcctctggagggttagtccatcaatgttttgcttcttgtcccaatactactgtgaccctctctgatcgcacagaaatcactgcctatcacatatatcctgttaagcactgaagaccctattgaaattagagttctacagatgccaaaagctgtactttccatcaggcagatggcaagcttactgccttgatgcacatctggagccactggagctccttcctctctggttccagcattaaggtggagaactccatgtagcttcttgtcctttcccctcagctgtctttgcttcacaaggttttagcccaaagcaagagtgcaatcccaaagccacagagaaatgaactttccgctacctggaagctttaagtgagtaaatcagcttttcccctctcattcctagaggcacacacctcaaaagttactaggctggagagaccctaccttccagtgacccactcatcccccagccacggagaagagggaagaccaaaaagggagagtgagaaagaggatgagagggatggtcagctgtgaggggagggggcaagtggcccagcaaatgttgatgcctcccttcccatcttgccacacggtctttttcttttgtagcacagcctccattaataactcctcggctgaggatgaagatgtaggcacctttacccccagagccagttccttaattggctggctttctgagatgcagaccaccctagaatctcatctaggttcactagaagttagttaaatcttcctttctctgtctttctcttcattccatcccccaaacccaccaaacactaagggagagctccctttggatgtctgggcagtaaacctagctcatttttctaggagacccagaagtgacttctgagtagttatcactgtgtctgcctctgttacactgtgctgctttgcttaaacagaaatgcaggcctggacatctgactgtgcctttatattctgagtggggtgctgccccatgcaaaaaaatccagagaggtagtgaggtgtcagagctaaacacttggtgctgggttttgttgatgctggtataatgtgacacagtacaattacatgctaaattttgcattttctctatataacatctatttttcctgatactgtgcctttgccattttgataatgctattttgattgagtgaattttatttcctttgtattcccatagtgaacaatatattaaggtagatgccctttatctgggtactcctggtagattagctgttacacctcccttcccttttttacagtgaacctgtattcagttattgtcactctgagaactctccaataacaatttcttttccacagttaacaacacagctgttacacctcccttcctttttttcacagtgaacctgtattcagctattctcactctgagaactctccaataacaatttcttttccacagttaacaacaaagttctgtttttaaatgaagagattaagttctttttaaatgcctaaaggcatattctgacaacttttctacttctttaacttttttgatttaagatatatgcaaagcaaataaattcaataa

SEQ ID NO: 62366 - DNA, 7397 bp, Homo sapiens
atggctgaatcactaagtgaaatttctgacagtctggatgttctggaggccggtgatgagggaaagaagaaatgcaaatttaaagcccttaagagcttttttgttaagaagaaggaaaaagaagccgaagatacccaggaagaagaaatgctagaactgagcttgtccagcagcaacattaacatctcttctctgcagcccgttcgggaaaatcaaccaactaaggccagggccaagagcagcatggggagcaaagccctatcccatgatagcatcttcatgttgggtcctgagcctgaaagatcagcaagtaaaatgtttccttctatggatccccagagaggcagacctcagcagagatcccatatttccagaactctgcctaaacctaggagtaaggttcctggagttgtgtctggagccatgtcaggagctgtgcttcaaaatgtgcctacaagtgcagtctgggttgctggccccaagatcactgagaacccaccatcgcgccgacgccgactcagcatcatcccacctgttatccaacctgaaataatttctaagaacttggtagaaatctctctcgatgatgagtcacctaagaatccacaaaagaaggctttaccacataagagtttgacagcgactcagagcttctctgagttatcatctggacctgattgctcacagtccttgactgcatttgccacacttgcctctaccagtagcacccagctgcccattggtttcagcaccccagccaccacccagggctgtttggattcttcagctgctcgccacaaaatgactttaaatccccgcaaacaaaagaagaactttcaagtgattattcgtggccttccagtgtggttcagtcatttccagggtattttagagggatccctgcagtgtgtcactcagacattagaaactccaaacctggatgaaccacttccagtggaaccaaaggaggaggagccaaaccttccattggtttctgaagaagaaaagagcataaccaaaccaaaagaaatcaacgaaaagaagctgggaatggacagtgcagattcctcaagccagaaacagaacaacaaaactgagatgtatgataagaagacaacagaccaggctccaaacactgatgcttctcggagtcagggctatccaatgtcagcagcatatggaagaagatggagaagaaaaggagcaagtgtttcaggattgagtgggtgtgaattcaaaggaagaagccttaaacaatccagtgaagggtatggcctgggcgatagagctgggtcttcacctaccaataagactgccaggaatgtccctttctcgcacttgtccttagagaaggacaacatggagcagcctacaacttcacaaccagaaaccactacccctcaggggttgctttcagataaagatgacatgggaaggagaaatgctggcatagatttcggatccagaaaagcatcagcagcacagcccatacctgaaaacatggacaattccatggttagtgatccacaaccataccatgaagatgcagcttctggagctgagaagacagaagccagagcttctctctcactgatggtggaaagcctttctacaacccaagaggaggccattctctcagtagcagcagaggctcaggtgtttatgaatccttctcatatccagttagaagatcaagaagctttcagctttgatttacaaaaggcccaatccaaaatggagtcagcccaggatgttcaaactatctgcaaagaaaagccttctggaaatgttcaccagacctttacagcaagtgttttgggtatgacaagtactacagccaaaggagatgtttatgccaagactctgcctcccagaagcctttttcagtcctcaaggaagcctgatgctgaagaagtctcctcagattcagagaatattcctgaggagggggatggttctgaagaactggctcatggtcactcttcccagtccttggggaagtttgaagatgaacaagaagtcttctcagaatcaaaaagttttgttgaggacttgagcagctctgaggaggagctggacctcagatgcctctcccaggctttagaggagcctgaagatgcagaagtcttcacagaatcaagcagttatgttgaaaagtacaacacttctgatgattgcagcagctcagaggaagacctgcctctcagacaccctgctcaggccttgggaaagcccaaaaaccaacaagaagtctcctctgcttcaaataatactcctgaagagcagaatgattttatgcagcagctgccttccagatgcccttctcagcccattatgaatcctactgttcagcaacaagtccccaccagttcagtgggcacttctataaaacagagcgattccgtggagccaatccctccaagacaccctttccagccatgggtgaaccctaaagtggagcaagaagtttcctcatctccaaagagcatggctgttgaagagagcatttctatgaagcctctgcctcctaaacttctttgccagcccttgatgaatcctaaagttcaacaaaacatgttctcaggttcagaggacattgctgttgagagagtcatttctgtggagccactactccccagatattctcctcagtccttgacagatcctcaaatccggcaaatctcagaaagcacagctgttgaggaaggcacttatgtggaaccgctgcctcccagatgcctttcccagccctcggagaggcctaagttcctggactcaatgagtacttctgcagaatggagcagtcctgtggcaccaacaccttccaaatacacttccccgccatgggtgacccctaaatttgaggaactgtatcaactctctgcacatccagaaagcactactgttgaagaggacatttctaaggagcagctgcttcccagacatctttcccagttgactgtgggaaataaagtccagcaactgtcctcaaatttcgagcgggctgctattgaggcagacatttctgggagtccattgcctccccaatatgctacccagttcttaaagaggtctaaagttcaggaaatgacctcacgactagagaaaatggctgttgaaggcacttctaacaaatcaccgattcccaggcgtccgacccagtcattcgtgaaatttatggcacagcaaatcttttcagagagctctgctcttaagaggggcagtgatgtggcacctctgcctcccaatcttccttccaaatctttatcaaagcctgaagtcaagcaccaagttttctcagattcagggagtgctaatcctaagggaggcatttcttcaaagatgctacctatgaagcaccctttacagtccttggggaggcctgaagacccacagaaagttttctcttattcagagagagctcctgggaagtgcagcagttttaaagagcagctgtctcccaggcagctttcccaggccttgaggaaacctgagtatgagcaaaaagtctcccctgtttctgccagttctcctaaagagtggaggaattctaaaaagcagctgcctcccaaacattcttcccaagcctcagataggtctaaattccagccacagatgtcatcaaagggcccagtgaatgtacctgtaaagcagagcagcggtgagaagcacctgccttcaagtagtcctttccagcaacaggttcattcaagttctgtgaatgctgctgctaggcgatctgtttttgagagcaattctgacaattggttcctaggaagagatgaagcttttgcaatcaaaaccaagaaattcagccaaggttccaaaaaccccataaagagcattccagcccctgctaccaaacctgggaagttcaccattgctcctgtcaggcaaacatccacttctgggggcatttactctaagaaagaagatcttgagagtggtgatggtaataataaccagcatgcaaacctatccaatcaggatgatgttgaaaagctttttggagttcgactgaaaagagcccctccctcgcagaagtataagagtgagaaacaagataacttcacccagcttgcttcagtgccctcgggcccaatttcatcctctgtaggcaggggacataaaatcagaagcacttcccaggggctcctggatgctgcagggaacctcaccaaaatatcttacgttgcagataagcaacagagcaggcccaaatctgaaagcatggccaagaagcaacctgcttgcaagaccccaggaaagcctgctggtcaacagtcagattatgctgtctcagagccggtttggataactatggcaaagcagaagcagaagagtttcaaggcccacatttctgtgaaagagctgaaaactaagagcaatgctggagccgatgctgagactaaggagcctaaatatgggggagctggctctgcaaatgaaaaccaacctaaaaagatgttcacttccagtgtccataaacaggagaagacagcacagatgaagccacctaagcctacaaaatcagttggatttgaagctcagaagatactgcaagttcctgccatggaaaaagaaaccaaacgatcttcaactctcccagccaagttccagaacccagttgagccaattgagcctgtctggttctcactggccaggaagaaagccaaagcatggagccacatggcagaaatcacgcaataaagagctcttgtgtggagcatcagcatttattttatttagttttttttttttttttttttttgagacagagtctcgctctgttacccagattggagtgcagtggcgcgatctccgctcactgcaagctccgcctcccgggttcacgccactctcccgcctcagtctcccgactagctgggactacaggcgcccgccatcacgcccggctaattttgttttcgtatttttagtagagacggggtttcaccatgttggccaggatggtcttgatctcctgacctcgtgatccgcccgcctcagcctcccaaaagctgggattacaggcgtgagccaccgcgcccggccaagcatcagcgttttaaatgataattgctaatagctgtattaattctatgtagtgatctttttactgtgaccacttgtattaagcaaaataagtattaagcaaactaagaatttattaagcaaaataagaatttattaagcaaaatagccttagaaatgcaaattaaaacataattatttgaatgaaataaatgccatgaatgcttaaccttccacgtagtcactgccagcacccagaaacccagcatttcctctattaaaactatcgaaaacatttgcactgctgtaaaattgcaaaatctttaactttggacaatgtgctttagaagggagaaagcaaaaacattttgttggagcaactagaaaattgtcatttccctcaaccaaataaagtaattctaatggaaacattcagatgatttgacctaaagattggcctttaggttttatgagcctagatagatgccgcaattatttggttgttgctctaagctttgcaagggatcctaaaagaggcggtggaagtgaaaattctgggtctccaagaaaatttctgcacagccagttctccaatcagcctatcaccccttgaaacatcttccctgtgtccctgggggcccctgatgctttctccttgggtgatagtaacatgcagagcacttacacaaagctccctctttggacataccccacgtcgacctgtcacaggcctggctgtagcgagcacctccctatgacgcagaatgcttcttgggaattatcttactcctctggagggttagtccatcaatgttttgcttcttgtcccaatactactgtgaccctctctgatcgcacagaaatcactgcctatcacatatatcccgttaagcactgaagaccctattgaaattagagttctacagatgccaaaagctgtactttccatcaggcagatggcaagcttactgccttgttgcacatctggagccactggagctccttcctctctggttccagcattaaggtggagaactccatgtagcttcttgtcctttcccctcagctgtctttgcttcacaaggttttagcccaaagcaagagtgcaatcccaaagccacagagaaatgaactttccgctacctggaagctttaagtgagtaaatcagcttttcccctctcattcctagaggcacacacctcaaaagttactaggctggagagaccctaccttccagtgacccactcatcccccagccacggagaagagggaagaccaaaaagggagagtgagaaagaggatgagagggatggtcagctgtgaggggagggggcaagtggcccagcaaatgttgatgcctcccttcccatcttgccacacggtctttttcttttgtagcacagcctccattaataactcctcggctgaggatgaagatgtaggcacctttacccccagagccagttccttaattggctggctttctgagatgcagaccaccctagaatctcatctaggttcactagaagttagttaaatcttcctttctctgtctttctcttcattccatcccccaaacccaccaaacactaagggagagctccctttggatgtctgggcagtaaacctagctcatttttctaggagacccagaagtgacttctgagtagttatcactgtgtctgcctctgttacactgtgctgctttgcttaaacagaaatgcaggcctggacatctgactgtgcctttatattctgagtggggtgctgccccatgcaaaaaaatccagagaggtagtgaggtgtcagagctaaacacttggtgctgggttttgttgatgctggtataatgtgacacagtacaattacatgctaaattttgcattttctctatataacatctatttttcctgatactgtgcctttgccattttgataatgctattttgattgagtgaattttatttcctttgtattcccatagtgaacaatatattaaggtagatgccctttatctgggtactcctggtagattagctgttacacctcccttcccttttttacagtgaacctgtattcagttattgtcactctgagaactctccaataacaatttcttttccacagttaacaacacagctgttacacctcccttcctttttttcacagtgaacctgtattcagctattctcactctgagaactctccaataacaatttcttttccacagttaacaacaaagttctgtttttaaatgaagagattaagttctttttaaatgcctaaaggcatattctgacaacttttctacttctttaacttttttgatttaagatatatgcaaagcaaataaattcaataa

SEQ ID NO: 62367 - DNA, 1861 bp, Homo sapiens
gggagcgcggagcggaggccgaggcgagagcctggcgctgtaggactagaacgaaaggagtgaggcgccgagagcccagataccattttggcgtgagagctggtggttggcaaggccgcgggagtgggaagcgtccgccatgttctgcgaaaaagccatggaactgatccgcgagctgcatcgcgcgcccgaagggcaactgcctgccttcaacgaggatggactcagacaagttctggaggagatgaaagctttgtatgaacaaaaccagtctgatgtgaatgaagcaaagtcaggtggacgaagtgatttgataccaactatcaaatttcgacactgttctctgttaagaaatcgacgctgcactgtagcatacctgtatgaccgcttgcttcggatcagagcactcagatgggaatatggtagcatcttgccaaatgcattacgatttcacatggctgctgaagaaatggagtggtttaataattataaaagatctcttgctacttatatgaggtcactgggaggagatgaaggtttggacattacacaggatatgaaaccaccaaaaagcctatatattgaagtccggtgtctaaaagactatggagaatttgaagttgatgatggcacttcagtcctattaaaaaaaaatagccagcactttttacctcgatggaaatgtgagcagctgatcagacaaggagtcctggagcacatcctgtcatgaccatgcgccgaggcacttccaggcttcactcaactcatggactcctctgtactcactctctccaccactcccttcacctccctctttgattttagaagctatagacattgtttaagataactaagaatacttggctaagaagtataatttgctaactattaaggactttctttttttaatgttgtacactattcttcctactcttttttggttttggttttgttttgtagagactgtctcactatgttgcccaagctggtctcaaactcctggcctcaagcagtcctcccaccttagcttctcaaagtgttgagatcacaggcgtgagccactgcacccggcccctactcctttttctaataagctgtatctgtaatcacagcattcctacagttgttacagtgtgttttttaaatgaaagtaaacatggttacatttgaatctcttaaataagcagtcacttggctggacaggaagaaggtagatcctgtgtgtcttgttttctggtcatgtgtattgtacaagctagagagctgaatttctgagatacacattttcaaatcacatgcaagtgaagatgatggtctgtagaaattttcagtatatataatgtttaatgacatactaatttatcatctggctatttgggaaggaaggacacacatggattttgcacatttccaccatggtggctggtgtggcttgtggctatggggtgatcaccagtatcaccactttggaaggggacagtgaaattggggctagagaaggaactttgtacagttttccctgagattcagattgactgaaaagtcacatgaagagttgattgtcttttaatggtatgttttaaacagctgacattttaaattttgatgaaatccagtttattcgtttgttcttttatgctttgggtgttgcatccgagaaatcttttcccatcccaagatcacaattttttttcctttttacttctagaagtgttataattttaagctttatactttggtctatgacccgtttttttttttgttttgttttgttttttcgtttgtttctttgttttgagatggagcctgggtgatagagtgagacactgtcttgccaaaaaaaaaaaaaaaaaaaaaaaaa

SEQ ID NO: 62368 - DNA, 719 bp, Homo sapiens
ccggggtgcgcaaccggcccaacaggcaggcccggggctcgtgtgaagaacacagtggaagcatcctccaagccagccaacaaatttccgttttctactgccctttcgggccaggggttattttatgagcatctccgatgttgcacacgtggcgtgtgaaccgagagaaagaagatggagagatcaccctccagacgtcgtcgcctggaagaggccccaaaattgccatataagaacccaacacaccttgctcagcagcaggaaccctggagtcggctcaactcaacccccacaattacttccatgaggcgggatgcctactattttgatcccgagataccaaaggatgacctggacttccgcttagcagccttgtacaaccaccacactgggacattcaagaacaaaagtgagatactgttaaaccagaaaaccacgcaggatacctatagaaccaagatccaattccctggagaatttttaacccctcccactccacccatcactttcctggctaacatcagacactggatcaaccctaaaaaggagtccatccacagcatccaaggatccatagtgtcccctcacactgcagccaccaatggaggctactcccgaaagaaagatggtggcttcttctccacctagtgttgacagatccctgaactaattatagtgaaacatactgcggcccacttccattaaatagatttgtgcaa

SEQ ID NO: 62369 - DNA, 719 bp, Homo sapiens; identical to SEQ ID NO: 62368

SEQ ID NO: 62370 - DNA, 1300 bp, Homo sapiens
gctgaccagaatctttcccaacttgtctaagtcctctcaggccagccttggtgggaggtttctaggattcgctccctgcccttcccatcttagggtgtcgtctgagacagactcttattccctcaataaagagagagactcttattccctcagcggccagctcctcgcctcccctcggccgtagccacctcagtggtcaccgtcttcaccgtggtcgcctcagcccgctcgccaccccagttgaggcgctgctggtgtcatgtctgccacaggggaccgacacccgacccaaggggaccaggaggccccggtaagccaggagggagcacaggccgaggcggccggagctggtaaccaggagggcggcgactccggccccgacagcagcgacgtggtgcctgcggccgaggtggtcggagtcgcagggcccgtggaaggcctcggggaggaggagggtgagcaggcggcaggcctggccgcagtcccccggggcgggagcgccgaggaggactcagatatcgggcccgcgacggaggaagaggaggaggaagaggggaacgaggcggccaacttcgacttggcggtggtcgcccgtcgctacccggcgtcgggcattcacttcgtgctcctggacatggtccactcccttctccaccgcctctctcacaacgaccacatcctcatagagaaccgtcaactcagccgcctgatggtggggccacacgctgctgcgcgcaacccctggggcaacctccccccgctgctgctgccccagaggctgggtgcaggggccgcagcccgggcgggcgagggcctgggcctgatccaggaggccgcatcggtcccagagcctgcagtgccagctgacctggccgagatggccagggagcccgcggaggaggccgcagaggagaagctctcagaggaggccacagaggaaccagacgcagaggaaccggccacagaagaaccgaccgcacaggaggccacggccccagaggaagtcactaaatctcagcccgaaaagtgggatgaagaggcccaagatgctgcaggcgaggaagagaaagaacaagaaaaagagaaggatgcggaaaacaaggtgaagaactccaaagggacctagacgcagcagaggtgaagccaagaaaatccagatgcctgtgggaattgtaacacatatcattccaaagttcgttacatcaaaagtgatatccagtgacatctaactttcatggatgtatgtgacagtgttcaagttaaaaaataaaagtttgttttaaatgaaaaaaaaaaaaaa

SEQ ID NO: 62371 - DNA, 838 bp, Homo sapiens
ggacgaggggcaacgtatataaatgcgcgcaggcgtagttaagagagcgcattttgacttcgaggcaccgccgacgttactgtgtcgccatggggcgccgtccagctcgctgttaccggtattgtaagaacaagccgtacccaaaatctcgtttctgccgaggggttcctgatgccaagatccgcatctttgacctgggtagaaagaaggcaaaagtggatgagttcccactcggtggccacatggtgtctgatgaatatgagcagctgtcttctgaagccctggaggccgcccgtatttgtgccaacaaatacatggtgaaaagttgtggcagagatggctttcacatgcgagtgcggctccatcccttccatgtcatccgcatcaacaagatgttgtcctgtgctggggctgacaggctccagacaggtatgcgaggtgcctttggaaaaccccagggtactgtagcccgggtccacattggtcaagtcatcatgtccatccgcaccaagcttcagaacgaggagcatgtgattgaagccttgcgcagggccaagttcaagttccctggacgccagaagattcatatctccaagaagtggggcttcacgaagtttaatgctgacgaatttgaagacatggtggccaagaagtgcctcatccctgatggttgtggagtcaagtacgttcccagtcatggccccttggacaagtggcgggttctgcactcatgaaggttttggcagtactgtctccttgggccatgctggtctgacttatgcttactaataaattctgtttactggcaaaaaaaaaaaaaaaaaaaaaaaaaaaaaaa

SEQ ID NO: 62372 - DNA, 2477 bp, Homo sapiens
caccctggcccgctccccgcgccctccacgggtaacggccccctctctcggtgctcagaaaccggcggtgtcgacaggtggctctcgcttggcctccttgtctgcaagcctttctcctagagatctgtgcctcctggcgaaccatgggagacctgccgccctaccctgagcgccctgcccagcagcctccgggccggaggacttctcaggcctcccagaggcggcacagtcgggaccaagctcaggccctggcagcggaccccgaggagaggcagcagatacctccagacgcccagcgaaacgcccctggttggtcacagaggggcagcctgtcccaacaggagaacttgctgatgccccaggtcttccaggctgaggaagcccggctgggtggcatggagtacccatctgtgaacacgggctttccctcagagttccagcctcagccttactctgatgaaagcaggatgcaggtcgccgagctcaccaccagcctaatgctgcagcggctccagcagggccaaagcagcctgttccagcaactggaccccaccttccaggagcccccagtcaaccccttgggccagttcaacctctaccagacagaccagttctctgaaggtgcccagcacgggccttacataagggatgaccctgcccttcagttcttgccctctgagctgggcttcccacactacagtgcccaggtgcctgagcccgagcctctggagctggccgtgcagaacgccaaggcctacctgctgcagaccagcatcaattgcgacctcagcctgtacgagcacctggtgaatctgctgaccaagatcctgaaccagcggcctgaggaccccttgtctgtcctggagtctctgaaccgcaccacgcagtgggagtggttccaccccaagctggacacgctgcgggacgaccccgagatgcagcccacctacaagatggcggagaaacagaaggcgctgttcacccggagtggaggcggcactgaaggcgaacaggagatggaggaggaggtgggggagacaccagtgcccaacatcatggagactgccttctacttcgagcaggccggcgtcggcctgagctcggacgagagcttccgcattttcctggccatgaaacagctggtggagcagcagcccatccacacctgtcgcttctggggcaagatcctgggaatcaaacgcagctacctggtggccgaggtggaattccgggagggcgaggaggaggcagaggaggaggaggtggaggagatgacggaaggtggcgaggtcatggaggcgcacggcgaggaggagggcgaggaggacgaggagaaggccgtggacatcgtccctaagtccgtatggaagccgccgcccgtgatccccaaggaggagagccgctcaggcgccaacaagtacctgtactttgtgtgcaacgagccgggcctgccatggacgcggctgccccacgtcactccagcccagatcgtgaacgcccgaaagatcaagaagttcttcacaggctacctggacacgccagtcgtcagctacccacccttcccgggcaacgaggccaactacctgcgggcccagatagcccgcatctcggccgccacgcaggtcagcccgctgggcttctaccagtttagtgaggaggagggcgacgaggaggaggaaggtggtgctgggcgcgactcctacgaggagaacccggacttcgagggcatccccgtgctggagctggtcgactccatggccaactgggtgcatcacacacagcacatcctgccgcagggccgctgcacttgggtgaaccctttgcagaagacagaggaggaggaggacctgggggaggaggaagagaaggcagatgaggggccagaggaggtggagcaggaggttggccccccactgctaacgccactttcagaagatgcagaaatcatgcacctggcaccctggaccacccgcctgtcctgcagcctctgcccgcagtactcagtggccgttgtgcgctccaacctctggcccggggcctatgcctatgccagtggcaaaaagtttgagaacatctacatcggctggggtcacaagtacagccccgagagcttcaacccggccctgccagcccccattcaacaagagtaccccagtggcccagagatcatggagatgagtgaccccacagtggaagaggagcaggctctgaaagcagcccaggaacaagccctgggagccacagaggaggaggaggagggcgaggaggaggaggagggcgaggagacagatgactgaggcccaccctctagccactttccccaagcaggtagatagcaaatttccccttagaggtagttagcatggattatattttcactatgtgcttcctgtccccagagggcagggatagaaaaggaaggcaactgcttcaaataaaattcctccacggcattaaaaaaaaaaaaaaaaaaaaaa

SEQ ID NO: 62373 - DNA, 1286 bp, Homo sapiens
ggcgccgcggacgctgctggagtcgcctggcaacgatgtcgcctggcaactgaataggttggccagtggcgcgggctactggaagcagaaagggctgcggaggcagtgagtggtttctgcagagcttcatttggaaaggcctctgtagttggggaaagatggcccattcccagaactccttggagcttcccattaacatcaatgccacccagattaccactgcctatggccatcgggccctgcccaagctgaaggaggagctgcagtcagaggacctccagacgaggcagaaagccctcatggccttgtgtgacctcatgcatgaccccgagtgtatctacaaggccatgaacataggctgtatggagaacctgaaagctttgctgaaggatagcaacagtatggtgcgcataaagaccaccgaggtgctccacatcacggcaagccatagcgtgggcagatacgcctttctagagcacgacatcgtccttgccctgtccttcctgctgaatgaccccagcccagtctgccgggggaacctgtacaaggcatacatgcagctggtccaggtgcctagaggggcccaagagatcatcagcaaaggtctgatttcctcactggtatggaagctgcaggtggaggtggaggaggaggagttccaggagttcatcctggacacactggtcctctgcctgcaggaggatgccaccgaggccctgggcagcaatgtggtgcttgtcctgaagcagaagctcctcagcgccaaccagaacatccgcagcaaggccgcccgtgcgctccttaatgtcagcatatctcgagagggcaagaaacaggtgtgtcattttgacgtcatccccatcctggtccatctgctgaaagacccagtggagcatgtgaagtctaacgctgccggtgccctgatgttcgccacagtgatcactgaagggaagtatgcggccctggaggcacaagccatcggcctgctcctggagctgctgcactcccccatgaccatagcgcgcctgaatgccaccaaggcccttaccatgctggcagaggcccccgagggccgcaaggccctgcagacgcacgtgcccactttccgtgccatggaggtggagacttacgaaaagcctcaagtggccgaagccttacagcgggcagcccggatcgccatcagtgtcatcgagttcaaaccctgagcccttcattcacctctgtgagtgaataaatgtgctaagtctctttaaaaaaaaaaaaaaaaaaaaaaaaaaaaaaaaaaa

SEQ ID NO: 62374 - DNA, 5061 bp, Homo sapiens
gacagacatggcgcttcagctgtcttcagaataatgtcacccggcctcctctcctgtcttctgcagtcttaaaagacctagtccctaactgaggtctggcttttcctcagccctggatgaagtggagaagacctatttggagactgcttcctgtcaccataaaatcctgaacatttgtcttgaacatgaacactccaaaagaagaattccaggactggcccatagtcagaatagcagctcatttaccagacctcattgtctatggacatttctccccagagcgaccctttatggattattttgacggagtcctgatgtttgttgatatttcaggttttactgcaatgactgagaagttcagcagtgccatgtacatggacagaggggctgagcagttggtggagatcctcaactaccacataagtgcaatagtggagaaagtgttgatttttggaggagacatcctgaaatttgcaggtgatgcactgctagccctgtggagggtggagcgaaagcagctgaaaaacattatcacagtggtaattaaatgtagcctggagatccatggattgtttgagacccaggagtgggaagaaggcctagacatccgagtcaagataggactggctgctggccacatcagcatgttggtctttggagatgaaacacacagccactttctggtgattggtcaggcagtggacgatgtgcgccttgcccagaacatggctcagatgaatgatgttattctgtcaccaaactgctggcagctctgtgaccggagcatgattgaaattgagagtgttccagatcagagagcagttaaggttaacttcttaaaaccaccccccaattttaattttgatgaatttttcacaaagtgtacgaccttcatgcattattatccttctggtgagcacaaaaacctcctgaggcttgcatgcacgctgaagcctgatcctgaactggagatgtccctacaaaagtatgtgatggaaagcattttgaagcagattgataacaaacagcttcagggctatttatctgagcttcgcccagtgacgattgtgtttgtgaacctgatgtttgaagaccaagacaaagcagaagagataggcccagccatccaggatgcctatatgcacatcacttctgtcctgaagatcttccaaggccaaatcaataaagtcttcatgtttgacaagggctgctctttcctctgtgtctttggcttccctggggaaaaggtacctgacgagctcactcatgctctggaatgtgctatggatatatttgacttctgctctcaagtccacaaaatccaaactgtatccatcggtgttgccagtgggattgtcttctgtgggatcgttggacacactgtgagacacgagtacacagtcattggtcaaaaagtcaacttagctgccaggatgatgatgtactacccaggaattgtgacctgcgactctgtcacctacaatgggagcaacctaccagcgtacttttttaaagagcttccaaagaaagttatgaaaggtgttgcagattctggaccattgtatcagtattggggccgtactgagaaagtcatgtttggtatggcgtgcctcatctgcaacagaaaggaggattaccctttgctgggacgtaataaagagatcaactacttcatgtatactatgaagaaatttttgatatctaacagcagccaagtcttaatgtatgagggattaccaggatatggaaaaagccagatacttatgaaaattgagtacctggcccaaggtaagaatcacaggattattgccatttcattgaataagatcagcttccatcaaactttctataccatccagatgttcatggccaatgtcctaggcctagacacttgtaaacattataaagaacgacagaccaaccttcgaaataaagtcatgacactgttggatgaaaagttctactgtcttcttaatgacattttccatgttcagttccctatttctcgggagatttccaggatgagcaccttgaaaaagcaaaaacaattggaaatattgtttatgaagatcttgaagctgatagtgaaagaggaaaggattatttttatcattgatgaggcccagtttgtggattcgacctcctggagatttatggagaagcttatccggactcttcctatcttcatcattatgtccctgtgtcccttcgttaacattccctgtgcagctgccagggccgtaataaagaacaggaacaccacctacattgtcgttggtgcagtacagcctaacgacatctccaacaagatctgtcttgacctcaatgtgagctgcatctccaaagaactggactcgtacctgggggagggaagctgtgggattccattttactgtgaagaattgcttaaaaacctggaacatcatgaggtactcgttttccaacaaacggagtctgaggaaaagacaaataggacctggaataacctgttcaagtattccattaagctaacagagaagttaaacatggttactctccatagtgataaggaaagtgaagaagtctgtcacctcacaagtggtgtcagactgaaaaacctgtcacctccaacgtcattaaaagaaatctctctgatccagctggatagcatgagactttcccaccaaatgctggtgagatgtgctgccatcattggcctgaccttcaccactgagttgttgtttgagattctcccctgttggaatatgaagatgatgatcaagaccctggcaaccctagtggaatctaacattttttattgtttccggaatggcaaggagcttcaaaaggccctgaaacagaatgatccctcatttgaggtgcactatcgttccttgtctctgaagcccagtgaagggatggatcacggtgaagaggaacagcttcgtgaactggagaatgaggtgatcgagtgccacaggattcgattctgtaaccctatgatgcagaaaacagcctacgagctgtggctcaaggaccagagaaaagccatgcacttgaaatgtgcccgctttttagaagaagatgcccacagatgtgaccactgccgaggcagggacttcattccctatcatcacttcacagtgaatattcggctcaacgctttagacatggatgccattaaaaagatggctatgtctcatggatttaaaactgaagaaaagcttatcttgtccaactcagagattcctgagacatctgcattttttcctgaaaatcgcagtcctgaagaaataagagaaaagatcttgaatttctttgaccacgttttaacaaaaatgaagacatctgacgaagacattatccctctggaatcttgccagtgtgaagaaatcctagagattgtcatcttgcctctggcccaccattttctggctttgggagaaaatgacaaagccttatattacttcttagaaattgcatctgcttatctcatcttttgtgataactacatggcatacatgtatttgaatgaaggacagaagttgctaaaaactctcaagaaggacaaatcttggagccagacatttgagtctgccaccttttacagcctcaaaggtgaggtctgtttcaatatgggccagatagtgcttgccaagaaaatgctgaggaaggcactgaagctcctcaaccgaatctttccttacaacttaatctccttgtttctccatatccatgtcgagaaaaacagacactttcattatgtgaatcggcaggcccaagagagcccacctccagggaagaagaggctggcacaactttaccggcaaactgtctgcctttccttgctgtggcgcatctatagctacagttatctttttcactgcaagtattatgcccacctggcagttatgatgcaaatgaatactgcactggaaactcaaaattgtttccagatcattaaggcttacctagactattcgctataccaccacctggctggctacaaaggtgtgtggttcaaatatgaagtcatggccatggagcacatcttcaacctccccctgaaaggcgagggcattgaaatcgtggcatacgtggctgagacactggtcttcaacaagctcataatgggacacctggatttggccattgagttaggctcccgagcccttcagatgtgggcactgctccagaatcccaaccgacattatcagtccctctgcagacttagcagatgtctccttctgaacagcagatacccgcaattgatccaggtgctggggcggctgtgggagctttctgtaacacaggaacacatcttcagcaaggcatttttctattttgtctgcttggacatcctgctttattctggttttgtttatagaacatttgaagaatgtttggaattcatacaccaatacgaaaacaacagaatcctcaagttccacagtggactcctcctgggactttattcctctgtagctatctggtatgccagacttcaggaatgggacaacttttacaaattttccaatagagctaaaaatcttttgccaagaagaaccatgacacttacttactatgacggaatatctaggtacatggaggggcaagttcttcaccttcaaaaacaaatcaaagaacagtcagagaatgcccaagccagtggggaggagctactcaagaacttggagaatctggtggctcaaaataccactggccctgtcttttgcccaaggctctaccacctgatggcttacgtctgtatattaatgggagatgggcagaaatgtggcctcttcctgaacacagccttgcggctctctgaaacacaggggaatatactggagaaatgctggctgaacatgaacaaagaatcatggtactcaacctctgagttaaaagaagaccaatggcttcagacgatcttgagtctcccatcatgggaaaaaattgtagcaggcagggtaaacattcaggatcttcaaaaaaacaaattcctgatgagagctaataccgtggacaatcatttctaacatgtcaaagaaaaaagattttaataagcactaaaaaaaaaaa

SEQ ID NO: 62375 - DNA, 6628 bp, Homo sapiens
tcaccatccccaaccccaccggcagcgacgccggctactacgagtgcgaggctgtcctgcgcagcagcagcgtcccctctgttgtccggggcgcctacctctcagtgctggaaccgcctcagtttgtcaaggagccagaaagacacatcactgcggagatggagaaggtggtggacatcccctgtcaggccaaaggtgtgccgccgccctccatcacctggtacaaggacgcagccgtggtggaggtggagaagttgacccgcttccggcagcgcaacgacgggggcctgcagatcagcggcctggtgcccgatgataccggcatgttccagtgcttcgcccgcaatgcagccggcgaggtgcaaacttccacctacctggctgtcaccagcatcgcccctaacatcaccagaggccccctggacagcacggtgatcgatggcatgtcagtggtgctagcatgtgagacctcgggggcgccccgaccagctatcacttggcagaaaggggagcgcatcttggccagtggctctgtgcagctgcctcgcttcacacccctggagtcgggcagcctcctcatcagccccacacacatctccgatgcggggacctacacctgcctggccaccaactctcggggggtcgatgaggcctcagcagacctagtcgtttgggctcggacccgcatcaccaagcccccccaggatcagagtgtcatcaagggcacccaggcctccatggtgtgcggagtgacccacgacccccgagtaaccatcaggtacatctgggagaaggacggggccaccctgggcacggagagccatcctcgtatccgcctggacagaaacggctccctgcacatctcacagacgtggtcgggagacatcggcacgtacacctgccgggtgatctcagcaggaggcaacgactctcgcagtgcccacctgcgagtcaggcaactgccccacgcgcccgagcacccagtggccactctcagcaccgtggaaaggcgagccatcaacctgacgtggaccaagccctttgatggcaacagccccctgatccgctacattctggagatgtcggagaacaatgccccctggactgtactcctggccagtgtggaccccaaagctacctcagtgacagtcaagggcctggttcctgcacgctcctaccagttccgtctttgtgccgtcaacgacgtggggaaaggacagttcagcaaagacaccgagagggtctccctccccgaggagccccccacggcccctccacagaacgtcatcgccagcggtcgaaccaaccagtccatcatgatccagtggcagccgcctcctgagagccaccagaatggaattctcaagggttacatcatcaggtactgcctggccgggctgcccgtggggtaccagtttaagaacatcacggatgctgatgtgaacaacctgctgctggaggatctcatcatttggaccaactacgagatcgaggtggctgcttacaacagcgctgggctgggggtctacagcagtaaagtcaccgagtggacgctgcagggagttcccacagtccctccgggcaatgtgcacgcggaagccaccaattccacgaccatccgcttcacctggaacgcccccagcccccagttcatcaacggcatcaaccagggctacaagctgatcgcctgggagccggaacaggaagaggaggttaccatggtgaccgcccggcctaactttcaagacagcatccacgtgggcttcgtgtctggcctgaagaagttcaccgagtacttcacctcagtgctgtgtttcaccacccccggggacgggccacgcagcaccccgcagctggtgcgcacccatgaggatgtgcctgggcccgtgggacacctgagcttcagtgagatcctggacacatcgctgaaggtcagctggcaagagccgggagagaaaaatggcatcctcacagggtaccggatctcctgggaggagtacaatcgaaccaacacccgtgtgacccactacctgcccaacgtgaccctggagtaccgtgtcacgggcctcaccgcgctcaccacctacaccatcgaggtggccgccatgacctcaaagggccagggccaagtgtccgcctccaccatctcctctggggtgcccccagaactcccagggccccccaccaacctgggcatttccaacatcggcccccgctctgtgaccttgcagttcaggccaggctacgatgggaaaacctccatctcccgctggctggtggaagcccaggtaggcgtggttggggagggagaggagtggttgctgatccaccagctctccaatgagcccgatgcccgctccatggaggtgcccgacctcaaccccttcacctgctacagcttccgcatgcgccaggtgaacatcgtgggcaccagcccccccagtcagccttctagaaagatccagaccctgcaggcaccccctgacatggccccagccaatgtgtctctgcgcacagccagtgagaccagcctgtggctgcgctggatgcctctcccggagatggaatacaatgggaaccctgagtccgtgggctataagatcaagtacagccggtcagacgggcatggcaagacgctgagccacgtggtgcaggaccgtgtggagcgggactacaccatcgaggacctggaggagtggacagagtaccgcgtccaggtccaggccttcaacgccatcgggagcgggccctggagccagacggtggtgggcaggacccgggagtcagttccctcttccggccccaccaatgtgtctgcactggccaccacctccagcagcatgctggtgcgctggagcgaggtccccgaggctgatcgcaacgggctcgtgctgggctataaggtgatgtataaggagaaggactcggacacccagccccgattctggctggtggaaggcaactcgtctcgcagtgcccagctcaccggcttgggcaaatacgtgctctatgaagtccaggtgctggccttcacacgcatcggggacggcagccccagccaccctcccatcctggagcggacgctggatgatgtcccaggaccacccatgggcatcctgttcccagaggtgcggaccacgtctgtgcggctgatctggcagccccctgccgcccccaatggcatcattcttgcttaccagatcacacaccggctcaacaccaccacggccaacaccgccactgtggaggtgctggcacccagcgcccggcagtacacagccacgggcctcaagccagagtctgtctacctgttccgcatcacggcccagacccgcaagggctggggagaagctgccgaggccttggtggtgaccaccgagaagagagaccgtccgcagccccccagcaggccgatggtgcagcaggaggatgtgagagcacgcagcgtgctgctgtcctgggagccagggagcgacgggctctcccctgtgcgctactacaccatccagacccgcgagctgcccagcggcaggtgggcactgcactcggcctccgtgagccacaatgcctccagcttcattgtggacaggctgaagcccttcacgtcctacaagttccgagtgaaggcgaccaatgacattggcgacagcgagttcagcgaggagtcggagtcactgaccaccctgcaggctgcccccgatgaagcacccaccatcctctccgtgacgccccacaccaccacctccgtgctaatccgatggcagccgccagcagaggacaagatcaatggcatcctcctgggcttccggatccgataccgggagctgctctatgaaggactgaggggcttcacgcttcgaggcatcaacaacccaggggccacatgggctgagcttacctccatgtactccatgcggaacctgagccggcccagcctcacgcagtacgagctggacaacctgaacaagcacaggcggtacgagatacggatgagcgtgtacaacgctgtgggtgaggggccctccagccccccgcaggaggtctttgttggggaggcagtgcccacagcagcacctcgtaacgtggtcgtccacggcgccacggccacacagctggacgtgacttgggagccacctccgctggacagccagaatggagacatccaggggtacaagatttatttctgggaagcccagcgggggaacctcacagagcgagtgaagacgcttttcctggctgagaacagcgtgaagctcaagaacttgactggctacacggcctacatggtcagcgtggccgccttcaacgccgctggggatgggcctcggagcacccccacccaaggccagacccagcaagcagcccccagcgctcccagctcggtcaagttcagtgagctgaccacaacctcagtgaatgtgtcctgggaagccccgcagttccccaatggcatcctggagggctacaggctggtgtacgagccctgcagccccgtggatggagtcagcaagatcgtgaccgtggacgtgaaggggaacagccccctgtggctgaaggtgaaggacctggcggagggggtgacctacaggttccgcatcagagccaagaccttcacctacgggccggagatcgaagccaacgtcaccacgggccccggagaaggtgccccaggaccgcctggcgtgcccatcatcgtgcggtacagctctgccatcgccattcactggtccagcggagacccgggcaaagggcccatcacccgctacgtcatcgaggccagaccttcagacgagggactatgggacatcctcatcaaagacatccccaaggaggtgagctcctacacgttcagcatggacatcctgaagccgggcgtgagctatgacttccgggtcatcgcggtcaacgactatggtttcggcacccccagcagcccctcccagtctgtgccagcccagaaagccaaccccttctatgaggagtggtggttcttggtggtcattgccctggtcggcctcatcttcatcctgcttctggtcttcgtgctcatcatccggggccagagcaagaagtacgccaagaagacagactcggggaacagtgccaagtctggagccctaggccacagcgagatgatgagcttggatgaaagcagcttccctgccctggaactcaacaacaggcggctctccgtcaagaactctttctgccgaaagaacggcctgtacaccaggtctccccccaggcccagcccaggcagcctgcactactcggatgaggatgtcaccaaatacaacgacctcatccctgcagagagcagcagcctgacggagaagccctcagaaatctccgactctcagggaagtgacagcgagtacgaggtcgactcaaaccaccagaaggcccactcctttgtcaaccactacatcagtgaccccacatactacaactcgtggcggcgacagcagaagggcatctcgagggcacaggcctacagctacacggagagcgactcgggtgagccagaccacaccaccgtcaccaacagcaccagcacccagcagggcagcctctttcggcccaaggccagtcggactccaacgccccagaacccccctaaccccccaagtcagcagagcaccctctaccgtccccccagcagcctggccccaggctcccgggctcccatagcaggattttcatcatttgtttgacatcagaagaggaaaaagcagaaagagaaatggcaccaaactcctccttcacccctcctctcactgcctgccagaaaacaaaaacaccaagaaaccaagtcaacttttcacctcctgagtttatttttccagagattccagggccagcaaagccggcgttcagaaggagggagaaaaccgtgagaggatgtgtgtggccagcagctcttcagctttgagatggtggggttcactgctcccttgggaattacacggagctggggaagtggctgtgtcactgctatggacacggagtggggcgggcatctggagagagagagggagcggaggctaaggactggaggccgccaggcaggcgtggccgagggaagaaaaagcttctggatgtccagccagctgcccccttccagcccctccaggacccctggacccactgccgctgctctctgcaaaaagaatgggcatcccggaggccacgcctatcttctctctctgctcctccttccctccatgcaccatcactgtggctggcaggcatcggacagcctcatccagaccccctgccctgtcttggcaacctctactgcccatctcccctgctcaacttctccaccaagcatttggtttatttagaaaaaggaagaaaaacaaaaaacaaaaaactaaagggtgagaatttgcttagcgccttccttgttcctgcatattttttaaaatattgaatccaaggaagagagcccaagggtaggggagaaaccccccacaactgacccctgcctccctgtgctggaattgactttcctgagcatggacaaggaaaggtgaagtctggggagcagaggtgtaaataaggcgactggccttggcactgtgggatgattaggtttaacgcattgtgggcaagataagaatga

SEQ ID NO: 62376 - DNA, 3949 bp, Homo sapiens
gtggagggtcccggccgggagccgcggaaagagtagggctccccagacaacggggtccgacgagcagttgggcacgggctgagtccgcctgccggcagaatgtccctggctgcttattgcgtcatctgttgcagaagaataggaacctctacttccccaccaaaaagtggcacacactggagagatatcagaaatataataaagtttactggatcacttattttaggaggttctttatttcttacatatgaagttctggccctgaagaaggctgtgacattagatactcaagtggtagaacgagaaaaaatgaagtcatatatatatgtgcacacagtttctttagataaaggagaaaatcatggtattgcctggcaggcaagaaaagaacttcacaaagcagtaagaaaagtattggcaacatcagccaagatactgcggaatccatttgctgatccttttagtacagttgatatagaagatcatgagtgtgctgtgtggctgctcctacggaagagcaagtcagatgacaaaaccacgcgactcgaggctgtgcgggaaatgtcggagacccatcactggcatgattaccagtataggataattgctcaagcctgtgatccgaaaactcttattggtttggcacgaagcgaagagagtgatcttcgcttttttctcctaccacctcctttgccatctttaaaagaagattcttccactgaagaagagctcagacagttgctggcttccttacctcaaacagagctagatgagtgtatccagtattttacatctttggctcttagtgaaagcagtcagagtctagctgctcagaagggtggtttatggtgttttggaggaaatggacttccttatgctgaaagttttggagaagttccttcagcaacagtggaaatgttctgtttagaagctatagtaaaacattctgagatatccacacattgtgataaaatcgaagcaaatggaggcctgcagctacttcagaggctgtaccgacttcacaaggactgccctaaagtacagagaaatataatgcgtgtcattggaaatatggctttgaatgaacatcttcattcttctatagttcgctcaggctgggtttccatcatggcagaagcaatgaaatctccccacattatggagtcctcacacgctgccagaatcctggcaaatctagaccgagaaactgtgcaagaaaaatatcaggatggcgtatatgtgctgcatccccaatatcgaacaagtcagcccattaaagcagatgtcctttttattcatggccttatgggagcagcattcaaaacatggcgccagcaggacagtgagcaggctgtaattgaaaaacctatggaggatgaagacagatatacgacgtgctggcccaagacatggttagcaaaagactgtcctgctctccgaattatatctgtggagtatgacaccagcctcagcgactggagagcaaggtgccctatggaaagaaagtccattgcattcagaagcaacgaacttcttaggaagctcagagctgctggtgttggggataggccagtggtttggatatcacatagcatgggaggtcttcttgtcaaaaagatgctgttggaagcctctacgaagccagaaatgagtactgttatcaacaataccagaggaataattttttatagtgtccctcatcatggatcacgtttggctgaatacactgttaatattcgctatcttctcttcccctcgttggaagtcaaagaactcagcaaggattctcctgcacttaaaacactacaagatgactttctggagtttgctaaagacaaaaacttccaggtgctgaattttgtggaaacactaccaacctacattggcagcatgattaagctccatgtggtacctgtggaatcagcagatttaggcattggagatctaattcctgtggatgttaaccatttgaacatttgtaagccaaagaaaaaggatgcttttttgtaccagcgtactttacaattcattcgtgaagctttagccaaagaccttgaaaactaacagttgtgctcttccagttttcatatgtgaattcagtgcaagaaacttggtgttctgtttcttcttttaagctctatgcaatcatgcaaacatagtgatcatagcgtcaacatggtctggagtgtgttgcagactacagaacattgttctcccttcaagcgctgtaaagcaccaacccggaagtggcaggcacagaaggaagggctggattgggcccctttggtgtaaagaagtccctgtgtgctgctttatggttcgcagtgttgggcttggtgactggagcaaagctgctgtgagagagtgtcctttcccatctgtgactttcctggtgcatccaggaggggcacggcaggttctgaggtaactcaacttaccataaaaatgccattaagagagtacctaaaatggagagaagaatgaactagaacattcaagactcttttacttctgggtattgatttgctgtacatttttaaagtttgagtttttagctcagttctaccttttatctgacacattattactagtgttaactttgttagacttattgtcatgtctgggtcagttccttgtatctattttcgtattcctgagaacaaatctttttcttagaaaaattctagcttataataattcttttcagactgtagctgcctatgcttggaatttgtcctagataaggataaagtagctaatccattattgatcacagtatgaagtaaaactattctaagccattatatgaattagcaattcttagtatcaagattctcagattctctttggctaaataaacctttcttcttccttgctcatttgcaagtggtattaattgacctctatagcatgtgagtagtagataatcatgtcgatgacctttttttctttagagtaacagcattattgagatataatttacataccataagattcacccttttaaattatacaattcatttttgttttgttttgtttgtttagagacagggtctgactctgttgcccaagctggagtgcagtggcatgatcatagctcattgtaacctcaaactcctgggctcaagagatccttttgcttcagcctcccaagcagctaggactacaggcacatgccaccacacttgggtaattaaaaaataaataaatacttttttgtagagacagggtctcactgtgttgcccaggtctcaaactcccgatctcaagccaccctcccaaaatgctgtgattataggccagagccattgttcccaggctcaattcattggtttttagtatagttcactgagttgtgcaacatcattgctatttaatttcaggctatttcatcatccccaaaagaaccccatacccatgagcagtcagttcccacctctgctttcccaagcctgcggtaaacactaatctgttttctgtctctatggatttgggaattttatgtaaatggaatcatacaatatgtggccctctctgccttcttccttctattagcatgttttcaaggttcattcatgatatagcatgtatcagtactacttcatttctttttatggccgaaattactccattgtatgatatgccatgtttctttatccattcatcagctgatggacatctaggttctgttcatttttgtctatgataaataatgctaccatgatcatttgtgtacaaatttatgtgtggatagatgtttttgattctcttgggtggaattgctggtcaaatggtaagtctatgtttaaattttgaagatggtgaacttttgtagaatgagatagtcgaagctaaaactggagtatggcatctgaaggtaaatggctcatcaataaactcgatatcaacaattaaaaaaaaaaaaaaaaaaaaaaaaaaaaaaaaaaaa

SEQ ID NO: 62377 - DNA, 3631 bp, Homo sapiens
cgcggagcgccgccgccgcctccgccggagcgcgggtggaggggggcggggagagctgccggccgccccgctccgccgaacccagcaggaaggagggcgcgagcgggcgagcgcgggcagcacgggaggaaaaagcttccgcgcgggggagcgaaaagacggaaagaaagaaagaaaacgagcgcgagagggggaaaagcgagcgatcgagcgagcgcgcgcgcgaaaactccgggcaggaaggtggacttttaaatattctccactgaagcaaatgctgcaacaatttgcatttccttcaccaatgtcgtcttgtgccttttcttgttcctactgtaaaggagatgggttagatgttcactttcatttggacccgtggatacccattgaacagatgcttgaaacctgcaagtaatcttcagatcctagcagaaccataggcctttcctttgttttgggaggatatagcctgcctatatgctgtggaaatgaacggggagcagcagcttgatgcagatgccggctctggtatggaagaggtagaattaagctgggaagattatctagaagaaacagggtccacagcagttccctatgggtcttttaaacatgtggacacacgtttgcaaaatggatttgctcctgggatgaagctggaggtggctgtgagaacagatcctgagacctactgggttgccaccgttatcactacctgtgagcagttgctccttctccgctatgatggctatggggaggatcggagagcagatttctggtgtgacatcaggaaggctgatctctaccccattgggtggtgtgagcagaataagaagacccttgaagccccagaaggcatcagagataaagtatctgactgggatgagtttctgcggcagaccctgataggagcatgtagtcctcctgttccgctgctagagggcctccgtaatgggaggaatcctttagatctcattgctccaggatccagactagaatgtcaagctttccaggactctttaagcacttggattgttactgtagtagaaaacattggaggaaggctgaagctacgttatgaaggacttgaaagttctgacaattatgaacattggttgtattacttggatccatttcttcatcacgttggttgggctgctcaacagggatatgagcttcagcccccttcagccattagacatctaaaaaatgaagctgagtggcaagagattttggccaaagtgaaagaggaagaggaagagccattaccatcttacttatttaaggacaaacaagttattggcattcatacattctctgtaaacatgaaattggaagctgtagacccctggtctccttttgggatctctcctgctacagttgttaaggtttttgatgagaagtactttctggtggaaatggatgacttgcgtcctgagaaccacgcacggcgatcctttgtgtgccacgccgacagtcctggcatcttccctgtgcagtggagtctgaagaatggcctacacatcagcccccctccaggctacccaagccaggactttgactgggctgactacctcaaacagtgtggtgctgaagctgctccccagaggtgcttccctccgttaatttctgaacatgaatttaaggagaacatgaagctcgaggcggtgaaccccattctccctgaagaagtgtgtgttgctaccatcactgcagtgagaggctcctacctgtggctccagctggagggttctaagaagcctatacctgaatgtattgtgagtgtggaatccatggatatatttcctttgggctggtgtgaaaccaacggccaccccctcagcactcctcgccgagcacgagtatataaacagaggaaaattgcagtggttcagccagaaaaacaagtaccatcctcgaggactgtccacgagggcctgaggaatcaggagctgaactccacagagtcagttatgattaatggaaaatattgctgtccaaagatatacttcaaccaccgttgcttctcagggccatatcttaacaaaggaagaattgctgagctgcctcaatgtgtaggacctgggaactgtgttctggtccttagagaggtcctcactttacttatcaatgcagcctacaaacccagccgtgtccttcgggagctccagctggacaaagactctgtgtggcacggatgtggggaagtcctaaaagccaaatataaaggaaagagttatcgggctactgttgagatagtgaaaacagcagatcgggtgactgaattctgccggcaaacctgtatcaaactggaatgctgtcctaacctcttcggtccacggatggttctggataagtgttctgagaactgttctgtacttacaaagaccaaatacacacactattacggaaagaagaaaaataaaagaattgggaggccacctggtgggcatagtaacttagcttgtgccctgaaaaaagccagtaagaggagaaagaggcggaaaaatgtttttgttcataagaagaaacgctcctctgcatctgttgataataccccagcgggctctccccagggaagtgggggtgaagatgaggatgacccagatgaaggggatgatgattccctaagtgaaggcagtacatccgagcagcaggatgagctacaggaagaatcagaaatgtcagaaaaaaagtcatgctcctcttctcccacccaaagtgagatatccacatcgctgcctccagatagacaaaggagaaaaagggagcttcgcaccttttcattttctgacgatgaaaataaacctccttcaccaaaggaaataaggatcgaagttgctgaaaggcttcacctggacagtaaccccttgaagtggagtgtggcagacgttgtgcggttcatcagatccactgactgtgctccattagcaagaatattcctagaccaggaaattgatgggcaggccctgttgctccttacccttcccactgttcaagaatgcatggacttaaaattgggccctgccatcaaactttgccatcacatagagaggatcaagtttgctttttatgagcagtttgccaactgagaaggacaaccaaagtgagctggatctttgaagcacaaatgcagcaaatccttcaccctgctttataagtggagctggaatagtcctggggctctggggcctgcaggtatcagcttgctctctttgcactttcggggaaggaggactcacagtgaggaagcaaaaactgtgcacagaagtggatcacctgctggtggaaatgtggacatctcttgttcagcagatggcagtttttaaaaaataaaggttgtgaggaaaagacttatataagaagaaaagcatttccagtggtgtggcctgaaaacaaagaataacctaggctgctggaaagcacccttttggttgttttcattctgttccctcccattgtagattgaactttgttctctgctttctttttcttggaaagagaggacttagctttaagtcagcactgatttgggactgttcctaaggcatatcagtgcttcattgtcattgtgtttttaaactttttaaaattaaaacagttcattttggggatgaaaaaaaaaaaaaaaaaa

SEQ ID NO: 62378 - DNA, 3712 bp, Homo sapiens
ggcccgggcggtcgctgcgcggtggcggagcgtctagtggccgccgcaaccggtggctccgggccgccgttgtgaagtgagcgggcctctcccgcgccgcggcccgccgggcaccgccgctggaccccgcgccgacccggcagcgccccgacctgccgctcgggaggtccgcgaccgtttcgatttctgttcctaaagtccgattttggacgctgaaaaggaggctgtggaggggcgagcggcgtcctgggaagcaaggcctgctctgtgcggagcagaaacgccttgtgcgaacagaaataaattcccgcggaaaggatgaaggtggacttttaaatattctccactgaagcaaatgctgcaacaatttgcatttccttcaccaatgtcgtcttgtgccttttcttgttcctactgtaaaggagatgggttagatgttcactttcatttggacccgtggatacccattgaacagatgcttgaaacctgcaagtaatcttcagatcctagcagaaccataggcctttcctttgttttgggaggatatagcctgcctatatgctgtggaaatgaacggggagcagcagcttgatgcagatgccggctctggtatggaagaggtagaattaagctgggaagattatctagaagaaacagggtccacagcagttccctatgggtcttttaaacatgtggacacacgtttgcaaaatggatttgctcctgggatgaagctggaggtggctgtgagaacagatcctgagacctactgggttgccaccgttatcactacctgtgagcagttgctccttctccgctatgatggctatggggaggatcggagagcagatttctggtgtgacatcaggaaggctgatctctaccccattgggtggtgtgagcagaataagaagacccttgaagccccagaaggcatcagagataaagtatctgactgggatgagtttctgcggcagaccctgataggagcatgtagtcctcctgttccgctgctagagggcctccgtaatgggaggaatcctttagatctcattgctccaggatccagactagaatgtcaagctttccaggactctttaagcacttggattgttactgtagtagaaaacattggaggaaggctgaagctacgttatgaaggacttgaaagttctgacaattatgaacattggttgtattacttggatccatttcttcatcacgttggttgggctgctcaacagggatatgagcttcagcccccttcagccattagacatctaaaaaatgaagctgagtggcaagagattttggccaaagtgaaagaggaagaggaagagccattaccatcttacttatttaaggacaaacaagttattggcattcatacattctctgtaaacatgaaattggaagctgtagacccctggtctccttttgggatctctcctgctacagttgttaaggtttttgatgagaagtactttctggtggaaatggatgacttgcgtcctgagaaccacgcacggcgatcctttgtgtgccacgccgacagtcctggcatcttccctgtgcagtggagtctgaagaatggcctacacatcagcccccctccaggctacccaagccaggactttgactgggctgactacctcaaacagtgtggtgctgaagctgctccccagaggtgcttccctccgttaatttctgaacatgaatttaaggagaacatgaagctcgaggcggtgaaccccattctccctgaagaagtgtgtgttgctaccatcactgcagtgagaggctcctacctgtggctccagctggagggttctaagaagcctatacctgaatgtattgtgagtgtggaatccatggatatatttcctttgggctggtgtgaaaccaacggccaccccctcagcactcctcgccgagcacgagtatataaacagaggaaaattgcagtggttcagccagaaaaacaagtaccatcctcgaggactgtccacgagggcctgaggaatcaggagctgaactccacagagtcagttatgattaatggaaaatattgctgtccaaagatatacttcaaccaccgttgcttctcagggccatatcttaacaaaggaagaattgctgagctgcctcaatgtgtaggacctgggaactgtgttctggtccttagagaggtcctcactttacttatcaatgcagcctacaaacccagccgtgtccttcgggagctccagctggacaaagactctgtgtggcacggatgtggggaagtcctaaaagccaaatataaaggaaagagttatcgggctactgttgagatagtgaaaacagcagatcgggtgactgaattctgccggcaaacctgtatcaaactggaatgctgtcctaacctcttcggtccacggatggttctggataagtgttctgagaactgttctgtacttacaaagaccaaatacacacactattacggaaagaagaaaaataaaagaattgggaggccacctggtgggcatagtaacttagcttgtgccctgaaaaaagccagtaagaggagaaagaggcggaaaaatgtttttgttcataagaagaaacgctcctctgcatctgttgataataccccagcgggctctccccagggaagtgggggtgaagatgaggatgacccagatgaaggggatgatgattccctaagtgaaggcagtacatccgagcagcaggatgagctacaggaagaatcagaaatgtcagaaaaaaagtcatgctcctcttctcccacccaaagtgagatatccacatcgctgcctccagatagacaaaggagaaaaagggagcttcgcaccttttcattttctgacgatgaaaataaacctccttcaccaaaggaaataaggatcgaagttgctgaaaggcttcacctggacagtaaccccttgaagtggagtgtggcagacgttgtgcggttcatcagatccactgactgtgctccattagcaagaatattcctagaccaggaaattgatgggcaggccctgttgctccttacccttcccactgttcaagaatgcatggacttaaaattgggccctgccatcaaactttgccatcacatagagaggatcaagtttgctttttatgagcagtttgccaactgagaaggacaaccaaagtgagctggatctttgaagcacaaatgcagcaaatccttcaccctgctttataagtggagctggaatagtcctggggctctggggcctgcaggtatcagcttgctctctttgcactttcggggaaggaggactcacagtgaggaagcaaaaactgtgcacagaagtggatcacctgctggtggaaatgtggacatctcttgttcagcagatggcagtttttaaaaaataaaggttgtgaggaaaagacttatataagaagaaaagcatttccagtggtgtggcctgaaaacaaagaataacctaggctgctggaaagcacccttttggttgttttcattctgttccctcccattgtagattgaactttgttctctgctttctttttcttggaaagagaggacttagctttaagtcagcactgatttgggactgttcctaaggcatatcagtgcttcattgtcattgtgtttttaaactttttaaaattaaaacagttcattttggggatgaaaaaaaaaaaaaaaaaa

SEQ ID NO: 62379 - DNA, 3512 bp, Homo sapiens
cgcggagcgccgccgccgcctccgccggagcgcgggtggaggggggcggggagagctgccggccgccccgctccgccgaacccagcaggaaggagggcgcgagcgggcgagcgcgggcagcacgggaggaaaaagcttccgcgcgggggagcgaaaagacggaaagaaagaaagaaaacgagcgcgagagggggaaaagcgagcgatcgagcgagcgcgcgcgcgaaaactccgggcagcactttcatttggacccgtggatacccattgaacagatgcttgaaacctgcaagtaatcttcagatcctagcagaaccataggcctttcctttgttttgggaggatatagcctgcctatatgctgtggaaatgaacggggagcagcagcttgatgcagatgccggctctggtatggaagaggtagaattaagctgggaagattatctagaagaaacagggtccacagcagttccctatgggtcttttaaacatgtggacacacgtttgcaaaatggatttgctcctgggatgaagctggaggtggctgtgagaacagatcctgagacctactgggttgccaccgttatcactacctgtgagcagttgctccttctccgctatgatggctatggggaggatcggagagcagatttctggtgtgacatcaggaaggctgatctctaccccattgggtggtgtgagcagaataagaagacccttgaagccccagaaggcatcagagataaagtatctgactgggatgagtttctgcggcagaccctgataggagcatgtagtcctcctgttccgctgctagagggcctccgtaatgggaggaatcctttagatctcattgctccaggatccagactagaatgtcaagctttccaggactctttaagcacttggattgttactgtagtagaaaacattggaggaaggctgaagctacgttatgaaggacttgaaagttctgacaattatgaacattggttgtattacttggatccatttcttcatcacgttggttgggctgctcaacagggatatgagcttcagcccccttcagccattagacatctaaaaaatgaagctgagtggcaagagattttggccaaagtgaaagaggaagaggaagagccattaccatcttacttatttaaggacaaacaagttattggcattcatacattctctgtaaacatgaaattggaagctgtagacccctggtctccttttgggatctctcctgctacagttgttaaggtttttgatgagaagtactttctggtggaaatggatgacttgcgtcctgagaaccacgcacggcgatcctttgtgtgccacgccgacagtcctggcatcttccctgtgcagtggagtctgaagaatggcctacacatcagcccccctccaggctacccaagccaggactttgactgggctgactacctcaaacagtgtggtgctgaagctgctccccagaggtgcttccctccgttaatttctgaacatgaatttaaggagaacatgaagctcgaggcggtgaaccccattctccctgaagaagtgtgtgttgctaccatcactgcagtgagaggctcctacctgtggctccagctggagggttctaagaagcctatacctgaatgtattgtgagtgtggaatccatggatatatttcctttgggctggtgtgaaaccaacggccaccccctcagcactcctcgccgagcacgagtatataaacagaggaaaattgcagtggttcagccagaaaaacaagtaccatcctcgaggactgtccacgagggcctgaggaatcaggagctgaactccacagagtcagttatgattaatggaaaatattgctgtccaaagatatacttcaaccaccgttgcttctcagggccatatcttaacaaaggaagaattgctgagctgcctcaatgtgtaggacctgggaactgtgttctggtccttagagaggtcctcactttacttatcaatgcagcctacaaacccagccgtgtccttcgggagctccagctggacaaagactctgtgtggcacggatgtggggaagtcctaaaagccaaatataaaggaaagagttatcgggctactgttgagatagtgaaaacagcagatcgggtgactgaattctgccggcaaacctgtatcaaactggaatgctgtcctaacctcttcggtccacggatggttctggataagtgttctgagaactgttctgtacttacaaagaccaaatacacacactattacggaaagaagaaaaataaaagaattgggaggccacctggtgggcatagtaacttagcttgtgccctgaaaaaagccagtaagaggagaaagaggcggaaaaatgtttttgttcataagaagaaacgctcctctgcatctgttgataataccccagcgggctctccccagggaagtgggggtgaagatgaggatgacccagatgaaggggatgatgattccctaagtgaaggcagtacatccgagcagcaggatgagctacaggaagaatcagaaatgtcagaaaaaaagtcatgctcctcttctcccacccaaagtgagatatccacatcgctgcctccagatagacaaaggagaaaaagggagcttcgcaccttttcattttctgacgatgaaaataaacctccttcaccaaaggaaataaggatcgaagttgctgaaaggcttcacctggacagtaaccccttgaagtggagtgtggcagacgttgtgcggttcatcagatccactgactgtgctccattagcaagaatattcctagaccaggaaattgatgggcaggccctgttgctccttacccttcccactgttcaagaatgcatggacttaaaattgggccctgccatcaaactttgccatcacatagagaggatcaagtttgctttttatgagcagtttgccaactgagaaggacaaccaaagtgagctggatctttgaagcacaaatgcagcaaatccttcaccctgctttataagtggagctggaatagtcctggggctctggggcctgcaggtatcagcttgctctctttgcactttcggggaaggaggactcacagtgaggaagcaaaaactgtgcacagaagtggatcacctgctggtggaaatgtggacatctcttgttcagcagatggcagtttttaaaaaataaaggttgtgaggaaaagacttatataagaagaaaagcatttccagtggtgtggcctgaaaacaaagaataacctaggctgctggaaagcacccttttggttgttttcattctgttccctcccattgtagattgaactttgttctctgctttctttttcttggaaagagaggacttagctttaagtcagcactgatttgggactgttcctaaggcatatcagtgcttcattgtcattgtgtttttaaactttttaaaattaaaacagttcattttggggatgaaaaaaaaaaaaaaaaaa

SEQ ID NO: 62380 - DNA, 868 bp, Homo sapiens
ccaggacaggcattcaggcagagcaagctccaggtttcaccacaatgcccatccctgcctccccactccacccacctctgccttccttactgctgtatctgctgcttgaactggcaggagtcacacatgtgttccatgtgcaacaaacggagatgtcacagactgtatcaactggggagtcaatcatcttgagttgcagcgtacccgataccttaccaaatggacctgtcttgtggttcaagggaacagggccaaaccggaaattaatctacaatttcaaacaaggtaactttcccagagtaaaagagattggagacaccaccaagcctggcaacacagacttttccacccgcatccgtgaaatctctcttgctgatgctggcacctattactgcgtgaagttcataaaaggaagagctatcaaggagtaccaatcaggtcggggcactcaggtgtttgttactgagcagaatccaagacctcccaagaacagacctgcaggcagagcaggctccagggcccaccatgatgcccatacctgcctctcggccctgcctgagagaaacagcacaaactatttcgtccaaccctgctgctgcctccggctgctgggactcacaggcttgctgtcaaaataatccaaacagggaaggaacgtacaagtaaataacaaaagcccccatactcttctgactccctggagacagctactttttaggagtttcatttgccttcttcaagagagctttcttccactgacataaaatgccagcttgatcgtacaataaatctgtctatttacctgggtccaaaaaaaaaaaaaaaaaaaaaaaaaaaaaaaaaaaaaaaaaaaaaaaaaaaaaaaaaa

SEQ ID NO: 62381 - DNA, 1719 bp, Homo sapiens
gatagaccatgagcagccatggcaacagcctgttccttcgggagagcggccagcggctgggccgggtgggctggctgcagcggctgcaggaaagcctgcagcagagagcactgcgcacgcgcctgcgcctgcagaccatgaccctcgagcacgtgctgcgcttcctgcgccgaaacgccttcattctgctgacggtcagcgccgtggtcattggggtcagcctggcctttgccctgcgcccatatcagctcacctaccgccagatcaagtacttctcttttcctggagagcttctgatgaggatgctgcagatgctggtgttacctctcattgtctccagcctggtcacaggtatggcatccctggacaacaaggccacggggcggatggggatgcgggcagctgtgtactacatggtgaccaccatcatcgcggtcttcatcggcatcctcatggtcaccatcatccatcccgggaagggctccaaggaggggctgcaccgggagggccggatcgagaccatccccacagctgatgccttcatggacctgatcagaaatatgtttccaccaaaccttgtggaggcctgcttcaaacagttcaagacgcagtacagcacgagggtggtaaccaggaccatggtgaggacagagaacgggtctgagccgggtgcctccatgcctcctccattctcagtggagaacggaaccagcttcctggaaaatgtcactcgggccttgggtaccctgcaggagatgctgagctttgaggagactgtacccgtgcctggctccgccaatggcatcaacgccctgggcctcgtggtcttctctgtggcctttgggctggtcattggtggcatgaaacacaagggcagagtcctcagggacttcttcgacagcctcaatgaggctattatgaggctggtgggcatcattatctggtatgcacctgtgggcatcctgttcctgattgctgggaagattctggagatggaagacatggccgtcctggggggtcagctgggcatgtacaccctgaccgtcatcgtgggcctgttcctccatgccggcattgtccttcccctcatctacttcctcgtcactcaccggaaccccttccccttcattgggggcatgctacaagccctcatcaccgctatgggcacgtcttccagctcggcaacgctgcccatcaccttccgctgcctggaggagggcctgggtgtggaccgccgcatcaccaggttcgtcctgcccgtgggcgccacggtcaacatggatggcactgccctctacgaggccctggctgccatcttcattgctcaagttaacaactacgagctcaacctgggtcagatcacaaccatcagcatcacggccacagcagccagtgttggggctgctggcatcccccaggcgggtctggtcaccatggtcattgtgcttacgtcggtcggcttgcccacggaagacatcacgctcatcatcgccgtggactggttccttgaccggcttcgcacaatgaccaacgtactgggggactcaattggagcggccgtcatcgagcacttgtctcagcgggagctggagcttcaggaagctgagcttaccctccccagcctggggaaaccctacaagtccctcatggcacaggagaagggggcatcccggggacggggaggcaacgagagtgctatgtgaggggcctccagctctg

SEQ ID NO: 62382 - DNA, 2201 bp, Homo sapiens
ggccagttcctagtcggtggctccatgctggtctctgatgtttaggaagtggtgtcagcagagactgagctgcaccctttctttggacagatggcaggagaggagaacttcaaggaagagctcagatcccaggatgcttccaggaacttgaaccagcatgaggtagcaggacatccacattcctggtctctggagatgctgttacgcagattgagggctgtccacaccaagcaggatgacaagtttgccaacctcctggatgcggtgggggagtttggcacattccagcagaggctagtagccctcacctttatccccagcatcatgtcggccttcttcatgtttgctgaccacttcgtgttcacagcccagaagccctattgcaataccagctggatcctggcagtgggcccccacctgtccaaagctgagcagctgaatctgaccataccccaagcacccaatggcagtttcctgacatgcttcatgtaccttcctgtgccttggaatctggattctaccatccagtttggcctcaatgacacagacacatgccaagatgggtggatctatcctgacgctaagaagcgatcgctgatcaatgagtttgacttggtatgtggcatggagacgaagaaggacactgcacagatcatgttcatggcagggctcccgataggctctctcatcttcaggctcataactgacaagatgggccgctaccctgccatcctgctgtcactgctggggctgatcatcttcggctttgggacagccttcatgaacagctttcacctgtatttgttctttcgctttggcatctcgcagtcagtggtgggctacgccatcagcagcatttctttggccactgagtggttagtgggtgagcaccgggcccacgccattatcctgggacactgctttttcgctgtgtgggccatgttgctgacagggatcgcctacggtcttccccactggcagctgctgtttctggtgggtgggatacttgtgatccccttcatctcctatatctggattctcccggagtccccgcggtggctgatgatgaaagggaaggtgaaggaggccaagcaggtgctgtgctacgccgcaagtgtgaacaagaagaccattccttcaaatctgctggacgagctgcagctgcccagaaagaaggtgactcgggcctctgtcctggacttctgtaagaataggcagctctgcaaggtgaccttggtgatgagctgtgtgtggtttaccgtcagttacacctattttacgttgagcctgagaatgagagagctgggcgtgagcgtccacttcagacacgtggtccccagcatcatggaggtgcctgcccggctgtgctgcatctttctcctccagcagattgggaggaagtggagcctggctgtgactctcctccaagccatcatctggtgcttgcttctccttttcctccctgaaggggaggatggcctcagactcaagtggccacgttgtccggccacagagctgaaatccatgacgatcttggtgctcatgctcagagagttcagcctggccgccactgtcactgtgttcttcctctacaccgctgagctcctccccactgtgctcagggcgacaggtctggggctggtgtctctggcctcggtggctggagccatcttgtccctgacaatcatcagccagaccccctccctcctgcccatctttctctgctgcgtcttagccatcgtggccttttccctctcctccctgctgccggaaacgcgagatcagcccctctccgagagcctgaaccactcctcacagataaggaataaggtcaaggacatgaagactaaggaaacatcatctgatgatgtctgaggaagcggccaagaatgtcattctcaatgcccagatcctgagattggacccataccctgtctccaaccctgccttgaagcaattcaataaagaggaagcaaacagccaggctccctgagggccaggcccccagaccatcttgggttggaattgagtggccaagtatggggtcatggattccaggccacaaattccaggcctagttcagtttgggggcagggtcagtcctgctcccaggccagcccttgacattaaaaaaaaatgccccctccttctgcaggagctctgctgtgattcattccaataaaggtacaatgttggtcttg

SEQ ID NO: 62383 - DNA, 2456 bp, Homo sapiens
gagcctggccccacgtccaggcaccaggacctccaatccaatggtgtcttcttcctcccagtcacactgttcactttgccctacagcagcaagggctaaactaggagaggccaaaagcccaggcaagtcctggttgggcaagcaattgcgagtgaaactgaggaccatcctgactgagatgggtctttcataagtcccccaagagccaggtgaggcatcatcaacatcagcctctcctgccaccaccgcttccctgattcatgcacttcaggtttcagccagcagcacgcatccttggggttaggagccagcatctcaggtcggcagccatggtttctctggagaaagacccgtcagaggctcattcagagccttaaccctgagcctctgccacctacccaccgtgttgaagatgtcattgcttggaagggactacaacagtgagctgaactccttggacaacggacctcagtcaccctcagagagcagcagtagcattacttcagagaatgtccatcctgctggagaagctggactatcgatgatgcaaactttgatccacttgttgaaatgcaacattggcacagggctcctggggcttcccctggccataaagaatgccggcttgttggtcggtcctgtcagccttctggccatcggggtcctcaccgtgcactgcatggtcatcctgttgaactgtgctcaacacctcagccagagactgcagaagacttttgtgaactatggagaggccacgatgtacggccttgaaacctgcccgaacacctggctgagggcccatgcagtgtggggaaggtacactgtcagcttcttattagtcatcacccagctgggcttctgcagtgtttattttatgtttatggcagacaatttacaacagatggtggaagaagcccacgtgacctccaacatctgccagcccagggagattctgacgctgacccccatcctggacattcgtttctacatgctgataatcctgcccttcctgatcctgttggtgtttatccagaacctcaaggtgctgtccgtcttctcgacattggccaacatcaccacccttgggagcatggctctgatctttgagtatatcatggaggggattccatatcccagcaacctacccttgatggcaaactggaagaccttcttgctgttctttggtacagccatcttcacatttgaaggcgtcggtatggttctgcctctcaaaaaccagatgaagcatccacagcagttttcttttgttctgtacttggggatgtccattgtcatcatcctctatatcttactggggacactgggctacatgaagtttgggtcagacacccaggccagcatcaccctcaacttgcccaattgctggttgtaccagtcagtcaagctgatgtactctatcggcatcttcttcacctatgccctccagttccacgtcccagctgagatcatcatcccgtttgccatctcccaagtgtcagagagctgggcactgtttgtagacctgtctgtccgctcagccttggtctgtctaacctgtgtctcagccatcctcatcccccgcctggacttggtcatctccctggtaggctccgtgagcagcagcgccctggctctcatcatcccagccctcctggagatcgtcatcttttactctgaggacatgagctgtgtcaccattgccaaggacatcatgattagcatcgtgggccttttagggtgtatatttgggacataccaagccctctatgagttgccccaacccatcagccattccatggccaactccacaggtgtccatgcataattatctgtttttattctaatagctctcccttcctcccatccccagtttgacttccatgtggatgttatataccttcatcaaatcccaacatctctatattaattagtggcgtctttatctttccaagagaaatgcagatgagaaaagttagcactgatgtctctcaggctacacctcttttggttttatattttttggatggccttttgtacctctgaaccaaaattagattcaactattcatattatcagcctcattttatggaaaagggatgccacttaccccaatagcccttgaaacagagaccaagcataaatacaaaagtaactgttttctctacactgcagtagctgcccttaaagcatcagatttagaaaagtgtatgttgggcgaagggagttttctgtttagatattctaagtagaagagtcatagacagaacaaaaacagaactcagcagtaattttgtccaaccactggctccgccactgatttcctactggccctcaggcaagttcctccccatctctcagtctatgaagtgaacagttggactaactgattattaaggactctgtcaactctgatattctgaaagtgaataaaagaaattaacttatccaccaaccac

SEQ ID NO: 62384 - DNA, 2302 bp, Homo sapiens
gggaggttcagtgttgatggagttattgaagaaatgatggagtaagagactcttttctaagcaactcaagtttgcagtgattcaggcctacttctgaagagacagccttttatctcaatgaatgacacagaaaaaccagcagatactccctctgaggaagaggactttggtgatccaaggacatatgacccagatttcaaggggcctgttgccaacaggagttgtacagatgttctgtgctgtatgatcttcctactgtgtattattggctacattgttttaggacttgtggcctgggtacatggggaccccagaagagcagcctatcctacagacagccagggccacttttgtggccagaagggcactcccaatgagaacaagaccattttgttttactttaacctgttacgctgtaccagtccctccgtattgctaaacctacagtgccctaccacacagatctgtgtctccaagtgcccagaaaaatttttaacctatgtggaaatgcaacttttgtacacaaaagacaaaagctactgggaagactaccgtcagttctgtaagaccactgctaagcctgtgaagtctctcacacagcttttactggatgatgattgtccaacagcgatttttcccagcaaaccttttctccagagatgtttccctgacttctctaccaaaaatggcactttaacaataggaagtaagatgatgtttcaagatggaaatggagggacaagaagtgttgtagaactcgggattgctgcaaatggtatcaataaacttcttgatgcaaagtcacttggattgaaagtgtttgaagactatgcaagaacttggtattggattctcattggcctgacgattgccatggtccttagttggatatttttgatacttctgaggttcatagctggatgcctcttctgggtcttcatgattggtgtgattggaattataggttatggaatatggcactgttaccagcagtacaccaatcttcaggaacgcccaagttctgtattaactatctatgacatcgggattcagactaacataagcatgtactttgaactgcaacaaacatggttcacatttatgataatactctgcatcattgaagtgattgtcatcctcatgctgatcttcctcaggaatcgaatccgagtcgccattatcctgctgaaggaaggaagcaaagccattggatatgttcctagtacattagtctatccagctttaactttcattttgctctcaatctgcatttgctactgggtcgtgacagcagttttcttggcgacatcgggggtacctgtatacaaagtcatagctccaggggggcattgtatacatgaaaatcaaacctgtgacccagagatttttaatacaactgaaattgccaaagcttgccctggggctctgtgtaactttgctttctatggtggaaagagcttgtaccatcagtacatccctaccttccatgtatacaacttatttgtctttctctggcttataaacttcgtcattgcattaggtcagtgcgcccttgctggtgcattcgctacttattactgggccatgaaaaaacctgatgacatcccacgatatccactttttactgcatttggacgagccatacgatatcacacaggatccctagcatttggatctttaattattgcattaattcaaatgtttaaaattgtactagaatacttggaccaccgtcttaaacgtacccagaacacattgtctaaattcctacagtgctgcctgagatgctgcttctggtgtttggaaaatgcaataaagtttttaaacagaaatgcctatattatgattgcaatatatggcagaaacttctgcaggtcagcaaaagatgctttcaatctgctgatgagaaatgttttgaaagttgcagttacagatgaagttacatactttgtattattcctggggaaacttctagttgctggaagtataggtgttctggccttcctattcttcacacaaagactgccagtgattgcacaaggaccagcatctttatattactactgggtacctttgctgacagtcatttttgggtcttacctgattgcacatgggttcttcagcgtctatgcaatgtgtgttgaaacaattttcatctgcttctgtgaagatctggaaagaaatgatggatccacagaaaaaccctacttcgtaacccctaacctgcatggaattctgatcaagaagcaactagttccccagaagcagaaagagtagaaaagctccaaaaaaaaaaaaaaaa

SEQ ID NO: 62385 - DNA, 770 bp, Homo sapiens
atggtgcagccctgccagcccagcccaggctggcccagcttagccacacatgcgccatgaagtaccctttgatgccgctggtgaacgacctcacattttctttcctggttttctggttctgcctccctgtgggtttgctgttgttattgatcatctggctacgcttcttacttagccaagattcagaggaaaatgactccagtgtgtgcttggattgggagccctggagcaaaggcccagctgagttttgctggaaggggacactccacggccaagagaaggagaggccctgctggtgagcctgctgtgccaggtgaggcccttccaggggccagggggagcctcaaggcccacccaaagccttgggcagctgctatgtgggcaagaggctgcctccaccatattagagtttggttttcctggagtcagcagggcagtggcaatggcagaagtggatgggagagacttgccagggaggcaagaggactttggcaactgtggtgcctccctggaacccccaactcatctcctcttcagaccgacatgtgaaagcctccagaggtcccagcccttctccagcatcacagatgacctccagccctgcagggagccgctcaagtctgggagggcatgggagcagtgagcaggcccatggggagaaattggccaatttaattcagaggggtcttaaagcagggctgggccggagggtgtgggtccatattaaagaagcaagggtcttcccatacccgggggacccctgacaaacc

SEQ ID NO: 62386 - DNA, 784 bp, Homo sapiens
agaaggctttggcttctgatagtcatggactcactaggctgctgaggaagatcaataatacctactggaatcagtcatgagaagtcaagcatggaaattgtgaattgtgtgtgtggccagaccagtacctccaagtgttcagaagatgtgtgaccagacaaaacacagtaaatgctgcccagcaaaaggcaatcaatgctgcccaccacagcagaaccagtgctgccagtcaaaaggcaatcaatgctgcccaccaaaacagaaccagtgctgccagccaaaaggcagtcaatgctgcccaccaaaacacaatcactgctgccagccaaaacccccatgctgcattcaggccaggtgctgtggtttggagaccaagcctgaagtctcaccccttaacatggagtctgagcccaactcaccgcaaactcaggacaagggctgtcaaacccagcagcagccccatagcccacaaaatgagtccaggccaagcaaatgagagcagaagaagtcaaacaaagaagaagtccctggggccatgcctttcactttgtagggtgggggattactgagagtcaggctagacctgtgtttagagaagcagttttcacagtgactaccatttccacccaatgagaggctcctatttcccatcatagctccctaccctagggaggcctccatctggaaatgggaggatgaagaggctagaatcatctttcctagtgatcctgacatttagacagcacagaaataaagagcaataaaaagaaaaaaaaaaaaaaaa

SEQ ID NO: 62387 - DNA, 2074 bp, Homo sapiens
atgcgacctgttcgagagaactcatcaggtgcgagaagcccgcgggttcctgctgatttggcgcggagcattttgataagcctacccttcccgccggactcgctggcccacaggcccccaagctccgctccgacggagtcccagggccttttcaccgtggccgctccagccccgggagcgccttctcctcccgccacgctggcgcaccttcttcccgccccggcaatgtacagccttctggagactgaactcaagaaccccgtagggacacccacacaagcggcgggcaccggcggccccgcagccccgggaggcgcaggcaagagtagtgcgaacgcagccggcggcgcgaactcgggcggcggcagcagcggtggtgcgagcggaggtggcgggggtacagaccaggaccgtgtgaaacggcccatgaacgccttcatggtatggtcccgcgggcagcggcgcaaaatggccctggagaaccccaagatgcacaattctgagatcagcaagcgcttgggcgccgactggaaactgctgaccgacgccgagaagcgaccattcatcgacgaggccaagcgacttcgcgccgtgcacatgaaggagtatccggactacaagtaccgaccgcgccgcaagaccaagacgctgctcaagaaagataagtactccctgcccagcggcctcctgcctcccggtgccgcggccgccgccgccgctgccgcggccgcagccgctgccgccagcagtccggtgggcgtgggccagcgcctggacacgtacacgcacgtgaacggctgggccaacggcgcgtactcgctggtgcaggagcagctgggctacgcgcagcccccgagcatgagcagcccgccgccgccgcccgcgctgccgccgatgcaccgctacgacatggccggcctgcagtacagcccaatgatgccgcccggcgctcagagctacatgaacgtcgctgccgcggccgccgccgcctcgggctacgggggcatggcgccctcagccacagcagccgcggccgccgcctacgggcagcagcccgccaccgccgcggccgcagctgcggccgcagccgccatgagcctgggccccatgggctcggtagtgaagtctgagcccagctcgccgccgcccgccatcgcatcgcactctcagcgcgcgtgcctcggcgacctgcgcgacatgatcagcatgtacctgccacccggcggggacgcggccgacgccgcctctccgctgcccggcggtcgcctgcacggcgtgcaccagcactaccagggcgccgggactgcagtcaacggaacggtgccgctgacccacatctgagcaccggcctgcgctcgtccacccttgttccccacccccacccccactcccgccccgcacccccaagttgggacgccttgtttagctttgcttgcctgggactgttgccttgtaccgatgatggggagggctgaaagttttgctgtagctgtcgggttttgtacaaaagcaaaaataagtcaggagcagcgaaaatgggacttctagagagctctcttgccccacgccgctgctcctttcacctttgtaggctgggaatcgctgtgttatttgcaaagaaaaaacagcccccactcctcctcctgagttccagggttattctgttacatttgaaaatgttgtcttgttagtttgcagttagccaaggagtgaatgggagaaacatagtatcgggtgaggccagctggagaactgcaacgcctacgcccccagtcgtgtcgcgtctgttttcctcgtggttttttggggcgctgaccgctccaagcagcgcggcagctaaagccaatgttaatttatagccaggtgtgcgtgtgtctcccgcctcgccgcccctggccgcgggacagcttctgtccaatcatgttgagttggtgatttctgccgtgatctgtttgatatttcttcgcgctaatgtgttcagatttcgtttgggtagtggggaggggctactttgtttcagggttttcaagcttttactcttaattcctaaatgagatcaataaattttataacc

SEQ ID NO: 62388 - DNA, 2787 bp, Homo sapiens
gggggagggatgactaaagacaacggctgtaagagaactccacaagagagtcagaacgaaaatgtgcaacaagtgcggcggctcctaccatggcaggtgattcgaggactcagcacgaggcgagagtagggaccaggaagagccggaaaacccgcctgtgattggccgtccacgggtatcggtcgttgtgattgggtgaggcccagacagacagctgcgttttgaaccgcgtagggttctgggtagcaaaggccttgcaaggctcttaaccgaaagggggagggggaaggtcgccaacaaacggctgagctcacaatcctggccggggcgtccccctcccccatggagagagccagacccgagccgccgcctcagccgcgcccgttgcgtcccgctccgcccccgctgccggtcgagggcacctccttttgggcagcagccatggagccccctccgtcgtctcccacactgagcgcggcagccagtgcgaccttggcctcgtcgtgcggggaggcagtggcgtccggcttacagcccgcggtgcggcggctgctgcaggtgaagccagagcaggtgttgctgctaccacagcctcaggcccagaacgaggaagccgctgcctcgtccgcgcaggcgcggctgttgcagttcaggcccgacctgcggctcctgcagccgccgacagcgtcagacggcgccacctccaggcccgagttgcacccggtgcagcccctggcgctgcatgtcaaggccaagaagcagaagctggggcccagcctggatcagtcagtggggcctcgaggggccgtcgaaaccggtcctagagcctccagggtggtcaagttggaaggccccgggccggccctcggctacttccgaggggacgagaagggcaagctggaggcggaggaggtcatgagagactcgatgcaaggcggggcaggcaaaagcccggcagccatccgagaaggtgtgatcaaaacggaggaacccgagagactcctcgaggactgcaggctcggcgcggagcccgcgtccaatggcctggttcatggcagcgcggaggtcatcttggccccaacgtccggtgcctttgggccgcaccagcaagaccttaggatccctttgacgctccacacggtcccccctggggcccggatccagtttcagggagctccgccttcagagctgataagattgaccaaggtccccctgacaccagtgcctactaaaatgcagtccctactggagccttctgtaaaaattgaaaccaaagatgtcccgctcaccgtgttgccctcagatgcaggcataccagatactcccttcagtaaggacagaaatggtcatgtgaagcgacccatgaacgcatttatggtttgggcaaggatccaccgaccagcactagccaaagctaacccagcagccaacaatgcagaaatcagtgtccagcttgggttagagtggaacaaacttagtgaagaacaaaagaaaccctattacgatgaagcacaaaagattaaggaaaagcacagagaggaatttcctggttgggtttatcagcctcgtccagggaagcgaaaacgattccctctaagtgtttccaatgtattttctggtaccacacagaatatcatctctacaaatcctacaacagtttatccttaccgctcacctacgtactctgtggtaattcccagcctacagaatcccatcactcatccagttgtacatgcccttacagtcggcctccctttggctatggaaattttccgagttcaatgccagaatgccttagttattatgaagacaggtacccaaaacatgagggtatcttttcaactttaaatagagactattcttttagagactactcaagtgaatgcacacacagtgaaaattctcggagttgtgagaacatgaatggaacttcttactataacagtcatagccacagtggggaagaaaacttaaaccctgtgcctcagctggacattggaaccttggagaatgtcttcacagccccgacatcaactccttctagcatccagcaagtcaatgtcaccgacagtgatgaggaggaagaagaaaaagtgctcagggatttataattttaaaacaaatatgcacagaaaataaacatttcttaaaatatattctgggtcagttggtatgagaaaaaaaaaagcctagaattctttgttgaaagttttcagtcgtgatttgaggagttaaaaccaaatgcaatttatgtcttcataaaattttgattagtgaaactagagtctggatgtttcattgtaggaatatttaagttattaagtagtttaattttaatggctgaaatttgcatcaacatgtattattattactttatcctggaacatgcaaaatactgaagcctcacagttgtatgtgaggggaaaggggaaataaatctagcatagtgtgatttttattttatctcaggatacattttttaaatgattttttgtttgctttttatgtaatacttatggatgttgtcaatttttgatgtaacattttgaaagtattttgacaactcctagtgaacttggacttggttgctaaatttaacttacactaataaccaattataagttccaaatgtgttttaatggcacctgggtgattcttcagctaaatttagtcatttctgtttctaaatatttttatcattttaaaatattttttttccatttggcatacatcgttctttgttgtaattaaataaacatagataaaattgttaaaaaaaaaaaaaaa

SEQ ID NO: 62389 - DNA, 3280 bp, Homo sapiens
gggggagggatgactaaagacaacggctgtaagagaactccacaagagagtcagaacgaaaatgtgcaacaagtgcggcggctcctaccatggcaggtgattcgaggactcagcacgaggcgagagtagggaccaggaagagccggaaaacccgcctgtgattggccgtccacgggtatcggtcgttgtgattgggtgaggcccagacagacagctgcgttttgaaccgcgtagggttctgggtagcaaaggccttgcaaggctcttaaccgaaagggggagggggaaggtcgccaacaaacggctgagctcacaatcctggccggggcgtccccctcccccatggagagagccagacccgagccgccgcctcagccgcgcccgttgcgtcccgctccgcccccgctgccggtcgagggcacctccttttgggcagcagccatggagccccctccgtcgtctcccacactgagcgcggcagccagtgcgaccttggcctcgtcgtgcggggaggcagtggcgtccggcttacagcccgcggtgcggcggctgctgcaggtgaagccagagcaggtgttgctgctaccacagcctcaggcccagaacgaggaagccgctgcctcgtccgcgcaggcgcggctgttgcagttcaggcccgacctgcggctcctgcagccgccgacagcgtcagacggcgccacctccaggcccgagttgcacccggtgcagcccctggcgctgcatgtcaaggccaagaagcagaagctggggcccagcctggatcagtcagtggggcctcgaggggccgtcgaaaccggtcctagagcctccagggtggtcaagttggaaggccccgggccggccctcggctacttccgaggggacgagaagggcaagctggaggcggaggaggtcatgagagactcgatgcaaggcggggcaggcaaaagcccggcagccatccgagaaggtgtgatcaaaacggaggaacccgagagactcctcgaggactgcaggctcggcgcggagcccgcgtccaatggcctggttcatggcagcgcggaggtcatcttggccccaacgtccggtgcctttgggccgcaccagcaagaccttaggatccctttgacgctccacacggtcccccctggggcccggatccagtttcagggagctccgccttcagagctgataagattgaccaaggtccccctgacaccagtgcctactaaaatgcagtccctactggagccttctgtaaaaattgaaaccaaagatgtcccgctcaccgtgttgccctcagatgcaggcataccagatactcccttcagtaaggacagaaatggtcatgtgaagcgacccatgaacgcatttatggtttgggcaaggatccaccgaccagcactagccaaagctaacccagcagccaacaatgcagaaatcagtgtccagcttgggttagagtggaacaaacttagtgaagaacaaaagaaaccctattacgatgaagcacaaaagattaaggaaaagcacagagaggaatttcctggttgggtttatcagcctcgtccagggaagcgaaaacgattccctctaagtgtttccaatgtattttctggtaccacacagaatatcatctctacaaatcctacaacagtttatccttaccgctcacctacgtactctgtggtaattcccagcctacagaatcccatcactcatccagttggtgaaacctcacctgctatccagctgcccacacctgcagtccagagcccaagccctgtcacacttttccagcccagcgtctccagtgctgctcaggtggctgtccaggatccaagtctacctgtctatccagcactcccaccccaacgctttactgggccttcccaaacagacactcatcagctgcattctgaagccactcacactgtgaagcaacccactcctgtctctctagagagcgccaacaggatttcaagtagtgcaagtactgcccatgccagatttgcaacttcgaccatccaacctcctagggagtattccagcgtttccccttgtcccagaagtgctccaatcccccaggcttctcccattccacacccacatgtctaccagccccctccccttggccatccagccacactgttcgggacaccaccaagattctcttttcatcacccttacttcctacccggacctcactacttcccatcaagtacatgcccttacagtcggcctccctttggctatggaaattttccgagttcaatgccagaatgccttagttattatgaagacaggtacccaaaacatgagggtatcttttcaactttaaatagagactattcttttagagactactcaagtgaatgcacacacagtgaaaattctcggagttgtgagaacatgaatggaacttcttactataacagtcatagccacagtggggaagaaaacttaaaccctgtgcctcagctggacattggaaccttggagaatgtcttcacagccccgacatcaactccttctagcatccagcaagtcaatgtcaccgacagtgatgaggaggaagaagaaaaagtgctcagggatttataattttaaaacaaatatgcacagaaaataaacatttcttaaaatatattctgggtcagttggtatgagaaaaaaaaaagcctagaattctttgttgaaagttttcagtcgtgatttgaggagttaaaaccaaatgcaatttatgtcttcataaaattttgattagtgaaactagagtctggatgtttcattgtaggaatatttaagttattaagtagtttaattttaatggctgaaatttgcatcaacatgtattattattactttatcctggaacatgcaaaatactgaagcctcacagttgtatgtgaggggaaaggggaaataaatctagcatagtgtgatttttattttatctcaggatacattttttaaatgattttttgtttgctttttatgtaatacttatggatgttgtcaatttttgatgtaacattttgaaagtattttgacaactcctagtgaacttggacttggttgctaaatttaacttacactaataaccaattataagttccaaatgtgttttaatggcacctgggtgattcttcagctaaatttagtcatttctgtttctaaatatttttatcattttaaaatattttttttccatttggcatacatcgttctttgttgtaattaaataaacatagataaaattgttaaaaaaaaaaaaaaa

SEQ ID NO: 62390 - DNA, 1501 bp, Homo sapiens
gtcacgggattcggagccgggcggctacgggcggggtgtcgcagctctcttcgacgtacctgtcctcaggagccgcggcggcgactgcgcctcggacggccgtcggggccgagaaccatgagccccaggggcacgggctgctccgccgggctgctgatgactgtcggctggctgcttctggcgggcctccagtccgcgcgcgggaccaacgtcaccgctgccgtccaggatgccggcctggcccacgaaggcgagggcgaggaggagaccgaaaacaacgacagcgagaccgcggagaactacgctccgcctgaaaccgaggatgtttcaaataggaatgtcgtcaaagaagtagaattcggaatgtgcaccgttacatgtggtattggtgttagagaagttatattaacaaatggatgccctggtggtgaatccaagtgtgttgtacgggtagaagaatgccgtggaccaacagattgtggctggggtaaaccaatttcagaaagtcttgaaagtgttagattggcatgtattcacacatctcccttaaatcgtttcaaatatatgtggaaacttctaagacaagaccaacaatccattatacttgtaaatgattcagcaatcctagaagtacgcaaggaaagtcaccccttggctttcgagtgtgacacactggataataatgaaatagtagcaactattaaattcacagtctatacgagcagtgaattgcagatgagaagatcaagcctaccagccactgatgcagccctaatttttgtgctgaccataggagtcattatctgtgtatttataattttcttattgatcttcataatcataaattgggcagcagtcaaggctttctggggggcaaaagcctctacacctgaggtacaatccgagcagagttctgtgagatacaaagattcaacttctcttgaccaattaccaacagaaatgcctggtgaagatgatgctttaagtgaatggaatgaatgatgtttgaatgatatataacaaaccaaaggatattacagaatattagattcattattacaaaaataaaatacacattgaaatactttaataatgttgcgatggattgccacagtgtgaaggaaatgcagtgtggggataggactattttatcagtgcatttttccagtacagttatcaaatattacttttaatttgttctcaacacttatttcaggtaatagcttggggatatttatctaaaggtacccccaacaaatcttctaagtgcatttttgatcactttgataacttcttaggtgatttgcctgttttgtcttaaataagaacaatgtaatatagaaatgctttacatattagactttctctcccctggaagcactgggttgaacttgctaaagtaaatcatactttagaatctcttcagggaatgtgacatacaaagtttgtaagacatgaagtaataacgataatgataacaataaatgcttacttagtgaaa

SEQ ID NO: 62391 - DNA, 820 bp, Homo sapiens
gccctggcaaggttgtgggggacatcttgagctgaagcagggttttgagccactgctgctgctgccattgtcaccatggtctcagctctgcggggagcacccctgatcagggtgcactcaagccctgtttcttctccttctgtgagtggaccacggaggctggtgagctgcctgtcatcccaaagctcagctctgagccagagtggtggtggctccacctctgccgccggcatagaagccaggagcagggctctcagaaggcggtggtgcccagctgggatcatgttgttggccctggtctgtctgctcagctgcctgctaccctccagtgaggccaagctctacggtcgttgtgaactggccagagtgctacatgacttcgggctggacggataccggggatacagcctggctgactgggtctgccttgcttatttcacaagcggtttcaacgcagctgctttggactacgaggctgatgggagcaccaacaacgggatcttccagatcaacagccggaggtggtgcagcaacctcaccccgaacgtccccaacgtgtgccggatgtactgctcagatttgttgaatcctaatctcaaggataccgttatctgtgccatgaagataacccaagagcctcagggtctgggttactgggaggcctggaggcatcactgccagggaaaagacctcactgaatgggtggatggctgtgacttctaggatggacggaaccatgcacagcaggctgggaaatgtggtttggttcctgacctaggcttgggaagacaagccagcgaataaaggatggttgaacgtt

SEQ ID NO: 62392 - DNA, 978 bp, Homo sapiens
ttccattcacagactcttgttgggcagcagccacccgctcacctccatccccaggacttagagggacgcagggcgttgggaacagaggacactccaggcgctgaccctgggaggccaggaccagggccaaagtcccgtgggcaagaggagtcctcagaggtccttcattcagcggttccgggaggtctgggaagcccacggcctggctggggcagggtcaacgccgccaggccgccatggtcctgtgctggctgctgcttctggtgatggctctgcccccaggcacgacgggcgtcaaggactgcgtcttctgtgagctcaccgactccatgcagtgtcctggtacctacatgcactgtggcgatgacgaggactgcttcacaggccacggggtcgccccgggcactggtccggtcatcaacaaaggctgcctgcgagccaccagctgcggccttgaggaacccgtcagctacaggggcgtcacctacagcctcaccaccaactgctgcaccggccgcctgtgtaacagagccccgagcagccagacagtgggggccaccaccagcctggcactggggctgggtatgctgcttcctccacgtttgctgtgaccaacagggaggacagggcctgggactgttctcccagatccgccactccccatgtccccatgtccttcccccactaaatggccagagaggccctggacaacctcttgcggccctggcttcatcccttctaaggctgtccaccaggagcccggtgctaggggaagcatccccaggcctgactgagcggcaggggagcacggcccgtgggtttgattgtattactctgttccactggttctaagacgcagagcttctcacatctcaatcaggatgcttctctccattggtagcactttagagtccatgaaatatggtaaaaaatatatatatatcataataaatgacagctgatgttcatggaaaaaaa

SEQ ID NO: 62393 - DNA, 2189 bp, Homo sapiens
gagagctcccgggggccgttgggtagcgtcttcgctgttgcccttagggacggctgtgggcctgctgggggtgggggcccgaagcgccagagatggctgctcagcgagggatgcccagctccgccgtgagggtcctggaagaggcgttgggcatgggtttgacggcagccggggacgcgagggacacggcggacgcggtggcggctgagggcgcctactacctggaacaggtcaccataactgaagcatctgaagatgactatgaatatgaagagataccagatgacaattttagcatcccagaaggtgaagaagatctggcaaaagcaattcagatggcccaagaacaggctacagatactgaaattttggaacggaaaacagttcttccttcaaagcatgcagtacctgaagtaatagaagactttctctgcaatttcttgatcaaaatgggaatgaccagaactcttgattgctttcagtctgaatggtatgagttaatacagaaaggagtgactgaacttagaactgttgggaatgttccagatgtctacacccagattatgcttttggaaaatgagaacaaaaatttaaagaaagatttgaagcactacaaacaagcagctgacaaagctagagaagatttgctgaaaattcagaaagaacgtgattttcatcgaatgcatcataagcgaatagtccaggaaaaaaacaaattaattaatgacctcaaagggttgaagttacattatgcatcttatgaaccgactataagggtgttacatgagaaacaccacactttactgaaggagaaaatgctgacctccttggaaagagacaaagtagttgggcagatttctggacttcaagaaacattgaagaaactgcaaagaggacatagttaccatggtcctcaaattaaagttgatcatagtcgtgaaaaagaaaatgcaccagaaggtcctactcagaaaggtcttcgtgaagccagggaacaaaacaaatgtaaaacaaagatgaaaggcaatacaaaggattcagaatttcccatagatatgcaaccaaatccaaacctgaatgtttctaaagaaagtctttctccagcaaaatttgactacaagctgaaaaacatttttagactccatgaacttccagtgagctgtgtctccatgcaaccccacaaagacatcctagtctcctgtggcgaggaccgactctggaaggtgttgggccttccaaaatgcaatgtgcttctcacgggatttggccacactgactggctttcagactgctgcttccatcccagtggcgacaaattggctacttcaagtggtgacactacagttaaattatgggatctatgtaaaggcgattgcattttgacctttgaaggacacagccgcgcagtgtggtcctgcacatggcactcctgcggcaattttgtggcttcctcctcactggataaaactagcaaaatttgggatgttaatagtgaaagatgcagatgtactttgtatggacatacagattctgtgaacagcattgagttttttcctttctccaatactcttctcacaagctctgcagacaagaccctgtctatatgggatgcaagaacaggtatatgtgagcagtcactttatggtcacatgcattctatcaatgatgccatttttgatcccaggggtcacatgatagcatcctgtgatgcctgtggggttacaaagctgtgggactttcggaagctgttaccaattgtgtccatcgatataggtccaagtcctggcaatgaggtgaattttgattcatcaggtcgagttttagctcaggcaagtggcaatggtgttatccatttgctagatcttaaatctggggagattcacaaattgatgggccacgaaaacgaggcacacacggttgtgttttctcacgacggggagattctcttttctggaggctctgacggcacagttcgaacgtggtcttgaccgtcagcacatcccgctgcagagggcattccctttaaggcttgaaaatgcctcctgtagtcccaaaccagcaaagaactggttaaatgtgccagcaggtaacatttacagtctgctttaaaacatgctttggacatatattttagtgctcatactgttactaataaaaaaataactttatgctcaaaaaaaaaaaaaaaa

SEQ ID NO: 62394 - DNA, 2630 bp, Homo sapiens
aggttgcccgggagacgcgggtacacagagaagcggctcccgtcggaggccgagtcgtcgccacgatcgcccccttggtggactcgcaggccgagcggcttccccgcagagctcgaggagggcagacggcggcgggggcgccatgagtcagaggcaggtgctgcaagtgttcgagcaataccagaaggccaggacccagttcgtgcagatggtggcggagctggcgactagaccccaaaacatcgagacgctgcagaacgcgggtgtaatgtctttgctgagaactcttcttctggacgtggtcccaacaattcaacagactgctgctttggctcttgggagactggccaattataatgatgacctagcagaagctgttgtgaagtgcgacattcttccacagcttgtttattcattggcagaacagaatcgcttctacaagaaagcagctgcctttgtgttacgagcagttggtaaacattctccccagctagctcaggcaatagtcgattgtggagcactggatacgctggtcatatgcttggaagattttgaccctggagtcaaggaggctgcagcctgggcacttagatatattgcaagacataatgcagaactgtcacaagctgtggtggatgcaggagctgttcctcttttagtactctgtatccaggagccagaaattgctttgaaaaggattgctgcttcggccctcagtgatattgcaaagcattctccagagttagcacagacagtagtggatgcaggagctgttgctcatttagcccagatgatcctgaaccctgatgctaaattgaagcatcagatcctttcagctctcagtcaggtttcaaaacattccgtggatctggcagaaatggttgttgaagcagagatttttccagttgtacttacctgtctgaaggacaaggatgaatacgtgaagaaaaatgcttctactttaattagagagattgcaaaacatacacccgagctttcacagctggtagttaacgcaggaggggttgctgccgtgattgactgcattgggtcctgcaaagggaacacacggctgcctggcatcatgatgcttggttatgtagcagctcattctgagaacctagcaatggcagtcatcatttctaagggtgtaccccagttgtcagtctgcttgtcagaagaaccggaagatcatattaaggctgcagctgcttgggccttaggacagattggaagacacactcctgaacacgcacgggctgttgcagtcacaaatactttgccagttctgctttctttgtacatgtcaacagaaagttctgaggatctccaagtaaaaagtaaaaaagccataaagaatatcctgcaaaaatgtacctacttaccagcccttgaaccatttctatatgatgctcctcccaatattctgaaacatgtggttggacagttcagtaaggtgctgccgcatgatagcaaagctcgacgactttttgtaacaagtggtggccttaaaaaagttcaagagataaaagcagaacctggttctctccttcaagaatacatcaacagtattaacagttgttaccccgaggaaatagtgaggtattattcccctggatattcagatacacttctgcagagggtggacagctatcaaccacttaataactgagcaaagttatattgtgatactcaaattcacagcagagtagttttgagtaacagtaattaaatccttctaaatatttgaactaagtatattctagatttatttaatgggaaatacctttagataatattttctaaatttatgtaatactttaaacattcgtagcttgaatatgtgaggaactattcatggtcattcgcatgcataggatttgttctacaggtagattttaaaaacacgttaaagggccttaaggcattttgttattctgttaaaaaccacacacactcgtacatgcagacacctccaatgagatatagttaagagatggcattcaaaaaccctaaattattctagccaatttgtcataggcataggcaaggaaagctggccttgctaactatatagtagtatacacaagagaaatctttgaaggaggaaactgatgacagatatacagggcacttgaaggagactctgatgctagttatataagtgcattaacttaagacacggactctgtgggtaacctgttaggttttactaagaatttaggaaaaatttactcctctttatcacaagttttccaaacctccttccccaccctatctaaagtgttccttacctttcatgggcccagcgagggtagaattcagaatagagagttatactcctgcatacatgctctccctctcattgaaaggtttcttagtctagctctgctcatgaatgaacaaagaagcaggcatgtaaaatggatccttgtcctaacgtcactttcccaagtttcaaaagtcacattttcaggtatttaaggaatagtttgaagctaataccatcaggctcagagtttacatgcatttttacttaggaagtggtaaacgggtgaaagagggtttcaataaaattttaaataaaaacagcaaaaaaaaaaaaaaaaaaaaaaaaaaaaaaaaaaaaa

SEQ ID NO: 62395 - DNA, 2463 bp, Homo sapiens
aggttgcccgggagacgcgggtacacagagaagcggctcccgtcggaggccgagtcgtcgccacgatcgcccccttggtggactcgcaggccgagcggcttccccgcagagctcgaggagggcagacggcggcgggggcgccatgagtcagaggcaggtgctgcaagtgttcgagcaataccagaaggccaggacccagttcgtgcagatggtggcggagctggcgactagaccccaaaacatcgagacgctgcagaacgcgggtgtaatgtctttgctgagaactcttcttctggacgtggtcccaacaattcaacagactgctgctttggctcttgggagactggccaattataatgatgacctagcagaagctgttgtgaagtgcgacattcttccacagcttgtttattcattggcagaacagaatcgcttctacaagaaagcagctgcctttgtgttacgagcagttggtaaacattctccccagctagctcaggcaatagtcgattgtggagcactggatacgctggtcatatgcttggaagattttgaccctggagtcaaggaggctgcagcctgggcacttagatatattgcaagacataatgcagaactgtcacaagctgtggtggatgcaggagctgttcctcttttagtactctgtatccaggagccagaaattgctttgaaaaggattgctgcttcggccctcagtgatattgcaaagcattctccagagttagcacagacagtagtggatgcaggagctgttgctcatttagcccagatgatcctgaaccctgatgctaaattgaagcatcagatcctttcagctctcagtcaggtttcaaaacattccgtggatctggcagaaatggttgttgaagcagagatttttccagttgtacttacctgtctgaaggacaaggatgaatacgtgaagaaaaatgcttctactttaattagagagattgcaaaacatacacccgagctttcacagctggtagttaacgcaggaggggttgctgccgtgattgactgcattgggtcctgcaaagggaacacacggctgcctggcatcatgatgcttggttatgtagcagctcattctgagaacctagcaatggcagtcatcatttctaagggtgtaccccagttgtcagtctgcttgtcagaagaaccggaagatcatattaaggctgcagctgcttgggccttaggacagattggaagacacactcctgaacacgcacgggctgttgcagtcacaaatactttgccagttctgctttctttgtacatgtcaacagaaagttctgaggatctccaagtaaaaagtaaaaaagccataaagaatatcctgcaaaaatgtacctacttaccagcccttgaaccatttctatatgatgctcctcccaatattctgaaacatgtggttggacagttcagtaaggtattattcccctggatattcagatacacttctgcagagggtggacagctatcaaccacttaataactgagcaaagttatattgtgatactcaaattcacagcagagtagttttgagtaacagtaattaaatccttctaaatatttgaactaagtatattctagatttatttaatgggaaatacctttagataatattttctaaatttatgtaatactttaaacattcgtagcttgaatatgtgaggaactattcatggtcattcgcatgcataggatttgttctacaggtagattttaaaaacacgttaaagggccttaaggcattttgttattctgttaaaaaccacacacactcgtacatgcagacacctccaatgagatatagttaagagatggcattcaaaaaccctaaattattctagccaatttgtcataggcataggcaaggaaagctggccttgctaactatatagtagtatacacaagagaaatctttgaaggaggaaactgatgacagatatacagggcacttgaaggagactctgatgctagttatataagtgcattaacttaagacacggactctgtgggtaacctgttaggttttactaagaatttaggaaaaatttactcctctttatcacaagttttccaaacctccttccccaccctatctaaagtgttccttacctttcatgggcccagcgagggtagaattcagaatagagagttatactcctgcatacatgctctccctctcattgaaaggtttcttagtctagctctgctcatgaatgaacaaagaagcaggcatgtaaaatggatccttgtcctaacgtcactttcccaagtttcaaaagtcacattttcaggtatttaaggaatagtttgaagctaataccatcaggctcagagtttacatgcatttttacttaggaagtggtaaacgggtgaaagagggtttcaataaaattttaaataaaaacagcaaaaaaaaaaaaaaaa

SEQ ID NO: 62396 - DNA, 2009 bp, Homo sapiens
atgtggctcacataaattcagaaagtatgatagcagtgtaggtggttagcagcacctcataaggtccttcctagcaaggcaaagggatgctaatgactagccaatgctctaggaagacattgagaccagccaacttcttgccttgataactactgaagagacattgggtggctggattttgaaagcagacttctggttataggtgatgcaacttgaaaaacaatcctgaaacatgaaacaagaataataatatttaaatgtaacttaatcattatacctctttatccatcaaagtgaattcattccattccctttcatctgtgctcatactttgcatcagatattgggtaaaccaaagtgtgtaggaagaaataaatgttttcatagtcattactctttacaatgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagccaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctacaatgcttcaccctccacactatctgccacaatgttcattgttagtattttgtttcttatcatttcttctgtagcgagtttgtaattgcgcaggttagctgaaatgaacaatatgtccatcttaaagtgtgctttttcgactaattaaatctttgaaaagaa

SEQ ID NO: 62397 - DNA, 300 bp, Homo sapiens
atggaagagccaacttccagcaccaacgagaataaaatgaagagcccctgtgaatctaacaaaagaaaagttgacaagaagaagaagaatctgcacagagcctcagcccctgaacagagtttgaaagagacagaaaaagcaaaatatccaacattagtgttttactgcaggaagaataagaaaagaaattcaaatcaactggagaataaccagcctacagagagctccactgatccaatcaaagagaaaggagacctagacatatctgcaggatctccacaggatggtgggcagaattag

SEQ ID NO: 62398 - DNA, 1316 bp, Homo sapiens
acacccctgatttgaaacaagactaggatgcaaggtaaagaatgttaattcactaaagttttgacagactgaggccattgtttcagattggaaataggaaacttaaaagaactacatggacattgggtaaaagaacatgggttgaaatttgcctggcagtagcccaagagtaaatggtcttcaaggtgcatatgaaggaactgtaagagggaaatgggataattcacatctccaccaataattaaatgtagccacactagcttgggggatttgaggtgagacatctaaaatactaagtcatggtgagggctggaagacaaaagaatgaatcacttaataggaatggctgtggggaagggcttgacagaatcaacctctcacttccatgtgaaccatgaacattaaacatggagaaatgaggagcggcagcagatcagtttgggatgcgtcttcaggggatgctgaaacaacagcagcatttggtttcctctacacccctgtcacccctcccccacaagcccagggagtggtcagcagtggtgctttgtgatgtctaagccacccttggactgccattggctgggacactgcctgtatgatcaaacaaagctcaagggtgtggctttgccttgtcaccaggagggtatatatagggagggcaagagctctgggccactgggaagcttcaatatagctgtggaagtctggactctacaagatcctgctgtagacattcaacaaccaaccagaatcatggaaaagcccacttcaagcaccaatggggagaagaggaagagcccctgtgactccaacagcaaaaatgatgagatgcaggagacaccaaacagggacttagtcctcgaaccgagtttgaaaaagatgaaaacatcagaatattcaacagtattagtgttgtgctacaggaagactaagaaaatacattcaaatcaactggagaatgaccagtcctgagagaactccatcaatccagtccaagaggaggaggacgaaggatcctcacaggaggatgaagacctagactcatctgcagaatcttcaaagcaggatgaagacctacaattacctgaaggatcttcacaggaggatgaagacctagggttatctgaaggatcttcacaagaggatgaagacctagactcatctgaaggatctttgatggaggaagaagacccagactcatctgaaggatcgtcagaggagggtgaggaagactaattaaacatggagaaaccaaattggacaaatcctcaccaccaacggtgatgattacaataaaatcaagtttgagaagctga

SEQ ID NO: 62399 - DNA, 2430 bp, Homo sapiens
ccaggaagtgggtacacctgtccccacccccacagtaggagtcagaatcagggactggaagggatggggttcctggaggaagctcacagcagcagcagcctctgagtcacaactcagcccctccctggcatatccctttgtttgctgggagttgagctgtgactcacaaaggctctggtcccgggctgggcccatgtgacccagggtcctgactgccctgcccacagtcactgagaaaattctttgtgcaggctcaccttcccctcatctcccccactcttcctgatcctgcagcgtcagatcccagcctgcagtatcagacctcaaaaggagcctctggtgtcttccaaaagggaaggaaagagagagaaagccactggagttgggcagcgtgggaagctgtgaaagtggacaagcgtgaaagagcttccaagtagtggaaacagcagaagcaaagatgtgaacatgggaaaacctctgcagtatctgggtgactgtggggtttggctctgtttgagcaccccgggatgattggtggtggggtgtggctgaaggtgaattggaacagtgcactcagagccaggttgcaagagtgctgcatgctcctcagggattggctccggccaagtgccccagcctccttttctggagaattctgtttttgacttgggccccatgtccagttctgctctgacttgtgggtccaccttagaaaagtcaggagacacctgggaaatgaaggcactagactcttccagactcgttccatggccacccagaggccttgggtcatccacccaacatcccaacaaaccccactgtgcactggcatcatgccagggtccaggtgtcctgccaggagcagcctctgccctcccagagctgacatttcagggggatgtgtgccaaagtgagacctgtcagagatatttacaagcagccatctctcttgacatcgctgtatcccaaataaatcttctgggaagaccctcttcacctccagctctcctgatacagcaaggcagttgtgagcaagttattcataactctacacctcaatttcttggtatggaagatggggataatgagaggaccacaggatggttgtggagactgtgtgaggatatagatgccgagcccagtagcacagggtgcagccgttcaaaccaactgacatttactgagggctgctttgtcaggtccctctctacagtatactccaacacacacatacacacacatctgtaatcaataataatcctgcaacatctgagagtctggcagctgtttgtctgggcctttgcacatgctatgccctcccttccatcccccacccccaccaggggtgactcgtagccatccctttctgcatcttcttagatatcactttttccaagaagcctccctgtcacacttccccaatatcacagatgaagaaatcaagattcagaaaggttaagttactggcacaaggtcacacaatccagatctcatactcttagcccccggggaaccttcactgtattaaatgacatcaattgatcaatcaatcgatcaatcaatgaaagagtgggaggcatgcatctcctgatccccgatcctatacattttcatctctttattgtttctatcaaagcctgctaagtaattactttccctctgggtaagtgccactaggtgatgaggtgaggtaatcaaatgacatagaagaggaaggagtccactgccagggtaggtgcagtggagcaagtcttacaatgtgcaggattataactccagcaatgacccctaggctcatgctcattccccaggtggcagtttcagaacacattgctcaggtctcaccctgtaaatgtaggtaccagccttctagttgaccatcagaacacacaacgccaagatcttactccagccacctgccaggacctggagggcaggaggagagttctgcctacattgtctcattttccctccccttctgcagtgagatagaccatgtccagtgctcaggagttgactggccacactggggagtttgaccacaacattgggctccatatgcatggaatgaggttgcatgcaattgtccatgaggctgctccctcatttgtctgggtttctgctccaatgctatctcctcagaaagaccttctctgactgaagccagctctgcctccatcccatcactctggatctccttccccagcttcatctccattacactggccactctccctcacatcttattactgatctagttgtctactgtccatctccaccactgggatgtaaactccacaagggaggaatgctgtcagtttctttgactgctgtgtggtcagtaccagggcaatgcctcgcacagagtagccctctctccctaaatgtttttgaataaatgaaataaatgagcaaaaaaaaaaaaaaaaa

SEQ ID NO: 62400 - DNA, 866 bp, Homo sapiens
agcttcaatggaaggagggagccaagaagggggcctggtatacattcaaagatgataattacgacatggattgtgtatattcttgctcggaaaggtgtagggcttcccttcctaccaataaccagttcggacattgacgttgtggaaagtgaggctgtgtctgtactacatcattggttgaaaaaaacagaagaagaggcttctcggggcataaaggaaaagctgtccatcaaccacccttcccagggtgtaagggagaagatgtccactgactcccctcccacccatggccaggacatccacgtgaccagagatgtggtgaagcaccacctctctaagtctgatttgttggcaaaccagagccaagaggtcctagaggagagaacacgaatccagttcataagatggagccacactcgtatcttccaagtgccaagtgagatgacagaggacatcatgcgagatcgaatagagcaggtgagacgaagcatatcccgtcttacagatgtctcagctcaggacttcagtatgagaccctcctcctcagactgctgagagcaacagatggagctttgggaacgcggagaacagtggggttacagggagtcatcatcagccctaccccttggccaaccacatctccctgctgtgtcccctgggcatttctctacctcccaggtggaagtccttcagggtccagcagcaacctgtatcagaagaacatccttctctgcttgacctgaagaagggccagacctgggcagaaagactccagcaggtgagctcttcatgcgacagtgtcagcactggagtcttcttgctgaactgcgaataaagagatgtgctgtttaacaacccgccctgtt

SEQ ID NO: 62401 - DNA, 1618 bp, Homo sapiens
gaggcccgagccaggctcctagggcagagggcaaacggcccctccaggagggagccgggagattacgcagctccatgtaggtccacgtttaggttgggaggatctaccatgaagaaggtcaagaagaaaaggtcagaggccagacgccaccgagactccacctcccagcatgctagctccaattccacctctcagcagcctagccctgaatccacaccacagcagcctagtcctgaatccacaccacagcagcctagccctgaatccacaccacagcattccagccttgaaaccacctcccggcagccagcattccaagcccttccagcacccgaaatccgccgctcctcttgctgccttttatctccagatgctaacgtgaaggcagcccctcaatccaggaaagcagggcctctgattcgcgccggcccgcattcctgctcctgtgccacttgcccctgcagctccgcttgctggcgtcgtctggggctatgccatagccgcatcttcgatgtccttctgcctcgggactggcagatggcgccagggagaggactccccaacctgctcaccttctacagaaaatcttcaagaaaaccctccagtcatcgtaacgcgtgtcctccaagccctcggaactgtggctgtggctctgggggctctaggagctgcctactacatcactgaatccttgtgaacaagcccctaggcccacagtctggcagacctccaccagccccaggagttgataggtgatggcgctgggagaagatgttcagaatatctcaaaagccaagtccagaaggaggtgcttttaatgtgctgataaaccaacctcaggaaggtattatgtacagaagattcccaaggctgctgttgctgaaagagacttgggctactgccagggaactagggtctcactctgtcacccaggttggagtgcagcaggggcatgatcagctcactgaaggatcatttcttggtctaggctataggctggccttagaatcaactcacctggtgtcctattgtcagggacatcttaaccagggtgactgcacctcgaataaaggccagataaagccaaacttgctgggttacattccttgggggttagacacccttcatcacaagatgtttgtagctcaaagaaggggttaatgatgctaactagagacccagaacgtctgaaaacgtcctgatatttaaagaacaaagcatccttcatttgagaataagtttcactttaaagaccccctcaatatcctcctcagatttgccctgcacttcttgttccatgcttggggtcctaagaacaagccatctgatgcctctactatcattacctctattgggacccagaaaccaataccccaaaatatggtgcatggacatgctgaactgaagaagatgcctcaagggtcatccctaaaggcaaaaacagaacttccaaagtatctttctgtgacaacattaggttcaggcttgaagtccctgatttcgccatcaaagtcagatccaggggggacgatgctattcagaaacgtgctgagaagaggactgcaatgactgctttcaaaaaacaccagaataaatacatacgtagtgtaagcaagcg

SEQ ID NO: 62402 - DNA, 1233 bp, Homo sapiens
gcgctgaggtctcgccccataagactccgccccgccccacgaggccgcgccgccagcaataaggcccagccccgccttctgctgttgccgcagcaacccagaaagcgtcatggctgccgccggccaggaaaaagggtatttgacacagactgcggcagccctagacaagtcaccgtcactttcgccacagctagcagctcccatccgagggaggcctaagaagtgtctggtctatccgcatgcgccgaagagctcccgcttgtctcgttccgttctgcgttggcttcagggtctggatctcagcttcttccccaggaacatcaacagagatttttcaaatggcttcctaattgcagaaatattctgtatatattacccctgggaacttgaattatcatcctttgaaaacgggacctctttaaaagtcaagttggataactgggcacagttggagaagttcctggcaagaaaaaaatttaaattacctaaagaactaatccatggaacaattcattgtaaagctggagtgcctgaaatattgatagaagaggtttacactttattaacacatcgagaaattaaaagtatccaggatgactttgtgaatttcacggactatagctaccagatgcgtttacccctggtttccaggtctacagtttcgaagtctattaaagataacattaggttatcagaattactaagcaatcccaacatgctgaccaatgaacttaaagcggagttcctcatccttttacatatgttgcaaagaaaattaggcagaaaattgaatccagaatggtttgatgtgaaaccaacagtgggagaagttactctcaatcaccttcctgcccaagcctctgggcgcagatataatttaaaagttaaaagaggaagagttgtccctgttttaccaaatataggtagtggtggcagttcacatagagaaatacatgtgaagcaagctggacaacattcttattactctgctatgaaacctatcagaaacatggacaagaaaccttgaaaagcacctgtcaaatggctttgaagaagtgatgccaccatctctagccataataaagaaacagaatcacctagtattggatgtatttcaataataaatagagtggtgtcttttccataattgtgttaaagaacatttcttttccattcaatttgtttattaaactcctatgccaggcattgttgaaaatacaaaattaaataaat

SEQ ID NO: 62403 - DNA, 3359 bp, Homo sapiens
ttttctctcagttgaagcgcgcacattgagtcggcttttctactgcttcggctagggtaccttgtgaccatgtcttccaagaagaatagaaagcggttgaaccaaagcgcggaaaatggttcgtccttgccctctgctgcttcctcttgtgcggaggcacgggctccttctgctggatcagacttcgcggcaacctccgggactctgacggtgaccaacttattagaaaaggtagatgacaaaattcctaaaacattccagaatccccttattcatcttggactcaacactatgaagtctgcaaatatatgtataggtcgaccagtgttgcttactagtttgaacggaaagcaagaggtgtatacagcctggcctatggcaggatttcctggaggcaaggtcggcctgagtgaaatggcacagaaaaatgtgggtgtgaggcctggtgatgccatccaggtccagcctcttgtgggtgctgtgctacaggctgaggaaatggatgtggcactgagtgacaaagatatggaaattaatgaagaagaactgactggttgtatcctgagaaaactagatggcaagattgttttaccaggcaactttctgtattgtacattctatggacgaccgtacaagctgcaagtattgcgagtgaaaggggcagatggcatgatattgggagggcctcagagtgaccctgacactgatgcccaaagaatggcctttgaacagtccagcatggaaaccagtagcctggagttatccttacagctaagccagttagatctggaggatacccagatcccaacatcaagaagtactccttataaaccaattgatgacagaattacaaataaagccagtgatgttttgctggatgttacacagagccctggagatggcagtggacttatgctagaggaagtcacaggtcttaaatgtaattttgaatctgccagagaaggaaatgagcaacttactgaagaagagagactgctaaagttcagcataggagcaaagtgcaatactgatactttttattttatttcttcaacaacaagagtcaattttacagagattgataaaaattcaaaagagcaagacaaccaattcaaagtaacttatgacatgataggaggattaagtagccagctgaaagcaattagagaaataattgaattgcccctcaaacagcctgagcttttcaagagttatggaattcctgcccctagaggagtgttactttatggtcctccaggtactggaaaaacaatgatcgccagggctgttgctaatgaagttggagcctatgtttctgtaattaatggtcctgaaattataagcaaattctatggtgagactgaagcaaagttacgtcagatatttgctgaagccactctacgacacccatcaattatttttattgatgagctggatgcactttgtccgaaaagagagggggcccagaatgaagtggaaaaaagagttgtggcttcactcttaacactgatggatggcattggttcagaagtaagtgaaggacaagtgttggttcttggggccacaaatcgccctcatgccttggatgctgctctccgaagacctgggcgatttgataaagagattgagattggagttcccaatgctcaggaccggctagatattctccagaaactgcttcgaagggtaccccatttgctcactgaggctgagctgctgcagctggcaaatagtgctcatggatacgttggagcagacttgaaagtcttgtgtaatgaagcaggtctctgtgccttgcggagaatcctgaaaaaacagcctaacctccctgatgtcaaggtggctggactggtgaagattactctgaaggatttctttcaggcaatgaatgatatcagacccagcgccatgagggaaatagcaattgatgtcccaaatgtatcctggtcagatataggaggactggaaagtatcaaactgaagttggaacaggctgtggaatggcccttaaaacatccagagtctttcattcgaatgggtattcagccacctaaaggagttcttctctatgggccacctgggtgctctaaaacaatgatagcaaaggctttggccaatgagagtggactgaattttctagctataaaggggcctgaattaatgaataaatatgttggtgaatccgaaagagcagttagagagaccttccgaaaagcaagagcagtggcgccttccattattttctttgatgaactggatgccttagcagttgaaaggggcagttctttaggtgctgggaatgtagccgatcgtgttttggctcagctcttaacagaaatggatgggattgaacagctaaaggatgtgaccattttggcagctactaaccgtccagataggatagacaaggctttgatgcggcctggaagaattgatagaatcatctatgtgcctttaccggatgcagcaacaagaagggaaatatttaagctgcagttccactccatgcctgtcagtaatgaagttgacctggatgaactcatccttcaaaccgacgcatactcaggagcagagattgtagctgtctgcagagaggcagctcttctggctctggaagaaggcattcaagccaatctcatcatgaaaagacatttcactcaggccttgagcactgtgacacctagaattcctgagtcattgagacgtttttatgaagattatcaagagaagagtgggctgcgtacactctgagaaaatatatatattcaagatgctgaaaatcctttccagagaaaatttgtttctttttaaaattttttgagagtgttaaaaaaaattttactaggcaaaatgtttgaagtatgttcagtagaatttaggggctttggttcttacagattttcaagtcatgtaagtacagtgaagatatctctgagcataagtttcaatcagttttacctggaaatttgtggtgtggtttaaaaaacaaatgtttagctttttcatttgcgacctagtctgttcatcccatgaagcaatttctttttccagaatctgtttgagtgtctttctaaaatgccaaacatgttggcatcaattttatacagggatataaaaaagtatatgtggataaattttttgtaatctttagggatataaaaaagtgtatgtggataaattttttgtaatctttatttttgaaggccagccagtaaaatggcccaatgtgccagccatgcttatgtggccttgttttcaaatatacatatatgtgttatcattaaaattcatatatgtatttttgttttagccctcttaatctctacctatggccaaaaaaaaaaaaaaaaaaaaaaaaa

SEQ ID NO: 62404 - DNA, 2009 bp, Homo sapiens
tgggcccttagcaacggcctggcgacggtttccctgctgctgcagcccccgtcggctcctcttttccagtcctccactgccggggctgggcccggccgcgggaaggaccgaaggggatacagcgtgtccctgcggcggctgcaagaggactaagcatggatggcagccggagagtcagagcaacctctgtccttcccagatatggtccaccgtgcctatttaaaggacacttgagcaccaaaagtaatgctttttgcactgactcctcttctctcagactaagcactctccagctggtcaagaatcacatggctgttcactataataaaatcctttcagccaaagctgcagtagactgctcggttccagtaagcgtgagtaccagcataaagtatgcagaccaacaacgaagagagaaactcaaaaaggaattagcacaatgtgaaaaagagttcaaattaactaaaactgcaatgcgagccaattataaaaataattccaagtcactttttaataccttacaaaagccctcaggcgaaccgcaaattgaggatgacatgttaaaagaagaaatgaatggattttcatcctttgcaaggtcactagtaccctcttcagagagactacacctaagtctacataaatccagtaaagtcatcacaaatggccctgagaagaactccagttcctccccgtccagtgtggattatgcagcctcgggcccccggaaactgagctctggagccctgtatggcagaaggcccagaagcacattcccaaattcccaccggtttcagttagtcacttcgaaagcacccagtggggatcttttggataaacattctgaactcttttctaacaaacaattgccattcactcctcgcactttaaaaacagaagcaaaatctttcctgtcacagtatcgctattatacacctgccaaaagaaaaaaggattttacagatcaacggatagaagctgaaacccagactgaattaagctttaaatctgagttggggacagctgagactaaaaacatgacagattcagaaatgaacataaagcaggcatctaattgtgtgacatatgatgccaaagaaaaaatagctcctttacctttagaagggcatgactcaacatgggatgagattaaggatgatgctcttcagcattcctcaccaagggcaatgtgtcagtattccctgaagcccccttcaactcgtaaaatctactctgatgaagaagaactgttgtatctgagtttcattgaagatgtaacagatgaaattttgaaacttggtttattttcaaacaggtttttagaacgactgttcgagcgacatataaaacaaaataaacatttggaggaggaaaaaatgcgccacctgctgcatgtcctgaaagtagacttaggctgcacatcggaggaaaactcggtaaagcaaaatgatgttgatatgttgaatgtatttgattttgaaaaggctgggaattcagaaccaaatgaattaaaaaatgaaagtgaagtaacaattcagcaggaacgtcaacaataccaaaaggctttggatatgttattgtcggcaccaaaggatgagaacgagatattcccttcaccaactgaatttttcatgcctatttataaatcaaagcattcagaaggggttataattcaacaggtgaatgatgaaacaaatcttgaaacttcaactttggatgaaaatcatccaagtatttcagacagtttaacagatcgggaaacttctgtgaatgtcattgaaggtgatagtgaccctgaaaaggttgagatttcaaatggattatgtggtcttaacacatcaccctcccaatctgttcagttctccagtgtcaaaggcgacaataatcatgacatggagttatcaactcttaaaatcatggaaatgagcattgaggactgccctttggatgtttaatcttcattaataaatacctcaaatggccagtaacaaaaaaaaaaaaaaaaaaaa

SEQ ID NO: 62405 - DNA, 1194 bp, Homo sapiens
agtaacaaagaattccagcagtgagctgtgagttctgtccttgctggctttcccaagtggaaggctaccctcatctttcactaatggcagactaggacaagcattacccaggcctgcaagcttgttaaggactaggaacccaagcaagaactcaccatgccaatcaaacctgttgggtggatatgtgggcaggtgttgaagaacttttctggaagaatcgaggggatccagaaagcaatcatggaccttgtagatgagtttaaagatgaatttcccaccatcctaagattatcacagtctaatcagaaaagagaacctgcgcagaaaacatccaaaatcaggatggctattgctttagctaagattaatcgagcaacattaattcgtggattaaacagcatatccagatcctccaaatcagtggccaaacttctgcatcctcagcttgcatgcagacttttagagctaagggacatatctggtcgtctgctgagggaagttaatgcgccgaggcaacccctatataacattcaggtcagaaagggttctttgtttgaaatcatctcctttccagcaaagactgctttaactagcataatatatgcttcatatgcagcactaatttatttggcagtctgtgttaatgctgtgctgaagaaggtaaagaacatcttccaggaagaagaatccataaggcaaaacagagaggagagtgaaaattgtagaaaagccttttctgagcctgtgctttcggagcctatgtttgctgaaggtgaaatcaaagcaaaaccttataggtcattgccggagaagccagacatttcagattaccccaagcttcttgctaataagcagagtaataacatccaagttttacattctgtgtttgaccaatcagctgaaatgaatgagcaaatctgaatacaggtatcactgaacagaacttaagagttatctatttaatggcacatttcatctgacaaaactcagagtctagtttacatattctgaattgctctgctttcttaaaaaaaagagaagggggctactattaaaatgtcattttctagtatttacatgatagagtaaataaaatgaatattgatgtggaataaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 62406 - DNA, 2040 bp, Homo sapiens
ggcaaggcctggggccctgggcagcctccaggtgcagtgccctcccgtgggccgcacccttgccactgccccagggcatgtctctactcaccaattatgaagggcttcggcatcagatagagaggctggtgcgggaaaatgaggaactgaagaagttggtgcggctcattcgggagaatcacgagctcaagtcagcgatcaagactcaggcaggcgggctcggcatcagcgggttcacgagtgggcttggtgaggcaacagcaggcctttcctcacgccagaacaatggtgtcttcctgcccccgtccccagcagtggcaaacgaacgagtcctcgaagaagtggggatcatggccttggcacccctggccgagatgctaaccagcttgcagcccagcgccacaccgggctcactcatgagccccctgacaggcaccctcagcacgctgctgtctggcccagcacccacgtcacagagcagccccctcaccagcttcctgaccagtcccattgcgggacccctaacaggcacactggccagttccctgggcctgccctccactggcaccctgactcccagcagcctcgtggcaggccctgtggccatgtcccagagcagccccctgatagcccctgtgatgggcacggtggctgtctctctgagcagccccctcctcagctccactgccaccccaccaggggtctctcagaacctgctggccaaccccatgagcaacctggtcctgccagaggccccaaggctgcggctggctgagccactccgcggaggccccactgggccccagtccccagcttgcgtggtacccactgccaccaccaaagtcccactctccactgagcccccccagtcgacccaggacccagagcctctcagcatggcgtttgcaggagcacccctccagacctccacccctatcggagccatgggcacacctgctcccaagacggccttctccttcaacacttcggacacacaggcccagcccagtgccgcccaggaacaagtggtccctgcatctgtccccacctcccccaccacctcccccacggtcaccgtccttgcctctgcccccgcccttgccccccaggttgccaccagctacacaccctcaagcaccacccacatcgcccagggtgccccccatcccccttcccgaatgcataattccccaacccagaacctgcctgtcccccactgtcctccacacaacgcccactccccacctcgtacctcatcctccccggcttcagtcaatgactctcgaggtccacgcaccacagaaccgtcgacgaagagcatgatggaggtggaacggaagctggcccaccgcaagaccagcaagttccccgagaacccccgagagtcgaagcagctggcctgggagaggctggtgggtgagattgccttccagctggaccgcaggatcctgtccagcatcttcccagagcgcgtacggctctacggcttcactgcctccaacatcccagagaagatcatccaggcttccctgaaccccagtgaccacaagctggatgagaagctgtgccagaggctcacacagcgctatgtgagcgtcatgaacaggctgcagagtctgggctacaacgggcgggtgcaccctgcgctgaccgagcagctggtgaacgcttatggcatcctgcgagagcgcccggagctggcggcgtctgagggcggcccctacaccgtggacttcctgcagcgtgtggtggtggagaccgtgcaccccggcatgctcgccgacgcgctgctgctgctctcctgcctcagccagctggcgcacgatgacggcaagcccatgttcatctggtgacgctggagctgggaggtccaggctcgctcagccccacagccctgtgcacggccattaaagcttcccacagacactggtcgctgggcctgtgccagcgctcctgggtggtgctgcctcctctggggtggctcaccgggccccggcaccgtgccccttcaaaaaaaaaaaaaaaaaaaaaaaaaaaaaa

SEQ ID NO: 62407 - DNA, 1380 bp, Homo sapiens
agttgccagttggttcgttggtccgtggaggcctctgagcacagacccgggcctcccctggggaagggggtgggaagaccccgaggtggaaaagaaggagcaccttgagctggatgggggctgcagcgagcctggttcgggctgggggcggactcgctggggctcccagggcttccaaaccacgaaacgcccaggtggagggagtaaggctcccgtttagaggccagtcctgccctcctgactttcggtggcttgtggaatttgtttgttttgactgatacctttcttacgagggactttctttgtctctgggttgcttctaatatttaaaatcatcatgggcacagatgagtccatccatgctcactggaaacagtccacggggctgccgtctcccctccatctcaagcacgacctgcggcagacagctggagaaggttccagaaaaaagggactctggcatgaccgaggtggagaggacctacagtgctaattgcagtgattttctggaatctaagggatgttttgccaacacaacaccctctggcaaaagtgtcagttcctcatcttcagtggaaacaggcccaagtgtcagtgagcctcctggcctccccagagtgtctgcttacgtagacaccactgctgacttggatcggaaactctccttctcacattctgatcactcctctgaaatgtcgttgcctgaagtccaaaaggataaatatcctgaggaattcagcctgcttaagttgcagacgaaagatgggcatcgtcctgagtggacattttacccaaggtttagcagcaacatccacacctaccacgtcggaaagcagtgcttctttaatggagtcttcctcggcaacaagaggtctctatcagagaggacggtggacaagtgctttgggagaaagaaatacgatattgatcccaggaatggaatcccaaagttaactccaggcgacaatccatatatgtacccagaacagagtaaaggcttccacaaagcaggatcaatgctcccaccagtgaatttttcaatagtgccttatgaaaagaaatttgatacatttattccacttgagcctcttccacaaattcccaacttgcctttctgggtgaaggagaaggccaacagtttgaaaaatgagatacaagaggttgaggagcttgacaactggcagccagcagtgcccttaatgcacatgctacacctttctggtgctttggactttccaagacaatcctgagcataaacaggcccacaaaacatgtgctgactgcactctggcgacccttttccagttgatgttttttgtcatgtgactgttctaaatccagtgtttgacccttaaaaaaaaaaaaaaaaaaaaaaaaaaa

SEQ ID NO: 62408 - DNA, 1826 bp, Homo sapiens
ccgctcagaaagcgcgggaaaggcacgcagccacgccccaagggcgcagcctaggacaggggcttctggagcttctggcagccgtctgccctcatggcctttgcacctatggggcccgaggcctcgttcttcgacgttttggaccgacacagggagtccctgctggctgccctgaggagaggtggcagggagcccccaactgggggaagccgcctggcctccagttctgaggttcttgcatctatagaaaatattatccaagacataatcacaagcttggcaagaaatgaagcacctgcattcacgatagacaacagatcaagctgggaaaacataaagtttgaagattctgtgggtcttcagatggtatcccattgcaccaccagaaagatcaaaagtgattcaccaaaatcagctcaaaaattttctctaatccttaaaatattgtccatgatttataaattagtacagagcaacacttatgcaaccaaaagggacatatattacactgacagtcaactctttggtaaccagactgtcgtcgacaatattatcaatgacatttcttgcatgttaaaagtgtcaaggaggagtctacatatattatctacatcaaaaggtttaattgctggcaacttaagatacatcgaggaagatggcaccaaagtgaattgtacctgtggtgcaacggctgttgctgtgccatcgaatattcaaggaattcggaatttagttacagatgcaaagtttgtattaattgtagaaaaagatgcaacatttcagcggctcctagatgacaacttttgcaacaaattgtctccttgcatcatgattacgggaaagggagttcctgatctaaacacaagacttttagtcaagaaactgtgggatacatttcatgttcctgttttcactcttgtagatgctgatccacatggcatagaaataatgtgcatctataagtatggatctatgtctatgtcttttgaagctcatcatctcacagttccagctattagatggcttggtcttctcccttctgatcttaaaagattaaatgtacctaaagatagtttgattccactgacaaaaagggaccaaatgaaacttgacagtatcctgaggagaccttatgttacctgccaaccattttggagaaaagaaatggaaataatggcagactctaaaatgaaggcagaaattcaagctttgactttcctatcatcagattatctttccagagtgtacttacctaacaaattaaaatttggaggatggatataaaaataaatcagaagaacttctgattgccagaggcttttcattagttttgttttgattggcaaatactattgtggaaagaacatatattatattcttaattctgtaaaagtgaaataaaataactttccgttaattatatatttttgtcaaaacaaatgctgtactccaattttctttgcaaggccttattcttgcctctatagagacagatttctgtcctatcttctaaagcaaattataaaagaatatgttattttgacctttaaattatttttgaaaaaataatattttatacatgtcatcaaagtctacaaaatatttaccttctacgatacaactaatgttaacgcataaagtatcttactggtaacaaaaatcataatgatctgaatttgagatgttgcaaatgaattgtggtgtccggtagtttcttcttacattttcctttgcctttatactttaggggtcttactccattaattcatttgttacattagtaaaattcagtatgaataaatatttggattgatgtaaaaaaaaaa

SEQ ID NO: 62409 - DNA, 1712 bp, Homo sapiens
ccgctcagaaagcgcgggaaaggcacgcagccacgccccaagggcgcagcctaggacaggggcttctggagcttctggcagccgtctgccctcatggcctttgcacctatggggcccgaggcctcgttcttcgacgttttggaccgacacagggagtccctgctggctgccctgaggagaggtggcagggagcccccaactgggggaagccgcctggcctccaggtttgaagattctgtgggtcttcagatggtatcccattgcaccaccagaaagatcaaaagtgattcaccaaaatcagctcaaaaattttctctaatccttaaaatattgtccatgatttataaattagtacagagcaacacttatgcaaccaaaagggacatatattacactgacagtcaactctttggtaaccagactgtcgtcgacaatattatcaatgacatttcttgcatgttaaaagtgtcaaggaggagtctacatatattatctacatcaaaaggtttaattgctggcaacttaagatacatcgaggaagatggcaccaaagtgaattgtacctgtggtgcaacggctgttgctgtgccatcgaatattcaaggaattcggaatttagttacagatgcaaagtttgtattaattgtagaaaaagatgcaacatttcagcggctcctagatgacaacttttgcaacaaattgtctccttgcatcatgattacgggaaagggagttcctgatctaaacacaagacttttagtcaagaaactgtgggatacatttcatgttcctgttttcactcttgtagatgctgatccacatggcatagaaataatgtgcatctataagtatggatctatgtctatgtcttttgaagctcatcatctcacagttccagctattagatggcttggtcttctcccttctgatcttaaaagattaaatgtacctaaagatagtttgattccactgacaaaaagggaccaaatgaaacttgacagtatcctgaggagaccttatgttacctgccaaccattttggagaaaagaaatggaaataatggcagactctaaaatgaaggcagaaattcaagctttgactttcctatcatcagattatctttccagagtgtacttacctaacaaattaaaatttggaggatggatataaaaataaatcagaagaacttctgattgccagaggcttttcattagttttgttttgattggcaaatactattgtggaaagaacatatattatattcttaattctgtaaaagtgaaataaaataactttccgttaattatatatttttgtcaaaacaaatgctgtactccaattttctttgcaaggccttattcttgcctctatagagacagatttctgtcctatcttctaaagcaaattataaaagaatatgttattttgacctttaaattatttttgaaaaaataatattttatacatgtcatcaaagtctacaaaatatttaccttctacgatacaactaatgttaacgcataaagtatcttactggtaacaaaaatcataatgatctgaatttgagatgttgcaaatgaattgtggtgtccggtagtttcttcttacattttcctttgcctttatactttaggggtcttactccattaattcatttgttacattagtaaaattcagtatgaataaatatttggattgatgtaaaaaaaaaa

SEQ ID NO: 62410 - DNA, 1880 bp, Homo sapiens
ctttcccacccttcctccccacaaggctgtctgagatgccaccttccacctaaacatcatctcccaaattttaatccttaactttggtctctgacttctgcttgattccacagtctccacccacatttgcacaaaggaccatcacctgtccttcctggaatctctaaagttttctgctttccttctgtcctgatggccagctctgctaagtcagctgagatgcccaccatctccaaaacccttaaccctactcctgatcctcatcaagaatatctggaccctaggattaccattgccttattcgaaattggatcacattccccttcctcctggggctctctccctttcctaaagaatagcagccatcaagttacagaacaacagactgcacagaagtttaacaatctcttaaaagaaattaaagatattcttaaaaatatggcaggttttgaagagaagatcacagaagcaaaagaactttttgaggaaaccaatattactgaggatgtgtcagcccacaaagaaaatatcagaggacttgacaaaatcaatgaaatgttatcaacaaacctgcctgttagtttagccccagagaaagaagacaatgaaaagaaacaggagatgatattggaaaccaatattactgaggatgtgtcagcccacaaagaaaatatcagaggacttgacaaaatcaatgaaatgttatcaacaaacctgcctgttagtttagccccagagaaagaagacaatgaaaagaaacagcagatgataatggaaaaccagaactctgagaacaccgcacaagtttttgcaagagatttggtaaatcgtttagaagaaaaaaaagtccttaacgaaactcaacaaagtcaggaaaaagcaaaaaacagacttaatgttcaagaagaaactatgaaaattaggaacaacatggagcagttactacaggaagcagaacactggagtaaacaacatactgagctcagtaaactgataaaatcctatcagaaatctcagaaagacataagtgaaactcttggaaataatggagtcggtttccaaacccagccaaataatgaagtgtcggctaagcatgagctggaggaacaggtgaagaaactgagccatgacacctattcattgcagttgatggcagctttgctagagaatgaatgccaaatcttacagcagagagtagagattctcaaggaactccatcatcagaaacagggaactctgcaagagaagccaattcagataaactataaacaggacaagaaaaatcagaagccatcagaagcaaagaaagtagaaatgtataagcagaacaagcaagcaatgaagggtacattttggaaaaaagacagatcctgtagaagcctggatgtttgtcttaataagaaagcttgcaatacccagttcaatattcatgttgcaagaaaagctcttaggggaaaaatgaggtcagctagcagcctaagatagaaaataccaaaagcagatgaaaaggtgaatccttaaaaaactacatctgttacctccaacttgtcagtcatgatcaatcatcaaaccttgggcagatctgctggttcaaccaagaaagagctatagaataaggagattgacacttatattactcattacttcagcagttatgtaagtctggtctttaatgaccattgtgtctacatcaagttcataacttttcacctttacaatctgcttgttttttttgtaattattagatagacagcctagagtgagaagttaaaggtccaattaagttaagatctaaataaaaaccagaatacaagggaaaaaaaaaaaaaaaaaaaaaaaaaaaaaaaaaaaaaaaaaaaaaaaaaaaaaaaaaaaaaaaa

SEQ ID NO: 62411 - DNA, 1466 bp, Homo sapiens
gcatgctctgactttctctctctttcgattcttccatactcagagtacgcacggtctgattttctctttggattcttccaaaatcagagtcagactgctcccggtgccatgaacggagacgacgcctttgcaaggagacccacggttggtgctcaaataccagagaagatccaaaaggccttcgatgatattgccaaatacttctctaaggaagagtgggaaaagatgaaagcctcggagaaaatcttctatgtgtatatgaagagaaagtatgaggctatgactaaactaggtttcaaggccaccctcccacctttcatgtgtaataaacgggccgaagacttccaggggaatgatttggataatgaccctaaccgtgggaatcaggttgaacgtcctcagatgactttcggcaggctccagggaatctccccgaagatcatgcccaagaagccagcagaggaaggaaatgattcggaggaagtgccagaagcatctggcccacaaaatgatgggaaagagctgtgccccccgggaaaaccaactacctctgagaagattcacgagagatctggaaatagggaggcccaagaaaaggaagagagacgcggaacagctcatcggtggagcagtcagaacacacacaacattggtcgattcagtttgtcaacttctatgggtgcagttcatggtacccccaaaacaattacacacaacagggacccaaaaggggggaacatgcctggacccacagactgcgtgagagaaaacagctggtgatttatgaagagatcagcgaccctgaggaagatgacgagtaactcccctcagggatacgacacatgcccatgatgagaagcagaacgtggtgacctttcacgaacatgggcatggctgcggacccctcgtcatcaggtgcatagcaagtgaaagcaagtgttcacaacagtgaaaagttgagcgtcatttttcttagtgtgccaagagttcgatgttagcgtttacgttgtattttcttacactgtgtcattctgttagatactaacattttcattgatgagcaagacatacttaatgcatattttggtttgtgtatccatgcacctaccttagaaaacaagtattgtcggttacctctgcatggaacagcattaccctcctctctccccagatgtgactactgagggcagttctgagtgtttaatttcagattttttcctctgcatttacacacacacgcacacaaaccacaccacacacacacacacacacacacacacacacacacacacacaccaagtaccagtataagcatctgccatctgcttttcccattgccatgcgtcctggtcaagctcccctcactctgtttcctggtcagcatgtactcccctcatccgattcccctgtagcagtcactgacagttaataaacctttgcaaacgttcaaaaaaaaaaaaaaaaaa

SEQ ID NO: 62412 - DNA, 1322 bp, Homo sapiens
gcatgctctgactttctctctctttcgattcttccatactcagagtacgcacggtctgattttctctttggattcttccaaaatcagagtcagactgctcccggtgccatgaacggagacgacgcctttgcaaggagacccacggttggtgctcaaataccagagaagatccaaaaggccttcgatgatattgccaaatacttctctaaggaagagtgggaaaagatgaaagcctcggagaaaatcttctatgtgtatatgaagagaaagtatgaggctatgactaaactaggtttcaaggccaccctcccacctttcatgtgtaataaacgggccgaagacttccaggggaatgatttggataatgaccctaaccgtgggaatcaggttgaacgtcctcagatgactttcggcaggctccagggaatctccccgaagatcatgcccaagaagccagcagaggaaggaaatgattcggaggaagtgccagaagcatctggcccacaaaatgatgggaaagagctgtgccccccgggaaaaccaactacctctgagaagattcacgagagatctggacccaaaaggggggaacatgcctggacccacagactgcgtgagagaaaacagctggtgatttatgaagagatcagcgaccctgaggaagatgacgagtaactcccctcagggatacgacacatgcccatgatgagaagcagaacgtggtgacctttcacgaacatgggcatggctgcggacccctcgtcatcaggtgcatagcaagtgaaagcaagtgttcacaacagtgaaaagttgagcgtcatttttcttagtgtgccaagagttcgatgttagcgtttacgttgtattttcttacactgtgtcattctgttagatactaacattttcattgatgagcaagacatacttaatgcatattttggtttgtgtatccatgcacctaccttagaaaacaagtattgtcggttacctctgcatggaacagcattaccctcctctctccccagatgtgactactgagggcagttctgagtgtttaatttcagattttttcctctgcatttacacacacacgcacacaaaccacaccacacacacacacacacacacacacacacacacacacacacaccaagtaccagtataagcatctgccatctgcttttcccattgccatgcgtcctggtcaagctcccctcactctgtttcctggtcagcatgtactcccctcatccgattcccctgtagcagtcactgacagttaataaacctttgcaaacgttcaaaaaaaaaaaaaaaaaaaa

SEQ ID NO: 62413 - DNA, 1290 bp, Homo sapiens
ctctctctttcgattcttccatactcaagagtacgcacggtctgattttctctttggattcttccaaaatcagagtcagactactccctgtgccatgaacggagatgacacctttgcaaggagacccacggttggtgctcaaataccagagaagatacaaaaggccttcgatgatattgccaaatacttctctaaggaagagtgggaaaagatgaaagtctcggagaaaatcgtctatgtgtatatgaagagaaagtatgaggccatgactaaactaggtttcaaggccatcctcccatctttcatgcgtaataaacgggtcacagacttccaggggaatgattttgataatgaccctaaccgtgggaatcaggttcaacgtcctcagatgactttcggcaggctccagggaatcttcccgaagatcatgcccaagaagccagcagaggaaggaaatgtttcgaaggaagtgccagaagcatctggcccacaaaacgatgggaaacagctgtgccccccgggaaaaccaactacctctgagaagattaacatgatatctggacccaaaaggggggaacatgcctggacccacagactgcgtgagagaaagcagctggtgatttatgaagagatcagcgatcctgaggaagatgatgagtaactccccttggggatatgacacatgcccatgatgagaagcagaacgtggtgacctttcacgaacatgggcatggctgtggacccctcgtcatcaggtgcatagcaagtgaaagcaagtgttcacaacagtgaaaagttgagcgtcatttttcttagtgtgccaagagtacgatattagcgtttccattgtattttcttgaagtgtgtcattctgttagatattaacattttcactgatgagcaagacatacttaatgcatattttggtttgtgtatccatgcacctaccttagaaaacaagtattgtcagttacctctgcatggaacagcattaccctcctctctccctagatgtgactactgagggcagttctgagtgtttaatttcagattttttcctctgcatttacacacacacacaaaccacaccacacacacacacacacacacacagacacacaccaagtaccagtataagcatctcccatctgcttttcccattgccatgcgtcctggtcaggcttccctcactctgtttcctggtcagcatgtactcccctcatccgattcccctgtagcagtcactgacagtaaataaacctttgcaaacgttaaaaaaaaaaaaaaaaa

SEQ ID NO: 62414 - DNA, 1250 bp, Homo sapiens
acacgccgatttgcccttttgattcttccacaatcagggtgagactgctcccagtgccatgaacggagacgacgcctttgcaaggagacccagggatgatgctcaaatatcagagaagttacgaaaggccttcgatgatattgccaaatacttctctaagaaagagtgggaaaagatgaaatcctcggagaaaatcgtctatgtgtatatgaagctaaactatgaggtcatgactaaactaggtttcaaggtcaccctcccacctttcatgcgtagtaaacgggctgcagacttccacgggaatgattttggtaacgatcgaaaccacaggaatcaggttgaacgtcctcagatgactttcggcagcctccagagaatcttcccgaagatcatgcccaagaagccagcagaggaagaaaatggtttgaaggaagtgccagaggcatctggcccacaaaatgatgggaaacagctgtgccccccgggaaatccaagtaccttggagaagattaacaagacatctggacccaaaagggggaaacatgcctggacccacagactgcgtgagagaaagcagctggtggtttatgaagagatcagcgaccctgaggaagatgacgagtaactcccctcggggatatgacacatgcccatgatgagaagcagaacgtggtgacctttcacgaacatgggcatggctgcggacccctcgtcatcaggtgcatagcaagtgaaagcaagtgttcacaacagtgaaaagttgagcgtcatttttcttagtgtgccaagagttcgatgttggcgtttccgctgtattttcttgcagtgtgccattctgttagacattagcgttttcgttgatgagcaagacatgcttaatgcatatttcggcttgtgtatccatgcacctacctcagaaaacaagtattgtcaggtattctctccatagaacagcactaccctcctctctccccagatgtgactactgaggggaggtctgagtgtttaatttccgattttttcctctgcatttacacacacaccacacacgcacacacacacaccaagtaccagtataagcatctcccatctgcttttctccattgccatgcgacctggtcaagcccccctcactctgtttcctgttcagcatgtactcccctcatccgattccgttgtatcagtcactgacagttaataaacctttgcaaacgttcaaaaaaaaaaaaaaaaaaaaaaaaaaaaaaaaa

SEQ ID NO: 62415 - DNA, 1114 bp, Homo sapiens
acacgccgatttgcccttttgattcttccacaatcagggtgagactgctcccagtgccatgaacggagacgacgcctttgcaaggagacccagggatgatgctcaaatatcagagaagttacgaaaggccttcgatgatattgccaaatacttctctaagaaagagtgggaaaagatgaaatcctcggagaaaatcgtctatgtgtatatgaagctaaactatgaggtcatgactaaactaggtttcaaggtcaccctcccacctttcatgcgtagtaaacgggctgcagacttccacgggaatgattttggtaacgatcgaaaccacaggaatcaggttgaacgtcctcagatgactttcggcagcctccagagaatcttcccgaaggacccaaaagggggaaacatgcctggacccacagactgcgtgagagaaagcagctggtggtttatgaagagatcagcgaccctgaggaagatgacgagtaactcccctcggggatatgacacatgcccatgatgagaagcagaacgtggtgacctttcacgaacatgggcatggctgcggacccctcgtcatcaggtgcatagcaagtgaaagcaagtgttcacaacagtgaaaagttgagcgtcatttttcttagtgtgccaagagttcgatgttggcgtttccgctgtattttcttgcagtgtgccattctgttagacattagcgttttcgttgatgagcaagacatgcttaatgcatatttcggcttgtgtatccatgcacctacctcagaaaacaagtattgtcaggtattctctccatagaacagcactaccctcctctctccccagatgtgactactgaggggaggtctgagtgtttaatttccgattttttcctctgcatttacacacacaccacacacgcacacacacacaccaagtaccagtataagcatctcccatctgcttttctccattgccatgcgacctggtcaagcccccctcactctgtttcctgttcagcatgtactcccctcatccgattccgttgtatcagtcactgacagttaataaacctttgcaaacgttcaaaaaaaaaaaaaaaaaaaaaaaaaaaaaaaaa

SEQ ID NO: 62416 - DNA, 1322 bp, Homo sapiens
ccaggctctagggacagaaccttcccaaggcgggggggaggggagactctgattttcccgccgaaagcgtccccttggattggctactttaaattcagagtacgcacacgccgatttgcccttttgattcttccacaatcagggtgagactgctcccagtgccatgaacggagacgacgcctttgcaaggagacccagggatgatgctcaaatatcagagaagttacgaaaggccttcgatgatattgccaaatacttctctaagaaagagtgggaaaagatgaaatcctcggagaaaatcgtctatgtgtatatgaagctaaactatgaggtcatgactaaactaggtttcaaggtcaccctcccacctttcatgcgtagtaaacgggctgcagacttccacgggaatgattttggtaacgatcgaaaccacaggaatcaggttgaacgtcctcagatgactttcggcagcctccagagaatcttcccgaagatcatgcccaagaagccagcagaggaagaaaatggtttgaaggaagtgccagaggcatctggcccacaaaatgatgggaaacagctgtgccccccgggaaatccaagtaccttggagaagattaacaagacatctggacccaaaagggggaaacatgcctggacccacagactgcgtgagagaaagcagctggtggtttatgaagagatcagcgaccctgaggaagatgacgagtaactcccctcggggatatgacacatgcccatgatgagaagcagaacgtggtgacctttcacgaacatgggcatggctgcggacccctcgtcatcaggtgcatagcaagtgaaagcaagtgttcacaacagtgaaaagttgagcgtcatttttcttagtgtgccaagagttcgatgttggcgtttccgctgtattttcttgcagtgtgccattctgttagacattagcgttttcgttgatgagcaagacatgcttaatgcatatttcggcttgtgtatccatgcacctacctcagaaaacaagtattgtcaggtattctctccatagaacagcactaccctcctctctccccagatgtgactactgaggggaggtctgagtgtttaatttccgattttttcctctgcatttacacacacaccacacacgcacacacacacaccaagtaccagtataagcatctcccatctgcttttctccattgccatgcgacctggtcaagcccccctcactctgtttcctgttcagcatgtactcccctcatccgattccgttgtatcagtcactgacagttaataaacctttgcaaacgttc

SEQ ID NO: 62417 - DNA, 1281 bp, Homo sapiens
tctgattttggaagaatctaaagagaatatcagagcatgcatactctgaacttggagtagccaatcccaggggacgctttaggcgggaaaatcagagtctccgtcagagtgctcctggtgccatgaacggagacgacgcctttgcaaagagacccagggatgatgctaaagcatcagagaagagaagcaaggccttcgatgatattgccaaatacttctctaaggaagagtgggaaaagatgaaattctcggagaaaatcagctgtgtgcatatgaagagaaagtatgaggccatgactaaactaggtttcaacgtcaccctctcacttttcatgcgtaataaacgggccacagactctcagaggaatgattctgataatgaccgtaaccgtgggaatgaggttgaacgtcctcagatgacttttggcaggctccagagaatcatcccgaagatcatgcccgagaagccagcagaggaaggaagtgattcgaagggagtgccagaagcatctggcccacagaacgatgggaaaaagctgtgcccgccgggaaaagcaagtagctctgagaagattcacgagagatctggacccaaaagggggaaacatgcctggacccacagactgcgtgagagaaagcagctggtgatttatgaagagatcagcgaccctgaggaagatgacaagtaactcccctcagggatacgacacatgcccatgatgagaagcagaacgtggtgacctttcacgaacgtgggcatggctgcggacccctcgtcatcaggtgtatagcaagtgaaagcaagtgttcacaacagtgaaaagttgagcgtcatttttcttagtgtgccaagagttcgatgttggcgtttccgttgtattttcttgcagtgtgccattctgttagacattagcattttcgttgatgagcaagacatgcttaatgcatatttcggcttgtgtatccatgcacctacctcagaaaacaagtattgtcaggtattctctccatagaacagcactaccctcctctctccccagatgtgactactgaggggaggtctgagtgtttaatttccgattttttcctctgcatttacacacacaccacacacgcacacacacacaccaagtaccagtataagcatctcccatctgcttttctccactgccatgtgtcctggtcaagcccccctcactctgtttcctgttcagcatgtactcccctcatccgattcccctctatcagtcactgacagttaataaacctttgcaaacgttc

SEQ ID NO: 62418 - DNA, 4285 bp, Homo sapiens
cgcgcttttctggaatctttcgcccccggaagggcagcggcgggcgcctgtgtggaaggtggggtggccagagacacccgagggacctgagctggatcgccatacctaccctgtggtcctcatcttcctggcctcatagctcctcctctccaagcatgtcttccccgttgcaaagagctgtgggagataccaagagggccttgtctgcatcttctagttcctctgccagtctaccctttgatgacagggactcaaaccatacctcagaggggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcagtctttggtagatgagtggctggatagctacaagcaagaccaggatgcaggatttctggagcttgttaactttttcatccaatcttgcggatgtaaaggcattgtgacccctgagatgttcaagaagatgtccaactcagagatcatccagcacctaacagagcagtttaatgaggactcgggggactaccctctcatagctccaggtccatcctggaagaagttccagggcagcttctgtgaatttgtgaggacattggtctgtcagtgccagtacagcctcctctatgatggcttccctatggacgacctcatctccctgctcactggcctctcagactcacaagtccgcgccttccgtcacactagcaccctggctgctatgaaactgatgacctccctggtaaaagttgccctccaactgagtgtgcaccaagataacaatcagcgtcagtatgaggctgaaagaaacaaggggccagggcagagggcacctgagcggctggagagcctgttggagaaacgcaaagagctccaagagcatcaagaggagattgaggggatgatgaatgccctcttcaggggtgtctttgttcatcggtacagggatgtccttcctgagatccgtgctatctgcattgaggaaattgggtgttggatgcaaagctacagcacgtctttcctcaccgacagctatttaaaatatattggttggactctgcatgataagcaccgagaagtccgcctgaagtgtgtgaaggccctgaaagggctgtacggtaaccgggacctgaccacacgcctggagctcttcaccagccgcttcaaggaccggatggtttccatggtcatggacagagagtatgatgtggcagtggaggctgtcagattactgatacttatccttaagaacatggaaggggtgctgacggacgcggattgtgagagcgtctacccagttgtgtatgcctctcatcgaggcctggcctctgccgcaggcgaatttctgtactggaaactcttctaccctgagtgcgagataagaatgatgggtggaagagagcaacgccagagcccaggcgcccagaggactttcttccagcttctgctgtccttctttgtggagagcgagctccatgaccacgctgcttacttagtagacagtctgtgggactgtgcaggggctcggctgaaggactgggagggtctgacaagcctgctgctggagaaggaccagaacctgggtgatgtgcaggagagcacactgatagaaatccttgtgtccagtgcccggcaagcttcagaggggcacccgcctgtgggccgggtcactgggaggaagggcttaacctctaaggagcgcaagacccaagccgatgacagggtgaagttgactgagcacctcatccccctgctgccccagctcctggccaagttctcagctgatgcagagaaggtcactcccctgctccagcttctcagctgctttgacctccacatctactgcactgggcgcttggagaagcacctggagctgttcctgcagcaactccaggaggtggtggtgaagcatgcagagccagcggtgcttgaggctggggcgcatgccctctacctgctctgtaatcccgaattcactttcttcagccgggcggactttgcccgcagccagctagtagatttgctgactgaccgcttccagcaggagcttgaagagctgttacagtcgtccttcctagatgaggatgaggtatataatctggcagccactctgaaacgcctctctgccttctacaacactcatgacctgactcgctgggagctctatgagccatgttgccaactcctgcagaaggctgtggacacaggagaggttcctcaccaggttatcctgccagccttgactcttgtctatttttccattctctggacactaacccacatttctaaatcagatgcttcccagaagcagctgtcgagtttgagggacagaatggtggccttctgtgaactctgccagagttgcctctcagatgtggatactgagatccaggagcaggcttttgtcttattaagtgatctacttctcatctttagccctcagatgattgttgggggccgtgatttccttaggccacttgtcttttttcctgaagctactctccagtctgagctagccagcttcctcatggaccacgtcttcatccagccgggagacctgggcagtggtgattcccaggaggatcatttacagatagagcggctacaccagcggcgccgcctcctagccgggttctgcaagctgttgctttatggggtgctggagatggatgcagcctcagatgttttcaaacactacaacaagttctacaatgactatggtgacattatcaaggaaacattaactagagcaaggcagattgaccgaagtcattgttcccgaatcctgctgctgagcctcaagcagctgtacacagaactgctgcaggagcatgggccccagggcctgaatgagcttcctgccttcatcgagatgagggacctggcccggaggtttgccttgagttttggaccccagcagctgcagaaccgtgacctcgtggtcatgctacacaaggaaggcatccagttctccttgtctgagcttcctccagctggctcctccaatcagcctccaaatctggcattcctggagctcctttcagagttttccccccgactcttccatcaggacaagcagcttttactgtcctatctagaaaagtgcctgcagcatgtctcccaggcacctggccatccctggggcccagtcaccacctactgccactccctcagccctgtggagaacacagcagagaccagccctcaggtcctccccagctccaagaggaggcgcgttgaagggcctgccaagcctaacagagaggacgtctcctcgtcccaggaagaaagtctgcagctgaacagcatcccgcccacgcccaccctcacctccacagctgtgaagagcaggcagcccctgtgggggttgaaagagatggaggaagaagatggctcagagttggattttgcccagggtcagcccgtcgcaggcaccgagaggtcaaggttcttgggtccacaatatttccagactccacacaacccttcaggtcctggcctgggcaaccagctgatgcgactcagccttatggaagaggacgaggaagaagagttagaaatccaggatgagtcaaatgaagaacggcaggatacagacatgcaagcaagtagctactcttccaccagtgagcgcgggctggacctcttagattctacagagctggatattgaggatttctgacaggactctgggcccctccccagctccactccctacctcaagaatgtgaccatttggaaaaggcaaagagaaaaggagcaaaatgaagcattcccccaggcttcagccctgggctctgaggggaaagagttgggcattgtttttctaacctaacctttccctctggggtagagaagccgagagaccctgtcctccctaatgcactgtggcccagtccccttgcctttttcctgttctgtttggagtggagaagggcagcacctctgtgtttaatggaaatagcccatagtctcctggatttttggaacatctttctcagcctattttgtgtcctaatgattcgctcaataaacatgtttgaatccacacgttaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 62419 - DNA, 3286 bp, Homo sapiens
gcgtgtcgggcgcggaagggggaggcggcccggggcgcccgcgagtgaggcgcggggcggcgaagggagcgcgggtggcggcacttgctgccgcggccttggatgggctgggcccccctcgccgctccgcctcctccacacgcgcggcggccgcggcgagggggacgcgccgcccggggcccggcaccttcgggaaccccccggcccggagcctgcggcctgcgccgcctcggccgccgggagccccgtggagcccccgccgccgcgccgccccgcggaccggacgctgagggcactcggggcggggcgcgcgctcgggcagacgtttgcggggaggggggcgcctgccgggccccggcgaccaccttgggggtcgcgggccggctcggggggcgcccagtgcgggccctcgcgggcgccgggcagcgaccagccctgagcggagctgttggccgcggcgggaggcctcccggacgcccccagccccccgaacgctcgcccgggccggcgggagtcggcgccccccgggaggtccgctcggtcgtccgcggcggagcgtttgctcctgggacaggcggtgggaccggggcgtcgccggagacgcccccagcgaagttgggctctccaggtgtgggggtcccggggggtagcgacgtcgcggacccggcctgtgggatgggcggcccggagaagactgcgctcggccgtgttcatacttgtccgtgggcctgaggtccccggaggatgacctagcactgaaaagccccggccggcctccccagggtccccgaggacgaagttgaccctgaccgggccgtctcccagttctgaggcccgggtcccactggaactcgcgtctgagccgccgtcccggacccccggtgcccgccggtccgcagaccctgcaccgggcttggactcgcagccgggactgacgtgtagaacaatcgtttctgttggaagaagggtttttcccttccttttggggtttttgttgccttttttttttcttttttctttgtaaaattttggagaagggaagtcggaacacaaggaaggaccgctcacccgcggactcagggctggcggcgggactccaggaccctgggtccagcatggaggtggtggacccgcagcagctgggcatgttcacggagggcgagctgatgtcggtgggtatggacacgttcatccaccgcatcgactccaccgaggtcatctaccagccgcgccgcaagcgggccaagctcatcggcaagtacctgatgggggacctgctgggggaaggctcttacggcaaggtgaaggaggtgctggactcggagacgctgtgcaggagggccgtcaagatcctcaagaagaagaagttgcgaaggatccccaacggggaggccaacgtgaagaaggaaattcaactactgaggaggttacggcacaaaaatgtcatccagctggtggatgtgttatacaacgaagagaagcagaaaatgtatatggtgatggagtactgcgtgtgtggcatgcaggaaatgctggacagcgtgccggagaagcgtttcccagtgtgccaggcccacgggtacttctgtcagctgattgacggcctggagtacctgcatagccagggcattgtgcacaaggacatcaagccggggaacctgctgctcaccaccggtggcaccctcaaaatctccgacctgggcgtggccgaggcactgcacccgttcgcggcggacgacacctgccggaccagccagggctccccggctttccagccgcccgagattgccaacggcctggacaccttctccggcttcaaggtggacatctggtcggctggggtcaccctctacaacatcaccacgggtctgtaccccttcgaaggggacaacatctacaagttgtttgagaacatcgggaaggggagctacgccatcccgggcgactgtggccccccgctctctgacctgctgaaagggatgcttgagtacgaaccggccaagaggttctccatccggcagatccggcagcacagctggttccggaagaaacatcctccggctgaagcaccagtgcccatcccaccgagcccagacaccaaggaccggtggcgcagcatgactgtggtgccgtacttggaggacctgcacggcgcggacgaggacgaggacctcttcgacatcgaggatgacatcatctacactcaggacttcacggtgcccggacaggtcccagaagaggaggccagtcacaatggacagcgccggggcctccccaaggccgtgtgtatgaacggcacagaggcggcgcagctgagcaccaaatccagggcggagggccgggcccccaaccctgcccgcaaggcctgctccgccagcagcaagatccgccggctgtcggcctgcaagcagcagtgaggctggccgcctgcagcccgtgtccaggagccccgccaggtgcccgcgccaggccctcagtcttcctgccggttccgcccgccctcccggagaggtggccgccatgcttctgtgccgaccacgccccaggacctccggagcgccctgcagggccgggcagggggacagcagggaccgggcgcagccctcccccctcggccgcccggcagtgcacgcggcttgttgacttcgcagccccgggcggagccttcccgggcgggcgtgggaggagggaggcggcctccatgcactttatgtggagactactggccccgcccgtggcctcgtgctccgcagggcgcccagcgccgtccggcggccccgccgcagaccagctggcgggtgtggagaccaggctcctgaccccgccatgcatgcagcgccacctggaagccgcgcggccgctttggttttttgtttggttggttccattttctttttttctttttttttttaagaaaaaataaaaggtggatttgagctgtggctgtgaggggtgtttgggagctgctgggtggcaggggggctgtggggtcgggctcacgtcgcggccgcctttgcgctctcgggtcaccctgctttggcggcccggccggagggcaggaccctcacctctcccccaaggccactgcgctcttgggaccccagagaaaacccggagcaagcaggagtgtgcggtcaatatttatatcatccagaaaagaaaaacacgagaaacgccatcgcgggatggtgcagacgcggcggggactcggagggtgccgtgcgggcgaggccgcccaaatttggcaataaataaagcttgggaagcttggacctgaaaaaaaaaa

SEQ ID NO: 62420 - DNA, 1400 bp, Homo sapiens
gctccggctgagggtccgcgggacccagggaacgcggcctggaggacgaggaggactgggttcccggaggcaacaggaccggctcggcatctacagctactggcaggacacgtcctcacagaaaattgaagacttgatggaaatggtgcaaaagctgcagaaagtgggaagcctagagccccgagttgaggtcctgattaaccggattaatgaggtccagcaagcaaaaaagaaagccaataaagacctaggagaggcccggaccatctgtgaggccctgcagaaggaactggactcgctgcatggagagaaagtacacctgaaggagatcttgagcaaaaaacaagagaccctgaggatcctccggctgcattgccaggaaaaggaaagtgaggcacacaggaagcacaccatgttgcaggagtgcaaggagagaatttctgccctgaacttgcagattgaagaagagaagaacaaacagagacagctgaggttggcattcgaggaacagctggaagatctgatgggccagcacaaggacctctgggacttccacatgccagagcggctggcaaaggagatttgtgccctggacagcagcaaggagcagctgctcaaggaagagaagctggtcaaggcgacactggaagacgtgaagcatcagctgtgctccctgtgtggggctgagggcccctccacccttgatgagggactctttctccgcagccaggaggctgcagccacagtgcagctgtttcaggaagagcacaggaaggctgaggagctcctagcagctgctgcccagcgccaccagcagctgcagcagaagtgccaacaacagcagcagaagcggcagaggctgaaggaagagctggaaaagcatggaatgcaagtccctgcccaagcccagagcacacaagaggaagaggctggcccaggagatgtggctcccagaccaggtagaccagtgacatggtggagttgaagagagaggctcactgcagagcactgtttccatggaaaaatggaacatggcaaagtgcagaaattcttcagtcagtccaggacagacgagttctctaagatgcagttaatcatacctgtcttaaacaaactggcaatatactatcaaacatgacttttaaatcaagtggaagttagaaaatatattgaactgagtggcaatgaagacaccacattttaaaactgtaattcagttaagcccacaattagaaggaactttagcttttattggttcaccacaattttttaagaaatcaaccaatgattgttcagttaatgaataaaaggcctttgacacagttcacctattcatgtgaaaaaaaaagactaataaatagtcagcttcccttaaaaaaaaaaaaaaaaaaaaaaaaaaa

SEQ ID NO: 62421 - DNA, 2336 bp, Homo sapiens
ttgaattcgcccctgccaaaaaggtcgtgtgtctcctttgtgtgaggcacagcctgaggtttggggccaggcagatgtgggtttaatttcaggccccacaatgtacgaatttgggaaataatcctcttcaccttctctttcttttaaaacttaattacttaaactaaaaatagggccccatgtttcaaaattaaagaagcaaaagggtatagaaggcaaaatgttttcccaaaaccctgtcccaaacctctcgctggtcacccatctggctccactgcagtccattagatccagaagttgccgccttcacttcccttccttccccctcacccgctactccctctgctcgctaggctcctgccagccatgttcccacctcatgatgggtctttgcactgactacctcccaaccccacccaaattgctgcagggcctgccccccaccacttgatttggggccctcaggtcccttcccatatctcaggagcacttcccactcctttgctctttagcctcccttggcctacttcatttctcttgaacacggttaccgcagccccattcggtatcttattgtgtctgttcccagtcttgcccacccagaacgtgagccccgtgagggccccacagagcacctgcttgcaggaggtactcaatagatctgtgttgcgtgaaagcagcagagacacaaggctggcaaccgccccaactctgcctgccctgtcaactcaacctcctttcctccgtgcagtgggaagcctagagccccgagttgaggtcctgattaaccggattaatgaggtccagcaaggtgagttcaggggccttggctgccagctaggaccagctgcatggtttgcggggctcagtgccaagtgagaatgcagggtcccttgttccaaagttactggttattcacaacagcaacagcagagccttaaattaagtacagggcatttcagcatgcgactgccatagttacatgcccatgatcctggccctgctatcagcagagcctggcaaggagagctggaagcctcgtttcctactctataaaatctaggccactatagatttacctgaaggcaaatgagaaatgtcactgttgggaagagaatagaggctgcactcacacaatgtttttctgctctttggtgaagcaaaaaagaaagccaataaagacctaggagaggcccggaccatctgtgaggccctgcagaaggaactggactcgctgcatggagagaaagtacacctgaaggagatcttgagcaaaaaacaagagaccctgaggatcctccggctgcattgccaggaaaaggaaagtgaggcacacaggaagcacaccatgttgcaggagtgcaaggagagaatttctgccctgaacttgcagattgaagaagagaagaacaaacagagacagctgaggttggcattcgaggaacagctggaagatctgatgggccagcacaaggacctctgggacttccacatgccagagcggctggcaaaggagatttgtgccctggacagcagcaaggagcagctgctcaaggaagagaagctggtcaaggcgacactggaagacgtgaagcatcagctgtgctccctgtgtggggctgagggcccctccacccttgatgagggactctttctccgcagccaggaggctgcagccacagtgcagctgtttcaggaagagcacaggaaggctgaggagctcctagcagctgctgcccagcgccaccagcagctgcagcagaagtgccaacaacagcagcagaagcggcagaggctgaaggaagagctggaaaagcatggaatgcaagtccctgcccaagcccagagcacacaagaggaagaggctggcccaggagatgtggctcccagaccaggtagaccagtgacatggtggagttgaagagagaggctcactgcagagcactgtttccatggaaaaatggaacatggcaaagtgcagaaattcttcagtcagtccaggacagacgagttctctaagatgcagttaatcatacctgtcttaaacaaactggcaatatactatcaaacatgacttttaaatcaagtggaagttagaaaatatattgaactgagtggcaatgaagacaccacattttaaaactgtaattcagttaagcccacaattagaaggaactttagcttttattggttcaccacaattttttaagaaatcaaccaatgattgttcagttaatgaataaaaggcctttgacacagttcacctattcatgtgaaaaaaaaagactaataaatagtcagcttcccttaaaaaaaaaaaaaaaaaaaaaaaaaaa

SEQ ID NO: 62422 - DNA, 1009 bp, Homo sapiens
ggcgaaaggaagggcgggccctcaggtgacgcagattggccctccagagaaggggcggccccttctcaggtgccgtcacccccaaacctcagcactgccattccaggtccttaaaggggagaccgcgattctaagaagcagccaagcccagggctggcctgaagcccccggacggcagtgcccagcaggcagcgcccagcaccctggctcccacctcccagtggccccaaaggaaaacagctgccatgcacatccccaaaagcctccaggagctggccaacagcgaagccgtgcagtttctgagaaggcccaagaccatcacgcgggtcttcgaaggggtcttctccctgatcgtcttctcctccctgctgaccgacggctaccagaacaagatggagtctccgcagctccactgcattctcaacagcaacagcgtggcctgcagctttgccgtgggagccggcttcctggccttcctcagctgcctggccttcctcgtcctggacacacaggagacccgcattgccggcacccgcttcaagacagccttccagctcctggacttcatcctggctgttctctgggcagttgtctggttcatgggtttctgcttcctggccaaccaatggcagcattcgccgcccaaagagttcctcctggggagcagcagtgcccaggcagccatcgccttcaccttcttctccatccttgtctggatattccaggcctacctggcattccaggacctccgaaatgatgctccagtcccttacaagcgcttcctggatgagggtggcatggtgctgaccaccctccccttgccctctgccaacagccctgtgaacatgcccaccactggccccaacagcctgagttatgctagctctgccctgtccccctgtctgaccgctccaaagtccccccggcttgctatgatgcctgacaactaaatatccttatccaaatcaataaagagagaatcctccctccagaagggtttctaaaaaca

SEQ ID NO: 62423 - DNA, 1355 bp, Homo sapiens
ttctcccagctgtctgaaggtgtctgattccattatttgcctgtgatgactttgaaagctaggtaaacctgtaaaatgcaaaagccatcaataagaagcaaattgatgctagagtatctcctccttatttgactgtctcagaactaaatagagaaagcagtgacataaacaaatgtacaccaccttcctgccccatgcctttattgttagtcttcttccccagaggagtcctgatctaattgaagagcgtgaacaacccaacctgtccaaaactttataacttcattattttttaagtaaataattttttattcctaaaatgctagagtctcacctcattatctattttcttcttgcagtgatacaatttcttcttgggattttcacaaatggcatcattgtggtggtgaatggcattgacttgatcaagcacagaaaaatggctccgctggatctccttctttcttgtctggcagtttctagaatttttctgcagttgttcatcttctacgttaatgtgattgttatcttcttcatagaattcatcatgtgttctgcgaattgtgcaattctcttatttataaatgaattggaactttggcttgccacatggctcggcgttttctattgtgccaaggttgccagcgtccgtcacccactcttcatctggttgaagatgaggatatccaagctggtcccatggatgatcctggggtctctgctatatgtatctatgatttgtgttttccatagcaaatatgcagggtttatggtcccatacttcctaaggaaatttttctcccaaaatgccacaattcaaaaagaagatacactggctatacagattttctcttttgttgctgagttctcagtgccattgcttatcttcctttttgctgttttgctcttgattttctctctggggaggcacacccggcaaatgagaaacacagtggccggcagcagggttcctggcaggggtgcacccatcagcgcgttgctgtctatcctgtccttcctgatcctctacttctcccactgcatgataaaagtttttctctcttctctaaagtttcacatcagaaggttcatctttctgttcttcatccttgtgattggtatatacccttctggacactctctcatcttaattttaggaaatcctaaattgaaacaaaatgcaaaaaagttcctcctccacagtaagtgctgtcagtgagagagaagttggatcagttcaaagaacccatgattcaatgatttacccatgcctgccacacttccctcagccagacaaagcagcctgttcataaatatacaacatgtccccttcaggcctgtttatccagcctgag

SEQ ID NO: 62424 - DNA, 2248 bp, Homo sapiens
caaagaatcccttcaccccctccagggatggctctgagctctcgggcgcgtgccttctccgtggaagccttggtggggagacccagcaaaagaaaactccaagacccaatacaggcggagcagcctgagctgcgggagaaaaagggcggagaggaagaggaggagagaaggagcagcgctgcagggaagagcgagccgcttgaaaaacaacctaagacagagccctcaacatctgcttcctctggctgcggcagcgacagcggctacggcaacagctctgaaagtctggaagagaaagatattcaaatggagcttcaaggatctgaactgtggaaaagattccatgacatcgggactgagatgatcattactaaagcgggcaggcggatgttcccctctgttcgggtcaaggtgaaagggttggatccagggaagcagtaccatgtggccatcgatgtggtgccggtggattccaaacgctataggtacgtctatcacagctcacagtggatggtagctgggaatacagaccatttgtgcatcattcctagattctatgttcacccggactcaccctgctcgggagagacctggatgcggcagatcatcagctttgatcgcatgaaactcaccaacaatgagatggatgacaaaggccacatcattctgcaatccatgcataagtacaaaccccgagtgcacgtgatagagcaaggcagcagtgttgacctgtcccagattcagtccttgcccactgaaggtgttaaaacattctcctttaaagaaactgagttcaccacagtaacggcttaccaaaaccaacagattacgaaactaaaaatagaaagaaatccttttgctaaaggatttagagatactggaagaaacaggggtgtattggatgggcttttagagacctacccatggaggccttctttcactctcgattttaaaacctttggcgcagacacacaaagtggaagcagtggctcatctccagtgacctctagtggaggggccccctctcctttgaactccttactttctccactttgcttttcacctatgtttcatttacctacaagctcccttggaatgccctgtccagaggcatacctgcccaatgtcaacctgcctctatgctacaagatttgtccaactaatttttggcaacagcaacctcttgttttaccggctcctgaaagactagcaagcagcaacagttctcagtctttagccccactcatgatggaagtgcctatgttatcttccctgggggtcaccaattcaaaaagcggttcatctgaagactccagtgatcagtatctacaagcacctaattctaccaatcaaatgttatatggattacagtcacctggaaatatttttctgccaaactccatcaccccagaagcacttagttgctcctttcatccttcctatgacttttatagatacaatttctctatgccatctagactgataagtggttccaaccatcttaaagtgaatgacgacagtcaagtttcttttggagaaggcaaatgtaatcatgttcattggtatccagcaattaaccattacctttagtaagacaatagcatttctagaacaattacatgtaaacaaatattttctttatttgtagccaaagaaatttcaacagttattgggcttaaaaagcatcattacaatacagtatttctttgttatacatttaaagatttaaagtgccttatcaaataatattcatgaagagttgtttataatgtcaaatgaaacctacaggaatctctgattacagtggccttgagcttcaaaatgagatatgcaataaatattatttgatgatactccaccagtgaaaattgatgctaagtgatgggattttcaattatactgaagctagttcaccacgttaactgcattttacacattgacaatgacaaaaagaagatggatgtaattctcatgaaagcagtgaagcaatttcagttttaaaaatgaagatcggctttcatgtaattatctagtagttgtagaagaaaatttaattatttgtttgcctcatgcctttatactttgctgttgaagaaactactaatctcaatttaagatacaaataaggacacaaactttcaagtattatattttatttatctttgtagcctaaagaccatttaatcttgaaggaacacaaagatcaaatgaaaagtaaaacactctaaataaatttgcttttattttc

SEQ ID NO: 62425 - DNA, 2377 bp, Homo sapiens
gtcctgtttctctccctgttgtccctgcctctttttccttcccgccgtgccccgcggccgggccggggcagccgggaagcgggtggggtggtgtgttacccagtagctcctgggacatcgctcgggtacgctccacgccgtcgcagccactgctgtggtcgccggtcggccgaggggccgcgatactggttgcccgcggtgtaagcagaattcgacgtgtatcgctgccgtcaagatggaggggcctttgtccgtgttcggtgaccgcagcactggggaaacgatccgctcccaaaacggatgtaaccattactaacgatggtgcaaccatcctgaagttactggaggtagaacatcctgcagctaaagttctttgtgagctggctgatctgcaagacaaagaagttggagatggaactacttcagtggttattattgcagcagaactcctaaaaaatgcagatgaattagtcaaacagaaaattcatcccacatcagttattagtggctatcgacttgcttgcaaggaagcagtgcgttatatcaatgaaaacctaattgttaacacagatgaactgggaagagattgcctgattaatgctgctaagacatccatgtcttccaaaatcattggaataaatggtgatttctttgctaacatggtagtagatgctgtacttgctattaaatacacagacataagaggccagccacgctatccagtcaactctgttaatattttgaaagcccatgggagaagtcaaatggagagtatgctcatcagtggctatgcactcaactgtgtggtgggatcccagggcatgcccaagagaatcgtaaatgcaaaaattgcttgccttgacttcagcctgcaaaaaacaaaaatgaagcttggtgtacaggtggtcattacagaccctgaaaaactggaccaaattagacagagagaatcagatatcaccaaggagagaattcagaagatcctggcaactggtgccaatgttattctaaccactggtggaattgatgatatgtgtctgaagtattttgtggaggctggtgctatggcagttagaagagttttaaaaagggaccttaaacgcattgccaaagcttctggagcaactattctgtcaaccctggccaatttggaaggtgaagaaacttttgaagctgcaatgttgggacaggcagaagaagtggtacaggagagaatttgtgatgatgagctgatcttaatcaaaaatactaaggctcgtacgtctgcatcgattatcttacgtggggcaaatgatttcatgtgtgatgagatggagcgctctttacatgatgcactttgtgtagtgaagagagttttggagtcaaaatctgtggttcccggtgggggtgctgtagaagcagccctttccatataccttgaaaactatgcaaccagcatggggtctcgggaacagcttgcgattgcagagtttgcaagatcacttcttgttattcccaatacactagcagttaatgctgcccaggactccacagatctggttgcaaaattaagagcttttcataatgaggcccaggttaacccagaacgtaaaaatctaaaatggattggtcttgatttgagcaatggtaaacctcgagacaacaaacaagcaggggtgtttgaaccaaccatagttaaagttaagagtttgaaatttgcaacagaagctgcaatcaccattcttcgaattgatgatcttattaaattacatccagaaagtaaagatgataaacatggaagttatgaagatgctgttcactctggagcccttaatgattgatctgatgttccttttatttataacaatgttaaatgcaattgtcttgtaccttgagttgagtattacacattaaagtaaagtacaagctgtaaacttgggtttttgtgatgtaggaaatggtttccatctgtactttggtcctctgatttcacatattgcaacctagtactttattagtttaaaaagaaattgaggttgttcaaagtttaagcaattcattctctctgaacacacattgctattcccatcccacccccaatgcacagggctgcaacaccacgacttctgcccattctctccagtgtgtgtaacagggtcacaagaattcgacagccagatgctccaagagggtggcccaaggctatagcccctccttcaatattgacctaacgggggagaaaagatttagattgtttattcttctgtggacacagtttaaaatcttaaacttgtctttttcctcttaatgtatcagcatgctaccctttcaaactcaaattttcattttaactgcttaggaataaatttacacctttgtgaaaattcaaaaaaaaaaa

SEQ ID NO: 62426 - DNA, 2463 bp, Homo sapiens
gtcctgtttctctccctgttgtccctgcctctttttccttcccgccgtgccccgcggccgggccggggcagccgggaagcgggtggggtggtgtgttacccagtagctcctgggacatcgctcgggtacgctccacgccgtcgcagccactgctgtggtcgccggtcggccgaggggccgcgatactggttgcccgcggtgtaagcagaattcgacgtgtatcgctgccgtcaagatggaggggcctttgtccgtgttcggtgaccgcagcactggggaaacgatccgctcccaaaacgttatggctgcagcttcgattgccaatattgtaaaaagttctcttggtccagttggcttggataaaatgttggtggatgatattggtgatgtaaccattactaacgatggtgcaaccatcctgaagttactggaggtagaacatcctgcagctaaagttctttgtgagctggctgatctgcaagacaaagaagttggagatggaactacttcagtggttattattgcagcagaactcctaaaaaatgcagatgaattagtcaaacagaaaattcatcccacatcagttattagtggctatcgacttgcttgcaaggaagcagtgcgttatatcaatgaaaacctaattgttaacacagatgaactgggaagagattgcctgattaatgctgctaagacatccatgtcttccaaaatcattggaataaatggtgatttctttgctaacatggtagtagatgctgtacttgctattaaatacacagacataagaggccagccacgctatccagtcaactctgttaatattttgaaagcccatgggagaagtcaaatggagagtatgctcatcagtggctatgcactcaactgtgtggtgggatcccagggcatgcccaagagaatcgtaaatgcaaaaattgcttgccttgacttcagcctgcaaaaaacaaaaatgaagcttggtgtacaggtggtcattacagaccctgaaaaactggaccaaattagacagagagaatcagatatcaccaaggagagaattcagaagatcctggcaactggtgccaatgttattctaaccactggtggaattgatgatatgtgtctgaagtattttgtggaggctggtgctatggcagttagaagagttttaaaaagggaccttaaacgcattgccaaagcttctggagcaactattctgtcaaccctggccaatttggaaggtgaagaaacttttgaagctgcaatgttgggacaggcagaagaagtggtacaggagagaatttgtgatgatgagctgatcttaatcaaaaatactaaggctcgtacgtctgcatcgattatcttacgtggggcaaatgatttcatgtgtgatgagatggagcgctctttacatgatgcactttgtgtagtgaagagagttttggagtcaaaatctgtggttcccggtgggggtgctgtagaagcagccctttccatataccttgaaaactatgcaaccagcatggggtctcgggaacagcttgcgattgcagagtttgcaagatcacttcttgttattcccaatacactagcagttaatgctgcccaggactccacagatctggttgcaaaattaagagcttttcataatgaggcccaggttaacccagaacgtaaaaatctaaaatggattggtcttgatttgagcaatggtaaacctcgagacaacaaacaagcaggggtgtttgaaccaaccatagttaaagttaagagtttgaaatttgcaacagaagctgcaatcaccattcttcgaattgatgatcttattaaattacatccagaaagtaaagatgataaacatggaagttatgaagatgctgttcactctggagcccttaatgattgatctgatgttccttttatttataacaatgttaaatgcaattgtcttgtaccttgagttgagtattacacattaaagtaaagtacaagctgtaaacttgggtttttgtgatgtaggaaatggtttccatctgtactttggtcctctgatttcacatattgcaacctagtactttattagtttaaaaagaaattgaggttgttcaaagtttaagcaattcattctctctgaacacacattgctattcccatcccacccccaatgcacagggctgcaacaccacgacttctgcccattctctccagtgtgtgtaacagggtcacaagaattcgacagccagatgctccaagagggtggcccaaggctatagcccctccttcaatattgacctaacgggggagaaaagatttagattgtttattcttctgtggacacagtttaaaatcttaaacttgtctttttcctcttaatgtatcagcatgctaccctttcaaactcaaattttcattttaactgcttaggaataaatttacacctttgtgaaaattcaaaaaaaaaaa

SEQ ID NO: 62427 - DNA, 747 bp, Homo sapiens
acttccgccctcgcgggactggctagggcgtttgaccgccggcggtgaaggggaggcggtgggcgtcttggagaacagagcgagatggagaagcgaggccgaggcgtgaagtcgagccccatccagaccccgaaccagacccctcagcaggctccggtgacgcctaggaaagaaaggaggcctagcatgttcgagaaggaggcatatacacagattttaagagaaagactgagagagtcaattcacaatgttcagtatgtggagcctccttttgatgactcaattgctgatataggtaaagaatggaagagtgccctggcaaaattaaagtttgctaattcatatagaatggagccattgaagaaattccaagctcattcagtagaaactaaagtccagcagatactaacagaaagtcttaaagatgtcaaatatgatgataaagtattctctcacttgtcacttgaattggcagaccgcatactgttagcagtcaaagaatttgggtaccaccgttataagttcattataaaagtattatttattcaaaagactggccaagcaataaatattgccagcagatggatctgggacattgcatgggacagctgggtcgcagctaaacacgaagcagaatcctacgtggcactggtcttggtgtttgccctttattatgaatagctcattacaggtactaaggattgtttacttccgaacttttcaaaaataaatgaaatttacatattt

SEQ ID NO: 62428 - DNA, 2792 bp, Homo sapiens
gtaatactgcaaaaataacaatcaaagacgtgcgtaaaataaaggatgagtttctgaatgccccagagaaggcaattaaatgtaagttggcctatattgaaccatataaaaggacaatgcagtggtccaaagaagctaaagaaaaatttgaagaaaaggctcaagataaatttatgacatgttcagttatcaaaattctggaagataatgtgctcttagttgagcttttcgattctcttggtgctcctgaaatgactactactagtattaatgaccagctagttaaagagggcctagcatcttatgaaataggatacatcctcaaagataattctcaaaagcatattgaagtttgggatccttctccagaagaaattatttcaaatgaagtacacaacttaaatcctgtgtctgcaaaatctctacctaatgagaattttcagtcactttataataaggaattgcctgtgcatatctgtaatgtaatatctcctgagaagatttatgttcagtggttgttaactgaaaacttacttaatagtttagaagaaaagatgatagctgcttatgaaaactcaaaatgggaacctgttaaatgggaaaatgatatgcactgtgctgttaagatccaagataaaaatcagtggcgaagaggccagatcatcagaatggttacagacacattggtagaggtcttgctgtatgatgtgggtgttgaactagtagtgaatgttgactgtttaagaaaacttgaagaaaatctaaagacgatgggaagactctctttggaatgttctctggttgacataagaccagctggtgggagtgacaagtggacagcaacagcttgtgactgtctttcattgtacctgactggagctgtagcaactataatcttacaggtggatagtgaggaaaacaacacaacatggccattacctgtgaaaattttctgcagagatgaaaaaggagagcgtgttgatgtttctaaatatttgattaaaaagggtttggctttgagagaaaggagaattaataacttagataacagccattcattatctgagaagtctctggaagtccccctggaacaggaagattcagtagttactaactgtattaaaactaactttgaccctgacaagaaaactgctgacataatcagtgaacagaaagtgtctgaatttcaggagaaaattctagaaccaagaaccactagagggtataagccaccagctattcctaacatgaacgtatttgaggcaacagtcagctgtgttggtgatgatggaactatatttgtagtacctaaactatcagaatttgagctaataaaaatgacaaatgaaattcaaagtaatttaaaatgccttggtcttttggagccttatttctggaaaaaaggagaagcatgtgcagtaagaggatccgatactctgtggtatcgtggcaaggtgatggaggttgtaggtggcgctgtcagagtacaatatttagatcatggattcactgaaaagattccgcagtgccatctttaccctattttgctgtatcctgatataccccagttttgtattccttgtcagctccataataccacacctgttgggaatgtctggcaaccagatgcaatagaagttcttcaacaactgctttcaaagagacaggagttacctaaaaatccatgggagaaattgtctattcacctctattttgatggaatgtcactttcttattttatggcatactataaatactgtacttctgaacatactgaggagatgttgaaagaaaaaccaagatcagatcatgataaaaagtatgaagagaaacaatgggaaataaggtttgaggaattgctttcggctgaaacagacactcctcttttaccaccatatttgtcttcatctctgccttccccaggagaactctatgctgttcaagttaagcacgttgtctcacctaatgaagtgtatatttgccttgattctatagaaacttctaaccagtctaaccagcatagtgacacagatgatagtggagtcagcggggaatcagaatccgagagccttgatgaagcactgcagagggttaataagaaggtagaggcgcttcctcctctgacggattttagaacagaaatgccttgccttgcagaatatgatgatggcttatggtatagagcgaagattgttgccattaaagaatttaatcctttatctatcttagtacaatttgttgattatggatcaactgcaaagctgacattaaacagactgtgccaaattccttctcatcttatgcggtatccagctcgagccataaaggttctcttggcagggtttaaacctcccttaagggatctaggggagacaagaataccatattgtcccaaatggagcatggaggcactgtgggctatgatagactgtcttcaaggaaaacaactctatgctgtgtccatggctccagcaccagaacagatagtgacattatatgacgatgaacagcatccagttcatatgccgttggtagaaatggggcttgcagataaagatgaataagtgcctaagtgtatacagtgagagcatctatagaagcctagaagaattctgttatgtttagactatgtcttatctttagactatttcaggcttaattttcctaacttgttcagcactagtgctttacctctcatttttaattgaactgttaggaattgtgtggggaaaaaaagtaaataaatgttcgcttccaaaaaaaaaaaaaaaaaaaaaaaaaaaaaaaaaaaa

SEQ ID NO: 62429 - DNA, 3516 bp, Homo sapiens
aatctctactcggcccgcaccagcagcgctggcgtcagggcgcggtgggggcaagacgggtgactggcagcagggcggtgccgggccgagaagggcgcctcacctggcgcctcctgccttcctttccacctcaggttgcagagagccgccagggcaggtggaagggccacgccccgctcccgtgagggtcaccgagagacgttgggggtggggcagggaccccaaccctagaccagtcctgtagggcacaatgtctgaacaagagcgtatacaggaatgtctgcggaaggaaataaggtcacttctcatttccaccaaagatggtttgagcccacaggagttggagaaggagtaccttttgatggttggcaaccatctaccactccgaatccttgggtatcggtccactatggagctggtattggacatgcctgatgttgttcgtgtctgccccggtgcaggtggtactgtaatactgaaagccattccagatgaatctaccaaaggaatagcaagcttagttgcaaaacagaggagcagccataagcttcgaaactcaatgcataagggaagacctagtatttattctggaccgagatctcatcggcgagtaccttaccgaggaagggttgcccctattcttccagctgttgtgaagagtgagttgaaggacctgttggcgttatctcctgttcttctttctgattttgaaaaggcatttgccaaaagatttggacgatcattccaatacatgcaatatggatttctctctatgtttgaagtgcttaatgcggcttcagatgtcatttctgtagagcagaccagagcaggttctttgttgatgctaaagaagagtgtaacagaggaaaagccgagaggatgtccagcaggtaaaatttttacccagccatttagaatgaaacaagggtcatactccacaggctttccggtagcaaagccatgcttttcacaacccacttcaaacatggaaccaccgaagcaaataatgagcatggaaaagacttccaagttaaatgtagtggagacttcaagactgaatcacactgaaaaattaaaccagctggagaacacattcaaatcagttattgcacagattggacctggaggaactatcagttcagaactaaaacataagataaaatttgttgtatctaagttcccagagggtttgtttatttctaaactgcttggagagtatgaggtaatttttaaagagcaactatcaccaaaaaaattaggcttcttaaatgtgacagaacttgttggagctcttagtgacattctccatgttgagttcaggaaaggacaccaagacttactagtgtttgatgcggataagaagcctctaccacctgttcagtcagataagaaaatagaagccaaagcttgtgtctccagtccacctagaaattcattgtctactgctgctgtcaaagagactgtatggaattgcccttcaaaaaaacaaaaagagccacaacagaagatttgcaagaagcctaatctggtggtaaagcctttacagctgcaagtagaaacaaacaaatcagagctcaacttggcaatggcaaatcatgacatcccgccagatgctgtgccgaacaagaaattatgcagactcccaccattagacaccagttccctcataggggtctttgtggagtatatcatctctcctagtcaattctacatccggatctatagcagggattcgtcagagttactcgaagacatgatgattgaaatgcggcgctgttattctaatcagctggtttctgatcgatatgtcatgccagaatgttttattcagccgggacatctctgttgtgtaaggatttctgaggataagtggtggtatcgggtcattatccatcgagtccttgagaaacaggaagttgaagtgttctacccagactttggaaatattggaattgttcagaagtcctccctgaggttcctcaagtgctgctacacaaagcttccagctcaggctatcccttgttctttggcttgggtgagaccagtagaggaacactggacatcgaaagctattttgcagttccagaagttgtgcggtttgaagccattagtgggggtagtggatgaatatgtagatggaatccttaacatttttttgtgtgacacatcctcaaacgaagatgtctatttccatcatgtcttgagaacagagggccatgctattgtatgccgagaaaatatctcttctaagggtttcagtgagctcaaccctttagctttatacacgacatccagtggagggccagaggacattgtcttgacagaactgggttatccttcccagcagcactattttaatgaagaccgaaagataagtccacagtcaaaagagagtgagttacgtatcttggatgagatccccactggaatgccatgcctggagtcagtgaccataggtgatgatatttgggatgagaactggttacctctacaggctaagatgggaaaaggaggtgatgctgcctcccatctatttactgcaagccttggtggaaagaatcagtattcatcatgtaaagaaatgccacagaaggactggtgtttttctacccctaaagatacatgggatgattcttggcagccttcaggccttgtaaatggaacgaaagtagaagtccataagccagaagtactgggtgctcaggaaaaaaatactggcacaaacaggactcaaaagcaactagacataaatggttcttcagattcttccacactgcccaaattggaagaattctgtacctctcttacccagtcagagcagtcagcagacgggagccagtctgaacccaacaacagtcagactcagccaaagcaaattcagctttccacagcagcaccctgttcaacaactgcagtggatgattccgcagaaaagccctctggttctgtggaaagctcaccagagatcctaaagaatgaagatttttctagcagccgtgctattacattgtacaaagacaagcgtcaagaatctgtagaccagctgtctttgattttgtcttatgagtgccagatttctcagaagctctacattcctcgaagtacagccactgctgccttaggtgctgccgcacggttagctacatccaggagcctcctacactggtaccccagtgtgaaaaggatggaagcatgagggagggagggaggagggagaaaaacagaatccagccgcttaggctttgatgaactcccaggccaaaatgaggagttattgaagcaaaatagtatcttgatcattgatacttttgtctttctgtgactatatgttagctttattatgctaacagtctactttgatgtgtaagtaagtattgatatttactgttaatcttgatttttcttgattttattctgtgtcattttgttcacctttgtttttaatgtagtttaaaggaatttgtttttttgtgtttgtttttcttgtacattatcatgactgataaatgaaaattg

SEQ ID NO: 62430 - DNA, 1536 bp, Homo sapiens
tggttgcctagcaaccggtggtgccaaacactggagctcagagcggggggcgcggagagcgaagcgggaaaggaggtggtgtctgtgaacaggcctaggggtttctgacccttctggtttctgtgccatggccacgctgagcgtcaagccaagtcggcgcttccagctgcccgactggcacactaacagctacctgctatccaccaatgcccagctgcagcgagatgcttcccatcagatccgccaggaggcccgggtgctccgcaacgagaccaacaaccagaccatttgggatgaacatgacaacaggactcgactggtggagaggattgatactgtcaaccggtggaaggagatgctggacaagtgtctgacagatttagatgccgagatcgatgccctgacacagatgaaggagtcagcagagcaaaacctgcaggccaagaacctgcctctggatgtggccattgagtgcctgaccctgcgggaaagccggcgagacattgatgtggtgaaggaccctgtggaggatgagctgcataaagaggtggaggtcatcgaggccaccaagaaggccttgcaacagaaggtcagccaggccttcgagcagctctgcctcttgcaggaagtccaacagcagctcaactccgaccatcggggcaaaatggagacactagagatcgacagaggctgtctctctctcaacctcagatccccaaacatctcgctgaaggttgaccccacacgtgtacctgatggctccaccacactccagcagtgggatgacttcagtcggttcaacaaggaccgagcggaggctgagatgaaggcagccacagagctgagggaggccactgctctaactattgctgagaccaacaacgagcttgaagcccagagagttgcaacggaatttgccttcaggaagcggctgcgggagatggagaaagtgtacagtgagctcaagtggcaagagaagaataccttggaggagatcgctgagctgcaggaggacatccggcacctggaggaggatctgcgcacaaagctcctgagcctgaagctgtcccatacccggctagaggccagaacctaccggcccaacgtggaactctgccgggaccaggcacagtacggcctcaccgacgaggttcaccagctagaggcaaccatcgctgccctgaagcagaagctggcgcaagcacaggacgcactggacgccctgtgcaagcacctggcccggctgcaggctgacattgcctgcaaggccaactccatgctgctggacaccaagtgcatggacacacggcgcaagctgaccgtgcctgctgagaggttcgtgcctgaggtggacaccttcacacgtaccacaaatagcaccctgagtccactcaaaagctgccagctggagctggcctagccttggaggactgcaggaggagggcagggttgggtgggcaatggaaggagggaggagagaaatgaatggaataaatgcagaggatctcaaaaaaaaaaaaaaaaaaaaaaaaaaaa

SEQ ID NO: 62431 - DNA, 1707 bp, Homo sapiens
gtggtaggctgcgaccccttcctcccacagccccttcccgcccctcgccgggcatccgccgacaggacaggagagatttacaaatagtgttttggcatcatggaacgtgtaggttgtactttaacgacaacttacgcccaccctagaccaacaccaaccaactttctaccagccatcagtaccatggcctcaagctacagggaccgctttccccactccaatttgacccatagcctgagccttccttggagacccagcacatactacaaagtcgcctccaattccccaagcgtggccccgtactgcaccagatcacagagggtgtccgagaataccatgcttccctttgtttccaacagaaccactttcttcacaagatacacaccggatgactggtacaggtccaatttaaccaactatcaagagtccaacacttcccgacataattcggagaaactaagagtggatacatctcgcctgattcaagacaaatatcaacaaacaagaaaaactcaggcagacacaacccaaaatctgggagaacgtgtcaatgacatagggttttggaaatctgaaatcattcatgagttggatgaaatgattggagagacaaatgcacttactgatgtgaagaaaagactggagcgggctttgatggagactgaagcccctcttcaggtagcccgagaatgtctatttcatcgagaaaagagaatgggaatcgacctagttcacgatgaagttgaagcacaactgctgacggaagttgatactattctgtgttgtcaagaaagaatgaagctacatttggataaggctattgcccaacttgcagccaacagagcgtcccagcatgagctggaaaaggacctgagtgacaaacagacggcttaccggatcgacgacaaatgccaccacctgcgcaacacatcagacggtgtcggctacttccgcggagtggagagggtcgatgcaactgtctcagtgcctgagtcctgggccaaatttacagatgacaatattctccgctcccagagtgaacgggcagcttccgctaagctaagagacgacattgaaaacctcttggttgtgactgccaatgagatgtggaatcaattcaacaaagtgaacttgtctttcaccaatcgcattgctgagactgcagatgctaagaataagattcagacgcacttagcaaagaccctgcaggagattttccagactgaaatgaccatagaatccatcaagaaggccatcaaggacaagactgccttcctgaaggtggctcagaccagactggatgagcgcacaagacggccgaacattgagttgtgccgagacatggctcagctacgccttgttaacgaggtacacgaggttgacgacaccatccagaccctgcagcagcgcctgagggatgcagaggacaccctgcagtcgctggtccacatcaaagccacactcgagtatgacctggctgtcaaagccaattccctgtacatcgaccaggaaaaatgcatgagcatgcgcaagagctaccccaacaccctccggctggtcggcttctgctagggaccccaccgggtgtggttttgatacccctaagttaaggctgagccagagcactgtctcagcatttgaaccgaatgctaatatagtcacttattaaaggattatgctgatggaaatgtaccaaaaaaaaaaaaa

SEQ ID NO: 62432 - DNA, 1605 bp, Homo sapiens
atttaggatgaactatgtgtgacaaatggtgccgttgagtcctctcaactgggaacgagtcaccgtgtatctggagaccatgtgtgtaacgggttgcacctgcttggctggatacaaagaaccatccatcccatcagggaaatatgcaacatgcttcaaagaataagaagagaactttgggccagtagagacggggtttcaccgtgttagccaggatggtctcgatctcctgacctcgtgatccgcctgccttggcctcccaaagtgctgggattacagggcactgaatgtcaaagtgaaggaattcaatgaagcccggatcaagggcaggagcaaccgtgaccctcttaaaagagccaatgccccatgtaattagtgacgcgcgcgaatggatagacgctattcccaccgtccctacatagcatccagcgacaccacagccaagggacaggcttggcggaactgcgggagagaagaaccctctgagcctgattgaaaggcggtgaagagacaggagagggggatcggtgggcggtcccgcctccatcttcagttcccgcatgggggcgaggcagatccagaccagctcctcccagacctctccagaagaagccatgggaacccctcgtatccagcatttgctgatcctcctggtcctaggagcctccctcctgacctcgggcctagagctgtattgtcaaaagggtctgtccatgactgtggaagcagatccagccaatatgtttaactggaccacagaggaagtggagacttgtgacaaaggggcactttgccaggaaaccatactaataattaaagcagggactgagacagccattttggccacgaagggctgcatcccggaaggggaggaggccataacaattgtccagcactcttcacctcccggcctgatcgtgacctcctacagtaactactgtgaggattccttctgtaatgacaaagacagcctgtctcagttttgggagttcagtgagaccacagcttccactgtgtcaacaaccctccattgtccaacctgtgtggctttggggacctgtttcagtgctccttctcttccctatcccaatggtacaactcgatgctatcaaggaaaacttgagatcactggaggtggcattgagtcgtctgtggaggtcaaaggctgtacagccatgattggctgcaggctgatgtctggaatcttagcagtaggacccatgtttgtgagggaagcgtgcccacatcagctgctcactcaacctcgaaagactgaaaatggggccacctgtcttcccattcctgtttgggggttacagctactgctgccattgctgctgccatcatttattcacttttcctaagaaggcacttctgggcctgggtctgaggacatcttttttgactgggagccttcttactgttgaggttcaacaagctgaggagtagatgggaatttgagggagaatacagagatactatgaacgtatttgacatttttaatacaatttctgctataatttttgtatgcagtaggcgttactaataaacatttctgctgtgaaaaaaaaaaaaaaaaaaaaaaaaaaaaaaaaaaaaaaaaaa

SEQ ID NO: 62433 - DNA, 10155 bp, Homo sapiens
atgcccagtgatgccaaagacagtgttaatggtgaccttttgttaaattggacaagtcttaaaaatattttaagtggtcttaatgcttcttttcctcttcacaacaatactggctcaagcacagtcactacttcaaaatccatcaaagacccaagactgatgaggagagaagaaagtatgggagaacagagtagtactgcaggcttaaatgaggttttgcaatttgagaagagttcagataatgttaattcagaaataaaatcgacaccatctaattctgcctcctcctcagaagttgtccctggtgatcgtgctgttcttactaatggtttggataccccttgctttaaaacttctgttaatgattcacaatcttgggctcacaacatgggctctgaggactatgactgtatacctcccaataaagttaccatggcagggcaatgtaaggaccaaggtaatttttccttcccaatttctgtgtcaaatgtagtgtcagaggttgagaaccaaaaccacagtgaggagaaggctcagagagcccaacaggagtccggtaatgcttatacaaaagagtacagtagtcacatttttcaggactcgcagtcttctgatttaaaaacaatttatcagactggttgccaaacgtctacagtttttccactcaaaaagaaagtaagcattgatgaataccttcaaaatactggaaagatgaaaaacttcgctgacctggaagacagttccaaacatgaagaaaagcaaacttcatggaaagaaattgataatgatttcactaatgaaacaaaaatcagtccaatagataattacattgttttgcaccaagaatacaaagagagtgagagtcataattcttttgggaaaagctgtgataaaatattaattactcaagagttagaaataacaaaatcttctacatctaccataaaggataaggatgaactagatcatctagcattggaatggcaaattactccaagttttgagagcctgtcacaaaagcatcctcagcactctgtggagtatgagggtaacattcatacaagtttagccattgctcaaaagctaatggaactgaaattggggaaaataaatcaaaattatgctagcattataactgaagctttcccgaaaccaaaagacataccccaggccaaagaaatgttcattgatacagttatttcatcttataacatagaaacagctcatgacagttcaaattgcagcataactagagaacatatatgtgtccataggaaaaatgaaaatgaaccagtgtcattagagaacattcagagagactataaagaaactgcttatgttgaagataggggtcaggatcacaatctgttctgtaattcacagttaagcaatgatatatggctgaatgttaatttcaaaaaacaaacagatagagaaaaccaaaatgaggctaaagagaatagtgcttcatgtgtagaaaacaacatagagaacatatatggagacaaaaagcaggattctcatacaaacgaaaatttcagcaatatagatgaaaaggaggacaaaaattaccacaatatagaaattttgagttctgaagaattttctactaaatttaacttgatttgcagagaagataatgcagtgtcagcagcaactgcattattagagagtgaagaagataccattagtgccgtgaaacaaaaagatactgaaaatactggaagaagtgtagagcatttggcttccacgacatttcccaaaactgcaagttcttcagtgtgtgtagcctcaaatgctgcaatacagatagctagtgctactatgcctgcattaagcctaaataatgacgatcaccagatataccagtttaaagaaacttgttcttctgaaagtccagattttggtttgttagtaaaacatagggtttctgattgtgaaattgatacggataaaaataaatcacaagaatcatttcatcaatcaataaatgagaacttagttcttcagagcattgaattggaaagtgaaattgaaatagaattagaagattgtgatgatgcttttatatttcaacaagatacacatagccatgaaaacatgctttgtgaagaatttgtgacctcatataaggctctgaagtctcgtatcagttgggaaggtctgttagcacttgataacggggagatggaagttttggaaagcaccacaggaagggagaatagtgatcagcattattctaaggaaagtaactatttttattcctctacacaaaacaatgaaacagaacttaccagcccaattttacttccagatctacaaattaaaattactaatatatttaggccaggattcagcccgacagctgactcccttgcattgaaagatagtttttgcacacatgtaactgaagccacaaaaccggaaataaataaggaagatggagaaattctaggatttgacatttattcccagccttttggtgaaaatgcagattatccatgtgaagataaagttgataatataaggcaagaatcagggccagtgagtaactctgaaatctccctttcttttgacttgagtcgtaatacagatgtgaatcatacgtctgaaaatcagaacagtgaatctttgtttactgaaccttctaatgtcacaacaatagatgatggaagcagatgtttctttacaaaatcaaaaactgactataatgataccaaaaataaaaaggaggtagaatcaagaattagcaaaaggaagctacatatatcttccagggatcagaacataccacataaagatttaagacgacataaaatttatgggagaaagaggaggctaaccagtcaagactcatctgagtgtttctcttcattatcccaaggacgaattaaaacattttcacagtcagaaaagcacattaagagtgtcctaaatatcctaagtgatgaagcatctttatgtaaaagcaaatgtctttccagaaaactagacaaagcagttgttcacttaaaaaaagctcatagaagagttcacacatctttgcagcttataactaaagtaggagaagaaagaaagggcccattaccaaaatcatatgcagtaatatgcaataatttctgggaaagttgtgaccttcaaggttatagttctgtgtctcaaagaaaatattattctactaagcatttttcgtcaaaaagaaaatatgacaaacggagaaagaaaagagctccaaaagctgatatttctaaatcattaacccatgtgtcaaagcacaagtcttataaaacaagtggagagaaaaaatgcctttctaggaaaagtatggctagcagtgtctcaaaaagtcaccccaccaccagtcacatgggagaattttgtaatcaagaacatcctgaatcacagttgcctgtatcctccacatcccaaagtacaagtcagtcagtttattataatagcagtgtaagcaatccaagtttatcagaagaacatcagcccttttctggaaaaactgcatatctgttttccccagaccactcagatgagaaactaatagaaaaagaaaatcaaattgatacagcatttttatctagcactagtaaatatgaaaagcttgaaaaacattcagcaaatcataatgttaaagatgcaactaaagaaaacagttgtgacgctaatgaagtaataaatgaaagtaattctgtatctttaagttgcataaaagaaaacataaattctagtacaggcaacgattgtgatgcaacttgcataggtcacacaaaggcgaaaactgacgtacttatatcagtcttagattcaaatgtgaagcactttttaaatgatctctaccaacaaggtaaccttattttatctgattgtaaaagaaacctggaagtaaagtggacagatcctattgagagacccaaacaaagcattattacaggaaacttccttatgggcccattaaacctaactttgatagcaagtaaaaagtacagtattcctcaggtatcagccgctgcagtgacagatagtgagggagaatcttcaaaatcttacttggataagcagagaattcttactgtagattcttttgcagcatccagtactgtaccacactgtgagcagagctgtagagaaaaagagcttctaaagacagaacagtgctcttcaggtaattgcctccatacagatgggaatgaaacaaatgtcactgagaattatgagttggatgtagcatcaggaactgaagaagataaaagttatggggaaaatatagtggaattatcttccagtgatagttctctgcttttaagagataatgtaaaaggctcctcttcagaaacatgtattgtgaagaaagacactgaggacagaataacgtggaaagttaaacaagcggaaaaagcaaaagattctgtttacaaaagaagcatgactgaaggatcaactgttaatactgagtacaaaaatcaaaagaatcagatctcagaagaatcctgcttaaatgagaaaattattacaactaacttgattgattcccatctgagcactaaaaatactaccactgagtcagtccctttgaagaacacagtttctaatccgcttaacaaaagagagaagaagggggaaattaaagttagtaaagactcgcagtctgacttgacattacattcagaaatagcctatatttccaaaccaggaattctaggagttaatcatacgcctattttacctgcccactctgaaacctgtaaagtccctactcttctgaagaaacctgcgtcatacgtgagtgattttaaagaaaaacattgctcagctaatcatacggcccttatagctaatctatctcaaattttgcagagggcagatgaagcatcatctttgcagattctacaggaagaaactaaggtttgtctaaatattctccctttatttgtggaagcttttgaaagaaagcaagaatgttcagttgaacaaatcctgatttcaagagaactgttggtagaccaaaacctgtggaataattgcaaacacacattaaaaccatgtgctgttgacactttggtagaacttcaaatgatgatggaaacaattcaattcattgaaaacaaaaaaaggcacttagaaggtgaaccaacattgcgaagcttgctttggtatgatgaaacactgtatgctgagcttcttggaaaaccacgtggatttcaacagcagtctaatttctatcctggtttccaaggaagattaaaatataatgcattctgtgagttacagacttaccatgatcaattagttgaattgcttgaagaaacaaaaagggaaaagaattcatactatgtattcttaaagtacaaacgacaggttaatgaatgtgaagccataatggagcattgttccgattgctttgatttttctctttctgttccatttacctgtggagttaactttggagatagtttagaagacctggaaatcttaagaaaaagtactttaaagttgatcaatgtatgtggggactctcctaaagttcattcgtatccaggaaaacaggaccatctgtggattatcatagaaatgatctcctcaaaggttaattttattaagaacaacgaggcagtacgtgttaaaatatctctttatggtctggaacatatcttttttgatgctgcaaaaaatcttgtttggaaagagagaacacaatccttcagcaaaaaatactcacaaaagaaggacgaagaaaggctactcagagtgaataaatgtgccttttctaagttgcagaagatatatgatactttgtctaaagatttaaacaatgaaccaatttcccctattgggcttgaggaggatactataattgcttccagaaagtcagatcatccaataaacgaagcaacaattagcatagaaaattctaaatttaacagtaatttgcttgcacacccagatatttgttgtattagtgagatattggatcaggctgaatttgcagaccttaaaaaattacaggatctcaccttgagatgtacagatcacttagaaattttaaaaaaatactttcagatgctacaagataataacatggataatatttttatcacagaagaaaatgttttagacgtggtgataaaccacagccatgaggctatcattttaaagcctgaagctattgaaatgtatattgaaatcgtcatggtctcagaaacaattcactttcttaaaaactcaatagcaaagaaactagacaaacagaggtttcgaggtatgctttggtttgatttgtcacttcttcctgagctggttcagtgccaagaaaaaatggcttctttttcatttcttaaagataactcaacagatgtttgcctttggaaagtgatagagactgctgtttccgaacttaagaaagatctggatattatctgcaaatataatgaagctgttaattgctcatatgctattcatttgctctcaagagaacttcaagaactttcagaaataaaaaagcttctgaagaagtccaagtattttatttccacatatattgactttgtgccatatatagcatccataaattatggaagcactgtgacagagttagaatacaactacaatcaattttctacactgctgaagaatgtaatgtctgcccctaggaaagatttaggaaaaatggcccacattaggaaagtcatgaaaacgattgaacatatgaagatgatatgtactaaaaatgctgaactaaccatttcctttttcctatgccaaatgctgtataacagaaggaagattttacagctgaagagaaaagaaaaaatgaatattcatattgtaaaacctggggaaaataacaataaatttagtatttctacgatgttgcccccagtatcagagtgcataaacaaaaacatctcaaattcctctaaaaaacgaccgagcactgtagacaaatgtgaagactctcaggaacaacagcaagatactactgtttccagttgtaaaaagctaaaggtagacatgaaagatgtcacaaaaatcaacagagaaaaggcaacattcaagcatccaaggactacaggatctcatcccaaaagcgaaaacaaaatagtaccaagttcatgtgacagtctgaaaagaaatcatttaacgccaaaaaaggttgaaatgcaaagatcactacctggctcacttttacccttagagaacccaaaagacacttgcgcatcaaagtcggaaagcaaaatagacttaactgtttcatctgatcacttcagtggacaacaggaaaatttaaatagcatgaagaaaagaaatgtgaacttcagtgctgctgaaacaaaaagtgataagaaagattgtgctgcttttgcaatttgtgaccaaaaaagtgtacatggcacattttcaccagaccatgggacgcttttgcagaaatttcttaaaaattccccagatcccacccaaaaatcctgcctttctgatataaacccagaaactgatgtttctcttgtgcctgatgcgtcggtgctctcaaagccaattttctgttttgtgaaagatgtccatcctgatctagaaatgaatgacacagtctttgaacttcaagataatgatatagtaaattcatctattaaaaattcctcatgcatgacttctccagaacccatctgtatccagaacaaaattcctactctgcagataaacaaactacagcctacagaaactgagtcagaggacaaatacatgaaggatacattgaatcccaatactgtgcatacttttggagcatctgggcatataacccttaatgtgaatcaaggagcagagtactctctttctgaacaacagaatgacaaaaattcaaaagtcctaatgcagaatgctgccacatattggaatgaacttccacagtctgcatgtaacccaacatataattcttctgagcatttatttggaacttcatatccatactctgcttggtgtgtttatcagtacagcaacagcaatggcaatgccattacccagacataccaagggataacatcatatgaagtacagccatctccttctgggctgttgaccacagttgcaagtactgcccagggcacacattctaatcttctgtactctcaatattttacttattttgcgggggagccacaagcaaatggctttgtgccagtgaatgggtattttcaatctcaaatacctgcttctaattttcggcagccaattttttcacaatatgcttctcatcagccattaccacaagctacatacccttaccttcctaatcgatttgtgcctccagaagttccttgggtttatgctccatggcaccaagaatcctttcatccaggacactgaaaatagtcttctgtctattgaaataagacataacaagtttttccaaatattttttacttatatattttttaacatttagcgatttttaatgtttgtaaatgtggtaggaaatataaatcatatggtcctttgtaaaatatacaaataatctaacacatatcatataggacatcaatttctaacatctgatataccagaattatttccatgcaattataaggggagggtaatatgatcaaagttaagcaatagtggtaaaatctttaaaactagattcttgcttctgatatgtttcaatacattgttgatggcattgtgccatttgagctgaaagcaggattttttttcattagtcatcaaaccaagaattttataattcttgacactttattatataatttacaattctatgccagatatggcaaatttcttcaatttcagtattttatagtttctacttgtaaaatatttttaataagaaaaattggtttgcataatctcagtgtttccttgagtagagatgttttaaatgtttatgttggaagcaattgtagttaattatattggcaatgaagcactttcaatgcctttttctacaagagccatttccagaagattattttgtttttggatttcacaatttaaatagttattttaatgattttctagcaaataatagagaataatgtttatgcttatgcagttagtctttattacagtaatttaaacaatgtggcacaaacatagttttttcatgctcttgtcatagacttttctttttaaccttctgcaaaagtaaaaactctcttagtaataatcatcatagggcaacaggatatagtatgtaactgcagtcttgagctgtctcttttcatgtattacctttcttgctcaacagctattcctgttttctgtaagatcctagtcagacagagccctcacaactggatagacctttctcaagggttagccctaaaatgtgacaagagaattggtttggctgaatcacaacaaataactagcaaagcttcagtgcttttgcaaactttttatgtaagcaaactttttgtgttatctggcacaggcctttgaaaagactataattctactttgtttaatgtagagtaactaatttttcaatttagaaagacagtgagaatccccaggataagcctctttatactcacttaaaccaactgggatggaattcagaatacctaagctgcttctttaacatagagatctttaaaaagggaaggtcaagcaaagaactgtaaccgaaagaagtaagagatttgaaaagacgatagagttaaaacaatatttaaaaaacatttctatttggtccatgcagttttatttgaaaatagtctgtcaaaatcagaactcctgaacaactttgaaagcagtaatattaactggtattcaaaaatgaataacagccaaaaatgaataacagccatttgatttatgtttccctcagtcatttggtttatgtttggttatggcaagatgttacagcatttatagttaatactactactaatatgtaaaccaaaagttaaatattctagttaaggattgtttctttaaacaactttcagattctgttgacattgtctttgtggtatttttatttcatgggttttaatttctcttaaagacttacctaaatattcagttacatttttaaaaaatctgtacgtgacagaatattaaaacatggaatatttttgcttcaaaaaaaaaaaaaaaaaaaaaaaaaaaaaaaaaaaaaaaaaaaaa

SEQ ID NO: 62434 - DNA, 4199 bp, Homo sapiens
ggagggcagtcggcggctctcgcgccccggccactttccctgcgcgattcccggagctccctgcaggaggtgagagtccccagcgggtccggatggcgtagttttgccgcggcgcagcagctgccggagctcgccgccgccgagcgctgggcggggaaacttgccgccgctttcctccaacttgctgcgggtggatctccgctggacacaccgcctccgaggcagtttgaaaattgcaaggagggactttaagactacttctgatttgcaaagattgtctgtgctctgagcaggctgaagtgactggacgagacgcactgttggagaaataaaaatgacttcccattatgtgattgccatctttgccctgatgagctcctgtttagccactgcaggtccagagcctggtgcactgtgtgaactgtcacctgtcagtgcctcccatcctgtccaggccttgatggagagcttcactgttttgtcaggctgtgccagcagaggcacaactgggctgccacaggaggtgcatgtcctgaatctccgcactgcgggccaggggcctggccagctacagagagaggtcacacttcacctgaatcccatctcctcagtccacatccaccacaagtctgttgtgttcctgctcaactccccacaccccctggtgtggcatctgaagacagagagacttgccactggggtctccagactgtttttggtgtctgagggttctgtggtccagttttcatcagcaaacttctccttgacagcagaaacagaagaaaggaacttcccccatggaaatgaacatctgttaaattgggcccgaaaagagtatggagcagttacttcattcaccgaactcaagatagcaagaaacatttatattaaagtgggggaagatcaagtgttccctccaaagtgcaacatagggaagaattttctctcactcaattaccttgctgagtaccttcaacccaaagcagcagaagggtgtgtgatgtccagccagccccagaatgaggaagtacacatcatcgagctaatcacccccaactctaacccctacagtgctttccaggtggatataacaattgatataagaccttctcaagaggatcttgaagtggtcaaaaatctcatcctgatcttgaagtgcaaaaagtctgtcaactgggtgatcaaatcttttgatgttaagggaagcctgaaaattattgctcctaacagtattggctttggaaaagagagtgaaagatctatgacaatgaccaaatcaataagagatgacattccttcaacccaagggaatctggtgaagtgggctttggacaatggctatagtccaataacttcatacacaatggctcctgtggctaatagatttcatcttcggcttgaaaataatgcagaggagatgggagatgaggaagtccacactattcctcctgagctacggatcctgctggaccctggtgccctgcctgccctgcagaacccgcccatccggggaggggaaggccaaaatggaggccttccgtttcctttcccagatatttccaggagagtctggaatgaagagggagaagatgggctccctcggccaaaggaccctgtcattcccagcatacaactgtttcctggtctcagagagccagaagaggtgcaagggagcgtggatattgccctgtctgtcaaatgtgacaatgagaagatgatcgtggctgtagaaaaagattcttttcaggccagtggctactcggggatggacgtcaccctgttggatcctacctgcaaggccaagatgaatggcacacactttgttttggagtctcctctgaatggctgcggtactcggccccggtggtcagcccttgatggtgtggtctactataactccattgtgatacaggttccagcccttggggacagtagtggttggccagatggttatgaagatctggagtcaggtgataatggatttccgggagatatggatgaaggagatgcttccctgttcacccgacctgaaatcgtggtgtttaattgcagccttcagcaggtgaggaaccccagcagcttccaggaacagccccacggaaacatcaccttcaacatggagctatacaacactgacctctttttggtgccctcccagggcgtcttctctgtgccagagaatggacacgtttatgttgaggtatctgttactaaggctgaacaagaactgggatttgccatccaaacgtgctttatctctccatattcgaaccctgataggatgtctcattacaccattattgagaatatttgtcctaaagatgaatctgtgaaattctacagtcccaagagagtgcacttccctatcccgcaagctgacatggataagaagcgattcagctttgtcttcaagcctgtcttcaacacctcactgctctttctacagtgtgagctgacgctgtgtacgaagatggagaagcacccccagaagttgcctaagtgtgtgcctcctgacgaagcctgcacctcgctggacgcctcgataatctgggccatgatgcagaataagaagacgttcaccaagccccttgctgtgatccaccatgaagcagaatctaaagaaaaaggtccaagcatgaaggaaccaaatccaatttctccaccaattttccatggtctggacaccctaaccgtgatgggcattgcgtttgcagcctttgtgatcggagcactcctgacgggggccttgtggtacatctattctcacacaggggagacagcaggaaggcagcaagtccccacctccccgccagcctcggaaaacagcagtgctgcccacagcatcggcagcacgcagagcacgccttgctccagcagcagcacggcctagcccaacccagcccaacccggcccaacccagcccagcccagctcagctcagctactgccaagggcaggaccaatggctgagcctcgtgtccagactcagagggctggattttggttcccttgtaaagacagagtgaatttcagtataaagatcacccgttgtattcaccccacacccagggctagtataaacatgaccctgggcttctgtaccacactagaattcatgtgagaaagctaaaatggtggtcttctccaccagcccctcacaggcttgggggttttcaatgtgaaacacatgccagtttttaaaatgctgctttgtccaggtgagaacatccataatttggggccctgagttttacccagactcaaggagttggtaaagggttaatagccagatagtagaaccagtgaggagatgcggccaaagattctttatatctgaaccaagatgtaaaacaagaaatgctttgaggctttctaagcgatcctcctgtctaatttgcacctttgtctggatgcacacttctgaccttgctgccacaacctgtggggtctgatgtgtcccttgatgggtgctgccctcagggactgcaccctgacaagtgttaaggcaacattcctttcttgtgccctgggccaaaaccaatgctgatgaccttatcagcttcctgtttcttcccatacttgcatacaccactgcaaaatgtcttaatgcaaattttgtatttcttacaggcctacagaaattgaaaatgaccaaaatcaggaaccacagatttgtgcccattcctaatattttgttctgcaaattaatgtataatttgaggtgaaattcagttataaagtcaaggacgaatttgcacagtgatatatttctatgtgtatgcaagtacaagtatataatatgtcacctggcacattcattttctcagttgaagaagagaaaatttgaaaatgtccttatgcttttagagttgcaacttaagtatatttggtagggtgagtgtttccactcaaaatatgtcaacttaaaaaaaaataggccctttcataaaaaccaaactgtagcaagatgcaaatgcatggcaaatcctgtcggtctccagttggttatctgaatagtgtcaccaattccaccaagacagtgctgagattggaaaagggcactcatttggattgccttacttctcttgccttaaatatatcccatatatttaatatgtcaaaaagggcttgaggtgaatttcattaaatggaataatatgatgccactttgcagctaaaataagctcagtgatacctcct

SEQ ID NO: 62435 - DNA, 3627 bp, Homo sapiens
attcatgctgtcgcgggaaccccgaaggtggggccccacgtaacaagaagatgacccgaagttgctccgcagtgggctgcagcacccgtgacaccgtgctcagccgggagcgcggcctctccttccaccaatttccaactgataccatacagcgctcaaaatggatcagggctgttaatcgtgtggaccccagaagcaaaaagatttggattccaggaccaggtgctatactgtgttccaaacattttcaagaaagtgactttgagtcatatggcataagaagaaagctgaaaaaaggagctgtgccttctgtttctctatacaagattcctcaaggtgtacatcttaaaggtaaagcaagacaaaaaatcctaaaacaacctcttccagacaattctcaagaagttgctactgaggaccataactatagtttaaagacacctttgacgataggtgcagagaaactggctgaggtgcaacaaatgttacaagtgtccaaaaaaagacttatctccgtaaagaactacaggatgatcaagaagagaaagggtttacgattaattgatgcacttgtagaagagaaactactttctgaagaaacagagtgtctgctacgagctcaattttcagattttaagtgggagttatataattggagagaaacagatgagtactccgcagaaatgaaacaatttgcatgtacactctacttgtgcagtagcaaagtctatgattatgtaagaaagattcttaagctgcctcattcttccatcctcagaacgtggttatccaaatgccaacccagtccaggtttcaacagcaacattttttcttttcttcaacgaagagtagagaatggagatcagctctatcaatactgttcattgttaataaaaagtatacctctcaagcaacagcttcagtgggatcctagcagtcacagtttgcaggggtttatggactttggtcttggaaaacttgatgctgatgaaacgccacttgcttcagaaactgttttgttaatggcagtgggtatttttggccattggagaacacctcttggttatttttttgtaaacagagcatctggatatttgcaggctcagctgcttcgtctgactattggtaaactgagtgacataggaatcacagttctggctgttacatctgatgccacagcacatagtgttcagatggcaaaagcattggggatacatattgatggagacgacatgaaatgtacatttcagcatccttcatcttctagtcaacagattgcatacttctttgactcttgccacttgctaagattaataagaaatgcatttcagaattttcaaagcattcagtttattaatggtatagcacattggcagcacctcgtggagttagtagcactggaggaacaggaattatcaaatatggaaagaataccaagtacacttgcaaatttgaaaaatcatgtactgaaagtgaatagtgccacccaactctttagtgagagtgtagccagtgcattagaatatttgttatccttagacctgccaccttttcaaaactgtattggtaccatccattttttacgtttaattaacaatctgtttgacatctttaatagtaggaactgttatggaaagggacttaaagggcctctgttgcctgaaacttacagtaaaataaaccacgtgttaattgaagccaagactatttttgttacattatctgacactagcaataatcaaataattaaaggtaagcaaaaactaggattcctgggatttttgctcaatgctgagagcttaaaatggctctaccaaaattatgttttcccaaaggtcatgccttttccttatcttctgacttacaaattcagtcatgatcatctggaattatttctaaagatgcttaggcaggtattagtaacaagttctagccctacctgcatggcattccagaaagcttactataatttggagaccagatacaaatttcaagatgaagtttttctaagcaaagtaagcatctttgacatttcaattgctcgaaggaaagacttggcgctttggacagttcaacgtcagtatggtgtcagcgttacaaagactgtctttcacgaagagggtatttgtcaagactggtctcattgttcactaagtgaggcattactagacctgtcagatcataggcgaaatctcatctgttatgctggttatgttgcaaacaagttatcagctcttttaacttgtgaggactgcatcactgcactgtatgcatcggatctcaaagcctctaaaattgggtcactattatttgttaaaaagaagaatggtttgcattttccttcagaaagtctgtgtcgggtcataaatatttgtgagcgagttgtaagaacccattcaagaatggcaatttttgaactagtttctaaacaaagggaattgtatcttcaacagaaaatattatgtgagctttctgggcatattgatctttttgtagatgtgaataagcatctctttgatggagaagtgtgtgccatcaatcactttgtcaagttgctaaaggatataataatctgtttcttaaatatcagagctaaaaatgttgcacagaatcctttaaaacatcattcagagagaactgatatgaaaactttatcaaggaaacactggtcacctgtacaggattataaatgttcaagttttgctaataccagtagtaaattcaggcatttgctaagtaacgatggatatccattcaaatgagagacctaaaatatattaacattttaattaagaatacttgatcaacattttttgaagttcaatttaccatattttataaattgcgcattctgcacagtggacaagtttgcaattctgacttattaaaatttcaaattctgcatatcacaaaatctccttatacttttggtatggcttgcagcatttatgagttttccaaaatatagaaagcagtaggtcagtaggagcaaactagccaacaggtactgtctttgaatttactactgtaagactaagcagtgttactggacacagttttaacttgttcaatctgcttcaaaaacaagaaaaacaacaactatgagttatcaaaatattgactccatttatgactagactacatttctgaaagatctttggtttacgattcttaagaatattgacaatacctataaaactttgaagataacttttacttaaatatgaaaattatagtttgaaaattaggctcaagcaaatatcaaatactgcaaaaatccccttgtcccaggataccctaaaatagaagtatattttgatgtttgtttattctacctcaaacagaggcttaagttttgaagtgtaaccagtttatacttcattttatacaaaacttattgctgagaagtctgaatattgtgctttttgttgtttgtaaatagaattgaatttaaatacaccaggataaatcttatttaaaggaagcctgtttgaaaatcaccaactttaacttattgcttatataaatccaagctctgtacctgatctttatgtaaagcaagattcatatgtgtagtatctaatgccctttggtgttacatttgactaaaatacaaatgtctgtatt

SEQ ID NO: 62436 - DNA, 2530 bp, Homo sapiens
attcgctcttcagacgccggagacgtaggagtgggtcttcagactccaaaggggttggactaatggcggatgctgaggcgagggctgagttcccggaggaggccagacctgacaggggcaccttgcaggtgtttcaagatatggccagccgcttgcgaatccattccatcagggccacatgctccacgagctccggccaccctacatcatgtagcagttcttctgagatcatgtctgtgctgttcttctacatcatgaggtacaagcagtcagatccagagaatccggacaacgaccgatttgtcctcgcaaagagactgtcgtttgtggatgtggcaacaggatggctcggacaaggactgggagttgcatgtggaatggcatatactggcaagtacttcgacagggccagctaccgggtgttctgcctcatgagtgatggcgagtcctcagaaggctctgtctgggaggcaatggcctttgcttcctactacagtctggacaatcttgtggcaacctttgatgtgaaccgcctgggacacagtggtgcattgcccgccgagcactgcataaacatctatcagaggcgctgcgaagcctttgggtggaacacttatgtggtggacggccgggacgtggaggcactgtgccaggtattctggcaggcttctcaggtgaagcacaagcccactgctgtggtggccaagaccttcaagggccggggcaccccaagtattgaggatgcagaaagttggcatgcaaagccaatgccgagagaaagagcagatgccattatcaaattaattgagagccagatacagaccagcaggaatcttgacccacagccccccattgaggactcacctgaagtcaacatcacagatgtaaggatgacctctccacctgattacagagttggtgacaagatagctactcggaaagcatgcggtctggctctggctaagctgggctacgcgaacaacagagtcgttgtgctggatggtgacaccaggtactctactttctctgagatattcaacaaggagtaccctgagcgcttcatcgagtgctttatggctgaacaaaacatggtgagcgtggctctgggctgtgcctcccgtggacggaccattgcttttgctagcacctttgctgcctttctgactcgagcatttgatcacatccggataggaggcctcgctgagagcaacatcaacattattggttcccactgtggggtatctgttggtgacgatggtgcttcccagatggccctggaggatatagccatgttccgaaccattcccaagtgcacgatcttctacccaactgatgccgtctccacggagcatgctgttgctctggcagccaatgccaaggggatgtgcttcattcggaccacccgaccagaaactatggttatttacaccccacaagaacgctttgagatcggacaggccaaggtcctccgccactgtgtcagtgacaaggtcacagttattggagctggaattactgtgtatgaagccttagcagctgctgatgagctttcgaaacaagatatttttatccgtgtcatcgacctgtttaccattaaacctctggatgtcgccaccatcgtctccagtgcaaaagccacagagggccggatcattacagtggaggatcactacccgcaaggtggcatcggggaagctgtctgcgcagccgtctccatggatcctgacattcaggttcattcgctggcagtgtcgggagtgccccagagtgggaagtccgaggaattgctggatatgtatggaattagtgccagacatatcatagtggccgtgaaatgcatgttgctgaactaaaatagctgttagctttggtcttttggcctctttaccctgtgtttatgtttgttccaaaaccatcatttaaatctctactgtcacattttgtttcttaaaagcaaagccagctaacaccttcattcatccctagttcggaaattcaagctaactacttaccctttaaactgtcactgcatatgcaagtaccgctctaatttttggatcattaaggggagttacacaacttttaagtgaaaaaaataggtaacaaaacaaccacctgatagtaagttttctgataagactatagataagtggtagaggtaatcaattcttccgaagtgtttccttcgtgaataactggtagaggtaatagttttttcaatgtatttccttcatgagtaaagaaaatgtggattgaagtatagattccagtagcctagtttccacagcacgataacaccatgacgcctactgctgttcccaccttgggattctgtgtgctgccatcccacctgcagctgccctggaattcccttcgctgtttgccttcatctccctccacgtttgagaggctgtcaggcagcagcgaaagcttgttaggatgtcctgtgctgcttgtgatgagagcctccacactgtactgttcaagtcaatgttaataaagcatttcaaaaccaaaaaaaaaaaaaaaa

SEQ ID NO: 62437 - DNA, 1646 bp, Homo sapiens
aatcgagagagtctcagcctttaggtagctgacactgtgataagagcatcctgtgaactacccaaataaggaggaaaacgaacgcagctgagcatgggatgccatataaaaatcacttaaaccagtcgccactccttgtttcctgagttgccctgtgctggaggtctgctcagacgaaggtctccatggcgttagaagtcttgatgctcctcgctgtcttgatttggaccggtgctgagaacctccatgtgaaaataagttgctctctggactggttgatggtctcagttatcccagttgcagaaagcagaaatctgtatatatttgcggatgaattacatctgggaatgggctgccctgcaaatcggatacatacatatgtatatgagtttatatatcttgttcgtgattgtggcatcaggacaagggtagtttctgaggaaactctcctttttcaaaccgagctgtactttaccccaaggaatatagatcatgaccctcaggaaatccatttggagtgttccacctctaggaaatcagtgtggcttacaccagtttctactgagaatgaaataaaattggatcctagtccttttattgctgactttcagacaacagcagaagagttaggattattatcttctagtccaaacttgctctgagctaaaggagaaatggaaacttgaagctggtgttatgtattttgcaggaaaacagtttcattttttcatagcaaaaatatagttggtgtatatctctccttaagtctctggtttctaaaaaccctacttcagtaaaggtcctgattagttgattagtgaatgtgtatttctaaatatttgtattcagtaggggtatggctgattaatttaacattaactattaggtaattcatattatacatttaagttctttctgttctgtgtagaagattcagaaatatgtcttcaaagacaatgacttgatctaattgataagaacctccaataaatatgttctaatatttttcaggaagaataaagaatagagagagacatataaatgtgcaagaggcaaaactttgagcatagtgtaaaatttaacatattaactctcacgaaaggcaaaatccttttatgtgcagatactttaattcatgtagattttcctattaatcagtaaagttgaatcctaacaataatgccatgtgacaacctatttagattattccagaattaaattcaatttattttctagagctcaagtaaccactaccttaactgaaatttgatgttaggtttcccttgttcctccgaatggttcttccacactcaaaataattgaatggttgagttggttaagcaaagagttatcctgccacctaagagcattcattaaatgattatttattaccacctactttatactatcttcctttctttaaacatggagtctaaatatgtaatatatcaaaaaatacttctgatttggtagatttcttatatcaagggtgagaattgaactgtgccattggctattcaatagcttattgaatgtatgttttggatgccacatcctcctggaagcaaattttgccaagatactgtttattattatttttaattaaagtgatactattccattttcaattaaaaaaaaaaaaaaaa

SEQ ID NO: 62438 - DNA, 480 bp, Homo sapiens
atgctgcatgtgctggcctcgctgcctttgctgctcctgctggtgacgtctgcctccacccacgcctggtcgagacccctctggtaccaggtggggctggacttgcagccctgggggtgtcagccaaagagtgtggagggctgtaggggtggcctgagctgtcctggctactggctgggccctggagcaagccgcatctaccccgtggctgcggtcatgatcaccaccacgatgctgatgatctgccgcaagatactgcaggggcggcggcgctcacaggccaccaagggtgagcatccgcaggtgaccactgagccctgcggaccctggaaacggcgggccccaatctcagaccacaccctgctccgtggggtcctgcacatgctggatgccctcctggtccacatcgaaggccacctacgtcatctagccacccagcggcaaatccaaataaaggggacttccacccagagtgggtga

SEQ ID NO: 62439 - DNA, 2209 bp, Homo sapiens
ccccggccccggctccggcgctgctcccaccgccgcggcaacggccccggcccacggaggcggctggacggacccccgacggttggacgtacggactctgcttcgagagtaggccatggacaccttcagcaccaagagcctggctctgcaggcgcagaagaagctcctgagtaagatggcgtccaaggcagtggtggccgtgctggtggatgacaccagcagtgaggtgctggatgagctgtaccgcgccaccagggagttcacgcgcagccgcaaggaggcccagaagatgctcaagaacctggtcaaggtggccctgaagctgggactgctgctgcgtggggaccagctgggcggtgaggagctggcgctgctgcggcgcttccgccaccgggcgcgctgcctggccatgacggccgtcagcttccaccaggtggacttcaccttcgaccggcgcgtgctggccgtcgggctgctcgagtgccgcgacctgctgcaccaggccgtgggtccccacctgaccgccaagtcccacggccgcatcaaccacgtgttcggccacctagccgactgcgacttcctggctgcgctctacggccccgccgagccctaccgctcccacctgcgcaggatctgcgagggcctgggccggatgctggacgagggcagcctctgaaccccggcgccgcccaaccgcgcccctcgcgccttttggggctctcctgctgggcgcgggtggggtttgtgggtttttttccacctcttttctcccaatcggactccggccaaactcccctagacagatgggtgacctgtctcctttgagaggatgctgaggcatctgtagcagctgtttcaaacaccaatgtcacctctcctcctggcccccgcccaatggggagaggaatttggggccctactctggggaccacctttcacccgtttgtactttctgggccacgccgacccctgggtcgcttgatgtaaaagccaaaagctgctgcctcccacttggatcatgtcgcctgggattttcatccctcgcacaaggactacgggttcacacggtgaactgggggaagggaagtgttagggggcaagtcgcggcacccccccttccataaactcacgtcctaacccccaggacctcagaagatgatctgatttggaaataggatcattacagatggaattagttcagatgatctcatcttggagtagggtgggccccaattcaaggactggggtccttaaaaaaagggggcctggggcagggcgcggtggctcacgcctgtaatcccagcactttgagaggctgaggcgggcggatcacgaggtcaggaggtcgagaccatcctggctaacacggtgaaaccccatctctactgaaaatacaaaaaattagctgggcatggtggcacatgcctgtagtcccagctactcgggaggctgaggcaggataatcacttgagccaggaggaggaggttgcagtgagccgagattgtgccactgcactccagcctgggtgacagggcaagactctgtctcaaaaaaagaagcgggggagtgggggattgaggccacgtgcagtggctcactactgtaattccagcactttgggaggccgaggcaggaagattgcttgaactcagaagttcaagaccagtctgggcaacatggtgagaccctcgtctctacaaaaaaaaaattatcgtggtgggccgggcgtggtggctcacacctgtaatcccagcactttgggaggctgaggcgggcagatcacaaggtcaggagatcgagaccatcctggccaacatggtgaaaccccgtctctactaaaaatacaaaaattagccgggcatggtgttgcgtgcctgtagtcccagctacttgggaggctgaggcaggagaatcgcttgaacctgggaggcgcaggttgcagggaggcggaggttgcagtgagccgagattgcaccactgcacttcagcctggtgacagagcgagactcgtctcaaaaaaaaaaaaaaaaaaaaaaaaaaaagtgactgtggtggtgcacacgtataatcccagctacttgagagatgacgagggaagatcacttgagcccaggagttaagaggctgcagtgaccgatgatcatgccactgcactccagcttgggtgagagtgggactctgtcttaaaaaaaaaaaaaaaaaaaaaaa

SEQ ID NO: 62440 - DNA, 5959 bp, Homo sapiens
atcttgtgttgttgaggctgaggactgactggggttctgagactccctgtcccggaccgcagattatagtgggaccagtctcattaggttgaatctacagcctatgttggtgttaacccaggtctcttagagcgttaaaaggatctgaacaaagtctgctcaaatctcctgctgtgaaccagcagaatttttgaacagagaccacgtctccacctcctgggctccaacgattctcccatcttggcctcccaaagcgctggatttacaggtttcttcacatataaaaatctattgtaaaaatacggaaaagaatggcagcggaaacgcagacactgaactttgggcctgaatggctccgagctctgtccagtggtgggagtattacatcccctcctctttctccagcattgccgaagtataaattagcagattatcgttacggcagagaagaaatgttagcacttttccttaaagacaacaagataccttcagaccttctggataaagaatttctgcctatcctccaggaggaaccccttccaccattggctctggtaccctttacagaagaagaacagagaaacttttccatgtctgtaaatagtgctgctgtcctgcgattgacaggacgaggaggaggaggaacagtggtgggggctcctagaggtcgaagttcttcaagagggcgaggcagaggcagaggtgaatgtggtttctaccaaagaagttttgatgaagtagagggtgtttttggtcgaggaggtggcagagaaatgcatagatcgcagagctgggaggaaaggggtgacagacgttttgaaaaaccaggacgaaaagatgtagggagaccaaattttgaggaaggtggaccaacatcagtagggagaaagcatgaatttatacgctcagaaagtgaaaattggcgcatctttagagaggaacaaaatggagaagatgaagatggaggttggcgactagctggatcaaggagggatggagagaggtggcgacctcacagtcctgatggccctcgttctgcaggctggcgggaacacatggaacgacgtcggaggtttgagtttgattttcgagatagagatgatgaacggggttaccgaagggttcgctctggcagtgggagcatagatgatgacagggatagcttgcccgaatggtgcttagaggatgctgaagaagaaatgggtacatttgactcatctggagcattcctttctctaaaaaaagtacagaaagagcctattccagaagagcaggagatggacttccggcctgtggacgaaggggaggagtgctctgactctgagggtagccataatgaagaggccaaagaacccgataagacaaataagaaagaaggagagaaaacagatagagtaggagttgaagctagtgaggaaactccccagacctcatcatcatctgctagaccaggtactccttcagaccatcagtctcaggaagcatcacagtttgagaggaaagatgaaccaaaaactgagcaaacggaaaaagctgaagaggagactcggatggaaaatagtctaccagccaaagtgcccagcagaggggatgaaatggttgctgatgtccagcagcccctgtcgcagattccttcagatacagcctctcctcttctcatacttccacctcctgttcccaatcctagtcctactctccggccagttgaaacaccagttgtaggtgctcctggtatgggcagtgtttccacagaacctgatgatgaagaaggtctcaaacatttggagcagcaagctgagaaaatggtggcttatctccaagacagtgcactagatgatgaaagattggcatcaaaactgcaagagcacagagctaaaggagtgtcgattccattgatgcatgaagcaatgcagaagtggtattacaaagatcctcagggagaaattcaaggtcccttcaataatcaggagatggcagaatggtttcaggcgggctattttactatgtctttattggtgaagagagcgtgtgatgaaagcttccaacctcttggcgatatcatgaaaatgtggggaagggttcccttttctccaggtccagctccccctcctcatatgggagagctggaccaggaacgactgaccaggcagcaagaactcacagccttataccagatgcagcacctgcagtaccagcagtttttaatacaacaacaatatgcacaggttttggcccaacagcagaaagcagcactgtcttcccagcagcagcagcagttggcacttcttcttcaacagtttcagaccttgaagatgagaatatctgatcagaacatcattccctcagtaactaggtctgtgtccgtgccagatactggctctatctgggagcttcagccaacagcttcacagcctacagtttgggaaggtggtagtgtatgggatcttcctctggacaccacgacaccaggccctgccctggaacagcttcagcagctagagaaggccaaagctgcaaagctagagcaagagagaagagaggcagaaatgagggcaaaacgggaagaggaagagcgaaagaggcaggaagaactccgaagacaacaggaggaaattcttcggcgacagcaggaagaagaaaggaaaaggcgagaggaagaagaacttgcccgaaggaaacaggaagaggctctgcgtcgccagcgggagcaagaaattgcattaaggcgacagcgagaagaggaagaaagacagcagcaagaagaagctcttagaagactggaagagaggagaagagaagaggaagaaaggcggaagcaggaagaattgttacgcaaacaggaagaggaggctgcaaaatgggcccgggaagaagaagaagcccagcgtcgattagaggagaaccggctgcggatggaagaggaggcagccagactccggcatgaggaagaagaacggaagagaaaggagctggaggtccagcggcagaaggagttaatgcgccagaggcaacagcagcaagaggctctccggaggttgcagcagcagcagcagcaacaacagctggcgcagatgaagcttccttcttcttcaacgtggggccagcagtccaatacaacagcatgtcagtcccaggccacgctgtcgttggctgaaatccaaaaactagaggaagaacgagaacggcagcttcgagaagagcaaaggcgccagcagagggagttgatgaaagctcttcagcagcagcagcaacagcaacagcagaaactctcaggttgggggaatgtcagcaaaccttcaggtaccacgaaatctcttctggagatccagcaggaagaggccaggcaaatgcaaaagcagcagcagcagcagcagcaacaccagcaaccaaacagagctcgtaacaatacgcattccaacctgcacaccagcattgggaattctgtttggggctctataaatactggtcctcctaaccagtgggcatctgacctagtcagtagtatttggagtaatgctgacactaaaaactccaacatgggattctgggatgatgcagtgaaagaggtgggacctaggaattcaacaaataaaaataaaaacaacgccagtctcagtaaatctgtaggtgtgtctaaccggcagaataagaaagtagaagaagaagaaaagttgctgaagctctttcagggagtaaataaagcccaagatggatttacgcagtggtgtgaacagatgcttcatgcccttaatacggcaaataacttggatgttcccacatttgtttctttcctgaaagaagtagaatctccttatgaggtccatgattatatcagggcctatttaggagatacttctgaggccaaggagtttgccaagcagttccttgagcgccgtgccaaacagaaagccaaccagcagcgtcagcagcagcagctgccacagcagcagcagcagcagccgccacagcagccgccacagcagccacaacagcaggactctgtgtgggggatgaaccacagtacactccattcagtatttcagaccaatcaaagcaacaaccaacaatccaattttgaggctgtgcagagtggcaagaagaagaaaaagcagaagatggtccgagcagatcccagtttattaggattttcagtcaatgcatcatcggagcgactcaacatgggtgaaatcgagacgttggatgactactgagcacctgccagtggactggccatccctctcctgtctgccgactatggagtctccacctttggacacaacacttactcaccatttactctttatcactctgcaacaaatcacagaaccgatcatctcaggctttttcttctggccctttgtgtccaagattctttaatccatttttgttggtgaacatctcagactatagataagtggactggaccctgtgtcttgggggtggcagttgggattactccccaacaaggctgattttaggcagcatgtgttcactgtgctgtgatttcatctactgtctcccagaaagtgtgttgggatcggccattagcagcttgctttctcttgtcactttttttcttctattttgttttttcttcttctttttccccccatcagggcaaatggtctaactggtgcaatcatgaagagagttaatggttaacagacattggccaataacaaaacaccccatggactgtgactcgagtatccaacaggcagtcagagctctcccggtctgaaagttgcattgccactgctaactttgggattgcatcagagaggccctgagtggggttgagatgaggttggtttggtttgatgttacacactcctcacctgttctttctgagtgtcctttctctgaaaggatttatgtttttcttcgttagatagtgacttctgagcaagctgatctcccctggcatgctccaacctgattggacaaaggaagctctatggcctgggagagagactattcttaatttttctttcttacaaaaactgatttttcccataaatatttttacttcagaggactaggaccattttgttttgggcccttctgctgaaaatttgtctcgtttaagaggcagctagaatctttaccatatgtatgaatttgtataatttcatttttggatagggataaacttttgcttctgataaaagcctggaatttcatctggtcctcagagcattgcgtgtgtgtcttgctgtagcccggaaaaggttttgtgtaaagattctgggatggcaagttgtttgccttttctgaaaagagaacatacagaacctgtccatctttaagaccttcatccatggaatctactatacaggaggatgcagtgggctggaggggatgggcgaaaatgggagcaggaagcctggcctggcttctggtcatggcctcctaaaaccttaaacttcaagtagaaatgtactcaagccctatttataaacaaatacttttcctgcctccaccaaacccctacagaacatcacctggaattgccactcacactgggttggagtcattgggcagctgtgcctgtgcgagaggtgctgtggtctgggcagcccctggaaaagcacctttgctgcctgtcattgttgcctgaagaaggctggagttgctctgagagcagtttgggtttggagtattatatttggcttctatttttattattttggatcaccattctccctatcccttcttgcctccctcccttctaaacatgtgtaataactatacagagactgctacaaaattgtatatagtttttggatcaaatagcatgaggggagaggaaaccattaaaagttggggctcctactctcctttgctttgtaaattcaaaagttgggggtgggtaagagggatagttaaaatgtttacaaaactttaggctccctcggaacttttgccagtgtggaggaaaataaaaaagaacttaaat

SEQ ID NO: 62441 - DNA, 2486 bp, Homo sapiens
gccacagactcctcagaaaggctcccgagagggtgacacccaccccctctggccatgagcccctttctgccccactcctaccctccaggccaggccactgatgtcactggtgccaggacagcattgttctccctcccacacccgccttcacctcacaagccccatcaccatgggaactgagccagccactcagaacacagagttttcaaagggcagccttatatacggagtcacctctccccagagaggtcacagccaacattcagaggcctcccagggccccctctccctggataaaccacttcagctgccccccatttttctcgagggagaaaaaggggaatcctctgtccagaatgagcaggaaggagagccaagcctacagtcacccagcttagagctccagtcccctgcgtggccacgccatgcaggagtggctcaggagcccctgaaagtgtccagcagctacctcagtgacacccagagcagcgagagtcatgtttccagcgtgcagcacccgaggccagaggagggcagccatgccagcctgagcagcgggtacgcaggggacaaggagggcagcgacatcagcttggtgggcagccaccggagagtgcggctgaacagaaggctcaacacccaggcggccagtaaccaaaccagccagctgggctccatagaccctcccagctctctaaagagccggctgactggccccgcccacagcaccaagcagactggagggaaagagtgaggccagcctgcccggcagcggcagcggcagcagcatcctgtccagcgccagcttcatcagcttgggcagcagtgccctcacctaccaggtgagcagcgggctgctgacttccacagccagccttccctccacccaggccagcagccgtcagagcgtccggctggatggcagtgcccaaaacaggcagagcagccacaccagcgtgcaggaggacaagacgggcggcaacgtgaaaaccagtgagcaggtcaccacgggggagcagcctgcccaggtgtgcatgcctttgtgagaatcctctccagcagccagagtctcccagaaaacaacacacaggcccagcaaacacaggctgcacccagagtggatattcccaaaacaagtaggaaaggtgttttcaaaagcacacactgactgtgtcaaccatcagtgggtaatcccatttgtagcaacaagcatcagtgggcaggccacatgtagcaggaaggatctatgctgagcaccgcctatcctgagaacacagtcagtgaggagactgtctatactgagaaccactgttgctaggaagagctgtagtatcaagattcaccaatgctgagtccacctgtgtcaaaacagcgaagagtaatgacatcgactgtgaacttcagtgacaagccatctataacaagatccatcaatggcaaaaccatctgtagtcagcagcatcctggtgggaccccctgtaccaaaactcatcagtggcgacagatgttctcgatggcaaacgctgacgatattaagaactgtcacgagttagaaccttccatgatgaaaccatcctaaatgatgaatgccatctgcaaccaacaccagccacgatgagctcagaagaaacaagctgcaaccatggttgggactgtccatatcaagaaccatctgcagtgagcaccatgcgtggagtgccacatccacatgaaacttcatcctggccaagcagcaccacactctgtccatcattgtcactgcccgcagaagcactagcaagacagccacggtgcacacggagcaccttcacgactctcagctcccccaaggagtccagactaagtgactgtcaccagagaaggatcatcaggagcagccagggatgcccccggcacacagggactaggtctagtgagaacattagagggcggtgtaaatggatccccatgcctgggcacctgtaatcccaactacttgggaggcaccatcccagagagctccaagcgtccttttttttttttttttcctttgagtgctgtctctggacatcttcagcccagaatcttctcaggagcaaaggcttcctgatgcctcattcatgtcaagaaaggaggccaggagccatcctgtgttcagatggttgagacagtgactacgatggcaggacaatgccgtgagaagcacttcatggtgacagagcccaacccagccgggaacagctgcgatggggaagctctggagcattttgtgagcaccgtctcggtggatgggaaagccaaagtctctgcccgtctcttactggaggcactaaaccccctccctgggttgacctcacagacattgaagtgagtctgcccacaaaggaaaagaggccagagactgtcgtgaagacatccactaggtaccagaaggaaagctgagggggcagcaaagacaataaaaggtgtctagagaggtcaaaaaaaaaagaaaaaaaaaaaaaaaa

SEQ ID NO: 62442 - DNA, 2034 bp, Homo sapiens
ggctccacggccacatccgcaaaaagggtactggtgaacgtgacattttcacgaagccacagcccatggtcactccctgcaaagctctgaacttgcgcattcccaggccaggccgtggttgtctttccaaggcggctcagcttgtgctttgcttggagagagcggagggcagcagcacagtgacagcgtctgggacctcagaccagtttccacagccacttatgaaagcagacggctccatgggctggaggaggtgggacgctctggaaagaactcgggtgcgagtgggaaagaaaatcgagctgagcagctggaagtcgaagtcgcgtgagtgaggaccagacactctcgatttaggcaaaggcggggtgcacttcccaacaacacatcctcctcactggcgagaccaggcctgcccttcaagttcctctcctgatttaatccccttggcgagggtttggcatgaaatcaatggccagcaagcttggtaaacgaagccgcctacaccgccctccccctccctgcacggccgcgccccgcctccgctcctgtctcaatctgggattgtcctcctgtagccccaccatccaccgtggggaacggtggagagactacaactcccagtatgcaccgcgatgcgcgcctcaccctgcatctcccagcccgcagccagctggcatcctagaccctctgccctgcgaccaacagccgggagcggaccagacaccagaactcccggaacggttgaagacggttccgctccctgtcccgcctttcgcagcccagcagtttcgccctgcggagaggagccttgctgtttccaaatctctcctgctgaagagacattggagctagggcggctagtttcacctggtaattgtgacaccctgtctcctcgagctgcaggcttttatgcttgtcatgttcgaagtttgataccttgcagatcaacaaagggccggtggcctctcactgcctccgcggcagggttgtcaagtttttcaggttaagtactgcacgactactcgcttctgaaactgatagacactgcctcagctccgtgcagggcagacgcacaagagcagaatctccgtgggacatctctctggagcatcaatattactgcagtatttggaagaaacaaatttaaataagttctaaggtgaagaatggaacatttaagacaagtctggaaagtcatctgcctttaataactgtcgtttgtccttaacgtcagactttctccaagaccaaaactctaagaacttatttccattcttacaaatagtaaaaatgataaatcatatcaagtcaattgaaagtcctgcctgctgctttcctaaattgcaatatggccttggtatggttttatttgtacttttgtgggggattcgtggatctttagattaaaaaaaaaaaaataggtttttgaacaatttttgcaagtttgcagctgttagttattgatttatttttccaacccatctaattcttctgtctctctcctctcctcaggctcaataattccatgggtctctaaggctgtgtttattttctttaaattttgttgatttacttttatactccatttgattttttctatctctcaccttttctcagactcagtcatcccacaggtctgtaaggctctgttcattttctttaaacttcttttttttttcctctcctcagattggataaattatattgctatgtctctgtttctgaactatagaaaagctcaaaattattatttttatttctcattttttatatggctattttttctctgctgatgtttcacatctattcatttatgagaatattttcctttgccctcatgagcgtgtttataatagctgccttcaaattcttgtctgccgtttacatcttggacatcttggagatggctactgcctgctttttatcttgtgtatttattacattttcacgtgtcttcacgcatcccttgaattggaaattgtgccctggagactgtatacaagactggattaaaaagactggattctgttt

SEQ ID NO: 62443 - DNA, 1559 bp, Homo sapiens
acaggccaggtcgtcaactcaactgtcaaggtgtccattgtaccagctgggccatggatccctcccgcctgaaatctgactccacctgccaagagtctgagcctgcaggcctagatttcgactctgctggccaagattatttctctgcagcccaataattcgactctttctaccaagaattggacctggactctcttaacgaagatcttctttcccagtccatgccacatgccaggacagagacctctgtgggcacatatgaatcccactcgacttctgaactggaggatctgacagagcccgagcaaagagagctcaaaaccaaactcactaaattggaggctgaaattgtaaccctacgccacgtactagcagccaaagagagacgctgtggggaactcaagaggaagttaggcctcaccgccttggtagggctgagacagaatctgtccaagagctggcttgatgttcaggtctccaacacctatgtgaaacagaagacatcagctgctctgtccaccatgggcactctcatctgcaggaagcttggaggcgtgaagaagtcggccacactcagatcttttgaaggattgatcttcaataaatacacgttaaatcaaggaaggaattaacatcatatacttcagacatcaaatatggaatccaagagactatcaacaacatgaacttgttcacaagttccttctgcttttaaacaaaaatatcgtgtttattcaaagccaatctgagaccctactctgtatcaagaactgtcccaggttctgaaagcatagaattagacatcgtatgtgccctctagaaacacttagactttcaaatcattataattcaatgagtcctaaaatagagctgtgtgccagagataaaagaagtcctgaggaaggggtgttcaactctgtcttggtaggtcagtaaggactttagagagacagaaagtcttagaggactaggagaagtttgccagacagacaagaatagaacattccagacaacatgcagaggaactgagtcacaaaggaatgtataagaatggcatattctaggaactaacactgtggctagagaggaaggggaaatggtgttacatgagtgagggaggggaaatggtgttacgtgagtaagaaaaaataagcagggggcaaaatcataagtagtcttacatactacattagatatcaatatttaagcctgtaggaaatgggaggcattgaagcacttaagtaaaaaagtaactatcaaatttttgttttagattactctggtcatcagagaaatagattaagtatttaagaggtagaatctctcagacttaggaaccaactgcatgaggcggggcttggggggataaatttgcaagataataaggatgtagaattgaaaaggcctgatattattgaagctggagttgcacattcattttgctttggcttttttgtatcagtggtcatgggcaccaaataaaatgcttccatgaacatttggattctggctcaaaaaaaaaaaaaaaaaaaaaaaaaaaaaaaaaaaaaaaaaaaaaa

SEQ ID NO: 62444 - DNA, 1735 bp, Homo sapiens
aatgatcgaagcagtacaaatcaggggagaacgtgcccaagacctggagaactgataataaattgtggtttatccttgcaatggaacactatatggaagtgaaaatgattgaaatagagctatacacatcatcacaggcaaatttcagaaacaacgctgagtgaaaaatccacccacaaatgaattatcaggagtgaacccagaggcacgtatgaatgaaagtccacagacaaacgaatttaaaggaacaaccgaggaggcacctgcgaaagaaagcccacacacaagtgaatttaaaggagcagccctggtgtcacctatcagtaaaagaatatttggagttttcctggtcttactggatgtcactctcctccttgccgacctaattttcactgacagcaaactttatattcctttggagtatcgttctatttctctagctattggcttattttttctcatggatgttcttcttcgagtatttgtagaaggatggacacatttagttcgacttctacgacttattattctgataagaatttttcatctgcttcatcaaaaaagacaacttgaaaagctgatgagaaggctggtttcagaaaacaaaaggcgatacacaagggatggatttgacctagacctcacttacgttacagaacgtattattgctatgtcatttccatcttctggaaggcagtctttctatagaaatccaattgaggaagttgtgcggtttctagataagaaacatcgaaaccactatcgagtctacaatctatgcagtgaaagagcttatgatcctaagcacttccataatagggtcagtagaatcatgattgatgatcataatgtccccactctacatgagatggtggttttcaccaaggaagtaaatgagtggatggctcaagatcttgaaaacatcgtagcgattcactgtaaaggaggcaaaggaagaaccgggactatggtttgtgccctccttattgcctccgaaatatttttaactgccgaggaaagcctatattattttggagaaaggcgaaccaataaaacccacagcaataaatttcagggagtagaaactccttctcagaatagatatgttggatattttgcacaagtgaaacatctctacaactggaatctccctccaagacggatactctttataaaaagattcattatttattcgattcgtggtgatgtatgtgatctaaaagtccaagtagtaatggagaaaaaggttgtcttttccagtacttcattaggaaattgttcgatattgcatgacattgaaacagacaaagtattaattaatgtatatgacggtccacctctgtatgatgatgtgaaagtgcagtttttctcttcgaatcttcctaaatactatgacaattgtccatttttcttctggttcaacacgtcttttattcaaaataacaggctttgtctaccaagaaatgaattggataatccacataaacaaaaagcatggaaaatttatccaccagaatttgctgtggagatactttttggcgagaaatgacttccaatgatgttgtagctggatccgactaagtatagctcccccttccccttctgggaaagaattatgttctttccaacccctgccacatgttcatgtgtcctaagtcttccttgatgatgcatctatatttatatatgtttatatatgttcttcataaatctattaaatatatatagataaaaa

SEQ ID NO: 62445 - DNA, 1966 bp, Homo sapiens
aatgatcgaagcagtacaaatcaggggagaacgtgcccaagacctggagaactgataataaattgtggtttatccttgcaatggaacactatatggaagtgaaaatgattgaaatagagctatacacatcatcacaggcaaatttcagaaacaacgctgagtgaaaaatccacccacaaatgaattatcaggagtgaacccagaggcacgtatgaatgaaagtccacagacaaacgaatttaaaggaacaaccgaggaggcacctgcgaaagaaagcccacacacaagtgaatttaaaggagcagccctggtgtcacctatcagtaaaagtatgttagaacgactttccaagtttgaagttgaagatgctgaaaatgttgcttcatatgacagcaagattaagaaaattgtgcattcaattgtatcatcctttgcatttggaatatttggagttttcctggtcttactggatgtcactctcctccttgccgacctaattttcactgacagcaaactttatattcctttggagtatcgttctatttctctagctattggcttattttttctcatggatgttcttcttcgagtatttgtagaagggagacagcagtatttttctgacttatttaacattttagatactgccattattgtgattcctctgctggttgatgtcatttacattttttttgacattaagttgcttaggaatattcccagatggacacatttagttcgacttctacgacttattattctgataagaatttttcatctgcttcatcaaaaaagacaacttgaaaagctgatgagaaggctggtttcagaaaacaaaaggcgatacacaagggatggatttgacctagacctcacttacgttacagaacgtattattgctatgtcatttccatcttctggaaggcagtctttctatagaaatccaattgaggaagttgtgcggtttctagataagaaacatcgaaaccactatcgagtctacaatctatgcagtgaaagagcttatgatcctaagcacttccataatagggtcagtagaatcatgattgatgatcataatgtccccactctacatgagatggtggttttcaccaaggaagtaaatgagtggatggctcaagatcttgaaaacatcgtagcgattcactgtaaaggaggcaaaggaagaaccgggactatggtttgtgccctccttattgcctccgaaatatttttaactgccgaggaaagcctatattattttggagaaaggcgaaccaataaaacccacagcaataaatttcagggagtagaaactccttctcagaatagatatgttggatattttgcacaagtgaaacatctctacaactggaatctccctccaagacggatactctttataaaaagattcattatttattcgattcgtggtgatgtatgtgatctaaaagtccaagtagtaatggagaaaaaggttgtcttttccagtacttcattaggaaattgttcgatattgcatgacattgaaacagacaaagtattaattaatgtatatgacggtccacctctgtatgatgatgtgaaagtgcagtttttctcttcgaatcttcctaaatactatgacaattgtccatttttcttctggttcaacacgtcttttattcaaaataacaggctttgtctaccaagaaatgaattggataatccacataaacaaaaagcatggaaaatttatccaccagaatttgctgtggagatactttttggcgagaaatgacttccaatgatgttgtagctggatccgactaagtatagctcccccttccccttctgggaaagaattatgttctttccaacccctgccacatgttcatgtgtcctaagtcttccttgatgatgcatctatatttatatatgtttatatatgttcttcataaatctattaaatatatatagataaaaa

SEQ ID NO: 62446 - DNA, 1607 bp, Homo sapiens
aatgatcgaagcagtacaaatcaggggagaacgtgcccaagacctggagaactgataataaattgtggtttatccttgcaatggaacactatatggaagtgaaaatgattgaaatagagctatacacatcatcacaggcaaatttcagaaacaacgctgagtgaaaaatccacccacaaatgaattatcaggagtgaacccagaggcacgtatgaatgaaagtccacagacaaacgaatttaaaggaacaaccgaggaggcacctgcgaaagaaagcccacacacaagtgaatttaaaggagcagccctggtgtcacctatcagtaaaagatggacacatttagttcgacttctacgacttattattctgataagaatttttcatctgcttcatcaaaaaagacaacttgaaaagctgatgagaaggctggtttcagaaaacaaaaggcgatacacaagggatggatttgacctagacctcacttacgttacagaacgtattattgctatgtcatttccatcttctggaaggcagtctttctatagaaatccaattgaggaagttgtgcggtttctagataagaaacatcgaaaccactatcgagtctacaatctatgcagtgaaagagcttatgatcctaagcacttccataatagggtcagtagaatcatgattgatgatcataatgtccccactctacatgagatggtggttttcaccaaggaagtaaatgagtggatggctcaagatcttgaaaacatcgtagcgattcactgtaaaggaggcaaaggaagaaccgggactatggtttgtgccctccttattgcctccgaaatatttttaactgccgaggaaagcctatattattttggagaaaggcgaaccaataaaacccacagcaataaatttcagggagtagaaactccttctcagaatagatatgttggatattttgcacaagtgaaacatctctacaactggaatctccctccaagacggatactctttataaaaagattcattatttattcgattcgtggtgatgtatgtgatctaaaagtccaagtagtaatggagaaaaaggttgtcttttccagtacttcattaggaaattgttcgagagaagagggcagcacacagggccaactggaagggggagccatcccggagacctgtgctcgactgatgggtgggagcaatagcgagagagagggagggacctgagagtggaagcctttattgggataatcttcctaaatactatgacaattgtccatttttcttctggttcaacacgtcttttattcaaaataacaggctttgtctaccaagaaatgaattggataatccacataaacaaaaagcatggaaaatttatccaccagaatttgctgtggagatactttttggcgagaaatgacttccaatgatgttgtagctggatccgactaagtatagctcccccttccccttctgggaaagaattatgttctttccaacccctgccacatgttcatgtgtcctaagtcttccttgatgatgcatctatatttatatatgtttatatatgttcttcataaatctattaaatatatatagataaaaa

SEQ ID NO: 62447 - DNA, 7065 bp, Homo sapiens
ccccgaagttgttccgcgctgggcgggcgagcggctgtgggagagcgggcggcgggccggcgggcggaccgggccggtgctggagaagtttgcgctgcggttcgtgagcgcagggtgcgggccccgccggccgctgcgcgcccgctgccatggctttccgcaggaggacgaaaagttacccgctcttcagccaggagttcgtcatccacaaccatgcggacatcggcttctgcctggtgctctgcgtcctcatcgggcttatgttcgaggtcacagccaagactgcctttctatttattttacctcagtataacattagcgtgcctacagcagacagtgagaccgtgcactaccactatggccctaaggacctggtcacaatcttgttctacatcttcatcaccatcatcttgcatgctgtggttcaggagtacattttagataaaatcagcaaacggcttcatctctccaaagtcaaacacagcaagttcaatgaatctggacagctggtcgtctttcatttcacctcggtgatttggtgcttctacgtggtggtgacggaaggatacttaacaaacccaagaagcctctgggaagactacccgcatgtgcacctccccttccaggtgaagtttttctacctatgccagctggcctactggctgcacgcacttcctgagctatacttccagaaggtacggaaggaggaaattccccgccagctccagtatatttgcctgtacctggtgcatatagctggagcatacctcttaaacctgagccgcctgggcctgatcttgctgctgctgcagtactcaactgagttcctcttccacacggctagactcttctactttgcagatgaaaacaacgagaaactgttcagtgcctgggctgctgtttttggggttacccgcctcttcatcctcacccttgccgtgctggccattggctttggactggctcgcatggaaaaccaggcatttgatcccgagaaagggaacttcaacactttgttttgcaggctctgcgtgctgctgctggtgtgtgccgcccaggcctggctcatgtggcgcttcatccactcccagctgcggcactggcgggaatactggaatgagcagagtgcaaagcggagagtcccagccacacccagactaccagccaggctcatcaagagggaatctggttaccatgaaaatggagtggtgaaggcagagaacggaacctccccacggactaagaaactcaagtctccctaaggccaaagtgctaagaacaggaatcctcttggtgggggccgagcagggggcaaggagcccaggccccctccctgcctcctccttcctgcctgtgatgctccgtctcaaacagccgaaacctgtcttgcaatggggggagggggcgtttcgctttccttcttcttggcttcctcttattcttccacaaaccattctcaataaagccaaaaatctttctctttctccccctcaggccacctcctgtcctcactcctgtcctgtgctggcttttctggaacgccaggcgcccatggctggcacctttctgcttgctctgtctcttgccttatggctgctgcttttcctttttacttcctattttcaccttatcttgcaatttttctgtctgatttttacaatgggaggggagctaagattgcagtcctgtccttcggtcccccagggcctgccggtcagaagcctggggctggtaggcccttggtggtcctcatgtggatgggcaagaagagagcggccatctcggatcataatctccttggtgctgattaactgacgagatatatgattccagttctgcatgtaccatcttgaggcacagcagccactgctcgttgtaaatgccaaggcatttggctttgggacgtgacaactcaatccagaaggatggtgtgaactcggttgggtcccgtgactcgagctcctaccagtggctggccgcggattggaagccagcctgctgtcgctctgtggggggggacacgtcttcccactgcttagagcgagagcagagcaaactgcgcagcaggcacctccagaaaggtaatggtggcagaacccacagtggagtcgacctaggcctttctccagcagtcccagtcgccattgctttttcagccattcacaagcattcaaaaccaaaccaaacagcagttcatatacctgcctgagataggctggtcctcacctccagagccagccagccccgtcaggggccaaacttactaccttgacttcatctctagctgcagaaacactaagtctcaagggcttcagccccatgctggtcccttggtgttcagggagggtcacttggaccgctgttcatctggccgcccttgttgagtgttctttggaattgtcgttttttgagcacaactacagcattttagactgcatgaaaccatgactgactgagagtcactctctgggtagatgataggcgcctttctggccccttccctcacagattctttcccctcccctccacctgaagagaaggcctccaagtccttttggtgccttgtgaggacttttagaaggggcgttcagctttaaaaagccggtcctaattacggccggacgcagtagcttacgcctgttatcccagcactttgggaggtcgaggtgggcagatcacctgaggttaggagttcaagaccagcctggccaacatggtgaaaccccatctctactaaaaatacaaaaaattaggtgtagtggcaggcacctgtaatcccagctactcgggaggctgaggcaggagaatcgcttgaacctagaaggcggaggttgcagtgagcggagattgtaccatggcactccagcctggacaacaagagcgaaattctgtctaaaaaaacaaaagtcccaattaagaacctccgaactctgttttgaggcaaaggggagtagttcttggtaggtgcaggaatagtagtgtcatttggaatactggtcatctttctgacatcacagtagaaaccaaaccttggatttagattcaaaaggggggaaatgggtcttttcatcaaggcaactccccttctccaagtcacttacatcatagataaattttagcttcccagtaactgagggatttgtttcctaacgccattggaggccttcatccctctctacgataaggttgcagaaatgggaagagctacccgtggttgcttttgattacccttaggaagtgagacagtgtttttgaaaatatgtatttcccccatttctccctctccttccctgacacttctctgggctgcacagcagaaacgttggtaaaagggcagtttggtttcaacacagcagacctgatatgggatcccttagccactttagtcaaacagccctgacagagtctataattgagttcaggccccccaccttgcctaataactgcaaatcgcatgttcagccagcagcctcctaagcccaccttcctcccccattagagaacacccatcctaggtgctctccaggctgtgtcattggcagggcttcacatgcaggaggcctctctcaggtgagtccaggttaaactgttgagttgtggcttcaacagatatgtatggcatgctgggatgtgccaggtgcctgcgttgtgccagttgctggagaggtagtgtgagcagagcagctgaaatcttgccatcaagcaaccctcattctcatgcctgtaggtttccattgctctgtcccaggacacttgcgtgccagagacgccacaacttcatgtccctgtctcttgcaagctccccgtgctgccagtacttcatgccttggatgtggtcccaccagcccagtggccggggtcagcttaggctctgcttcccagtggacgggtgtgctaagggtttattttatgtaaaaaaaaaaaaaaaaacaaaaaaaaaccctgagaccatgagtggggctggcatcttgccagcctgggcttcagggatgtttggggggggtggttagagggtagttgtagggtactttgtcacccccctccccctgccaccctccctggcacgtttatttcacagcagagccaagtctgtggcaggttgacacagactgtgttgccagagctgaaataattccacttcatcctatgagcgtgttgggctagcttgttctaattttggccactttggctgttttcttcagttttatgcattctctcctgccccaaagtgccaagccatttgtgaaggctctgccagacacctccaagcttgagagctcagcaccatgcaccaagagcaggagaaaagacgtaaacctaccccagcaactgtggcctctcgacagccctggctaactaacttacatttgtggggaagccaacagacacagcaggaggagagggaggtggcgctggtggaccaaggatctgtgctacccgctcccctccttggaggtgcagtgatgatgggagttatttttaccatccgggcgctgatagctgcactattaataaattgcatgtgttccttttgaaggtaggggatggttctgggtgagaggggagcaggctgagccggcgggggatctgctgtcctcccttttgagtcagttctaatcccatgtgtgtctgggccaccagaccgaaatggttgctgagaaacttgtctgttcatgtcccaaggcataacttcccaacatttaagaaaccccaatagacacctctgccctggccacgttcacagatccttctcttgaccggaaaccctgggaccctaagaacccctgaagcttggggtgggtgtgtgcttctggggtctcttttgggacctcctttgtcagtaccccttcttttttctaagcagctaataagaggttgggtgaaagagtgcatctcctcccaggattccacaacaaaattcttatcttccatggatgctttaattggaagtgggttgccgacccccttgtgcctagaaaaggccttcgcttgggtttcctttgtatgcttcagccttcctagttggtttttctaggcctggtgtgagaggtagggaagtctgcacataactaattcttttgcttaagggcctatggcacaagtgcacaaacttcaattcttgatgttctaagctctctcctctaacagagggagtgctgaaagcttttgagtcaagacaatggagtgctcttcctccctcactctgccttccgagcttatggttccttttctcaggagaggattttcaggattattggaggattaggtcattgtcagatgactggaaaacctaaataggatctctctccagctcaaggttgtcccagtgaggaagactttaccaacttctcactctaccccactactcacatgagtgttagctccaccttgcaaaggctgaagaccagttctccccagtgaaagctgcctcattcttttatggagttccctggagtggcagagctataaagacgagcattgggatttgcagtctccatgtagcctttcgtgcttggcaacccctgtagactttttgtcccaagcagattgcgtgcgtgcgcctgtgtgtgagaataagtgccttactttgctgtgtggttttcaacttgtactccgtggccagcccccagttgccagggctcgacggcagccaaggacaccatacctcagtatagttatatataaaagggacacggattgtgacagtttcaccccatttgtttctaaccccgctgcccaggattagggtctgtggtgtgttctgttttgtttttggtttctcccttgtgtcagttctcttctggcccagctgggtggctgtggaagtctgtgaggtggcccaaccacaagcatacctattaagagaagcccagagcttccagcccccacttcgaaaactctcctctggccccacatagcaaactccttctccgttattttccccacccccagattttttttaaaaggcccacttgccgtaacctcttttggtctattttgcttcccattcagcccaaagtttatatgataaaggtgtttacttttacttcccagtctccaagtgctaacacataaacacatacatgtctgactgttgcagaactgttcgagctcctaattcagtgttaccttgttttagtcgcagcaaccctctcccctaccccttgcccgcccacgtttttctcactcttccgggttgtgcaataactctcccagccagtggtcctttccacagcctttctgtcccttaaaacacctgcaactgggggagaaatgggacccatgggagggggagtcgtcatcccttacacaagaaatagccactttccttttgttgtcattcttgtgatcctgggtgggtttctgtggcactcttttagaacatgtagcatcatcttagaggtctatttttaaaaaatgtgttgaagaggaaaaaaccattctcacgatggggcttaagtcattgtccaggaataagattggcgtggtgcccatgacatcaccgtcactctgcctaaaagcactctagagctacttgttcacgtggagaggaaggatattttgcgaagcaacagccgcaggtggagagccctgttcacctgatagggtctagctgtgacagtaaatataataccgctgtttccttgggtacagatttgagtgttcatgtgatgagactgtaaacctcatttttcggttcctctgtttaaaaaaacatctgaaggatgaactaaggctgctggtgccctgagcaactgataatgcaaatgtggacaaagtgtctgttttctactctagcctgttcatatggaccaaatttcaacaaggaactcaaggaaaatttgtacctgccgtatttatgctttcatgtaaaaaagggttggggggaggggtgtctttttgcttttggtgaactttttttcaaaatcatttttccactgtttctgtctggttttaaaacaaattacagttttgtatggattttttaaatgtacattttggaacaaatgatcaaatattttctgaaataacaataaaaggcagaaaattatcagaaaaaaaaaa

SEQ ID NO: 62448 - DNA, 1815 bp, Homo sapiens
cacgccccgggccgggccgcagcctcctgggcttcgtgggggcagacccagcctttcccggcagcgagcgctcggccaggtgcactaggcgctgtgcgggccccccttccccgcggagccatggaggctgtggaactcgccagaaaactgcaggaggaagctacgtgctccatctgtctggattacttcacagaccctgtgatgaccacctgtggccacaacttctgccgagcctgcatccagctgagctgggaaaaggcgaggggcaagaaggggaggcggaagcggaagggctccttcccctgccccgagtgcagagagatgtccccgcagaggaacctgctgcccaaccggctgctgaccaaggtggccgagatggcgcagcagcatcctggtctgcagaagcaagacctgtgccaggagcaccacgagcccctcaagcttttctgccagaaggaccagagccccatctgtgtggtgtgcagggagtcccgggagcaccggctgcacagggtgctgcccgccgaggaggcagtgcaggggtacaagttgaagctggaggaggacatggagtaccttcgggagcagatcaccaggacagggaatctgcaggccagggaggagcagagcttagccgagtggcagggcaaggtgaaggagcggagagaacgcattgtgctggagtttgagaagatgaacctctacctggtggaagaagagcagaggctcctccaggctctggagacggaagaagaggagactgccagcaggctccgggagagcgtggcctgcctggaccggcagggtcactctctggagctgctgctgctgcagctggaggagcggagcacacaggggcccctccagatgctgcaggacatgaaggaacccctgagcaggaagaacaacgtgagtgtgcagtgcccagaggttgcccccccaaccagacccaggactgtgtgcagagttcccggacagattgaagtgctaagaggctttctagaggatgtggtgcctgatgccacctccgcgtacccctacctcctcctgtatgagagccgccagaggcgctacctcggctcttcgccggagggcagtgggttctgcagcaaggaccgatttgtggcttacccctgtgctgtgggccagacggccttctcctctgggaggcactactgggaggtgggcatgaacatcaccggggacgcgttgtgggccctgggtgtgtgcagggacaacgtgagccggaaagacagggtccccaagtgccccgaaaacggcttctgggtggtgcagctgtccaaggggaccaagtacttatccaccttctctgccctaaccccggtcatgctgatggagcctcccagccacatgggcatcttcctggacttcgaagccggggaagtgtccttctacagtgtaagcgatgggtcccacctgcacacctactcccaggccaccttcccaggccccctgcagcctttcttctgcctgggggctccgaagtctggtcagatggtcatctccacagtgaccatgtgggtgaaaggatagacacagaccgggggactcgggcactgctcctggctctgcagaaggtgtgggccttctgcttactgcaggccacctgccagggttctctggcatcacgctggcagccattagacacacaggggggtttctcaaattctaaatataattgtgattagaactgtcaaacattaagagggtatactgacagatgcttcctagaggaaacttttgaaagcccctgcgttctgagtggaccgatttctaaatccatacctacacacc

SEQ ID NO: 62449 - DNA, 1737 bp, Homo sapiens
cacgccccgggccgggccgcagcctcctgggcttcgtgggggcagacccagcctttcccggcagcgagcgctcggccaggtgcactaggcgctgtgcgggccccccttccccgcgaccctgtgatgaccacctgtggccacaacttctgccgagcctgcatccagctgagctgggaaaaggcgaggggcaagaaggggaggcggaagcggaagggctccttcccctgccccgagtgcagagagatgtccccgcagaggaacctgctgcccaaccggctgctgaccaaggtggccgagatggcgcagcagcatcctggtctgcagaagcaagacctgtgccaggagcaccacgagcccctcaagcttttctgccagaaggaccagagccccatctgtgtggtgtgcagggagtcccgggagcaccggctgcacagggtgctgcccgccgaggaggcagtgcaggggtacaagttgaagctggaggaggacatggagtaccttcgggagcagatcaccaggacagggaatctgcaggccagggaggagcagagcttagccgagtggcagggcaaggtgaaggagcggagagaacgcattgtgctggagtttgagaagatgaacctctacctggtggaagaagagcagaggctcctccaggctctggagacggaagaagaggagactgccagcaggctccgggagagcgtggcctgcctggaccggcagggtcactctctggagctgctgctgctgcagctggaggagcggagcacacaggggcccctccagatgctgcaggacatgaaggaacccctgagcaggaagaacaacgtgagtgtgcagtgcccagaggttgcccccccaaccagacccaggactgtgtgcagagttcccggacagattgaagtgctaagaggctttctagaggatgtggtgcctgatgccacctccgcgtacccctacctcctcctgtatgagagccgccagaggcgctacctcggctcttcgccggagggcagtgggttctgcagcaaggaccgatttgtggcttacccctgtgctgtgggccagacggccttctcctctgggaggcactactgggaggtgggcatgaacatcaccggggacgcgttgtgggccctgggtgtgtgcagggacaacgtgagccggaaagacagggtccccaagtgccccgaaaacggcttctgggtggtgcagctgtccaaggggaccaagtacttatccaccttctctgccctaaccccggtcatgctgatggagcctcccagccacatgggcatcttcctggacttcgaagccggggaagtgtccttctacagtgtaagcgatgggtcccacctgcacacctactcccaggccaccttcccaggccccctgcagcctttcttctgcctgggggctccgaagtctggtcagatggtcatctccacagtgaccatgtgggtgaaaggatagacacagaccgggggactcgggcactgctcctggctctgcagaaggtgtgggccttctgcttactgcaggccacctgccagggttctctggcatcacgctggcagccattagacacacaggggggtttctcaaattctaaatataattgtgattagaactgtcaaacattaagagggtatactgacagatgcttcctagaggaaacttttgaaagcccctgcgttctgagtggaccgatttctaaatccatacctacacacc

SEQ ID NO: 62450 - DNA, 1851 bp, Homo sapiens
cacgccccgggccgggccgcagcctcctgggcttcgtgggggcagacccagcctttcccggcagcgagcgctcggccaggtgcactaggcgctgtgcgggccccccttccccgcgagtccctcaagcgggaacctgcctcgtgtctcccaggagccatggaggctgtggaactcgccagaaaactgcaggaggaagctacgtgctccatctgtctggattacttcacagaccctgtgatgaccacctgtggccacaacttctgccgagcctgcatccagctgagctgggaaaaggcgaggggcaagaaggggaggcggaagcggaagggctccttcccctgccccgagtgcagagagatgtccccgcagaggaacctgctgcccaaccggctgctgaccaaggtggccgagatggcgcagcagcatcctggtctgcagaagcaagacctgtgccaggagcaccacgagcccctcaagcttttctgccagaaggaccagagccccatctgtgtggtgtgcagggagtcccgggagcaccggctgcacagggtgctgcccgccgaggaggcagtgcaggggtacaagttgaagctggaggaggacatggagtaccttcgggagcagatcaccaggacagggaatctgcaggccagggaggagcagagcttagccgagtggcagggcaaggtgaaggagcggagagaacgcattgtgctggagtttgagaagatgaacctctacctggtggaagaagagcagaggctcctccaggctctggagacggaagaagaggagactgccagcaggctccgggagagcgtggcctgcctggaccggcagggtcactctctggagctgctgctgctgcagctggaggagcggagcacacaggggcccctccagatgctgcaggacatgaaggaacccctgagcaggaagaacaacgtgagtgtgcagtgcccagaggttgcccccccaaccagacccaggactgtgtgcagagttcccggacagattgaagtgctaagaggctttctagaggatgtggtgcctgatgccacctccgcgtacccctacctcctcctgtatgagagccgccagaggcgctacctcggctcttcgccggagggcagtgggttctgcagcaaggaccgatttgtggcttacccctgtgctgtgggccagacggccttctcctctgggaggcactactgggaggtgggcatgaacatcaccggggacgcgttgtgggccctgggtgtgtgcagggacaacgtgagccggaaagacagggtccccaagtgccccgaaaacggcttctgggtggtgcagctgtccaaggggaccaagtacttatccaccttctctgccctaaccccggtcatgctgatggagcctcccagccacatgggcatcttcctggacttcgaagccggggaagtgtccttctacagtgtaagcgatgggtcccacctgcacacctactcccaggccaccttcccaggccccctgcagcctttcttctgcctgggggctccgaagtctggtcagatggtcatctccacagtgaccatgtgggtgaaaggatagacacagaccgggggactcgggcactgctcctggctctgcagaaggtgtgggccttctgcttactgcaggccacctgccagggttctctggcatcacgctggcagccattagacacacaggggggtttctcaaattctaaatataattgtgattagaactgtcaaacattaagagggtatactgacagatgcttcctagaggaaacttttgaaagcccctgcgttctgagtggaccgatttctaaatccatacctacacacc

SEQ ID NO: 62451 - DNA, 760 bp, Homo sapiens
gatggggcttttttccagatcttcgcgccgagagccggggacggccaacctgccggcatgcgataaaggccggggaatgtctagctggggccgcgctgagccgagtgcggacccgctttgtgtgcgcgtttgtttgtctccgctgcggtccgaaccgctgccgcgacccccgaggaggcggggcctccgcgcgcccggctccgcctggtgagggtttcacggcctctgctgccgccgccgccgccctcgtttgttccgttagatcgcgcagccccgaccgctgcacccggatcctagcaagccgggcgaggctgcccgggagccctcgatggccttcatttcacccaagcccgcttcttgctttccccggcgcttcccctcttttcctggttaacagcttatgggcggggagctcggcaaaactcagactaaaaacagaaaaagagaaaagaaaggacaaattcgatacacccgcgtcggtcctccagagtttgtgaaggggtgtaaacatgtcggagtctggggagatgagtgaatttggctacatcatggaattgatagctaaaggcaagatgccggattggagacgaggctaccgctgcagacagggctgtgggaagacgacggaacttgccacagcgacagacttctcccaaacaggaaataaaagtgggaagcattttaaaacctaaaaaaaaaaaaaaaaaaaaaaaaaaaaaaaaaaaaaaaaaaaaaaaaaaaaaaaaaaaaaaaaaaaaaa

SEQ ID NO: 62452 - DNA, 906 bp, Homo sapiens
gatggggcttttttccagatcttcgcgccgagagccggggacggccaacctgccggcatgcgataaaggccggggaatgtctagctggggccgcgctgagccgagtgcggacccgctttgtgtgcgcgtttgtttgtctccgctgcggtccgaaccgctgccgcgacccccgaggaggcggggcctccgcgcgcccggctccgcctggtgagggtttcacggcctctgctgccgccgccgccgccctcgtttgttccgttagatcgcgcagccccgaccgctgcacccggatcctagcaagccgggcgaggctgcccgggagccctcgatggccttcatttcacccaagcccgcttcttgctttccccggcgcttcccctcttttcctggttaacagcttatgggcggggagctcggcaaaactcagactaaaaacagaaaaagagaaaagaaaggacaaattcgatacacccgcgtcggtcctccagagtttgtgaaggggtgtaaacatgtcggagtctggggagatgagtgaatttggctacatcatggaattgatagctaaaggcaaggcttcagcaatgggcctgcagcaaacccatgagcattcccggttgacttctaaaggtggagaggcccgctgtccctttgaaatctctgaggttggaaagcagtctctcccaagaagaacttaggacaattcctctctctgttttgtgggggttggagggggagagttggtctggagtaggctcctaaccatttcaacgtaagcttatttcctaccactctcctcaggctcaaatcctgccccgccccgcagccccagcactagcccatttaagacccctgttttgtgtgtgattatacaggatttgaacactgaatattaaccatggaatagca

SEQ ID NO: 62453 - DNA, 2538 bp, Homo sapiens
aatgccagcctatgagcttcctggtagggacaccagctgtgaagtcctcataacagccaacttcttgcaactttcaagctgacggcctcaggaatgggaggaaggactcctccactggagaactgatagcagtattctggtagaggaggcatcaagagtcctgggaggccggtggtaatcatgtaggcaccatggaaactgctatgtgcgtttgctgtccatgttgtacatggcagagatgttgtcctcagttatgctcctgtctgtgctgcaagttcatcttcacctcagagcggaactgcacctgcttcccctgcccttacaaagatgagcggaactgccagttctgccactgcacctgttctgagagccccaactgccattggtgttgctgctcttgggccaatgatcccaactgtaagtgctgctgcacagccagcagcaatctcaactgctactactatgagagccgctgctgccgcaataccatcatcactttccacaagggccgcctcaggagcatccatacctcctccaagactgccctgcgcactgggagcagcgatacccaggtggatgaagtaaagtcaataccagccaacagtcacctggtgaaccacctcaattgccccatgtgcagccggctgcgcctgcactcattcatgctgccctgcaaccacagcctgtgcgagaagtgcctgcggcagctgcagaagcacgccgaggtcaccgagaacttcttcatcctcatctgcccagtgtgcgaccgctcgcactgcatgccctacagcaacaagatgcagctgcccgagaactacctgcacgggcgtctcaccaagcgctacatgcaggagcacggctacctcaagtggcgctttgaccgctcctccgggcccatcctctgccaggtctgccgcaacaggcgcatcgcttacaagcgctgcatcacctgccgcctcaacctgtgcaacgactgcctcaaggccttccactcggatgtggccatgcaagaccacgtctttgtggacaccagcgccgaggaacaggacgagaagatctgcatccaccacccatccagccgcatcatcgagtactgccgcaatgacaacaaattgctctgcaccttctgcaagttctctttccacaatggccacgacaccattagcctcatcgacgcctgctccgagagggccgcctcactcttcagcgccatcgccaagttcaaagcagtccgatatgaaattgataatgacctaatggaattcaacatcttaaaaaacagctttaaagctgacaaggaggcaaagcgaaaagagatcagaaatggctttctcaagttgcgcagcattcttcaggagaaagagaagatcatcatggagcagatagagaatctagaagtgtccaggcagaaggaaattgaaaaatatgtgtatgttacaaccatgaaagtgaacgagatggatggtctgatcgcctactccaaggaagccctgaaggagactggccaggtggcattcctgcagtcagccaagatcctggtggaccagatcgaggacggcatccagaccacctacaggcctgacccacagctccggctgcactcaataaactacgtgcccttggactttgttgagctttccagtgccatccatgagctcttccccacagggcccaagaaggtacgctcctcaggggactccctgccctccccctaccccgtgcactcagaaacaatgattgccaggaaggtcactttcagcacccacagcctcggcaaccagcacatataccagcgaagctcctccatgttgtccttcagcaacactgacaagaaggccaaggtgggtctggaggcctgtgggagagcccagtcagccacccccgccaaacccacagacggcctctacacctactggagtgctggagcagacagccagtctgtacagaacagcagcagcttccacaactggtactcattcaacgatggctctgtgaagaccccaggcccaattgttatctaccagactctggtgtacccaagagctgccaaggtttactggacatgtccagcagaagacgtggactcttttgagatggaattctatgaagtcattacttctcctcctaacaacgtacaaatggagctctgtggacaaattcgggacataatgcagcaaaatctggagctgcacaacctgacccccaacacagaatacgtgtttaaagttagagccatcaatgataatggtcctgggcaatggagtgatatctgcaaggtggtaacaccagatggacatgggaagaaccgagctaagtggggcctgctgaagaatatccagtctgccctccagaagcacttctgagccccttcagagcaggaaacaacctcagactcatcacaaagtagacatatacacacacatatatgtatgtatatttttctcaccacattcttcaaggaggttgtagacaaatgtttccatgacctctcagctttccaacaggaatcttgtaagagctaataaaaggaaatacctg

SEQ ID NO: 62454 - DNA, 932 bp, Homo sapiens
caaaaaggagaccagacaggaggcgtctgtagagatatcatgaacttcaacttagctttgttttccagagactggagctaaactgggctttcaacatcatcatgaagtttatcctcctctgggccctcttgaatctgactgttgctttggcctttaatccagattacacagtcagctccactcccccttacttggtctatttgaaatctgactacttgccctgcgctggagtcctgatccacccgctttgggtgatcacagctgcacactgcaatttaccaaagcttcgggtgatattgggggttacaatcccagcagactctaatgaaaagcatctgcaagtgattggctatgagaagatgattcatcatccacacttctcagtcacttctattgatcatgacatcatgctaatcaagctgaaaacagaggctgaactcaatgactatgtgaaattagccaacctgccctaccaaactatctctgaaaataccatgtgctctgtctctacctggagctacaatgtgtgtgatatctacaaagagcccgattcactgcaaactgtgaacatctctgtaatctccaagcctcagtgtcgcgatgcctataaaacctacaacatcacggaaaatatgctgtgtgtgggcattgtgccaggaaggaggcagccctgcaaggaagtttctgctgccccggcaatctgcaatgggatgcttcaaggaatcctgtcttttgcggatggatgtgttttgagagccgatgttggcatctatgccaaaattttttactatataccctggattgaaaatgtaatccaaaataactgagctgtggcagttgtggaccatatgacacagcttgtccccatcgttcacctttagaattaaatataaattaactcctcaaaaaaaaaaaaaaaaaaaaaaaaaaaa

SEQ ID NO: 62455 - DNA, 3044 bp, Homo sapiens
caggtatctaacctatctttgtatttttggaatttaatatagttcctgacataatcattgttcaatgggtctaatttttttttcctttaaaggcatttggatacctttgtgatagaaaaggcccttttcttcatccattgatggtttgatagtgggctgggaaggaaagctgtgttcctccacattaggcagcaaatacttgattgatttgatatttagcttagtcaaattgaagatctcaaacagacaaatcatggcttggaagaatgtgttaggaaactcttggatagtaaggaggtggtaagcagtcaagtagatgatttaaccagccacaatgagcatctttgtaaagaattgattaaaattgaccaactagcagagcaactcgaaaaagagaaaaattttgtggtggattccgccaacaaggaacttgaagaagccaagattgatctcatttgccagcaaaataatattatagtattggaagatacaataaaaaggcttaaatctataattttagatactgaaaaagcacaaaataaatctccttctagacttgattcctttgtcaagactttggaagcagacaaagatcactataagagtgaagctcaacatttgagaaagatgatgcgaagtaggtctaaaagtccaagacgcccatcaccaactgcccggggtgcaaactgtgatgtagaacttttgaagacaacaacaagagatcgtgaagaacttaaatgcatgctggaaaaatatgagcgccatttggcagaaattcagggtaatgtcaaggttcttaaatctgagagagacaagatcttccttctttatgaacaggcacaggaagaaattacccgacttcgacgagaaatgatgaaaagctgtaagagtcctaaatcaacaacggcacatgctattctccggcgagtggagactgaaagagatgtagcctttactgatttacgaagaatgaccacagaacgagatagtctaagggagaggctaaagattgctcaagagacagcatttaatgagaaggctcacctggaacaaaggatagaggagctggagtgtacagttcataatcttgatgatgaacgtatggagcaaatgtcaaatatgactttgatgaaggaaaccataagcactgtggaaaaagaaatgaaatcactagcaagaaaggcaatggataccgaaagtgaacttggcagacaaaaagcagagaataattctttgagacttttgtatgaaaacacagaaaaagatctttctgatactcagcgacaccttgctaagaaaaaatatgagctacagcttactcaggagaaaattatgtgcttggatgaaaaaattgataactttacaaggcaaaatattgcacagcgagaagaaatcagcattcttggtggaaccctcaatgatctggctaaagaaaaggaatgcctgcaagcatgtttggataaaaaatctgagaatattgcatcccttggagagagtttggcaatgaaagaaaagaccatttcaggcatgaagaatatcattgctgagatggaacaggcatcaagacagtgtactgaggccctaattgtgtgtgaacaagacgtttccagaatgcgtcggcaattggatgagacaaatgatgagctggcccagatcgccagggaaagagatatcttggctcatgacaatgacaatctccaggaacagtttgctaaagctaaacaagaaaaccaggcactgtccaaaaaattgaatgacactcataatgaacttaatgacataaaacagaaggttcaagatactaatttggaggttaacaagctgaagaatatattaaagtctgaagaatctgagaaccggcaaatgatggaacaacttcgaaaagccaatgaagatgctgaaaactgggaaaataaagcccgtcaatcagaggcagataacaataccctcaaactggaacttatcactgctgaggcagagggtaacagattaaaagaaaaagtagattccctcaacagagaggttgagcaacacttaaatgcagaaaggtcttacaagtcccagatttctaccttacataaatctgttgtaaaaatggaagaggagcttcagaaggttcagtttgaaaaagtgtccgctcttgcagatttgtcttctactagggaactctgtattaaacttgactcaagcaaagaacttcttaatcgacagctggttgctaaagatcaagaaatagaaatgagggagaatgagttagattctgctcattctgaaattgaactcctgaggagtcagatggcaaatgagagaatctccatgcagaatctagaagctttgctggtggccaatcgagacaaagaatatcagtctcagatagcacttcaagaaaaagaatctgaaattcagcttcttaaagaacacctttgtttggcagaaaataaaatggccatccagagtagagatgtggcccagttcagaaatgttgtcacacaattggaagctgatttagacattaccaaaagacaactaggaacagagcgctttgaaagggagagggccgtacaagaacttcgccgccaaaattattcaagtaatgcttatcatatgagttctacaatgaagccaaatacaaaatgtcattcaccagaacgtgctcaccatcgatctcctgaccgaggcctagatcgatcattagaagagaatctttgctacagagatttctgacacctgaaatgattcttcacatccctgagaaaggtcaaagttacaaactgattttttttttttttgctacatgagtgcatttatcttttaaatgcttggcaatgttaaatgtatttattaactttgtgtctctgaatctctgttctaatgtgccatgttgcagtgatctgagatgacttataaaaacaaaaatgtatatggctctttctatccatgcagtgatagtgagtgtaaaatctgcttacttcactattgaacactattctgttcactatctggagtaaataaagaagcttattaaaacagggaaaaaaaaaaaa

SEQ ID NO: 62456 - DNA, 3050 bp, Homo sapiens
agcgggggtgcgcctgcgcggcgcggatgggccaggaaggggtccctcctaggtgccctgtaaggcaggcaggtagacgtacgcgtcgctccgtgcgtaggagcgcgcgcacggcttgtagaccccgcgagaaggaaggtcgagccaggttaccaccaaagaatatgattttggtctaggggctccagtttctgaagctgaaaactaccagaatactctccagctagaacaagaagtgagaaaccaagatagattcatctcgacactgaaattacagattgaagatctcaaacagacaaatcatggcttggaagaatatgttaggaaactcttggatagtaaggaggtggtaagcagtcaagtagatgatttaaccagccacaatgagcatctttgtaaagaattgattaaaattgaccaactagcagagcaactcgaaaaagagaaaaattttgtggtggattccgccaacaaggaacttgaagaagccaagattgatctcatttgccagcaaaataatattatagtattggaagatacaataaaaaggcttaaatctacttgattcctttgtcaagactttggaagcagacaaagatcactataagagtgaagctcaacatttgagaaagatgatgcgaagtaggtctaaaagtccaagacgcccatcaccaactgcccggggtgcaaactgtgatgtagaacttttgaagacaacaacaagagatcgtgaagaacttaaatgcatgctggaaaaatatgagcgccatttggcagaaattcagggtaatgtcaaggttcttaaatctgagagagacaagatcttccttctttatgaacaggcacaggaagaaattacccgacttcgacgagaaatgatgaaaagctgtaagagtcctaaatcaacaacggcacatgctattctccggcgagtggagactgaaagagatgtagcctttactgatttacgaagaatgaccacagaacgagatagtctaagggagaggctaaagattgctcaagagacagcatttaatgagaaggctcacctggaacaaaggatagaggagctggagtgtacagttcataatcttgatgatgaacgtatggagcaaatgtcaaatatgactttgatgaaggaaaccataagcactgtggaaaaagaaatgaaatcactagcaagaaaggcaatggataccgaaagtgaacttggcagacaaaaagcagagaataattctttgagacttttgtatgaaaacacagaaaaagatctttctgatactcagcgacaccttgctaagaaaaaatatgagctacagcttactcaggagaaaattatgtgcttggatgaaaaaattgataactttacaaggcaaaatattgcacagcgagaagaaatcagcattcttggtggaaccctcaatgatctggctaaagaaaaggaatgcatgcaagcatgtttggataaaaaatctgagaatattgcatcccttggagagagtttggcaatgaaagaaaagaccatttcaggcatgaagaatatcattgctgagatggaacaggcatcaagacagtgtactgaggccctaattgtgtgtgaacaagacgtttccagaatgcgtcggcaattggatgagacaaatgatgagctggcccagatcgccagggaaagagatatcttggctcatgacaatgacaatctccaggaacagtttgctaaagctaaacaagaaaaccaggcactgtccaaaaaattgaatgacactcataatgaacttaatgacataaaacagaaggttcaagatactaatttggaggttaacaagctgaagaatatattaaagtctgaagaatctgagaaccggcaaatgatggaacaacttcgaaaagccaatgaagatgctgaaaactgggaaaataaagcccgtcaatcagaggcagataacaataccctcaaactggaacttatcactgctgaggcagagggtaacagattaaaagaaaaagtagattccctcaacagagaggttgagcaacacttaaatgcagaaaggtcttacaagtcccagatttctaccttacataaatctgttgtaaaaatggaagaggagcttcagaaggttcagtttgaaaaagtgtccgctcttgcagatttgtcttctactagggaactctgtattaaacttgactcaagcaaagaacttcttaatcgacagctggttgctaaagatcaagaaatagaaatgagggagaatgagttagattctgctcattctgaaattgaactcctgaggagtcagatggcaaatgagagaatctccatgcagaatctagaagctttgctggtggccaatcgagacaaagaatatcagtctcagatagcacttcaagaaaaagaatctgaaattcagcttcttaaagaacacctttgtttggcagaaaataaaatggccatccagagtagagatgtggcccagttcagaaatgttgtcacacaattggaagctgatttagacattaccaaaagacaactaggaacagagcgctttgaaagggagagggccgtacaagaacttcgccgccaaaattattcaagtaatgcttatcatatgagttctacaatgaagccaaatacaaaatgtcattcaccagaacgtgctcaccatcgatctcctgaccgaggcctagatcgatcattagaagagaatctttgctacagagatttctgacacctgaaatgattcttcacatccctgagaaaggtcaaagttacaaactgatttttttttttttgctacatgagtgcatttatcttttaaatgcttggcaatgttaaatgtatttattaactttgtgtctctgaatctctgttctaatgtgccatgttgcagtgatctgagatgacttataaaaacaaaaatgtatatggctctttctatccatgcagtgatagtgagtgtaaaatctgcttacttcactattgaacactattatgttcactatctggagtaaataaagaagcttattaaaacagaaaaaaaaaaaaaaaa

SEQ ID NO: 62457 - DNA, 1726 bp, Homo sapiens
agttctacggtgcggatgggggatggggcaggatggggcaggacaccgatatgctaaatacctaccaacagttggttaggaccccgtcggtgcgaccagggcaggacgtgcggctccaggctccaggaaccagaacggggctgctcaagctgctgtcgaccgtctctcaggacaagcagggctgcctggggagtggtgatggtgtgccaaatcaagacctgcagcagaggcctcagagctcaaggcagacagcaaagaaggaccgcaagcccaggggccagagcaagaaaggacagggctctgaagagtctgaagatcacttcccgcttcttcctcggaaaccctccttccccttccagtgggcctgggagagcatcgccacagatgtccgggctgtgcttcagccaagctccccaacccctggccaccaagccctgcccatgccctcctcgttctcccagcgtcagtccaggcgcaagtccacggccaacctcccagaggcccatggctgctgctggaagacagaggcgcaaaacctgaaggcgagacagcagctgggagcctggggcggtgtctccatccctactggcaaaggggagctaggatcagagccccccagtggtctccagctgcctgggaggaggccaggatcaggatcggcgtccgacaagcaggtccagctgcaaagcctgggtgctgaggaggccgagaggggtctgagttctggggtgctgccccagcgccccaggagggggtcgatctcagaggaggagcaattttcagaggccacagaggaggctgaggagggagagcacaggactccctgcagaaggagggctggttgtcagagaaaggggcagatttctggagaggaagcctccgatgagggagaagtgcagggccagagccaggggagcagccccagcttcaacaacctccgaaggcgacaatggaggaagacaagggccaaggagctgcaggggccatgggacctggagaagctgcacaggcagctacagagagacctggactgtggcccccaaaagctgccctggaagactttgagggctgccttccaggcctccaagcggaatggaaaggcctatgcctcgggatacgatgaaactttcgtgtctgccaacctccctaatcgcaccttccacaaacgacaggaagccaccaggagcctgctgcaggcctgggagcggcagcggcaggaggagcggcagcaggccgagctgcggcgggcccggacacagcatgtacagcggcaggtggcccactgcctggcagcctacgcacccagagggagccggggccctggggcggcccagcgcaagctggaggagctgaggcgccaggagcgacagcgctttgctgagtaccaggcggagctgcaaggcatccagcacagggtgcaggcccggcccttcctgttccagcaggctatgcaggccaatgcccggctcaccgtcactcggcgcttctcccaggtgctgtcagcactggggctggatgaggagcagctgctgtctgaggcaggaaaggtggacagagagggcacccccaggaaacccaggagccacaggtcaatgggggtgagaatggagcactctcctcagaggcccccaaggacagaacccaccggcagccagcctgacaggcactacaaccccagcctggacccggagtgcagtccctgagataaaattaaaggctttatggc

SEQ ID NO: 62458 - DNA, 1700 bp, Homo sapiens
cacaaattccctctgtctcctccagaatccagaaaagaataattacaatattttcaaaatggaaagttcccatgccaaagagtttgccttcttcaccaaactatgatttcgtgatgttcttaaaggtagtgtacaccaggtttttacattcttattttgaatgtagttttagtgtttgtgtgatttgtttttcagcctggcctgcagactagcaacccaagacttatactgcccaatttgacagctcatttttattttagtttcaccatatacatgaattggacttacaattccagaaaaattaaaggctcaagaatggggcatgagtacacactgtgtgctaaggaaagaatatttggattgaattgaacccctgcagaacgtggactatttagagacctgaatttggccttgggtgaatacctgccttgggttggccaactagcagtcaacagcaatgagccaaaagagacaaaccaagtttcaaaatggcaaatcaaagacttcagaaaatagctcagctaaacgtgagaaaggaatggttgtcaatagcaaagagatttctgatgcagtcgggcaatcaaaatttgttctagagaaccttcggcattacacagtccatccaaatttggcccagtactataagcctttgaaggccactgccctgcagaaattcctggctcaaaacaggaaaaacaccagcttcatgttaaaagtaacacagtatgaccaggataagacgttactgattatgaccaacaacccacctccctgctcaatcacccagcaagacaaggagagtgcatcaaaatatttttccaaggagttactgctcaaggtcatggaaagtcatcatcagcacaaacccactgagaacctctggctgccccgcatgcctcagaaaaaaaagttaagatctaagctgaaaccaatcttccctttgatactgtcggatgatcccacatccaagcgagaacaatggtttaggttttccactgacaatgatttcaagagcgaagggaagtattcaaaagtctacgctttgaggacacagaagaaaatgtaccctcagctcacctttgctccagtccatgagagagatatgaggaaagatgcttccaagaagtcagcgagtgaaaggccaatttccaaagtgattcgggaaccactgacactcgcatcgctcttggaagacatgcccaccagaaccgcgcccggggagagcgccttccgcaacgggagggccccgcagtggattatcaaaaaggccacggtcatcgggtgaacacagacccctcagtcctcccgcctcgctctcttgagactgaggggtccgcagaagtcgccacccaaataaaaccacattcctgctgctgcgggcgtgggctcccgggtcgcaagccgggagggtcgagccgaagtctccggcgggccgcaagaggagaagggggcgtggctgcgtcccgggggccgagggcggccggggagggcgggccttggccccgagtgaaggcgcggcggcccaaccggcgtgagagcgcggggccggccttcctgcagcctcttccgctcgccggctgcggcgcctgggacggttgcggtgggtctgggcgctgggaagtcgtccaagatgattaaaaaattcgacaagaaaaaaaaaaaaaaaaaaaaaaaaaaaaaaaaaaaaaaaaaaaaaaaaa

SEQ ID NO: 62459 - DNA, 1040 bp, Homo sapiens
tggacaaccatcagggagccaggacacagaggggcagagcaagtcagcattggcgccccttcctcagatccctatcatcttgggaaacagtagcccagaggttcaggaagatgttaacttaaatgttcggggtgccccagtctgttcagcatggctgaaatccacactccgtattcttccttgaagaaactgttatctttactcaatggcttcgtggctgtgtctggcatcatcctagttggcctgggcattggtggtaaatgtggaggggcctctctgacgaatgtcctcgggctgtcctccgcatacctccttcacgttggcaacctgtgcctggtgatgggatgcatcacggtactgcttggctgtgccgggtggtatggagcgactaaagagagcagaggcacgctcttgttttgcatcctgtcaatggttattgtcctcatcatggaagttacagctgccacagtggtccttcttttctttccaattgttggagatgtggccttggaacacaccttcgtgaccctgaggaagaattacagaggttacaacgagccagacgactattctacacagtggaacttggtcatggagaagctaaagtgctgtggggtgaataactacacagatttttctggctcttccttcgaaatgacaacgggccacacctaccccaggagttgctgtaaatccatcggaagtgtgtcctgtgacggacgcgatgtgtctccaaacgtcatccaccagaagggctgtttccataaactcctaaaaatcaccaagactcagagcttcaccctgagtgggagctctctgggagctgcagtgatacagaggtgggggtctcgctatgttgcgcaggctggtcttgaactgctggcctaaagcgatccccccgcctaggcctcccaaagtgctgggtttaccagcgtgagccaccacgctgggcttcctgcatccttttaaggttcctgagggtctgcctgagaggagctgtccctgaatctccatgcagccccacctgccacatcaccaag

SEQ ID NO: 62460 - DNA, 3080 bp, Homo sapiens
gacgctacctacctctggcctggcctctacccactgctgccctggccgctaccaacatgagcctcccggagagtcctcacagccccgctactctcgactatgctctggaagacccgcaccagggccagaggtcccgagaaaagagcaaggcgacagaggtaatggcagatatgtttgatggccgcttggagccaatcgtgttcccaccgccccggcttccagaggagggggtcgcgccccaggatcccgcagatggtggccatactttccacatcttggtcgatgcgggtcgcagtcatggagccatcaaagcggggcaggaagtgactccaccacccgcggagggcctagaagcggcctctgcctcgctgacaactgacagcagcctcaaaaatggctttccgggtgaagagacgcacggcctaggtggggagaaggctctagaaacctgtggggcagggaggtcggagtctgaagtgattgcagaggggaaggccgaggacgtgaagcctgaggagtgtgccatgttctcagccccagtggatgagaagccaggaggcgaagaaatggacgtggcggaagaaaacagagcaatagatgaggtaaacagggaggcagggcctgggcccgggcccgggcccctgaacgtgggtctccacctgaaccccctggagtccatccagctggaactggactccgtgaatgcagaggctgacagggcgctcctgcaggtggagcgcaggtttgggcagattcatgaatactacctggagcagaggaatgacatcatttgcaatatcccgggcttctgggtcactgctttccgccaccacccacagctgtctgccatgattagaggccaagatgccgagatgttaagctacttaaccaatttggaagtgaaggagctcagacaccctaggacaggctgcaagtttaagttcttctttcaaagaaacccttacttcagaaacaagctgattgtaaaggtgtatgaggtcagatccttcggccaagtggtgtctttttccactctaatcatgtggcgccggggccatggaccccagtccttcattcataggaaccgacatgtcatctgcagcttcttcacctggttttcagaccacagccttccagagtccgacaggattgctcagattattaaagaggacctctggtcaaatccactgcagtactacctgttgggtgaagacgcccatagagctagacgtcgcctggtaagggagccagtggagatccccaggccctttgggttccagtgtggttaacctttgcctttggaattactcctgcagaaggttgcctgccaccaccagctggacctgagcttgggcaacagcattaggtatgccctttactttttttgttctgactttcctgtaccctctgtttaaactttccgttctctcaacctgaagattgagaccttggtggctgtgctgctcccctttcacctggtcgtcttgctattctgcattaacatcacatgctcccagccgatgggtcacatccttctaagcgaagcgaatgatgctgtaggttacactgtatttacctttgtttggactcggtttgttcccaggacctctggtctggctcctcctacttggatttctagctgtgtctaagaacctattcagctcaccctgctctgcatctgacagtacaggtgcatggcctgtggacaattgctgggcattaatgaagtcaagggagaacagcagggggcaacttggtctgtgtgaattatgggaccccattacttttcctgagactggtcacctattgctgcctgctactggctattcccaagtactgctacttgggcagctccctgctgagtgaacatatcccagaccattgccagctccactctctggtttctaataaacagggatctccagaacactggtggtggacacagctttcctgtcagcacacaaaagacctgttcctcttccaaaagacctctctttaccaccaccaccctcatcactcagaaaccctactgtttgttagacaggtggttgaggggacatgtcagaccctatcctcatggcaaggttaatatgttggtgttcttgacaagtaccaggctttctcagccacaaccagtggattcattcaaaatctaggtacctttatttgcctcccttcctgaacctaatgaagtgccagagtgagtgtacactttcttttctctcatctctcataaatctcttctgtcttcctttaaaaaaaacaaaagtagtagttcagaaacatccgcagaagcaggctttttagtttcttggctctctttgtcatgtccagaggcaggctgttctgtaaaatagactgccagacctcttattgcccattctcctttcttctcagcccctcacccctctttagcaattcctagagggtttaaaggactacagagctgtatggaatgaaaggtgatttctagttcagagtggatagaagaactaaagagattgtgatgggtgctctaggcagggaaaactgaacaaaaaggcagaaatgattcaggggaaaatcgggcctagaatttacactgggttgactagttatgatgggaagagaagtacttttttttagtatgcacgtagaagaatagaagatggttggagtgttaaatatgttccctagagaagggttctttgaagaaacactgcaattttgggtgttctctttcttgtttgcatatggccttacttatgtggaagattaatactgtgttataatattttctctttctgtttactgggaagattcagctgtacagattttcttttactttcaaatagaaatatttggaataatatcagtctttcttttttgtacattatgtggatatggatattcatggcagttttcagcctgttcttgtttctgttaaagccgtatctttaacattttaatttgaataacttggtcttacctgatgctgaagactggaaactattgtgttcatgggtaaataaattacaaaatattaaaaaaaaaaaaaaaaaaaaaaaaaaaaaaaaaaaaaaacaaaaaaaaaaaaaaaa

SEQ ID NO: 62461 - DNA, 2012 bp, Homo sapiens
agggggcaggaacagcaggcctggccagcccaaaggactctctatccaggatgtaaatgagcacactgctggcccatgcgcctcggggctgtagagggcagcctcagaggcactgggcattcctggcaccatggatgacgctgctgtcctcaagcgacgaggctacctcctggggataaatttaggagagggctcctatgcaaaagtaaaatctgcttactctgagcgcctgaagttcaatgtggcgatcaagatcatcgaccgcaagaaggcccccgcagacttcttggagaaattccttccccgggaaattgagattctggccatgttaaaccactgctccatcattaagacctacgagatctttgagacatcacatggcaaggtctacatcgtcatggagctcgcggtccagggcgacctcctcgagttaatcaaaacccggggagccctgcatgaggacgaagctcgcaagaagttccaccagctttccttggccatcaagtactgccacgacctggacgtcgtccaccgggacctcaagtgtgacaaccttctccttgacaaggacttcaacatcaagctgtccgacttcagcttctccaagcgctgcctgcgggatgacagtggtcgaatggcattaagcaagaccttctgtgggtcaccagcgtatgcggccccagaggtgctgcagggcattccctaccagcccaaggtgtacgacatctggagcctaggcgtgatcctctacatcatggtctgcggctccatgccctacgacgactccaacatcaagaagatgctgcgtatccagaaggagcaccgcgtcaacttcccacgctccaagcacctgacaggcgagtgcaaggacctcatctaccacatgctgcagcccgacgtcaaccggcggctccacatcgacgagatcctcagccactgctggatgcagcccaaggcacggggatctccctctgtggccatcaacaaggagggggagagttcccggggaactgaacccttgtggacccccgaacctggctctgacaagaagtctgccaccaagctggagcctgagggagaggcacagccccaggcacagcctgagacaaaacccgaggggacagcaatgcaaatgtccaggcagtcggagatcctgggtttccccagcaagccgtcgactatggagacagaggaagggcccccccaacagcctccagagacgcgggcacagtgagcttcttgcggcccagggaatgagatggagctcacggcttaaagcccaagctctgaagaagtcaagggtggagccagagaaggaaggcagtcccagatgagcctctattttcatcagcttcttctctctccccttgaacttggtaacccacatggttctcccgtggcccctaggtggatgaggccaaagtcaaatccaaggctgagacagtcgtgcgactcctactcccccagagcgtgacccggagcaggtgctggacacagagcctgtctcagcagagggtccccactggccgcaacggctcagtgacagcaagagcaggaagagcagcaggaaggcaccgctgtccaccttgggcaccatttatcctcctttcatcgtccccggggcagttgcgtgaccctgctgggaggccagaccaggccagactgagggtcaggggaccaggctgggttgggggttgggtggggctggacggggacgaggcgcggagaggaggcgggaaagagcttcggctgggccacgggctcgcgggcactctcggcggcagcctcgggggctccgactccagctctgggcaagatccataaacttttaaagaagcctcaaaacatacttttaaagcattaagctttaaagtgctagaaatcttgtgccccatatgtgcttctttcagtattatcctagatcctcaggagtagcatggcaactggagaaaatgggaggaaagacaagaagaaatagaagctgatttaacaccaaaaaaaaaaaaaaaaaa

SEQ ID NO: 62462 - DNA, 1330 bp, Homo sapiens
ggggggcgcagcaggccagggcaacccgccgcgaggcggcgtccacgccgaggagccgcgcattcccggtccacacagacgcggcggagcgccctcccaggcgggactacaactcaatgcctggcacgggggcgggctcggcggtgacttaatccgggctgagtttggtggtggtagtgagggcaggtaggggcactgcccattttggccaagggtcacacagcatctacatcacaattgcaccggagtttaaaaatgtctggccctgtccctccccaccacccgccgctgtgtccagacagagaatgttctaacgctgggggcggctgcggatgaagtccttggggagaaaaggagcaggccaagggcgatggtggagtagagctgcctctcagaggcagcatgagctgagagggtgataggaaggcggcgctagacagcatggaggactttctgctctccaatgggtaccagctgggcaagaccattggggaagggacctactcaaaagtcaaagaagcattttccaaaaaacaccaaagaaaagtggcaattaaagttatagacaagatgggagggccagaagagtttatccagagattcctccctcgggagctccaaatcgtccgtaccctggaccacaagaacatcatccaggtgtatgagatgctggagtctgccgacgggaaaatctgcctggtgatggagctcgctgagggaggggatgtctttgactgcgtgctgaatggggggccactgcctgaaagccgggccaaggccctcttccgtcagatggttgaggccatccgctactgccatggctgtggtgtggcccaccgggacctcaaatgtgagaacgccttgttgcagggcttcaacctgaagctgactgactttggctttgccaaggtgttgcccaagtcacaccgggagctgagccagaccttctgcggcagtacagcctatgctgcccccgaggtgctgcagggcattccccacgatagcaaaaaaggtgatgtctggagcatgggtgtggtcctgtatgtcatgctctgtgccagcctaccttttgacgacacagacatccccaagatgctgtggcagcagcagaagggggtgtccttccccactcatctgagcatctcggccgattgccaggacctgctcaagaggctcctggaacccgatatgatcctccggccttcaattgaagaagttagttggcatccatggctagcaagcacttgataaaagcaatggcaagtgctctccaataaagtagggggagaaagcaaacccaaaaacccgcttctaaaaaaaaaaaaaaaaa

SEQ ID NO: 62463 - DNA, 5613 bp, Homo sapiens
agcaggtgctggcacaagagcagcggcttgggggagccggcagcagcagtaacagcagcagcagccgccgccgccgccgccagtaaacgcggacggtaccccaggggactacccagccggccggccctggaagccgcgctcgggtcccgccgcagtcggcggtgggggatgggcaggcagtggcggtcccgcctgccgagggttaacccccgccggtcccggtcctgagctggaccagagccctcctccagaaacccctgcgtccgccacggcccaggttaaatggaaaccacccttgggaactggatgcctgtgtagctgttctaccatatcagtgtattgcaatgagtgggggaggagagcagctggatatcctgagtgttggaatcctagtgaaagaaagatggaaagtgttgagaaagattgggggtgggggctttggagaaatttacgatgccttggacatgctcaccagggaaaatgttgcactgaaggtggaatcagctcaacaaccaaaacaagttctgaaaatggaagttgctgttttgaaaaagctgcaaggaaagaccatgtttgtagatttattggctgtgggaggaatgatcgattcaactatgtggtcatgcagttgcagggtcggaatctggcagatcttcgccgtagccagtcccgaggcacattcaccattagtaccactctccggctgggtagacagattttggagtctattgaaagcattcattctgtgggattcttgcatcgagacatcaaaccgtcgaacttcgctatgggtcgctttcctagtacatgtaggaaatgttacatgcttgattttggcttggctcgacaatttaccaattcctgtggtgacgtcagaccacctcgagctgtggcaggttttcgagggacagttcgttatgcatcaatcaacgcacatcggaacagggaaatgggaagacatgatgacctttggtccttattctacatgttggtggagtttgtggttggtcagctgccctggagaaaaataaaggacaaggagcaagtaggctctattaaggagagatatgaccacaggctcatgttgaaacatctccctccagaattcagcatctttctagaccatatctcttctttggattattttacaaaaccagactaccagatgtccatcagggtgacccggaagtcctacaaggtgtccacctctggcccccaggcctttaacagcctctcctacacgagtgggcctggtgcctgcatcagctcctcgagcttctcccgaatgggcagcagcagcttccggggtggcctgggtgcaggatatggtggggccagtggaggcatcaccaccatcactgtcaaccaaagcctgctgagccctcttaacctggaggtggaccccaacatccaggccgtgcgcacccaggaggagaagcagatcaagaccctcaacaacaagtttttctccttcatagacaaggtacggttcctggagcagcagaacaagatgcttgagaccaagtggagcctcgtgcagcagcagaagatggctcggagcaacatggacaacatgttcgagagctacatcaacaaccttaagtggcagctggagactctgggccaggagaagctgaagctggaggcggagcttggcaacatgcatgggctggtggaggacttcaggaacaagtatgaggttgagatcagtaaatgtacagagatggagaatgaatttgtgctcatcaaggagtatgtagatgaagcttacatgaacaagatggagctggagtcttccctgaaagagctgactgccaagatcagcttcctcaggcagctgtatgaagaggagatcgggagctgcagtcccagatctcggatacatctgtggtgctgttcatggacaacagccgcttcctggacatggacagcatcatccctgaggtcaaggccagagggcttccctggaggctgccacgcagataccgagcagcgtggggagctagccattaaggatgccaatgccaagctgtctgagctggaggccgccctgcagctagccagtcaagacatggcgcggcagctgcgtgagtaccaggagctgatgaacgtcaagctggccctggatatcaagatcgccacctacaggaagctgttggagggcgaggagagctggctggagtctgggatgcagaacatgagtatccatatgaagaccaccagcagctatgcaggtggtcagagcttggcctatgggggcctcacaagccctggcctcagctacggcctgggctccagctttggctctggcatgggctccagctccttcagccacaccagctcctccagggccgtggtcatgaagaagatcgaaacccgtgatgggaagctagtgtctgagtcctccaacgtcctgcccaatttgagaattactgccacacttcttacatccgtgtttgacaatagcatcaagacttttggagtaattgagagtgacccttttgactgggagaagactggaaatgatggctccctaacaaccaccactacttctaccacccctcagttgcacactcgcttgacccctgctgcaattggaattgccaatgctactcccatccctggagacttgcttcgagaaaatacagatgaggtatttccagatgaacagcttagcgatggagaaaatggcatccctgttggtgtgtcaccagataaattgcctggatctctgggacacccccgtccccaggagaaggatgtttgggaagagatggatgccaacaaaaacaagataaagcttggaatttgtaaggctgctactgaagaggagaacagccatggccaggcaaatggtcttctcaatgctccaagccttgggtcaccaattcgtgtccgctcagagattactcagccagacagagatattccactggtgcgaaagttacgttccattcacagctttgagctggaaaaacgtctgaccctggagccaaagccagacactgacaagttccttgagacctgcctggagaaaatgcagaaagataccagtgcaggaaaagaatctattctccctgctctgctgcataagccttgcgttcctgctgtgtcccgtactgaccacatctggcactatgatgaagaatatcttccagatgcctccaagcctgcttctgccaacacccctgagcaggcagatggtggtggcagcaatggatttatagctgttaacctgagctcttgcaagcaagaaattgattccaaagaatgggtgattgtggacaaggagcaggaccttcaggattttaggacaaatgaggctgtaggacataaaacaactggaagtccttctgatgaggagcctgaagtacttcaagtcctggaggcatcacctcaagatgaaaagctccagttaggtccttgggcagaaaatgatcatttaaagaaggaaacctcaggtgtggtcttagcactttctgcagagggtcctcctactgctgcttcagaacaatatacagataggctggaactccagcctggagctgctagtcagtttattgcagcgacgcccacaagtctaatggaggcgcaggcagaaggaccccttacagcgattacaattcctagaccttctgtggcatctacacagtcaacttcaggaagctttcactgtggtcagcagccagagaagaaagatcttcagcccatggagcccactgtggaactttactctccaagggaaaacttctctggcttggttgtgacagagggtgaacctcctagtggaggaagcagaacagatttggggcttcagatagatcacattggtcatgacatgttacccaacattagagaaagtaacaaatctcaagacctgggaccaaaagaacttcctgatcataatagactggttgtgagagaatttgaaaatctccctggggaaactgaagagaaaagcatccttttagagtcagataatgaagatgagaagttaagtagagggcagcattgtattgagatctcctctctcccaggagatttggtaattgtggaaaaggatcactcagctactactgaacctcttgatgtgacaaaaacacagacttttagtgtggtgccaaatcaagacaaaaataatgagataatgaagcttctgacagttggaacttcagaaatttcttccagagacattgacccacatgttgaaggtcagataggccaagtggcagaaatgcaaaaaaataagatatctaaggatgatgacatcatgagtgaagacttgccaggtcatcaaggagacctctctacttttttgcaccaagagggcaagagagagaaaatcacccctagaaatggagaactatttcattgtgtttcagagaatgaacatggtgccccaacccggaaggatatggttaggtcatcctttgtaactagacacagccgaatccctgttttagcacaagagatagactcaactttggaatcatcctctccagtttctgcaaaagaaaagctcctccaaaagaaagcctatcagccagacctagtcaagcttctggtggaaaaaagacaattcaagtccttccttggcgacctctcaagtgcctctgataaattgctagaggagaaactagctactgttcctgctcccttttgtgaggaggaagtgctcactcccttttcaagactgacagtagattctcacctgagtaggtcagctgaagatagctttctgtcacccatcatctcccagtctagaaagagcaaaattccaaggccagtttcatgggtcaacacagatcaggtcaatagctcaacttcgtctcagttctttcctcggccaccaccaggaaagccacccacgaggcctggagtagaagccaggctacgcagatataaagtcctagggagtagtaactccgactcagaccttttctcccgcctggcccaaattcttcaaaatggatctcagaaaccccggagcactactcagtgcaagagtccaggatctcctcacaatccaaaaacaccacccaagagtccagttgtccctcgcaggagtcccagtgcctctcctcgaagctcatccttgcctcgcacgtctagttcctcaccatctagggctggacggccccaccatgaccagaggagttcgtccccacatctggggagaagcaagtcacctcccagccactcaggatcttcctcctccaggaggtcctgccaacaggagcattgcaaacccagcaagaatggcctgaaaggatccggcagcctccaccaccactcagccagcactaaaaccccccaagggaagagtaagccagccagtaaactcagcagataggagccaggctgcatctctttgaaaggtgtgagatcttcctcctaaacctgatgcatgtgtgtccctgtactttctatgtaaaaaaatcagtgttgatcttctcttgcaaaagaaagtaacatgatcaattatttataagaagacataatacatgataaggaattacctaaggcaggcagcaagtagattaggaatcaatgtctttgtacaagaaggaaaaatagagcaaaaatccaagggggagaaactcattaaaatga

SEQ ID NO: 62464 - DNA, 4233 bp, Homo sapiens
agcgggcttgcagcgtcggtttccaaggactgtaacgccttcaaccgcccgccgcgatagagtgcccacgaccctgcctcgggaatcccgctctgcaccgccccaccagacccggactcggagccgcgagcggcccgagatgagcagcaatgactcctcccttatggctgggatcatttactatagccaggaaaagtacttccaccatgtgcagcaggctgcagctgtgggcctggaaaaattcagcaatgaccctgtgttgaagttctttaaagcctatggagtcctcaaagaagagcacatccaggatgccatcagtgacctggaaagcatcaggcatcacccagacgtgtccctgtgctccaccatggccctcatttatgctcacaaaagatgtgaaatcattgaccgagaagcaattcaggagcttgagtacagcctgaaggaaatacgcaagacagtcagtgggactgcactgtactatgctggccttttcctctggctcataggccgccatgacaaggccaaagagtacattgaccgcatgctgaagatttctagaggcttcagagaggcctatgtgctcagaggctggggtgacctgacctcagacaagccccacactgcgaagaaagccattgagtacctggaacaaggaattcaggacaccaaagatgtgctggggctgatgggaaaggcaatgtacttcatgatgcagcagaactactcagaggccctggaggtggtgaaccagatcactgtgacttcagggagcttcctgccagccctcgtcctgaagatgcagctgttcttagctcggcaggactgggagcagacagtagaaatgggacacagaatcctagaaaaagatgagagcaatattgatgcctgccaaattctaaccgtgcatgagcttgcaagagaaggaaacatgaccacagtaagttctttgaagactcagaaggctaccaatcacgttagaaatctgattaaggcactagagacaagggaacccgaaaatccaagcctccatcttaaaaaaattattgtggttagccgactgtgtgggagtcaccaggtgattctagggctagtgtgtagtttcatcgagcgcaccttcatggccaccccctcgtatgtccatgtggccacagaactgggctatctcttcatcctgaagaaccaagtgaaagaggccttgctgtggtattcagaagccatgaaactggacaaggatggcatggctggtttgacagggatcatcttgtgtcatatcttagaaggccacctggaggaagctgagtaccggctggaattcctgaaggaggtgcagaagtcccttgggaagtctgaggtgctaattttcctccaagccctcctgatgtccaggaagcacaagggggaggaagagaccacagcgctcctgaaggaggcagtggagcttcacttctccagcatgcaaggcatccctcttggctctgagtactttgaaaagctggacccgtacttcctggtctgcattgctaaggagtacttgctcttctgccccaagcagcccaggttaccaggccagatcgtgtctccacttcttaaacaagtcgccgtgatcttgaatcctgtagtcaaagcagcaccagctctgatcgaccccctgtatttgatggctcaggtcaggtattactcagagctagagaatgcccagagcatcctgcagcgttgcctggagctggaccccgcctccgtggatgcccatctcctcatgtgtcagatctacttggctcagggcaactttggcatgtgcttccactgcttagagctgggtgtcagccacaacttccaggtccgagatcaccccctctaccacctcatcaaggccagggccctcaacaaggctggagactatccagaggccataaagacgctgaaaatggtcatcaaattgccagctctgaagaaggaagaaggcagaaagttcctcaggccctctgtgcagcctagccagcgggcatccatcttattggaactggtggaggccctccggctgaatggggagctacatgaggccaccaaggtcatgcaggacaccatcaatgagttcggtggcacaccagaagagaaccgcatcaccattgccaacgtggacttggtcctgagcaagggcaatgtggacgtggcgctgaacatgctaaggaacatcttgcccaagcagtcctgctatatggaagccagagagaagatggccaacatctacctgcagaccctcagagacaggcgcctctacatcagatgctaccgtgagctctgtgaacatctgcctggcccccacaccagcctgctactgggcgatgccttaatgagcattctggagcccgagaaggccctggaggtctatgatgaggcctatagacagaacccacatgacgcctccctggccagcagaattgggcacgcttatgtgaaggcccaccagtatactgaggcaattgagtattatgaggctgcccagaagattaatggacaggactttctgtgctgcgatctgggcgaactgctcctgaagttaaagaaggtcaataaagcagaaaaagttttgaagcaggcactggaacatgacattgtccaagacatcccatccatgatgaatgatgttaagtgcctgcttttgctggcaaaggtttacaagagccataaaaaagaagctgtgatagaaactttgaacaaggccttggacctccagtctcggatactgaagcgagttccactggagcaaccagaaatgattccctcccagaagcaactggcagcctctatctgcatccaatttgcagagcactacctggcagagaaagagtatgacaaggcggtacagtcttataaggatgtcttctcctacttgccaactgacaataaggtgatgctggagctggcgcagctctacctgctccaggggcacctggacctgtgtgagcagcactgtgccatcctcctgcagactgagcagaaccatgagaccgcttctgtgttgatggctgacctgatgtttagaaaacagaaacatgaagcggccatcaatctttaccaccaagtcttggagaaagcgccagacaattttttggtattgcataaattaatcgatctgctaagaagaagtggaaaacttgaagacattcctgccttctttgaattggccaagaaggtgtctagccgggtgcctttggaaccagggttcaattactgcagaggtatctactgctggcacatagggcagcccaacgaagccttaaagttcctgaacaaggcacgcaaggacagcacttggggccagagcgccatctaccacatggtgcagatctgtctgaatccagacaacgaggttgtgggcggagaggcttttgagaaccagggagctgagagcaactacacagagaagaaggagttggagcagcagggtgtgagcaccgccgagaaactgctgcgtgagttttacccacattcagactccagccagacccagctgcggctgctgcagggcctctgccggctggccaccagggagaaggctaacatggaggctgcgctgggcagcttcatccagatagcgcaggctgagaaggacagcgtccctgccctgctggccttggcacaagcctacgtgttcctgaagcagatccccaaggcgcgtatgcagttgaagcgcctggccaagaccccctgggtgctgagtgaggctgaggacctggagaagagctggctcctgctggctgacatttactgccagggcagcaagttcgacctcgccttagaactgctgcggcgctgtgtgcaatacaacaagtcctgctacaaggcctatgagtacatgggcttcatcatggagaaggagcagtcctacaaggatgcagtcaccaactacaaactggcctggaagtacagtcatcacgccaaccctgccattggtttcaaacttgctttcaactacctgaaggacaagaaatttgtggaggccatcgaaatctgcaacgatgtcctcagggagcaccccgactaccccaagatcagggaggaaattttggaaaaggcccgaaagtccctgaggccctagctggggtcaaggggcctagaccagtagaagccatcaacctactgaagttgtgtggagggatggaaagtgggtcagtggagaagggattcagaaaatgacacattcttccccaaaaaaaaaaaaaaaaaaaa

SEQ ID NO: 62465 - DNA, 2277 bp, Homo sapiens
aaaccagatagaggttctccagcttttctttgattgtctctgctttagcgtctctaaatccggtcaccatgtcggaccccgaaggcgagaccttgcgaagcacctttccctcttatatggccgaaggcgagcggctctacctgtgcggggaattttctaaagccgcgcagagcttcagcaacgctctttaccttcaggatggagacaagaactgcctggttgctcgctcaaagtgcttcctgaagatgggagacttggagagatccctgaaggatgctgaggcttcgctccagagtgacccagctttctgtaaggggattttgcaaaaggctgagacactgtacaccatgggagactttgagtttgccttggtattctatcatcgaggctacaagctgaggcctgatcgggaattcagagttggcattcagaaagcccaggaagccatcaacaactcagtgggaagtccttcttccattaagctggagaacaaaggggacctctccttcttaagcaagcaggctgagaatataaaagcccagcagaagcctcagcccatgaaacacctcttacaccccaccaagggagagcccaagtggaaggcctcgctcaagagtgagaagactgtccgccagcttctgggggagctctacgtggacaaagagtatttggagaagctcctattggatgaagacctgatcaaaggcaccatgaagggcggcctgactgtggaggacctcatcatgacgggcatcaactacctggatactcacagcaacttctggaggcagcagaagccgatctacgccagggagcgggaccggaagctgatgcaagagaaatggctgcgggaccacaaacgccgtccctcacagacagcccattacatcctcaagagcctggaggacattgatatgttgctcacaagtggcagtgctgaagggagtcttcagaaagctgagaaagtgctgaagaaggtactggaatggaacaaggaagaggtacccaacaaggatgaactggttggaaacttgtatagctgcatagggaatgcccagattgagctggggcagatggaggcagccctgcagagccacagaaaggacctggagatcgccaaggaatatgaccttcctgatgcaaaatcgagagcccttgacaacattggcagagtttttgccagagttgggaaattccagcaagccattgacacgtgggaagaaaagatccctctggcaaaaaccaccctggagaagacctggctgttccacgagatcggccgctgctacttggagctggaccaggcctggcaggcccagaattatggcgagaagtcccagcagtgtgccgaggaggaaggggacattgagtggcaactgaatgccagtgttctggtggcccaggcacaagtgaagctgagagacttcgagtcagccgtgaacaattttgagaaggccctggagagagcaaagcttgtgcataacaacgaggcgcagcaggccatcatcagtgccttggacgatgccaacaagggtatcatcagagaactgaggaaaaccaactacgtggagaatctcaaagaaaaaagcgagggagaagcttcactgtatgaagatagaataataacaagagagaaggacatgaggagagtgagagatgagcccgagaaggtggtgaagcagtgggaccatagtgaggatgagaaagagacagatgaggacgatgaggcttttggggaagctctgcagagcccagcaagcggaaagcagagtgtggaagcaggaaaagccagaagcgatttgggagcagttgccaagggcctgtcaggagaattaggcacaagatcaggagaaacaggcaggaagctactagaagctggcagaagagagtcaagagaaatttataggaggccttcgggagaattagagcaaagactctcaggagaattcagcagacaggaaccagaagaactaaagaaactttcagaagtgggcagaagagagccagaagaactgggaaaaacacaatttggagaaataggagaaacgaaaaaaacaggaaatgagatggaaaaggaatatgaatgaagccatcggtagagatgaggatcaggaagctggtgttcagagggatcatgggattttattaaactggattttcaagcgatttgtctgttataggaaaaatgagggttttacttctgctgctttccatcactattttgccattaaataggtgtctttcactcttgcaaaaaaaaaaaaaaaaaaaaaaaaa

SEQ ID NO: 62466 - DNA, 3443 bp, Homo sapiens
gttacgccgcggagccgggagccggagcccgagcccgcggcggcggcgggaggcggcgagggggcgccgcggcggcggcggtggggcctgcggggcgggcggccgggcccggccaggccgcgatggcgaccaagaaggcaggctcgcggctggagacggagatcgagcgctgccgctccgagtgccagtgggagcggatccctgagctcgtcaagcagctgtcggccaagctcatcgccaacgatgacatggcagagcttctcctcggggagtcgaagctggagcagtacctgaaggaacaccccctgaggcagggggccagtccccgaggccccaagccccagctgactgaggtccgcaagcatctgaccgccgccctggaccgagggaaccttaagtcagaattcctacaagaatccaatctgatcatggccaagttgaattatgtggaaggtgattataaagaagctctgaacatttacgcccgggtgggcctggacgatctgccactgacagctgtcccgccctacaggctgcgggtgatcgcagaagcctacgctaccaaaggactttgtttggagaagctgcctatttcttcttctaccagtaatctccatgtggaccgggaacaggatgtcatcacctgttatgagaaagcaggggacatcgcactcctgtatctccaagagatagaaagggtaatactttctaatattcaaaacagaagccctaagcctggccctgctccccacgatcaagaactaggttttttcctagaaacaggacttcagagagcccatgtcctctatttcaaaaatgggaacttgacaagaggagtcggaagatttagagagcttctcagagcagttgaaacaagaacgactcaaaacctgcgaatgacaatagccaggcagctggcagagatcttgttgcggggtatgtgtgagcagagctactggaaccctctggaggatccaccgtgccagtcacctctggacgatcctctccgcaaaggagcaaacacaaaaacctacactctcactcggagagcccgtgtctactcaggagagaacattttttgtcctcaagaaaatacggaagaagccctgttgttattgctgattagtgaatcaatggccaaccgggacgctgtgctgagcaggatacctgaacacaagagtgaccgcctcatcagtctgcagagtgcatctgtggtctatgacttactcaccattgctcttggaagaagaggccagtatgagatgctgtcagagtgcctagaaagagccatgaagtttgcctttgaggaattccacctgtggtaccagtttgctctgtccctgatggctgctggaaaatctgcccgtgccgtgaaggtgctgaaagagtgtatccgcctgaagccagacgatgccaccatccctctcctcgctgccaagctctgcatgggctccctgcactggttggaagaggctgaaaagtttgccaaaactgtcgttgatgtgggagagaaaacgtcagagttcaaggccaaaggctacttagctctggggctcacgtacagtctgcaggccactgacgcttctttgcgagggatgcaggaggtcctacagagaaaggcgcttcttgcatttcagagggcccacagcctgtcacccacagatcaccaagcagctttctacctggctctgcagcttgccatctccagacagatcccagaggctctggggtatgtccgccaagctcttcagcttcaaggtgacgatgccaactccctgcacctccttgccctcctgctgtcagcacagaagcattaccatgacgctctgaacatcatcgacatggccctgagtgaatacccagaaaatttcatactactgttttccaaagtgaagttgcagtcactctgccgaggcccggacgaggcactgctgacttgtaagcacatgctgcagatatggaaatcctgctacaacctcaccaaccccagtgattctggacgtgggagcagcctcttagatagaaccattgctgacagacgacagcttaatacaattactttgccagacttcagcgatcccgagacaggctccgtccatgccacatcggtagcagcctcaagagtggagcaggcactgtcggaagtggcttcgtctctgcagagcagtgcccctaagcagggcccgctgcacccctggatgacgctggcacagatctggctccatgcagctgaagtctatatcggcatcgggaagcctgcagaagccacagcctgtacccaagaagctgccaacctcttcccaatgtcccacaatgtcctctacatgcgcggccagattgctgagctccggggaagcatggacgaggcgcggcggtggtatgaagaggccttagccatcagccccacccacgtgaagagcatgcagcgactggccctgatccttcaccagctaggccgctacagtctggcggagaagatcctccgggacgcggtgcaggtgaactcgacagcccacgaggtctggaacgggctgggcgaggtcctccaagctcagggcaacgatgcggcggctacggagtgcttcctgacagccttggagctggaggccagcagccccgccgtgcccttcaccatcatcccccgcgtgctctgagcaggcgcctgccagcctcacctgccgctcaggcctcagaggccctgccgggcaccagggcttgtgccatcgccccaaggggatgaatctgccacactgaggccagggacgagtgttcagtgggccacagtgaaccaaccaaaccaaccccgaatcatcgctctcgccatgtgcgtttctcttgttttttttgccagcccaatggtagtttctgaacctattgacattgttcaaaatggatcatgtgccatattttgttagttgacatctgagttttcagtaaaatgattatggaattaatcagcaaatgtagaagaatatattcaaagttaaaattcagtggcagcacagattatttttatcagagctgtaaagaaaacaactgtccttttctccccaccacccctcctgccccactttggcccagaaaccaaatgtgaacttcctgtctcccacctcagcactagtccatgccaggacaccagctgacaatttcttggttttactgtcaataattgtaccatgtgatcaattactgtcctcacttagaacaaagcctgagtccgagaatatttatattttaccaatatatgcctgttacaagagaaggaaatatgagttatttaagtttaacttttttatgtgaattcagagtttatttatcgagggaaatatgtacaaagaagcttcaaatggaatatttaccgacattccttatacatgacagacacttggctacatgggaagatgatgttaataataaaatgatttttaaatggaaaaaaaaaa

SEQ ID NO: 62467 - DNA, 2549 bp, Homo sapiens
cagtctaagggcacagaatggaaaggttctcattttcctcctccaatgagaattggcaccccaacagcaggccctgggccctcggctgtgatggaggggtgtctcggggtagcagtactaaggaagctctccaccttcagtgcatacttggaggaccacagctacaacgtggagcagatatggagggatattgaggacgtcatcatcaagaccctcatctcggcccaccccatcatcaggcataactaccacacctgcttccccaaccacacactcaacagcgcctgctttgagatcctgggctttgacattttgttggaccacaaactcaaaccctggctgctggaggtcaaccactctccaagcttctccaccgactctcggttggataaagaggtgaaagatggtctgctgtatgacaccttagtcctgatcaacctggaaagctgtgacaagaagaaagtcttggaggaggagagacaacgggggcagttcctgcagcagtgttgttctcgggagatgaggattgaggaagccaagggtttccgggccgtgcagttaaagaaaactgaaacgtatgagaaggaaaactgtggagggttccgactgatttatcccagtctgaattcggagaagtatgagaagtttttccaggacaacaactccctcttccagaatactgttgcttccagggctcgggaggagtatgcccggcaactgatccaggagctgagactaaaacgggagaaaaagcccttccaaatgaagaagaaggtagagatgcagggggaatcggcaggcgagcaagtgagaaagaagggcatgaggggctggcaacagaaacaacagcagaaagacaaggccgccacccaagcctccaaacagtacatccagccattgacattagtatcctacacacctgacttgctcttgagtgtcagaggtgaaaggaaaaatgaaacagacagcagcctcaaccaggaggctcccacggaggaggccagctctgttttccccaagctgacgtctgcgaagcccttcagttctctacccgatctgaggaatatcaatctcagcagctcgaagttggagcccagtaaacccaacttcagcatcaaggaggccaagtctgcctctgcagtgaacgtattcactggcactgtgcacttaacctccgtagaaaccaccccagaatccaccacccaactctcaatctccccaaagtctccgccaaccctggctgtgaccgccagctctgagtacagtggcccagagacggacagggtggtatcctttaaatgcaagaagcagcagacccctccacacttaacccagaagaaaatgttaaaatcttttctgcccacaaaatccaagagcttctgggagagtccgaacacaaactggactttgctaaagagtgacatgaacaagccacatttgatatccgagctactcaccaagcttcaactgagtgggaagctctccttcttcccagctcactacaaccccaagctggggatgaataacctgtcacaaaacccctccctgcctggggagtgccactcccgcagtgacagctctggcgagaagaggcagctggatgtgtcctccctcctcttgcagagtcctcagagctataatgttactctgagggacctgctggtgattgccactccagcccaactggatccaaggccttgtagaagccacgcaagtgctatgagggacccatgtatgcaggatcaagaagcatacagccattgcctgatctctggccaaaaaggatgtgagaggagctagaatcagactggatctctgccacttttcccttcctacctcttaacttgcaggaaacaatgtgtctcttccggcagtgtctccagtgttcacagaatcaactgaagttttgtttgctcatctagatatactggtcttccattagttcctagtagcagcagtggggccaacagccctgcctctgttccctcccagttagcttacagtgctacaggaccatgatttctggggttggattggtgctgccccaggacacactccagttgccgtaccagtggcacttctctgggttcttcacatggcaccatcatccagaatactcccccagataaagcaacttcgggagtagtgtttcagagaaggactcatgatttccaggagtcaaaagccctcagtccaccaacagaactatgccagttggtcttcatctccaagataaaagatgaggtcagggatgggcatggtgcataactctgagccctgagtgagagaactgaggcagctgcaacttcacaaggtcaaggcccgacctccgcccatccccaccagcccaaagacttgccacctcagtgcccgagcatcctctggtgacctccctcaccagcccaacttaatctcaccagtgaaaacagaggtgaggcgagagtacccagcctgaagatgcttcttctatcagcctgcagaaatgttacactttcccttcaggcatccattaataaaagaaattgccatgcttaaaaaaaaaaaaaaaa

SEQ ID NO: 62468 - DNA, 1408 bp, Homo sapiens
ggttgaggtcaagtagtagcgttgggctgcggcagcggaggagctcaacatgcgtgagtgtatctctatccacgtggggcaggcaggagtccagatcggcaatgcctgctgggaactgtactgcctggaacatggaattcagcccgatggtcagatgccaagtgataaaaccattggtggtggggacgactccttcaacacgttcttcagtgagactggagctggcaagcacgtgcccagagcagtgtttgtggacctggagcccactgtggtcgatgaagtgcgcacaggaacctataggcagctcttccacccagagcagctgatcaccgggaaggaagatgcggccaataattacgccagaggccattacaccatcggcaaggagatcgtcgacctggtcctggaccggatccgcaaactggcggatctgtgcacgggactgcagggcttcctcatcttccacagttttgggggtggcactggctctgggttcgcatctctgctcatggagcggctctcagtggattacggcaagaagtccaagctagaatttgccatttacccagccccccaggtctccacggccgtggtggagccctacaactccatcctgaccacccacacgaccctggaacattctgactgtgccttcatggtcgacaatgaagccatctatgacatatgtcggcgcaacctggacatcgagcgtcccacgtacaccaacctcaatcgcctgattgggcagatcgtgtcctccatcacggcctccctgcgatttgacggggccctgaatgtggacttgacggaattccagaccaacctagtgccgtacccccgcatccacttccccctggccacctacgccccggtcatctcagccgagaaggcctaccacgagcagctgtccgtggctgagatcaccaatgcctgcttcgagccagccaatcagatggtcaagtgtgaccctcgccacggcaagtacatggcctgctgcatgttgtacaggggggatgtggtcccgaaagatgtcaacgcggccatcgccaccatcaagaccaagcgcaccatccagtttgtagattggtgcccaactggatttaaggtgggcattaactaccagccccccacggtggtccctgggggagacctggccaaggtgcagcgggctgtgtgcatgctgagcaacaccacggccatcgcggaggcctgggctcgcctggacctggcagctctggagaaggattatgaagaggtgggcgtggattccgtggaagccgaggctgaagaaggtgaagaatactgaggggagggtgtggtgggttctccactccactgccacccccagcgtggctgctttcaagttctttgcaattaaaggttctgtataaaaaaaaaaaaaaaaaaa

SEQ ID NO: 62469 - DNA, 2347 bp, Homo sapiens
gggaggtttggagccctgcataaagagaaggacgggaccacagctgactgctgtgtccccacagatctgggcctcctgctgccaccatggccaaaggtggagaagccctgccacagggcagcccagcaccagtccaggatccccacctcatcaaggtgacagtgaagacgcccaaagacaaggaggatttctcagttacagacacatgcactatccagcagctgaaggaagagatatctcagcgctttaaggcccaccccgatcagcttgttctaatctttgctggcaaaatcctcaaggatcctgactcactggcacagtgtggagtgcgagatggcctcactgtccacctggtcatcaagaggcagcaccgtgccatgggcaatgagtgcccagctgcctctgtccctacccagggcccaagtcctggatcactccctcagccaagctccatttacccagcagatgggccccctgcctttagcttaggtctcctcacaggcctcagtaggctgggcttggcctatcgtggcttccctgaccagccaagctccctgatgcggcagcatgtgtctgtgcctgagtttgtgactcagctcattgatgaccccttcatcccgggtctgctgtccaacacaggcctagtacgccagctggttcttgacaacccccatatgcagcagctgatccagcacaaccctgagattgggcatattcttaacaacccggaaattatgcggcagacactggagtttttacgtaaccctgccatgatgcaggagatgatacgtagccaggaccgggtgctcagtaacttggagagcattcctggtggctacaatgtgctttgcactatgtacacagatattatggacccaatgcttaacgcagtccaggagcagtttggcggcaatccctttgccactgccactactgataatgccaccaccaccaccagccaaccttcaaggatggagaattgtgaccctctccccaacccctggacttccacacatggaggctcaggtagcaggcaaggaaggcaggatggggatcaggatgcacctgacattagaaataggtttccaaactttctgggtattataaggctctatgactatctccagcaattacacgagaacccccagtccctaggaacttatctacaggggactgcatctgccctcagccaaagccaggaaccaccaccatcagtaaacagagttcccccatcgtcaccctcatctcaggagcctgggtcaggccagcctctccccgaggagtcagtagcaatcaagggaaggtcctcctgcccagctttcctgagataccccacagagaacagtactggacaaggtggagaccaagatggtgcagggaaaagctctactggacatagcacaaacttgcctgatcttgtctcggggctgggagattctgccaacagggttccatttgctcccttatctttttcccccacggcagccattcctggaatccctgagcctccctggctgccatccccggcttatccaagatctctgaggccagatggcatgaatccagctccacagttacaggatgagatacaaccacagctgccactgctgatgcaccttcaggcagccatggcaaacccccgtgccctgcaagccctgcggcagattgagcagggtctacaggtcctagctactgaagcacctcgcctcctactctggttcatgccttgcctagcagggacgggtagtgtggcaggaggtatagagtctagagaagatccccttatgtctgaggatcctctcccaaatccacctcctgaggtgttcccagcactggactctgcagagctgggcttcctttcccctccctttctccatatgctgcaagatttagttagtacaaatccccagcagctgcagcctgaggctcactttcaggtgcagctggagcaactgcggtccatgggctttctgaatcgtgaagccaatcttcaggccctcattgctacggggggcgacgtggatgctgctgtggagaagctgagacagtcgtaggagccttattcattcaaaccatacgttttcctctgtgcctttttcccatatcctagttccctagctctcccatttttgaatacagctgcattataaaccaaatttactatgaagtcctttgctgtggaggcaatgttgttccagagtcaacgaggaagactaatggccaaaacatagtggaggtgctgtgtgtgagtcaaccacttgtaccactataccactggggggccccagtctaagctctgcttatgcctatcttgagatgcaattacacccaatttccaatgtgaaaa

SEQ ID NO: 62470 - DNA, 3648 bp, Homo sapiens
ccgtttttcctaggctggttggagaaaccagactctatggaatttgaaccctgaaacttctaatgcttagttatcagactgtttcattctgtaccatttaatgcttctgaattgtttctttttatcttgctgtctaaaagaggttaatagcatacaaaaatgaaataataaaatataaaatgatttcaaaggtacatgtgtaccttgtaaaatctgctatgtgtaattgggacatgtcttgggaatttttcatggtaaatcatgttaaagtagagttttaacatttatgttttttaaagattgacttggacaaggctactgcagcattcattttggaagaaagcttttgctggagcagatcaggaatcaagcgtcgaagatctcagtctcagcagaaacactatggagtgttctgggccacaagattccaaggagcttttgcagaactctcagagtagacaagcaaaagggcacaagagtggtcaaccactaggtcactctttcagactagaaaatccaactgagtttcggcctaagagtactcttgagggtcaattgaatgaatccatgtttcttctcagttctcgtcctactcccagaactagcactgcagtggaagtaagtcctggtgaggatatgactcactgttcaccacagaagacttctcctctgaccaagattacaagtggacacctgagtcagcaggacctggaatcccagatgagagagcttatctacacggactcagatcttgttgtcacccccattatcgacaatccaaagataatgaaacagccaccagttaaatttgatgcaaaaatattgcatctaccaacatattcagtggataagttattatttctgaaagatcaagattggaatgactttttgcaacaagtgtgctcgcagatcgactccactgagaagagcatgggggcctcccgagccaagctgaatctcctttgctatttgtgcgtggtggctggtcaccaggaggtggccaccaggctcctccattcccccctgttccaattgctaatccagcatttgcggatagctccaaactgggatatacgggccaaggttgctcacgtaattggtttactggcttcgcacacagctgagctccaggaaaatacacctgttgttgaggcaattgttctcttaactgaattaattagggaaaacttcaggaacagcaaattaaaacagtgccttttaccaacccttggggagctgatctatcttgtagccacccaggaagaaaaaaaaaagaaccctagagagtgctgggctgttcccttggctgcatacacagtgctaatgaggtgccttcgggaaggggaagagcgtgttgtgaatcacatggcagcaaaaattattgaaaatgtctgtaccaccttttctgctcagtcccagggctttattacaggagaaataggacccattttgtggtacctattcagacactccactgctgattctcttaggataacagcagtatcggccttgtgtagaatcactcgccattctcctactgccttccagaatgttattgaaaaggtgggactgaactcagtaataaactccctggcctctgccatctgcaaagttcagcagtacatgttgaccttattcgctgccatgttgtcctgtgggattcatcttcaaagactaatccaagaaaagggttttgtctccacaattatccgtttacttgacagcccctcaacatgcattagagcaaaagccttcctggttcttctatatattttgatttataaccgtgagatgttgctgctcagttgccaagcaagactggtgatgtacatcgagagagacagcagaaagaccactccaggcaaggagcagcaaagtggcaatgaatacctgtccaaatgcctggatcttctcatctgtcacattgtgcaggagctgccacgaatcctgggtgacattcttaactccttggctaatgtttctggacgtaaacacccatcaacagttcaagtgaaacagctgaagttgtgtctccccctgatgcctgtagtgcttcacctcgtaacttcacaggtatttcgacctcaagttgtgacagaagagtttcttttcagctatggaactattcttagtcatattaaatctgtagactcaggagaaacgaacatagatggagccataggactgacagcatcagaagaatttatcaagatcacattgtcagcttttgaagcaataatacagtatcctattttattgaaagactatcgctccacggttgttgactatatactgccacccttggtgtccttggttcaaagccaaaatgtggagtggagactctttagcttgcggttgctctcagaaaccacatctctactcgtgaaccaggagtttggggatggcaaggagaaggccagtgttgattctgacagcaatcttctggctctcattcgagatgtcttacttccccagtatgagcacattcttttagaacctgacccagtaccagcatatgctctgaaactgctagtcgcgatgactgaacacaacccaactttcacaagacttgtggaagaaagcaaactgatcccactcatttttgaagtaactctggaacatcaggagagcattctgggtaataccatgcaaagtgtgattgcattactcagcaatctagttgcctgcaaagattcgaatatggaactactttatgaacaaggacttgtcagtcacatctgtaacctgctcactgaaactgccacactgtgcttggatgtggacaataaaaacaacaatgagatggcagctccactgctcttttccctgcttgatattttgcacagcatgctgacctatacctccggtattgtacggctggctttgcaggcccagaagtctggctcaggagaggaccctcaggctgcagaagacctgctgctgctcaacagacctctgacagacctgattagcctgctcattccactgcttcctaatgaagatcctgagatttttgatgtttcatccaagtgcctgtctatactggttcagctgtatggaggggaaaacccggacagcctctctcctgaaaatgtggaaatttttgctcatttactgacatccaaggaggacccaaaggagcagaagcttctgttaaggattctcagaagaatgatcacctccaatgagaagcacttggagagcctcaagaatgcaggcagcctcctgcgggctctggagcggctggcccctgggagtggttcatttgccgacagtgcggtggctcccttggccctggaaatcctccaagccgttgggcactaggcaagaaggtgcttagcacaagcccgccctgtggccccagccctcggatgcataagcaaggtcagctcccagacacctttgccacatcccctcacagctgtctttggacctaataaagtcagcttaacccagaacctggtggcccaagtgctcactaaccccagggcctagaaaactgactcagaatggacttccttggttcctgtggaatgcatctgggaagcccaggtttgttagctgttctcagaaatgttctttccctctctgtgtgggccaggtgggctaaggttagcactgcctgtggtaataaagcagtggatgcaa

SEQ ID NO: 62471 - DNA, 1331 bp, Homo sapiens
ccgtttttcctaggctggttggagaaaccagactctatggaatttgaaccctgaaacttctaatgcttagttatcagactgtttcattctgtaccatttaatgcttctgaattgtttctttttatcttgctgtctaaaagaggttaatagcatacaaaaatgaaataataaaatataaaatgatttcaaaggtacatgtgtaccttgtaaaatctgctatgtgtaattgggacatgtcttgggaatttttcatggtaaatcatgttaaagtagagttttaacatttatgttttttaaagattgacttggacaaggctactgcagcattcattttggaagaaagcttttgctggagcagatcaggaatcaagcgtcgaagatctcagtctcagcagaaacactatggagtgttctgggccacaagattccaaggagcttttgcagaactctcagagtagacaagcaaaagggcacaagagtggtcaaccactaggtcactctttcagactagaaaatccaactgagtttcggcctaagagtactcttgagggtcaattgaatgaatccatgtttcttctcagttctcgtcctactcccagaactagcactgcagtggaagtaagtcctggtgaggatatgactcactgttcaccacagaagacttctcctctgaccaagattacaagtggacacctgagtcagcaggacctggaatcccagatgagagagcttatctacacggactcagatcttgttgtcacccccattatcgacaatccaaagataatgaaacagccaccagttaaatttgatgcaaaaatattgcatctaccaacatattcagtggataagttattatttctgaaagatcaagattggaatgactttttgcaacaagtgtgctcgcagatcgactccactgagaagagcatgggggcctcccgagccaagctgaatctcctttgctatttgtgcgtggtggctggtcaccaggaggtggccaccaggctcctccattcccccctgttccaattgctaatccagcatttgcggatagctccaaactgggatatacgggccaaggttgctcacgtaattggtttactggcttcgcacacagctgagctccaggaaaatacacctgttgttgagactacaagctccattggaatcgggattttgaactgtcttgttcaacactccactccagtgcctagacagtgccttgtgcaattgttctcttaactgaattaattagggaaaacttcaggaacagcaaattaaaacagtgccttttaccaacccttggggagctgatctatcttgtagcc

SEQ ID NO: 62472 - DNA, 1870 bp, Homo sapiens
aagcggtcgcggaagagcgcgcaggcctgccggggcgggagctagagatgctgttattctattgtatgtgagaagtcggcccagagatggaaaactttattctgtatgaggagatcggaagaggaagcaagactgttgtctataaagggcgacggaagggaacaatcaattttgtagccattctttgtactgataagtgcaaaaggcctgaaataaccaactgggtccgtctcacccgtgaaataaaacacaagaatattgtaacttttcatgaatggtatgaaacaagcaaccacctctggctagtggtggaactctgcacaggtggttccttaaaaacagttattgctcaagatgaaaacctcccagaagatgttgtgagagaatttggaattgacctgattagtggattacatcatcttcataaacttggcattctcttttgtgacatttctcctaggaagatactcttggaagggcctggcacactgaagtttagcaacttttgcttggcaaaagtggaaggtgaaaatttggaagagttctttgctttggtggcagcagaggaaggaggaggtgataatggggaaaatgtcctgaagaaaagcatgaaaagtagagtcaaaggatctcctgtatatacagcaccagaagttgtgaggggtgctgacttttccatctccagtgacctctggtctttgggctgtctgctttatgaaatgttttcaggaaaacctccattcttctcagaaagtatttcagaattaactgaaaagatcttatgtgaagatcctttgccacctattccgaaagattcttctcgtcctaaagcttcttcagattttattaatttgcttgatgggttacttcaaagagatcctcagaaaagattgacttggacaaggctactgcagcattcattttggaagaaagcttttgctggagcagatcaggaatcaagcgtcgaagatctcagtctcagcagaaacactatggagtgttctgggccacaagattccaaggagcttttgcagaactctcagagtagacaagcaaaagggcacaagagtggtcaaccactaggtcactctttcagactagaaaatccaactgagtttcggcctaagagtactcttgagggtcaattgaatgaatccatgtttcttctcagttctcgtcctactcccagaactagcactgcagtggaagtaagtcctggtgaggatatgactcactgttcaccacagaagacttctcctctgaccaagattacaagtggacacctgagtcagcaggacctggaatcccagatgagagagcttatctacacggactcagatcttgttgtcacccccattatcgacaatccaaagataatgaaacagccaccagttaaatttgatgcaaaaatattgcatctaccaacatattcagtggataagttattatttctgaaagatcaagattggaatgactttttgcaacaagtgtgctcgcagatcgactccactgagaagagcatgggggcctcccgagccaagctgaatctcctttgctatttgtgcgtggtggctggtcaccaggaggtggccaccaggctcctccattcccccctgttccaattgctaatccagcatttgcggatagctccaaactgggatatacgggccaaggttgctcacgtaattggtttactggcttcgcacacagctgagctccaggaaaatacacctgttgttgagactacaagctccattggaatcgggattttgaactgtcttgttcaacactccactccagtgcctagacagtgccttgtgtatgtatagatactgacaaatatttcaaaataaataaaactgtatcagca

SEQ ID NO: 62473 - DNA, 1894 bp, Homo sapiens
agatgcgcgcaaccgcgggagcagccaagtggactggactcttttcttgacttagctaccaggagctagagatgctgttattctattgtatgtgagaagtcggcccagagatggaaaactttattctgtatgaggagatcggaagaggaagcaagactgttgtctataaagggcgacggaagggaacaatcaattttgtagccattctttgtactgataagtgcaaaaggcctgaaataaccaactgggtccgtctcacccgtgaaataaaacacaagaatattgtaacttttcatgaatggtatgaaacaagcaaccacctctggctagtggtggaactctgcacaggtggttccttaaaaacagttattgctcaagatgaaaacctcccagaagatgttgtgagagaatttggaattgacctgattagtggattacatcatcttcataaacttggcattctcttttgtgacatttctcctaggaagatactcttggaagggcctggcacactgaagtttagcaacttttgcttggcaaaagtggaaggtgaaaatttggaagagttctttgctttggtggcagcagaggaaggaggaggtgataatggggaaaatgtcctgaagaaaagcatgaaaagtagagtcaaaggatctcctgtatatacagcaccagaagttgtgaggggtgctgacttttccatctccagtgacctctggtctttgggctgtctgctttatgaaatgttttcaggaaaacctccattcttctcagaaagtatttcagaattaactgaaaagatcttatgtgaagatcctttgccacctattccgaaagattcttctcgtcctaaagcttcttcagattttattaatttgcttgatgggttacttcaaagagatcctcagaaaagattgacttggacaaggctactgcagcattcattttggaagaaagcttttgctggagcagatcaggaatcaagcgtcgaagatctcagtctcagcagaaacactatggagtgttctgggccacaagattccaaggagcttttgcagaactctcagagtagacaagcaaaagggcacaagagtggtcaaccactaggtcactctttcagactagaaaatccaactgagtttcggcctaagagtactcttgagggtcaattgaatgaatccatgtttcttctcagttctcgtcctactcccagaactagcactgcagtggaagtaagtcctggtgaggatatgactcactgttcaccacagaagacttctcctctgaccaagattacaagtggacacctgagtcagcaggacctggaatcccagatgagagagcttatctacacggactcagatcttgttgtcacccccattatcgacaatccaaagataatgaaacagccaccagttaaatttgatgcaaaaatattgcatctaccaacatattcagtggataagttattatttctgaaagatcaagattggaatgactttttgcaacaagtgtgctcgcagatcgactccactgagaagagcatgggggcctcccgagccaagctgaatctcctttgctatttgtgcgtggtggctggtcaccaggaggtggccaccaggctcctccattcccccctgttccaattgctaatccagcatttgcggatagctccaaactgggatatacgggccaaggttgctcacgtaattggtttactggcttcgcacacagctgagctccaggaaaatacacctgttgttgagactacaagctccattggaatcgggattttgaactgtcttgttcaacactccactccagtgcctagacagtgccttgtgtatgtatagatactgacaaatatttcaaaataaataaaactgtatcagca

SEQ ID NO: 62474 - DNA, 3648 bp, Homo sapiens
ccgtttttcctaggctggttggagaaaccagactctatggaatttgaaccctgaaacttctaatgcttagttatcagactgtttcattctgtaccatttaatatttctgaattgtttctttttatcttgctgtctaaaagaggttaatagcatacaaaaatgaaataataaaatataaaatgatttcaaaggtacatgtgtaccttgtaaaatctgctatgtgtaattgggacatgtcttgggaatttttcatggtaaatcatgttaaagtagagttttaacatttatgttttttaaagattgacttggacaaggctactgcagcattcattttggaagaaagcttttgctggagcagatcaggaatcaagcgtcgaagatctcagtctcagcagaaacactatggagtgttctgggccacaagattccaaggagcttttgcagaactctcagagtagacaagcaaaagggcacaagagtggtcaaccactaggtcactctttcagactagaaaatccaactgagtttcggcctaagagtactcttgagggtcaattgaatgaatccatgtttcttctcagttctcgtcctactcccagaactagcactgcagtggaagtaagtcctggtgaggatatgactcactgttcaccacagaagacttctcctctgaccaagattacaagtggacacctgagtcagcaggacctggaatcccagatgagagagcttatctacacggactcagatcttgttgtcacccccattatcgacaatccaaagataatgaaacagccaccagttaaatttgatgcaaaaatattgcatctaccaacatattcagtggataagttattatttctgaaagatcaagattggaatgactttttgcaacaagtgtgctcgcagatcgactccactgagaagagcatgggggcctcccgagccaagctgaatctcctttgctatttgtgcgtggtggctggtcaccaggaggtggccaccaggctcctccattcccccctgttccaattgctaatccagcatttgcggatagctccaaactgggatatacgggccaaggttgctcacgtaattggtttactggcttcgcacacaactgagctccaggaaaatacacctgttgttgaggcaattgttctcttaactgaattaattagggaaaacttcaggaacagcaaattaaaacagtgccttttaccaacccttggggagctgatctatcttgtagccacccaggaagaaaaaaaaaagaaccctagagagtgctgggctgttcccttggctgcatacacagtgctaatgaggtgccttcgggaaggggaagagcgtgttgtgaatcacatggcagcaaaaattattgaaaatgtctgtaccaccttttctgctcagtcccagggctttattacaggagaaataggacccattttgtggtacctattcagacactccactgctgattctcttaggataacagcagtatcggccttgtgtagaatcactcgccattctcctactgccttccagaatgttattgaaaaggtgggactgaactcagtaataaactccctggcctctgccatctgcaaagttcagcagtacatgttgaccttattcgctgccatgttgtcctgtgggattcatcttcaaagactaatccaagaaaagggttttgtctccacaattatccgtttacttgacagcccctcaacatgcattagagcaaaagccttcctggttcttctatatattttgatttataaccgtgagatgttgctgctcagttgccaagcaagactggtgatgtacatcgagagagacagcagaaagaccactccaggcaaggagcagcaaagtggcaatgaatacctgtccaaatgcctggatcttctcatctgtcacattgtgcaggagctgccacgaatcctgggtgacattcttaactccttggctaatgtttctggacgtaaacacccatcaacagttcaagtgaaacagctgaagttgtgtctccccctgatgcctgtagtgcttcacctcgtaacttcacaggtatttcgacctcaagttgtgacagaagagtttcttttcagctatggaactattcttagtcatattaaatctgtagactcaggagaaacgaacatagatggagccataggactgacagcatcagaagaatttatcaagatcacattgtcagcttttgaagcaataatacagtatcctattttattgaaagactatcgctccacggttgttgactatatactgccacccttggtgtccttggttcaaagccaaaatgtggagtggagactctttagcttgcggttgctctcagaaaccacatctctactcgtgaaccaggagtttggggatggcaaggagaaggccagtgttgattctgacagcaatcttctggctctcattcgagatgtcttacttccccagtatgagcacattcttttagaacctgacccagtaccagcatatgctctgaaactgctagtcgcgatgactgaacacaacccaactttcacaagacttgtggaagaaagcaaactgatcccactcatttttgaagtaactctggaacatcaggagagcattctgggtaataccatgcaaagtgtgattgcattactcagcaatctagttgcctgcaaagattcgaatatggaactactttatgaacaaggacttgtcagtcacatctgtaacctgctcactgaaactgccacactgtgcttggatgtggacaataaaaacaacaatgagatggcagctccactgctcttttccctgcttgatattttgcacagcatgctgacctatacctccggtattgtacggctggctttgcaggcccagaagtctggctcaggagaggaccctcaggctgcagaagacctgctgctgctcaacagacctctgacagacctgattagcctgctcattccactgcttcctaatgaagatcctgagatttttgatgtttcatccaagtgcctgtctatactggttcagctgtatggaggggaaaacccggacagcctctctcctgaaaatgtggaaatttttgctcatttactgacatccaaggaggacccaaaggagcagaagcttctgttaaggattctcagaagaatgatcacctccaatgagaagcacttggagagcctcaagaatgcaggcagcctcctgcgggctctggagcggctggcccctgggagtggttcatttgccgacagtgcggtggctcccttggccctggaaatcctccaagccgttgggcactaggcaagaaggtgcttagcacaagcccgccctgtggccccagccctcggatgcataagcaaggtcagctcccagacacctttgccacatcccctcacagctgtctttggacctaataaagtcagcttaacccagaacctggtggcccaagtgctcactaaccccagggcctagaaaactgactcagaatggacttccttggttcctgtggaatgcatctgggaagcccaggtttgttagctgttctcagaaatgttctttccctctctgtgtgggccaggtgggctaaggttagcactgcctgtggtaataaagcagtggatgcaa

SEQ ID NO: 62475 - DNA, 1331 bp, Homo sapiens
ccgtttttcctaggctggttggagaaaccagactctatggaatttgaaccctgaaacttctaatgcttagttatcagactgtttcattctgtaccatttaatatttctgaattgtttctttttatcttgctgtctaaaagaggttaatagcatacaaaaatgaaataataaaatataaaatgatttcaaaggtacatgtgtaccttgtaaaatctgctatgtgtaattgggacatgtcttgggaatttttcatggtaaatcatgttaaagtagagttttaacatttatgttttttaaagattgacttggacaaggctactgcagcattcattttggaagaaagcttttgctggagcagatcaggaatcaagcgtcgaagatctcagtctcagcagaaacactatggagtgttctgggccacaagattccaaggagcttttgcagaactctcagagtagacaagcaaaagggcacaagagtggtcaaccactaggtcactctttcagactagaaaatccaactgagtttcggcctaagagtactcttgagggtcaattgaatgaatccatgtttcttctcagttctcgtcctactcccagaactagcactgcagtggaagtaagtcctggtgaggatatgactcactgttcaccacagaagacttctcctctgaccaagattacaagtggacacctgagtcagcaggacctggaatcccagatgagagagcttatctacacggactcagatcttgttgtcacccccattatcgacaatccaaagataatgaaacagccaccagttaaatttgatgcaaaaatattgcatctaccaacatattcagtggataagttattatttctgaaagatcaagattggaatgactttttgcaacaagtgtgctcgcagatcgactccactgagaagagcatgggggcctcccgagccaagctgaatctcctttgctatttgtgcgtggtggctggtcaccaggaggtggccaccaggctcctccattcccccctgttccaattgctaatccagcatttgcggatagctccaaactgggatatacgggccaaggttgctcacgtaattggtttactggcttcgcacacaactgagctccaggaaaatacacctgttgttgagactacaagctccattggaatcgggattttgaactgtcttgttcaacactccactccagtgcctagacagtgccttgtgcaattgttctcttaactgaattaattagggaaaacttcaggaacagcaaattaaaacagtgccttttaccaacccttggggagctgatctatcttgtagcc

SEQ ID NO: 62476 - DNA, 1870 bp, Homo sapiens
aagcggtcgcggaagagcgcgcaggcctgccggggcgggagctagagatgctgttattctatcgtatgtgagaagtcggcccagagatggaaaactttattctgtatgaggagatcggaagaggaagcaagactgttgtctataaagggcgacggaagggaacaatcaattttgtagccattctttgtactgataagtgcagaaggcctgaaataaccaactgggtccgtctcacccgtgaaataaaacacaagaatattgtaacttttcatgaatggtatgaaacaagcaaccacctctggctagtggtggaactctgcacaggtggttccttaaaaacagttattgctcaagatgaaaacctcccagaagatgttgtgagagaatttggaattgacctgattagtggattacatcatcttcataaacttggcattctcttttgtgacatttctcctaggaagatactcttggaagggcctggcacactgaagtttagcaacttttgcttggcaaaagtggaaggtgaaaatttggaagagttctttgctttggtggcagcagaggaaggaggaggtgataatggggaaaatgtcctgaagaaaagcatgaaaagtagagtcaaaggatctcctgtatatacagcaccagaagttgtgaggggtgctgacttttccatctccagtgacctctggtctttgggctgtctgctttatgaaatgttttcaggaaaacctccattcttctcagaaagtgtttcagaattaactgaaaagatcttatgtgaagatcctttgccacctattccgaaagattcttctcgtcctaaagcttcttcagattttattaatttgcttgatgggttacttcaaagagatcctcagaaaagattgacttggacaaggctactgcagcattcattttggaagaaagcttttgctggagcagatcaggaatcaagcgtcgaagatctcagtctcagcagaaacactatggagtgttctgggccacaagattccaaggagcttttgcagaactctcagagtagacaagcaaaagggcacaagagtggtcaaccactaggtcactctttcagactagaaaatccaactgagtttcggcctaagagtactcttgagggtcaattgaatgaatccatgtttcttctcagttctcgtcctactcccagaactagcactgcagtggaagtaagtcctggtgaggatatgactcactgttcaccacagaagacttctcctctgaccaagattacaagtggacacctgagtcagcaggacctggaatcccagatgagagagcttatctacacggactcagatcttgttgtcacccccattatcgacaatccaaagataatgaaacagccaccagttaaatttgatgcaaaaatattgcatctaccaacatattcagtggataagttattatttctgaaagatcaagattggaatgactttttgcaacaagtgtgctcgcagatcgactccactgagaagagcatgggggcctcccgagccaagctgaatctcctttgctatttgtgcgtggtggctggtcaccaggaggtggccaccaggctcctccattcccccctgttccaattgctaatccagcatttgcggatagctccaaactgggatatacgggccaaggttgctcacgtaattggtttactggcttcgcacacaactgagctccaggaaaatacacctgttgttgagactacaagctccattggaatcgggattttgaactgtcttgttcaacactccactccagtgcctagacagtgccttgtgtatgtatagatactgacaaatatttcaaaataaataaaactgtatcagca

SEQ ID NO: 62477 - DNA, 2176 bp, Homo sapiens
gccgccctctctccttctgccagtggaccccgtaccccctgcgctcccctgctttgcgctcgtgttaaaaaagccgcccgtttttatccgggcgttagttaagggcacacgggacgcctcttctaggacctgggtgcagcggggagagagagtgcttgtgtgtttcggcttgggagatgtgctttatggacgccatctcttaacttcccagagcggaccgcgtcttcaccgccctgcagcgcttcctaggctcccagccggtctcgcggactgatgcctacggacgtagcgaggccgcgaaagccgccgattcgcccgccgcgagttgcctggggagcgggggggagctagagatgctgttattctatcgtatgtgagaagtcggcccagagatggaaaactttattctgtatgaggagatcggaagaggaagcaagactgttgtctataaagggcgacggaagggaacaatcaattttgtagccattctttgtactgataagtgcagaaggcctgaaataaccaactgggtccgtctcacccgtgaaataaaacacaagaatattgtaacttttcatgaatggtatgaaacaagcaaccacctctggctagtggtggaactctgcacaggtggttccttaaaaacagttattgctcaagatgaaaacctcccagaagatgttgtgagagaatttggaattgacctgattagtggattacatcatcttcataaacttggcattctcttttgtgacatttctcctaggaagatactcttggaagggcctggcacactgaagtttagcaacttttgcttggcaaaagtggaaggtgaaaatttggaagagttctttgctttggtggcagcagaggaaggaggaggtgataatggggaaaatgtcctgaagaaaagcatgaaaagtagagtcaaaggatctcctgtatatacagcaccagaagttgtgaggggtgctgacttttccatctccagtgacctctggtctttgggctgtctgctttatgaaatgttttcaggaaaacctccattcttctcagaaagtgtttcagaattaactgaaaagatcttatgtgaagatcctttgccacctattccgaaagattcttctcgtcctaaagcttcttcagattttattaatttgcttgatgggttacttcaaagagatcctcagaaaagattgacttggacaaggctactgcagcattcattttggaagaaagcttttgctggagcagatcaggaatcaagcgtcgaagatctcagtctcagcagaaacactatggagtgttctgggccacaagattccaaggagcttttgcagaactctcagagtagacaagcaaaagggcacaagagtggtcaaccactaggtcactctttcagactagaaaatccaactgagtttcggcctaagagtactcttgagggtcaattgaatgaatccatgtttcttctcagttctcgtcctactcccagaactagcactgcagtggaagtaagtcctggtgaggatatgactcactgttcaccacagaagacttctcctctgaccaagattacaagtggacacctgagtcagcaggacctggaatcccagatgagagagcttatctacacggactcagatcttgttgtcacccccattatcgacaatccaaagataatgaaacagccaccagttaaatttgatgcaaaaatattgcatctaccaacatattcagtggataagttattatttctgaaagatcaagattggaatgactttttgcaacaagtgtgctcgcagatcgactccactgagaagagcatgggggcctcccgagccaagctgaatctcctttgctatttgtgcgtggtggctggtcaccaggaggtggccaccaggctcctccattcccccctgttccaattgctaatccagcatttgcggatagctccaaactgggatatacgggccaaggttgctcacgtaattggtttactggcttcgcacacaactgagctccaggaaaatacacctgttgttgagactacaagctccattggaatcgggattttgaactgtcttgttcaacactccactccagtgcctagacagtgccttgtgtatgtatagatactgacaaatatttcaaaataaataaaactgtatcagca

SEQ ID NO: 62478 - DNA, 1892 bp, Homo sapiens
atgcgcgcaaccgcgggagcagccaagtggactggactcttttcttgacttagctaccaggagctagagatgctgttattctatcgtatgtgagaagtcggcccagagatggaaaactttattctgtatgaggagatcggaagaggaagcaagactgttgtctataaagggcgacggaagggaacaatcaattttgtagccattctttgtactgataagtgcagaaggcctgaaataaccaactgggtccgtctcacccgtgaaataaaacacaagaatattgtaacttttcatgaatggtatgaaacaagcaaccacctctggctagtggtggaactctgcacaggtggttccttaaaaacagttattgctcaagatgaaaacctcccagaagatgttgtgagagaatttggaattgacctgattagtggattacatcatcttcataaacttggcattctcttttgtgacatttctcctaggaagatactcttggaagggcctggcacactgaagtttagcaacttttgcttggcaaaagtggaaggtgaaaatttggaagagttctttgctttggtggcagcagaggaaggaggaggtgataatggggaaaatgtcctgaagaaaagcatgaaaagtagagtcaaaggatctcctgtatatacagcaccagaagttgtgaggggtgctgacttttccatctccagtgacctctggtctttgggctgtctgctttatgaaatgttttcaggaaaacctccattcttctcagaaagtgtttcagaattaactgaaaagatcttatgtgaagatcctttgccacctattccgaaagattcttctcgtcctaaagcttcttcagattttattaatttgcttgatgggttacttcaaagagatcctcagaaaagattgacttggacaaggctactgcagcattcattttggaagaaagcttttgctggagcagatcaggaatcaagcgtcgaagatctcagtctcagcagaaacactatggagtgttctgggccacaagattccaaggagcttttgcagaactctcagagtagacaagcaaaagggcacaagagtggtcaaccactaggtcactctttcagactagaaaatccaactgagtttcggcctaagagtactcttgagggtcaattgaatgaatccatgtttcttctcagttctcgtcctactcccagaactagcactgcagtggaagtaagtcctggtgaggatatgactcactgttcaccacagaagacttctcctctgaccaagattacaagtggacacctgagtcagcaggacctggaatcccagatgagagagcttatctacacggactcagatcttgttgtcacccccattatcgacaatccaaagataatgaaacagccaccagttaaatttgatgcaaaaatattgcatctaccaacatattcagtggataagttattatttctgaaagatcaagattggaatgactttttgcaacaagtgtgctcgcagatcgactccactgagaagagcatgggggcctcccgagccaagctgaatctcctttgctatttgtgcgtggtggctggtcaccaggaggtggccaccaggctcctccattcccccctgttccaattgctaatccagcatttgcggatagctccaaactgggatatacgggccaaggttgctcacgtaattggtttactggcttcgcacacaactgagctccaggaaaatacacctgttgttgagactacaagctccattggaatcgggattttgaactgtcttgttcaacactccactccagtgcctagacagtgccttgtgtatgtatagatactgacaaatatttcaaaataaataaaactgtatcagca

SEQ ID NO: 62479 - DNA, 2633 bp, Homo sapiens
gatttcccggggaggtcccttctgggcccccggcggaggtgggagagagtcaggcaggagccgaggccggggagccctcttcgtcagctggtgctcactgcgccgcgccagcgccagccgggactcacccgcagctccatgcttgtgcccggttcgactcgtccatcctccaagaagaggcagcccatgaggctcccagtccccactgagtgccaccctgaaggatgtcccagctctcctccaccctgaagcgctacacagaatcggcccgctacacagatgcccactatgccaagtcgggctatggtgcctacaccccgtcctcctatggggccaatctggctgcctccttactggagaaggagaaacttggtttcaagccggtccccaccagcagcttcctcacccgtccccgtacctatggcccctcctccctcctggactatgaccggggccgccccctgctgagacccgacatcactgggggtggtaagcgggcagagagccagacccggggtactgagcggcctttaggcagtggcctcagcgggggcagcggattcccttatggagtgaccaacaactgcctcagctacctgcccatcaatgcctatgaccagggggtgaccctaacccagaagctggacagccaatcagacctggcccgggatttctccagcctccggacctcagatagctaccggatagaccccaggaacctgggccgcagccccatgctggcccggacgcgcaaggagctctgcaccctgcaggggctctaccagacagccagctgccctgaatacctggtcgactacctggagaactatggtcgcaagggcagtgcatctcaggtgccctcccaggcccctccctcacgagtccctgaaatcatcagcccaacctaccgacccattggccgctacacgctgtgggagacgggaaagggtcaggcccctgggcccagccgctccagctccccgggaagagacggcatgaattctaagagtgcccagggtctggctggtcttcgaaaccttgggaacacgtgcttcatgaactcaattctgcagtgcctgagcaacactcgggagttgagagattactgcctccagaggctctacatgcgggacctgcaccacggcagcaatgcacacacagccctcgtggaagagtttgcaaaactaattcagaccatatggacttcatcccccaatgatgtggtgagcccatctgagttcaagacccagatccagagatacgcaccgcgctttgttggctataatcagcaggatgctcaggagttccttcgctttcttctggatgggctccataacgaggtgaaccgagtgacactgagacctaagtccaaccctgagaacctcgatcatcttcctgatgacgagaaaggccgacagatgtggagaaaatatctagaacgggaagacagtaggatcggggatctctttgttgggcagctaaagggctcgctgacgtgtacagattgtggttactgttctacggtcttcgaccccttctgggacctctcactgcccattgctaagcgaggttatcctgaggtgacattaatggactgcatgaggctcttcaccaaagaggatgtgcttgatggagatgaaaagccaacatgctgtcgctgccgaggcagaaaacggtgtataaagaagttctccatccagaggttcccaaagatcttggtgctccgtctgaagcggttctcagaatccaggatccgaaccagcaagctcacaacatttgtgaacttccccctaagagacctggacttaagagaatttgcctcagaaaacaccaaccatgctgtttacaacctgtacgctgtgtccaatcactccggaaccaccatgggtggccactatacagcctactgtcgcagtccagggacaggagaatggcacactttcaacgactccagcgtcactcccatgtcctccagccaagtgcgcaccagcgacgcctacctgctcttctacgaactggccagcccgccctcccgaatgtagcgccaggagccacgtcccttctcccttccccgtggtggccccgctccctaaattttttaaaaagacaaaaacaaaacaacaacaacaacacacaaacctgacaagagaaaaacaaacctgaagctgccgagcaggagtggatgcagcctgatcagggtctggagcaaggagccgggctttcctgagctgtggcccggcagggaagatcgcctggacgtggagccagcatcgccccgtgccctcggcgtttgcatttgtaaacttgtggtcttcctatgtgtcagaaacaactgtgtcttgggggggaagaccctcgctgcgccgcttcccgccgcagcgcccgcgcctccgaggggacagcgccctctggagctcgctgggagcatcaccgcctggacgcccgcgccgcggaggagccggcgcccatctccacccgcacggctcgccggtccagagccatgagccaagagccctcttcacgctgctaactccaggggacagacgaagggacatctttggaaaacgctggttttggtttttaaaaagcccaacttttttttttaatttccataactaaagtgttcagactgg

SEQ ID NO: 62480 - DNA, 1157 bp, Homo sapiens
cgccccagccccgggatgctgctccggccccgcaggccgcccccgctcgcgccccccgcgccgccctcgcccgccagccccgaccccgagccgcggacacccggagacgccccggggaccccgccccggaggcccgcctcgcccagcgcgctgggggaactcgggttgccggtgtccccgggctcggcgcagcgcacgccctggagcgcccgggagacggagctgctgctggggacgctgctgcaaccggccgtgtggcgcgcgctgctcctggaccgccgccaggccctgcccacctaccgccgcgtgtcggccgcgctggcccagcagcaggtgcgccgcacccccgcgcagtgccgccgccgctacaagttccttaaagacaagtttcgcgaggcgcacggccagccgcccgggcccttcgacgagcagatccggaagctcatggggctgctgggcgacaacgggcgcaaacggcctcgccgccgctccccggggtccgggcgcccccagcgcgcccgccgcccggtccccaacgcgcacgcgccggctcccagcgaaccagacgccaccccgctgcccaccgcccgcgaccgcgacgcggaccccacctggacgctccgcttcagcccgtccccaccgaagtctgcggacgcctcccccgcccccggctccccgccagctcccgccccgaccgccctcgccacctgcatccccgaggaccgcgcgcccgtccgcggccccgggtccccgccgccacccccggcccgcgaagaccccgactcgccgcccggccgccccgaggactgcgcgccccctccggccgcgcccccgtcgctgaacaccgccctgctgcagaccctggggcacctgggcgacatcgcgaacatcctgggcccgctgcgcgaccagctgctgaccttgaaccagcacgtggagcagctgcgcggcgccttcgaccagacagtgtccctggccgtgggcttcattctgggcagcgcggccgccgagcgaggggtcctcagggacccgtgccagtgagtcccggctgcggccagtctcccctctccaggccgaggcccctccgccctgacccctcctgctgccttcccacccccgttcttgggtatgttcaataaaaggattgttttcctaga

SEQ ID NO: 62481 - DNA, 976 bp, Homo sapiens
atgtggacactgggagaaggaagtgagatggaaaagttctttgattgcatccaagaagtgaatggtcctcaagggcgaccattggctgggtagtggagtgttgaccaatcacagctcaggggcgtgattgtctcgtcctgggatcgcgagaggggtatatacagggaggccaggcagcctggagttagccgaccgttgcgagacgttgagctgcggaagatgagtccaaagccgagagcctcgggacctccggccaaggccacggaggcaggaaagaggaagtcctcctctcagccgagccccagtgacccgaagaagaagactaccaaggtggccaagaagggaaaagcagttcgtagagggagacgcgggaagaaaggggctgcgacaaagatggcggccgtgacggcacctgaggcggagagcgcgccagcggcacccggccccagcgaccagcccagccaggagctccctcagcacgagctgccgccggaggagccagtgagcgaggggacccagcacgaccccctgagtcaggaggccgagctggaggaaccactgagtcaggagagcgaggtggaagaaccactgagtcaggagagccaggtggaggaaccactgagtcaggagagcgaggtggaagaaccactgagtcaggagagccaggtggaggaaccactgagtcaggagagcgaggtggaggaaccactgagtcaggagagccaggtggaggaaccactgagtcaggagagcgagatggaagaaccactgagtcaggagagccaggtggaggaaccaccgagtcaggagagcgagatggaagaactaccgagtgtgtagacggccaagtactcccctatctccgagagcagcgactaagttcaggcccagccgccagacctcagagatctcaccagcggggtgcttgccattctgaagataataaaatgaatgtgttgcaaattgaaaaaaaaaa

SEQ ID NO: 62482 - DNA, 1096 bp, Homo sapiens
atgtggatgctgggagaagtatgtgagatggaaaagttgtttcatggcatccaagaagtgaatgatcctcaaggtgtagcagaggaatttgtaggagagagggatgattgacatcttcgtgtagccctccatccatcccagttagcatggagggattttagggctaccattggctgggtagtggagtgttgaccaatcacagctcaggggcgtgattgtctcgtcctgggatcgcgagaggtgtatatacagggaggccaggcagcctggagttagtcgaccgttgcgagacgttgagctgcggaagatgagtccaaagccgagagcctcgggacctccggccaaggccacggaggcaggaaagaggaagtcctcctctcagccgagccccagtgacccgaagaagaagactaccaaggtggccaagaagggaaaagcagttcgtagagggagacgcgggaagaaaggggctgcgacaaagatggcggccgtgacggcacctgaggcggagagcgggccagcggcacccggccccagcgaccagcccagccaggagctccctcagcacgagctgccgccggaggagccagtgagcgaggggacccagcacgaccccctgagtcaggagagcgagctggaggaaccactgagtcaggagagcgaggtggaagaaccactgagtcaggagagccaggtggaggaaccactgagtcaggagagcgaggtggaagaaccactgagtcaggagagccaggtggaggaaccactgagtcaggagagcgaggtggaggaaccactgagtcaggagagccaggtggaggaaccactgagtcaggagagcgagatggaagaaccactgagtcaggagagccaggtggaggaaccactgagtcaggagagcgagatggaagaaccactgagtcaggagagcgagatggaagaactaccgagtgtgtagacggccagctactcccctatctccgagagcagcgactaagttcaggcccagccgccagacctcagagatctcaccagcggggtgcttgccattctgaagataataaaatgaatgtgttgcaaaaaaaaaaaaaaaaaa

SEQ ID NO: 62483 - DNA, 1004 bp, Homo sapiens
atgtggatgctgggagaagtatgtgagatggaaaagttgtttcatggcatccaagaagtgaatgatcctcaaggtgtagcagaggaatctgtaggagagagggatgattgacgtcttcgtatagccctccatccatcccagttagcatggagggattttagggctaccattggctgggtagtggagtgttgaccaatcacagctcaggggcgtgattgtctcgtcctgggatcgcgagaggtgtatatacagggaggccaggcagcctggagttagtcgaccgttgcgagacgttgagctgcggaagatgagtccaaagccgagagcctcgggacctccggccaaggccacggaggcaggaaagaggaagtcctcctctcagccgagccccagtgacccgaagaagaagactaccaaggtggccaagaagggaaaagcagttcgtagagggagacgcgggaagaaaggggctgcgacaaagatggcggccgtgacggcacctgaggcggagagcgggccagcggcacccggccccagcgaccagcccagccaggagctccctcagcacgagctgccgccggaggagccagtgagcgaggggacccagcacgaccccctgagtcaggagagcgagctggaggaaccactgagtcaggagagcgaggtggaagaaccactgagtcaggagagccaggtggaggaaccactgagtcaggagagcgaggtggaagaaccactgagtcaggagagccaggtggaggaaccactgagtcaggagagcgaggtggaggaaccactgagtcaggagagccaggtggaggaaccactgagtcaggagagcgagatggaagaactaccgagtgtgtagacggccagctactcccctatctccgagagcagcgactaagttcaggcccagccgccagacctcagagatctcaccagcggggtgcttgccattctgaagataataaaatgaatgtgttgcaaattgaaaaaaaaaa

SEQ ID NO: 62484 - DNA, 551 bp, Homo sapiens
gagaggggtatacacagggaggccaggcagcctggagttagtcgaccgttgcgagacgttgagctgcggcagatgagtccaaagccgagagcctcgggacctccggccaaggccaaggagacaggaaagaggaagtcctcctctcagccgagccccagtggcccgaagaagaagactaccaaggtggccgagaagggagaagcagttcgtggagggagacgcgggaagaaaggggctgcgacaaagatggcggccgtgacggcacctgaggcggagagcgggccagcggcacccggccccagcgaccagcccagccaggagctccctcagcacgagctgccgccggaggagccagtgagcgaggggacccagcacgaccccctgagtcaggagagcgagctggaggaaccactgagtaaggggcgcccatctactcccctatctccctgagcagcaactaagtttaggcccagctgccagacctcagagatctcaccagcagggtgcttcccatgttgatgacaataaaatgaatgtgttgcaaaccgaaa

SEQ ID NO: 62485 - DNA, 573 bp, Homo sapiens
ggggtatacacagggaggccaggcagcctggagttagtcgaccgttgcgagacgttgagctgcggcagatgagtccaaagccgagagcctcgggacctccggccaaggccaaggagacaggaaagaggaagtcctcctctcagccgagccccagtggcccgaagaagaagactaccaaggtggccgagaagggagaagcagttcgtggagggagacgcgggaagaaaggggctgcgacaaagatggcggccgtgacggcacctgaggcggagagcgggccagcggcacccggccccagcgaccagcccagccaggagctccctcagcacgagctgccgccggaggagccagtgagcgaggggacccagcacgaccccctgagtcaggagagcgagctggaggaaccactgagtaaggggcgcccatctactcccctatctccctgagcagcaactaagtttaggcccagctgccagacctcagagatctcaccagcagggtgcttcccatgttgatgacaataaaatgaatgtgttgcaaaccgaaaaaaaaaaaaaaaaaaaaaaaaaaaaa

SEQ ID NO: 62486 - DNA, 2691 bp, Homo sapiens
ggggaggggaaggagcggcacatggggttgagcagaggagaaaatcagaaagatggcttagagaagtcagcagtctgcgagtctggggaggatggagagtggtttggggttttgggtcggggtctaaggtgatcagatgcagaagcattacacagtggcctggtttctttactcagcccctggggtagatcccagccccccatgtaggtcccttggctggaaaaggaagagggagtggtcagatgaatctgaggaggagccggagaaggagctcgcccctgagcctgaggagacctgggtagtggagacgctgtgtgggctcaagatgaagctgaagcaacagcgagtgtcacccatcctccttgagcaccacaaggacttcaacagtcagcttgcccctggggtagatcccagccccccgcataggtccttttgctggaaaaggaagatggagtggtgggacaaatctgaggagtcggaggaggagccacggaaggtgctcgcccctgagcctgaggagatctgggtggcggagatgctgtgtggcctcaagatgaagctgaagcgacggcgagtgtcgctcgtgctccctgagcaccacgaggccttcaacaggctgcttgaggatcctgtcattaaaagattcctggcctgggacaaagatctgagggtgtcggacaagtatctccttgctatggtcatagcgtatttcagccgagccggcttcccctcctggcaataccaacgccttcatttcttcctggctctctacctggccaatgacatggaggaggacgacgaggactccaaacaaaacatcttccacttcctgtatgggaagaaccgctctcgcatacccttgctccgtaagcgtcggttccagttataccgttccatgaacccgagggccaggaagaaccgctctcacatacccttggtccgtaagcgtcggttccagttacgccgttgcatgaacccgagggccaggaagaaccgctctcagatagtcctgttccagaaacgtcggttccacttcttctgttccatgagctgcagggcttgggtttccccagaggagttggaggagatccaggcttatgacccagagcactgggtgtgggcgcgagatcgcgctcgcctttcctagagctccagggaccgtggaggcctgaggtcatcggcctgagagaagaacaccggacccaggggagatgtggattttcagcaggaactttattccaatgctaatggcagacaccaggaaggaggagaggaaccatttgtgcagatcatctagaagaacctggaccattcttgatggagctgaatacagtgatcacgttgtcctcctaggagcaggggtggggggagggggatggggtccttctaggagtccttggagaaaagtaagaaaccaggagtgtttccagttccaccctttcctggggcaccaccaccctttttatattgctgaattccaacctccctggggcggaacctggaggtcctgtttcttacggacttggttgccacagtccaggagcatttgaaggcacaatgcaggggctcagattggcacagaattcttttgtgaaatatcagtgccacagattgtaacagatagcttcatgcacactctgcattttattggtttgtttggaaaatgttggccattgaattattcatagatttatttcaaatagtttggaaattgttgtacttttgaaaacatgctgttcctgtagttttttgatgagagttatagttgttatatatacataaagataattttcttttcatttttgagacaattctttttatcctaaatattttatcatctttaaatttgtttctgtattattatatgtgctcctgaagcgagcactctttttatctatgatacttccataataatctcttctatttatagctattggtagttcccctaaattctgacgatagaaatttttatttgctgtttaggtttgtgactgaattgtgagaattcagttgtgatttttaacatgtgtcagatatatatactaacacgtctaatatatactattttattggtttattttgaaaaacatgggtatagaattatttaaatattattttatttatttaaatatttattaaatatatttatttatttaaatgttattattactttaaatattattttaaatattttggaaatactggtatttttgaatagatgctgtttctataaagctgtgtgatggtattataactgttatatacacatacatataattttgttttcctttttaagagaggattcttttcatcctaaatcttttacctttcaatctttgtatctattattacacgtgctgctgaagggagcatggtttttatctatgatacttagttaacatatatattacatttatagctatgtagtagttcccctaaattcttgtaaaaataaatttttatttgatatttcatctatgtttgaaatgtgagaattcagatgtaattttttaccttgatttggcatgtttgtatgttactttaaagaggatgtgtgttctaaaggaggacatgagctgtgtgttttcaagagaacaatagagtgtgtctcttggggaaacgtaataaaaatgaacttttctcaccttcaaaaaaaaaaaaaaaaaaaaaaaaaaaaaaaaaaaaaaaaaa

SEQ ID NO: 62487 - DNA, 3320 bp, Homo sapiens
gttcttccgtgccaagtcgtgcttgtaaagaagcggtacttcctcttactcccgggacagaacttcccctcaggagggagaacatccgccgaacgaaatggagagcaaaagaccgcgactgctcgaggaagcagacaagcagaaaaagacagtcagagtgggactcaatgcaccttccatgctacgaaagaaccagctaggtttcctcagattcgccaactattgccgtatagctcgcgagctgcgtgtaagctgcatgcagaggaaaaaggtccagattcatagctgggatccctcctctttggcaagcgaccgatttaaccgcatactggcgaataccaacactgaccagctcttcacagtgaaccaagtcgaagctggaggctccaagtacggcatcatcaccatgcgaggcctgacgacccctgagctccgggtatacccgcacaaaaccctctacgtccctaatcggaaggtgaattctatgtgctgggcctcactgaatcacttggattcccaccttctgctgtgcttcgtgggacttgcagatactccaagctgtgccgtgctgctcccagcgtcgctgttcataggtagcttcccaggaatgcgtcggcctggcatgctttgcagtttccagatccctgatgcctggtcctgtgcctggtccctgagcatccacgcgtatcactctttcagtacaggcttgtctcagcaggtcctgttgaccaacgtggtgacgggacaccagcagtcatttgggactagcagtgatgtcttggcccagcagtttgcaatcatgactcctttgctgtttaatggctgtcgctctggggagatctttggcattgatctgcgctgtggaaatcaaggcagcgggtggaaggccatttgcctgtcccatgattcagcagtgacttctctgcaaatcctccaagatggccaattcctggtgtcatcagacatgactggaactatcaagctgtgggacttgagggccactaaatgtgtaacacagtacgaaggtcatgtgaataactccgcctacctacccgtgcatgtgaacgaagaagaaggagtcgtggcggccgtgggccaggactgctacacgagaatctggagcctccgtcatggccacctgctcacaaccataccctccccataccccgcctcggagaacgacattcccagtgtggccttctcttctcgcctcgggggcttccgaggagcaccagggctgctcatggctgtccgggaggacctttattgtttctcctacggttaattcttcaggatgcagcccggaggaacgtggatttgacttaaagaagtaaagagcatcgtattaccgtttctatgagcgcattttaagagatgttcggtgtttgtagatcccatccatccggctgctaggggtaaggtgctgttttatgtgaagatagttctgtaaagttgtttcagttaaactgggctgagagagcttgaaagtccttttcataaaagataactatttccttttcttgttgaataccttagaatagttgtccccccctttttttttttttaacaaaaaaacacttttctaaggactgaagattggcaaaaactaaaataaattaaaactgcttacaccagaagccttttagagaagcatgagactgtttgactagtcctacctgggttccggaaatacatgcatcatctgtacttgaagaggccagtgggagaggagaggagggggaggtcatttatctgagtctctccagaagtttttaaggctacattttggaatcattaaacttggccttctcaaactcaatagcagatctctgagattctccttttattattttccataggcaatgggaggaaaggtggatctttttaaataatagaagttttaaacagtccttaacgtgcttttgttgaggcatcttccagaatgtaaggtacagcagctccggtttctattattgtgacttgaatgtcaggattcaagggctcagtgtcaaagataattggctttgactttttgtaatctaggagcagcagtttgtgagatgtttattcaaagtgttagcctgtttttctaccaacaataagctagaaaagacaaaaaaaacaaaaaacaaaaaaacgtgtaataaagttagtggctacttcttaatagccaaagcctggaaatgatctcactttacaatatgctaaaattgataaataatttgtgctgtagtcatacaattggataaagcataatataaaataaggcacaattgctatatgaaactgtggattaatctcaacatgttgattgtaaatgtaggtagaaatgagtacaaactgattcagttctaaagttccaaagcactaaaaacttatctatggtgattacagtttgaatagtaggtatctctgtggaaggaagaaaggatattgtttgtttttttcccttttatttttaggatattgtttggaaagtaacacggggaaactttagaaatgctgttttctttttcttgatccttgatacatacatattttgtatgtctatacacttcacactttatataatacctcaaaaataaaaatatgaaaacagtacactgttgtaggttggtcaggaaagggaatgattgtggcttggacctgactatgagaagtagaaataatcagaaaaatcagaaatgattgcattggaagatcattcgaaggtagtattagtaagatttgctgatgagagtaatctagaaagtgaaagacagcataaagattgcagcttttttgttaactttaggactggtggatggttggtgtcatttactaaaatggggaggatttgaggtgaaaaaattttaggtgaagagaataatgctgagttttaggcaactattaaaatgtccattctgtagattagaggtgatgtcaggacataaatgaggttaatgtaatattacatattgatagaggaataggtcaatagagaagatacaaaagagtggttaggtgcatagatttttgaaatcagttaaattagtttttgatacttgatgtgtgacaggggaaactgtgtaagctgtacttgttatttctttgtaaaatgtcttagataataaaactaaatcataaagtagatattggtttaaaggatgtatacattgtcccttttacattgtaagcattcaataagaactagctgcggatgtaattttttttaaaaaagtccaaaagcagctatgggcagttgacaaaagaaaatgtaatgactacgtaacttgcgaatctgtttaccctcacttgcaaataaaataagtgcaaaaaaa

SEQ ID NO: 62488 - DNA, 4611 bp, Homo sapiens
gggtcgcgtcagtgcggagacagcggtgtcctgcgcgtcttcgggtcagtacggggggccgcgtcgtagggactcactggcggtgcgcgacctgggctggctccgggggtggcgggcgcagctgctgtgacagcttattgcaggagtgaccaggacactacctcctagaagtaatgcccacagaaagcgcaagttgttcgactgctcgccaaacaaaacagaagcgcaaatcccatagcctttctatacgaagaactaacagctcggagcaggagaggacgggactgccaagagacatgttagaaggacaagattctaaactgccttcctcggttcgcagtacacttctggaactgtttggtcaaatagaaagagaatttgaaaacctttatatcgaaaacttagaattacgtagagaaatcgacactcttaatgaacgtttagctgctgaaggacaagcgattgatggagcagagctgagtaagggccaactcaaaacaaaagccagtcacagcaccagccagctctcccagaaactgaagaccacttacaaggcttccaccagcaagattgtctccagctttaagaccacgacatcgagagctgcctgccagctcgtgaaggagtacatcggccaccgggacggcatctgggatgtcagcgtggccaagacacagccagtggtgctcgggactgcatcagccgatcacacggctttgctgtggagcatagagacagggaagtgcctagtcaagtacgcaggccacgtgggctcagtaaattctatcaaatttcatccctcagagcagttggctctcactgcttctggagatcagactgctcatatctggagatacgcggtgcagctgccgacaccccagcctgttgctgacactagtatatctggggaagatgaagtagagtgctctgacaaggacgagcccgacctcgatggggatgtgtccagcgactgccccaccatccgcgtcccactgacatccctcaagagccaccagggcgtggtcatcgcctccgactggctggttggggggaagcaggctgtgactgcctcctgggaccggacggcaaacctgtacgacgtggagacgtccgagctcgttcactctctgacagggcacgaccaggagttgacgcactgctgcacacaccccacccagcggctcgtggtgacctcctcccgtgacacgactttccgcctctgggatttcagggacccctccatccactcggtgaatgttttccagggacacacggacactgtgacttctgccgtgttcaccgtgggagacaacgtggtttcaggcagcgatgaccgcacggtgaaagtctgggacttgaaaaatatgagatcccccattgcaactattcgcacggactctgccattaacaggatcaatgtatgtgtcggccaaaaaatcatagccctcccccatgacaaccgacaagtgagactgtttgatatgtcaggagtgcgcctggcgcggcttccccggagcagccgacagggccacaggagaatggtatgctgctcggcatggagtgaagaccaccccgtgtgcaatctgttcacctgtgggtttgaccggcaagccattggttggaacatcaacatccctgcattgctacaagaaaaataaggacaccggcagcccttagtttcactgtttgccagcacagacctttgatgggtgcaggcttttctgcgtattaatcagccatttttgtgagagtttgaccctggaaagggtgctttgtatatgttcttttcacatagtgcccagcttgcatgaaatgtacagagaaatgtgtggtcgtattttttacttttgtcttgtatatgtatgtatattgggtcctctgggcagtagaggcaaagctcacctcccatgtagcacatgaaatgcttgtgagttgttgacattggacaggtgaacagtagggcattacatttgtgtgaattaaatgtgaacttctgtattacgttgcggcgtcggcagtcctgcgttccctggagtaactgtacgtatctgcctttgctgggaagactgtggggctgcctgtgttggctggcgaccagcaggattgctccaggattttgtgtttacctcgcgtgaagttcagcacgtgctgtcgtgtagtcagcttctactctaatttctgttacagttctgcaaaggtaacctggagtttagaagttaaaaaaaagcatgggatgttggatttgcaccatttggagtttctttaggaaagaaaagttttctgcttttttatagaaaatcatttcagtctcccgaggtctcatgctagcaaattttgaaataggattctaatcactgatttcaaatattaagcaaaatgtaaagcactttaatttatagctatggttataaacaggttttagatgtttcaaatgacttgtccactgaatgtcacttgaccttgataagaggccgcctgcacacagagcccagttaattctccgcacctcggttgtgtgcttccgaatgggctcactcccgtggtggtgtttgagagccaacaacactacctcagagacgggtctttgggaaactttgggtctcactgttgcctggctggagcactttggtttatagctggaatactgagttcagttcagaaggcaggaaagacagtcacaccgacgtgtcctgaaggtgtaggctctccacttaggcgcacaagctgacggctgcagccagcaggccccggtgacgagacacttccaggtcttgtggtggggacgcctctcagtgccagtcccgccactgctgagtgagcctggtgttcttgccttcttggaaattactgctcacctggtatctgtacgttaatgtttcttgctgagttacagttttgataaagaggctctcatttcctgtgtcttgtatattcagtcctttcaatacgtccacctggaggctcaccacttggagagacacaggaaggtaatatttacagctgtcatgtgacatccccaggtctttgtgttttgccctgttttacggtgaggtaggagggaacccatctggggaccggtaggtgcaggtgcagtaggacgtgggacttttggacccgtcctttggtgcagctcgccagggatgagaggcacctccctacttgggtcttcaggagctggtccaaggagcttcgaatctaagtcatctagaatgaccctgaaatgactgacagccccgggcccaagaaaaacccataaccacctcagatggatctgacgtggctaagggacaaacagcaaatatttcagtcattttgattttacaaataaaaaatgtgttgtgtttttgtccgacattatttcctgactgcactgttctgagaatggagtccacctggtccctctggttgattagaatctcaggtttcagctcctgctgtcctgagcgaacttgcctgatgcagggctgtgctgtgtccagatgttgctggggcctcactttttctcttggctggaggtccaattgccagagcctcccacactgcacatacaaaggtctgagcccagggcagcttctggggccactgcacaggccacctgcttgggttcctcggagtttaatttgaaagtctgggtgtcttaggatgatggttaggaacattgaaaaatggctgcaaatagccaaatcaaacttaagaaccagatctctgccagattaaacatttttgaagcttttaaaagtcaatattcctagtggccactgagttccaggcacactggtgccctttactgccacagctgctcaccttgtctggcaaactggagggacctcagaaactggactcctgcatgtccttgggggcgcagccctgtggtgctcaggcagagctctcaggagccggggcaccttgctgttcgctgctgtgtcgtcttctaatgtgagctcatccactgctgctgcagcgtggtgatcaggagtcacagacaagatcggggatggtgtgtgtgtgtgtgtgtgtgtgtgtgtgcacgtgtgtgtggctaaattaagtcatactgtcaaccacacgtgatctcgtctgaaacagtgtttggaagtgggaacagttttgtcctgtatgctgatgtgtccagaatttcatttaatgatagacggaaaatgtgtggttactgaaaactgtatatgatacagaatttcataagagccatgctgttgggcaaagcaactctttttcaaccactgctcatcagtttctgtagagacaaaaactctgtacatattttggaatctgaagaatcctatgtaaatcatttgttacttaagtctgtgaaaaacatatttctttggaggaaaatgtatgcatttataagtgttccatggaatcagtttttattgtatcgatataattgtctctaagtgttgactgtcttcattgcaatatgaaattcattaaaatgtccatgttccataattactattataaaagctttgtgttattgggagtcttattatttttatagtttttcatgttttgctttggtgaaacattgtgaatgactatataaacatcacgatgagctagaaattgaacaaatataatactggtcactcg

SEQ ID NO: 62489 - DNA, 1584 bp, Homo sapiens
cgaggaggggagcgggaagcgcagtgccagcgccacagcccttcaatcattttggttgctatccagcttctccacatcaagtccaacttcagaaaccccaagcctgtagagaaaagttgacctgtgctgactctggtgatggtgactgtctctcactaatttctttgaagtcttcaaggataagcagagttgatccatctgagaaagggatcatgaactagacagaatgaacagccttagaggcacagactcttgaacgggacggtggtggtatgactagtgcagagtgtttagagatcactcagtttttaaagactggcctttatcgtgtctcagtgcagccgaggcagagcctttgaaggatgcgatgttgtcattcttactaatctagtccagccgctgaggtgactttcaacggcagaccgtctcctgagcgccccaggtagaatttcaaaagtctccgggaccattatggcagtcaagtggacgggtgggcattcttctcctgtcctctgcctgaatgcaagtaaagaagggctgctggcttctggagcagagggcggagatctcacggcttggggtgaagatggaactccattaggacacacgcggttccaaggggctgatgatgttaccagtgtcttattttctccctcctgtcccaccaagctctatgcctcacatggagaaaccattagtgtactggatgtcaggtccctcaaagattccttggaccattttcatgtgaatgaagaagaaatcaattgtctttcattgaatcaaacggaaaacctgctggcttctgctgacgactctggggcaatcaaaatcctagacttggaaaacaagaaagttatcagatccttgaagagacattccaatatctgctcctcagtggcttttcggcctcagaggcctcagagcctggtgtcatgtggactggatatgcaggtgatgctgtggagtcttcaaaaagcccgaccactctggattacaaatttacaggaggatgaaacagaagaaatggaaggcccacagtcacctggtcagctcttaaaccctgccctagcccattctatctctgtggcttcgtgtggtaatatttttagttgtggtgcagaagatggtaaggttcgaatctttcgggtgatgggagttaagtgtgaacaggaactgggatttaagggccacacttcaggggtatcccaggtctgctttctcccagaatcctatttgctgcttactggagggaatgatgggaagatcacgttgtgggatgcaaacagtgaagttgagaaaaaacagaagagtcccacaaaacgtacccacaggaagaaacctaaaagaggaacttgcaccaagcagggtggaaatactaacgcttcagtaacagatgaggaagaacatggcaacattttaccaaagctaaatattgaacatggagaaaaagtgaactggctcttgggtacaaaaataaagggacaccaaaatatattagtagctgatcaaactagttgtatatctgtataccccttaaatgaattttaaatccaataaaaacatttgaagaaaaaaaaaaaaaaa

SEQ ID NO: 62490 - DNA, 4729 bp, Homo sapiens
ggtggcggcagcggcggttaggggatgtaacggtcgcccgcctccggcgtgacgatggcggccgtagggtccggaggctatgcgcggaacgatgcaggggagaagctgccctctgtcatggcgggagttccggcgcggaggggccagtcctccccgccccccgccccaccaatctgcctacggcggcggacgcgactctcgacggcctccgaggagacggtgcagaaccgggtgtcactcgagaaggtgcttggcatcacagcccagaacagcagtggcctaacctgtgaccccggcacaggccatgtggcctacctggcaggctgtgtggtggtgattttggaccccaaggagaacaagcagcagcacatctttaacaccgccaggaagtctctcagtgctctggcctcctcccctgatgggaagtacatagtgacaggggagaatgggcataggcctgctgtgcgcatctgggatgtggaggagaagaatcaggtggcggagatgctaggccacaagtatggtgtggcgtgtgtggccttctcacccaatatgaagcacatcgtgtccatgggctaccaacatgacatggtgctcaacgtctgggactggaagaaagacatcgtagtggcctccaacaaggtatcttgtagagtcattgccctctccttctcagaggacagcagctattttgtcactgttgggaaccgccatgtgaggttctggttcttggaagtctccactgagacaaaggtgacgagcacagtgccccttgtagggcgctcgggcatcctgggcgagctgcacaacaacatcttctgtggtgtggcctgcggtcggggccggatggcgggcagtaccttctgtgtgtcctactcgggcctcctctgccagttcaatgagaagagggtgctggagaagtggatcaacctgaaggtctccctgtcttcctgcctctgtgtcagccaggagctcatcttctgtggctgcacagatgggatagtccgcatcttccaggcccatagcctgcactacctcgccaacctgcccaagccacactaccttggggtagacgtggcacagggcctggagcccagcttcctcttccacaggaaggcggaagcagtctacccagatacagtggcactgaccttcgaccccatccaccagtggctgtcctgcgtgtataaggaccacagcatctacatctgggatgtcaaggacatcaacagagtgggcaaggtgtggtcagagctcttccacagctcctacgtttggaacgtggaggtgtatcctgagtttgaagaccagagagcttgtttgccatcaggatcctttctgacttgttcttcagacaacaccattcgcttctggaacttggacagcagccctgattctcactggcagaaaaacatcttcagcaataccctgctgaaggtcgtgtacgtggagaatgacatccagcacctgcaggacatgtcacacttcccagaccgggggagcgagaatgggacacccatggatgtgaaagccggggtgcgggtcatgcaggtcagtcctgacggccagcatttggcttcaggcgaccgaagtggaaatctgaggatccacgagctgcacttcatggacgagctggtcaaggtggaggcccatgatgctgaggtgctgtgcctggagtactccaagccagagacggggctgaccttgctggcctcagccagtcgggaccggctgatccatgtgctgaacgtggagaagaactacaacctggagcagacgctggatgaccactcctcctccatcaccgccatcaagttcgctggcaacagagacatccagatgatcagctgtggggctgacaagagcatctactttcgcagtgcccagcagggttcggatggactacactttgtccgtacccaccacgtagcagagaaaaccaccttgtatgacatggacattgacatcacccagaagtacgtggccgtggcctgccaggaccgcaatgtgagagtctacaacactgtgaacgggaagcagaagaagtgctacaagggctcccagggtgacgaagggtccttgctgaaggtccatgtggacccctcaggcaccttcctggccaccagctgctctgacaaaagcatctcagtgattgacttttactcgggcgagtgcattgccaagatgtttggccattcagaaattattaccagcatgaagttcacctatgactgtcatcacttgatcacagtatctggagacagctgcgtgttcatctggcacctgggcccggagatcaccaactgcatgaagcagcacttgctggagattgaccaccggcagcagcagcagcacacaaatgacaagaagcggagtggccaccccaggcaggatacgtatgtgtccacacctagtgagattcactccctgagccctggagagcaaacagaggatgatctggaggaagagtgtgagccagaagagatgctgaagacaccatccaaagatagcttggatccagatcctcgttgcctgctaaccaacggcaagctgccactgtgggcaaagcggctgctaggggacgatgatgtggcagatggctcggccttccacgccaagcgcagctaccagccccacggccgctgggcagagcgggccggccaagagcccctcaagaccatcctggatgcccaggacctggattgctactttacccccatgaagcccgagagtctggagaactccattctggattcactggagccacagagcctggccagcctgctgagtgagtcagagagtccccaggaagctggccgcgggcacccctccttcctgccccagcagaaggaatcatctgaggccagtgagctcatcctctactctctggaggcagaagtgacagtcacagggacagacagccagtattgcaggaaggaggtggaggccgggcctggagaccagcagggcgactcctacctcagggtgtcctccgacagcccaaaggaccagagcccgcctgaggactcgggggagtcagaggccgacctggagtgcagcttcgcagccatccactccccagctccgcctcctgaccctgcccctcggtttgccacgtcgctgccccatttcccaggatgcgcaggtcccacagaagatgagctgtccctgcccgagggacccagcgtccccagcagctccctaccccagactccggagcaggagaagttcctccgccaccactttgagacactgactgagtccccctgcagagctctgggagacgtggaggcctctgaagctgaagaccacttcttcaacccacgcctgagtatctccacgcagttcctctcaagcctccagaaggcatccaggttcacccataccttccctccccgggcaacccagtgccttgtgaagtctccagaggtcaagctcatggaccgaggcggaagccagcccagagcaggtactggctacgcctccccagacaggacccacgtcctcgctgcagggaaggctgaagagaccctggaggcctggcgcccaccacctccctgccttacgagcctggcgtcctgtgtccctgcttcctccgtgctgcccacagacaggaatctcccaacgcccacatctgcacccaccccaggcctggctcagggtgtccatgccccctccacctgttcctacatggaggccactgccagctcccgtgccaggatatcacgcagcatctccctcggtgacagtgagggccctatcgtggccacactggcccagcccctccgtaggccatcgtccgttggggagctggcctccttgggccaggagcttcaggccatcaccaccgcgacaacacccagtttggacagtgagggccaagagcctgccctgcgttcctggggcaaccacgaggcccgggccaacctgagactgaccctgtcaagtgcctgtgatgggctcctgctgccccccgtggatacccagcctggcgtcaccgtccctgcagtgagcttcccagcccctagccctgtggaagagagcgccctgaggctccacggctctgcctttcgcccaagtctcccagctcctgagtcccctggccttcctgcccaccccagtaacccccagcttccagaggcccggcctggcatccctggcggcactgcctccctcctggagcccacctccggtgcacttggtctgttccagggcagccctgcccgctggagtgagccctgggtgccggttgaagccctgcccccatctccccttgagctgagcagggtggggaacatcttgcacaggctgcagaccaccttccaagaagccctcgacctttaccgtgtgttggtctccagtggccaggtggacaccgggcagcagcaggcacggactgagctggtctccaccttcctgtggatccacagccagctggaggctgaatgcctggtggggactagtgtggccccagcccaggctctgcccagcccaggacccccgtccccaccgacgctgtaccccctggccagcccagacctgcaggccctgctggaacactactcggagctgctggtgcaggccgtgcggaggaaggcacgggggcactgagggcgcagcccctccaccgcagccctgctgcttctgaggacttaggtattttaagcgaataaactgacagctttgagaaaaaaaaaaaaaaaaaaaaaaaaaaaaaaaaaaaaaaaaa

SEQ ID NO: 62491 - DNA, 1669 bp, Homo sapiens
atgcgcacccgcgtcccgctgctgtttagccgtttccaaggctacgaagcccatcggccggggataagagagcaagaaaatgaagctcaagagcctcctgctccggtattacccgccaggaattatgttggaatatgaaaaacatggagaattaaagactaagtccatagatttgcttgatcttggtcccagcactgatgtcagtgcgttagtagaagaaatccagaaggcagaacctctactcacagcttcacgaacagagcaagtcaaacttttgatacagaggttgcaagagaaactcggccagaacagcaatcacacgttctatctttttaaggttctcaaagcacatatattgccactgactaatgttgcacttaacaaatcgggctcatgctttatcacaggaagctatgatcggacgtgcaagctctgggacactgcgtctggagaggagctgaacacgctggagggccacaggaatgtggtttatgccatagcattcaacaatccttacggtgacaaaatcgccactgggtcctttgataaaacttgtaaactctggagtgtggaaacaggaaaatgttaccataccttcaggggtcatacagcagaaatagtgtgtttatcatttaaccctcaaagcacattggtggcgactggaagtatggacacaacagccaaattgtgggacattcagaatggcgaggaagtttacaccttaagaggacattctgccgaaatcatctccttgtcatttaacacctcaggagacagaatcatcacggggtcttttgatcataccgttgtagtgtgggacgctgatactggaaggaaggtaaatatcttaattggtcattgtgctgagattagcagtgcctcattcaattgggattgctctctaatattaactggctctatggacaaaacctgcaagctgtgggatgctacaaatggaaaatgtgtggcaaccttaacaggccatgatgatgaaatactagacagctgctttgattacactggaaagcttattgcaactgcttcagctgatggaacagcaagaattttcagtgctgccacaagaaaatgcattgccaaactggaaggtcatgaaggtgaaatttcaaagatttctttcaaccctcaagggaaccatcttctaactggcagctctgacaaaacggctagaatctgggatgctcagactggccagtgcctccaggttcttgaggggcacactgatgaaatcttttcatgtgctttcaactataaaggcaacatagtcattacaggcagcaaggataatacctgtaggatatggcgttgactgaaggaagctggtcagtgagcaaccttgctagcaatggtaatcaagaactggaacttcacagacagcagctctcttaatatttcttatactttctctttttctgcaagtcaactatttctacaactgtccttcatttcacagatatgaccattaaacatgacaaagttatgccactccaatattattatttgatggcgatggcaggacacagcataatgtttggctaatgccaccagttatttcagttgtgtttgttttttaaaagcattatgatactgaaaaaggagaccagaacaacttaacaacgtgtctcctggattttactttgaagcctattgt

SEQ ID NO: 62492 - DNA, 7572 bp, Homo sapiens
ctcagctccgggccgagcgcgagcttgggctcgtaccccgctcccctctctccgcccgctctttacctaccggccgtagctggcccggtgggctcgcggggagacgctcgcgcgcgcaagcgcacacgacgcggagcggagctcgagacatcgaggagaggagtaagaagcatcggaggaggcgatcgaggaggaggcggtgtgtgtgtatgtgtctattctacggtgtggctcgtcgtggggcgagaggaggctcgagagagggcgagggagaagcgaaaagagtaagagagtcttcctttgcgagagcctctaatctggttgctatggaaatacatgaccacgcaaaaggaagtccattctgataattctgatacctgagatgtaactggactgaagagtagaaacaggaaaaattttagtgccaactttaattacaatggccactgattcaggggatccagccagcacagaagattctgagaaacctgatggaatttcatttgaaaacagagttccccaggtcgctgcaactttgacagtagaagctagactaaaggagaaaaacagtaccttctctgcttctggggaaactgtagaaaggaagagatttttccgaaagagtgttgaaatgacggaagatgacaaagttgccgaatcatcccccaaagatgagagaattaaggctgcaatgaatattccaagagtagataagcttccttcaaatgtgttgagaggtggacaagaagttaaatatgaacagtgttcaaagtcaacctcagaaatctcaaaagattgtttcaaggagaaaaatgaaaaggaaatggaagaagaagcagaaatgaaggctgtagctacttctcctagtggcagattcctgaaatttgacatagaactaggaagaggagcatttaaaacagtatataaaggactggacactgaaacatgggttgaggttgcttggtgtgagctgcaggaccgaaagttaaccaaagctgagcagcaaagattcaaggaagaagcagagatgttgaagggtctccagcaccccaatatagttcgattttatgattcctgggaatctatattaaaaggaaagaaatgtattgtattagtgactgaactaatgacatctgggaccttaaagacgtacttaaaacgatttaaagtcatgaaaccaaaggtcttaaggagctggtgcaggcaaattttaaaggggttgcagttcttgcacactaggactcctcctattattcaccgggatctgaagtgtgacaatattttcatcacgggacccactggatctgtgaagattggtgatctaggattagccaccttaatgcgtacctcatttgctaagagtgtcattggaactcctgagtttatggctccagagatgtatgaagaacactatgatgaatccgtagatgtttatgcttttggaatgtgtatgctggaaatggccacatcggagtatccttattctgagtgtcagaatgcagctcaaatataccggaaagtaactagtggcataaaaccagccagcttcaataaagtcactgatcctgaagtcaaagaaatcattgaaggatgtattcgtcaaaacaaatctgaaaggttgtctatcagggacctattaaaccatgcattttttgctgaggatacaggactgagggtggagttagcagaagaagatgattgctcaaattcatcccttgctttaagactctgggttgaagaccctaaaaaattgaaaggcaaacacaaagacaatgaagctattgaatttagtttcaacttagaaacagatacacctgaggaagtagcatatgaaatggtcaagtctgggttcttccatgaaagtgattccaaagctgttgctaaatccattagagaccgggtgacgccaataaagaagacaagagagaagaagcctgctggctgtttggaagaacgcagggattctcagtgcaagtctatggggaatgtattccctcagccccagaatacaactttaccccttgctcccgctcagcaaactggggctgaatgtgaagaaactgaagttgatcaacatgttagacaacagcttctacaaagaaaaccacagcagcactgctcctctgttacaggtgacaatttgtctgaggcaggagctgcatcagttatacattcagatacttcaagtcagcccagtgtagcctattcctcaaatcaaacgatgggctctcaaatggtttctaatatcccgcaggctgaagtaaatgttccagggcaaatttattcatctcagcaactagtaggacattaccagcaagtttcagggttacagaagcattcaaagctgactcagccgcagattttgcctttggttcaaggtcagtccactgttttacctgtacatgtccttggaccgacagttgtttcacaaccccaggtttccccattaactgttcagaaggtcccacagataaagcctgtatcccaaccagttggagctgaacaacaagcagctcttctaaaaccagatttagttcgaagcttgaatcaagatgtggcaactacgaaggaaaacgtcagtagccctgataacccaagtggaaatggcaaacaggatcggatcaaacagagaagagcttcctgtccccgaccagagaaggggactaaatttcagcttaccgtccttcaggtatcaacctctggagataacatggtagagtgtcagctggagacacacaacaacaagatggtcaccttcaagtttgatgttgatggtgatgcgccagaggatattgcagactatatggttgaagataactttgtgctggaaagtgagaaagaaaaatttgtagaagaattgagagctattgtaggtcaagcccaggagatccttcatgtccactttgccacagaaagagccactggagttgattctattactgtggactccaacagtagccagacagggtcatctgaacaagtacagataaattctacatctactcaaaccagcaatgaatctgctcctcagtcatccccagttggtcggtggcgattctgtatcaatcagacgataagaaaccgtgagactcagtctcctccttctcttcagcattccatgtctgcggttcctggccgacatccacttcctagtccaaaaaacacaagtaataaggaaatatcacgggacacattgctcactatagaaaataatccatgccaccgtgcacttttcacctccaaatcagaacacaaggatgtggttgatggtaagatttctgaatgtgctagtgtagaaaccaagcagccagctatactttatcaagtggaagataacaggcagataatggcaccagttactaatagttccagttactctactacttcagttcgtgcagttccagctgaatgtgagggactcaccaaacaagcaagcatattcatacctgtgtatccatgtcaccaaactgccagtcaggctgatgcacttatgtcccatcctggcgaatcaactcagacttctggtaactctcttacaactctggcatttgatcaaaagcctcaaaccttatcagtacagcagccagctatggatgcagagtttatttctcaagaaggagaaactacagtgaacactgaagcaagttctcctaagacagtcattcccactcagacccctggccttgaaccaactacccttcaacccactactgtcctggaatcagatggagaaagacctccaaaactggagtttgcagacaaccgaattaaaactctggatgaaaaattaagaaacttgctctatcaggagcacagcatctctagcatctatcccgagagtcagaaggatacccaaagcatagactctccattttcttcctctgctgaagataccctctcctgtccagtgacagaagtcatagccatcagtcactgtggaattaaagatagccctgtacaatcccctaatttccaacagacaggctctaagcttctgtccaatgtggctgcaagtcagcctgctaatatatcagtgttcaaaagggacctgaatgtgataacttctgtacccagcgaattgtgtttacatgagatgtcctcagatgcttcacttccaggggatccagaggcctatcctgctgctgtgtcaagcggtggagccattcatctgcagacaggagtggaaacagaagagatgagatcagcaattgctcctgatcccattcctctgacacgggagtccacagctgatactagggctttgaatagatgtaaagcgatgagtggatcatttcagcggggtcggttccaggtgattacaattcctcagcagcagtcagcaaaaatgacatcttttggaatagaacacatatcagtgttcagtgagacaaaccattctagtgaagaagcctttattaaaacagcaaagtctcagttggtagaaatagaacctgccacacaaaatccaaaaacttcgttttcttatgagaagttacaagctcttcaggaaacctgtaaagaaaataaaggagttcccaaacaaggtgacaacttcttatctttcagcgcagcttgtgagactgatgtatcttcagtgaccccagaaaaggaatttgaagaaacttcagccacaggaagtagcatgcagtctggatctgaactgttgcttaaagagagagagatattgactgctgggaaacagcctagctctgatagtgaattttcagccagtcttgctggcagtggaaagtcagtggcaaagactggtccagagagtaatcagtgcttaccacaccacgaagaacaagcttatgctcaaacacagagttcactcttctattcgccatcttccccaatgagcagtgatgatgaatcagaaatagaggatgaggacttgaaggtggagcttcaaagattacgagaaaaacacattcaggaggtggtaaatcttcaaacccagcagaataaggagctgcaggagctctatgaacgccttcggtcaattaaagatagcaaaacccaatctactgagattcctttgccacctgcatcaccacgtcgaccaagatctttcaaaagcaaacttcgaagccgcccccagtccttgacacatgtggacaatggcatagttgctacagatccactgtgtgtggagagtaatgcagcatcatgccaacagtctccagccagtaaaaaagggatgttcacagatgacttacacaagctggtggatgactggacaaaggaagcagtaggaaattctcttattaagccaagtttaaaccaacttaaacaaagtcaacacaaactagagacagaaaactggaataaagtatctgaaaatactccgtctactatgggctacacatcaacatggatttcttctctgtcccaaatccgtggagctgtcccaacttccttgccacaaggactctcactcccttcatttcctgggccattatcatcatatggaatgcctcacgtttgtcagtataatgctgtggcgggggcggggtatccagtacagtgggtaggaatttcaggaacaacacaacaatctgtagtaattcccgcccaatctgggggaccattccagccagggatgaatatgcaggcatttccaacttcatcagtgcagaatcctgccacaatccctcctggtcctaaatgaatcagagtagatggtgataaaaagggaggttttttcagaattattttcaggacacccaagatattaaagtttcttcctcttgggttctgtcatattttccctcatttgagtttactttagactatatattttttgttccagtgtggtatttgatacagctcatcattctgtagaaatgtgcagtttgcagatagaacactgcacacagaaatgttttttcacttcaaattctatcctctttgatacttgattttttaaaaatactgttcagaatgctttaataagctcagcttgagcattaccatttccaggacactttccatgaattgttgagaagctccccatcccccgcctttttttttttttttttaactgctgctatctgcagctggatactcttctttaaaaatgtttaaaaattatttagattgattctccccaaatgtggatgaactgagaccctccatcagccagagtcttatgggatcttcacttcacatgtttgtcttaggtttacctttcacagaaggcagggtaacttgctgcaggaaacgttttggtgtataaaattagaatcacttttttttttttttttgagatggagtctctctctgtcacccaggttggagtgcagtggtgtgatcttggctcactgctgcaacctccccctcctgggttcaagcgattctcctgcctcagcctcctgagtagctgggactacaggcgccagccaccatgcctggctaatttttgtatttttagtagaggatggggtttcactatgttggccagactggtctcaaactcctaaccttgtgatccgccctccttagcccccccaaaaaattacaataattttgtcaaccaatacagaacatgagccctttttaaatgtgatttcccgtcatcacagcagtaggatgaagccttgttttgggtgagacagagggaaagggaaaaaacagaattgtaacagttccttgattctgcagatactgctgctgttttacgatttcagtaataattcaaagcagctgtctccttgtttctcacatgcatactacattggttttgagcatctgagaggcattggtttgtcttgcattcttttgcaaggcatatattgcagctgatatgaatctcgtttggggggaatccttgtattcctaacaagggggattaaagctacacctcaatccattcttctgaagtgaaatttacttgacacagtaggtttcgagacttacatatgaaacactggctttacagggttctcagagatgtggggtatacactgtcctgcagtgagatagtagaccctagaaggatactatttaagttgtccttagctctttttaattacaatttttagttgttagaatttctttttagtatctatagtatcttagatgattttagatcttaaatgagtttggcagcctctttagaatctgagagagatcactgtcaagttgcactttactgggttttatccagttttaggaggaggggaggcaatgtcaaaatgtacacctttggtttttaagaaggttaactataataatgttaaaggctagtcacagggttacctaatgctcagtctgtgaaacctaaatagaattcttaaaatgttatttaccaactaagtattcatgttcaaattacttaccttccactctgaagactttaaggtcatttctaatacacatttacctaattaggagttctgtctactagtaaacattccaaattgctacccaacattactgttaacagattttcctccgtattcttctaaaaattataccccatgggcttgccaggtaatgacgaaaacttaatgggtgtacttttttttttttttgcacagtctactttgtgacattaagtacctcttttcc

SEQ ID NO: 62493 - DNA, 7743 bp, Homo sapiens
ctcagctccgggccgagcgcgagcttgggctcgtaccccgctcccctctctccgcccgctctttacctaccggccgtagctggcccggtgggctcgcggggagacgctcgcgcgcgcaagcgcacacgacgcggagcggagctcgagacatcgaggagaggagtaagaagcatcggaggaggcgatcgaggaggaggcggtgtgtgtgtatgtgtctattctacggtgtggctcgtcgtggggcgagaggaggctcgagagagggcgagggagaagcgaaaagagtaagagagtcttcctttgcgagagcctctaatctggttgctatggaaatacatgaccacgcaaaaggaagtccattctgataattctgatacctgagatgtaactggactgaagagtagaaacaggaaaaattttagtgccaactttaattacaatggccactgattcaggggatccagccagcacagaagattctgagaaacctgatggaatttcatttgaaaacagagttccccaggtcgctgcaactttgacagtagaagctagactaaaggagaaaaacagtaccttctctgcttctggggaaactgtagaaaggaagagatttttccgaaagagtgttgaaatgacggaagatgacaaagttgccgaatcatcccccaaagatgagagaattaaggctgcaatgaatattccaagagtagataagcttccttcaaatgtgttgagaggtggacaagaagttaaatatgaacagtgttcaaagtcaacctcagaaatctcaaaagattgtttcaaggagaaaaatgaaaaggaaatggaagaagaagcagaaatgaaggctgtagctacttctcctagtggcagattcctgaaatttgacatagaactaggaagaggagcatttaaaacagtatataaaggactggacactgaaacatgggttgaggttgcttggtgtgagctgcaggaccgaaagttaaccaaagctgagcagcaaagattcaaggaagaagcagagatgttgaagggtctccagcaccccaatatagttcgattttatgattcctgggaatctatattaaaaggaaagaaatgtattgtattagtgactgaactaatgacatctgggaccttaaagacgtacttaaaacgatttaaagtcatgaaaccaaaggtcttaaggagctggtgcaggcaaattttaaaggggttgcagttcttgcacactaggactcctcctattattcaccgggatctgaagtgtgacaatattttcatcacgggacccactggatctgtgaagattggtgatctaggattagccaccttaatgcgtacctcatttgctaagagtgtcattggaactcctgagtttatggctccagagatgtatgaagaacactatgatgaatccgtagatgtttatgcttttggaatgtgtatgctggaaatggccacatcggagtatccttattctgagtgtcagaatgcagctcaaatataccggaaagtaactagtggcataaaaccagccagcttcaataaagtcactgatcctgaagtcaaagaaatcattgaaggatgtattcgtcaaaacaaatctgaaaggttgtctatcagggacctattaaaccatgcattttttgctgaggatacaggactgagggtggagttagcagaagaagatgattgctcaaattcatcccttgctttaagactctgggttgaagaccctaaaaaattgaaaggcaaacacaaagacaatgaagctattgaatttagtttcaacttagaaacagatacacctgaggaagtagcatatgaaatggtcaagtctgggttcttccatgaaagtgattccaaagctgttgctaaatccattagagaccgggtgacgccaataaagaagacaagagagaagaagcctgctggctgtttggaagaacgcagggattctcagtgcaagtctatggggaatgtattccctcagccccagaatacaactttaccccttgctcccgctcagcaaactggggctgaatgtgaagaaactgaagttgatcaacatgttagacaacagcttctacaaagaaaaccacagcagcactgctcctctgttacaggtgacaatttgtctgaggcaggagctgcatcagttatacattcagatacttcaagtcagcccagtgtagcctattcctcaaatcaaacgatgggctctcaaatggtttctaatatcccgcaggctgaagtaaatgttccagggcaaatttattcatctcagcaactagtaggacattaccagcaagtttcagggttacagaagcattcaaagctgactcagccgcagattttgcctttggttcaaggtcagtccactgttttacctgtacatgtccttggaccgacagttgtttcacaaccccaggtttccccattaactgttcagaaggtcccacagataaagcctgtatcccaaccagttggagctgaacaacaagcagctcttctaaaaccagatttagttcgaagcttgaatcaagatgtggcaactacgaaggaaaacgtcagtagccctgataacccaagtggaaatggcaaacaggatcggatcaaacagagaagagcttcctgtccccgaccagagaaggggactaaatttcagcttaccgtccttcaggtatcaacctctggagataacatggtagagtgtcagctggagacacacaacaacaagatggtcaccttcaagtttgatgttgatggtgatgcgccagaggatattgcagactatatggttgaagataactttgtgctggaaagtgagaaagaaaaatttgtagaagaattgagagctattgtaggtcaagcccaggagatccttcatgtccactttgccacagaaagagccactggagttgattctattactgtggactccaacagtagccagacagggtcatctgaacaagtacagataaattctacatctactcaaaccagcaatgaatctgctcctcagtcatccccagttggtcggtggcgattctgtatcaatcagacgataagaaaccgtgagactcagtctcctccttctcttcagcattccatgtctgcggttcctggccgacatccacttcctagtccaaaaaacacaagtaataaggaaatatcacgggacacattgctcactatagaaaataatccatgccaccgtgcacttttcacctccaaatcagaacacaaggatgtggttgatggtaagatttctgaatgtgctagtgtagaaaccaagcagccagctatactttatcaagtggaagataacaggcagataatggcaccagttactaatagttccagttactctactacttcagttcgtgcagttccagctgaatgtgagggactcaccaaacaagcaagcatattcatacctgtgtatccatgtcaccaaactgccagtcaggctgatgcacttatgtcccatcctggcgaatcaactcagacttctggtaactctcttacaactctggcatttgatcaaaagcctcaaaccttatcagtacagcagccagctatggatgcagagtttatttctcaagaaggagaaactacagtgaacactgaagcaagttctcctaagacagtcattcccactcagacccctggccttgaaccaactacccttcaacccactactgtcctggaatcagatggagaaagacctccaaaactggagtttgcagacaaccgaattaaaactctggatgaaaaattaagaaacttgctctatcaggagcacagcatctctagcatctatcccgagagtcagaaggatacccaaagcatagactctccattttcttcctctgctgaagataccctctcctgtccagtgacagaagtcatagccatcagtcactgtggaattaaagatagccctgtacaatcccctaatttccaacagacaggctctaagcttctgtccaatgtggctgcaagtcagcctgctaatatatcagtgttcaaaagggacctgaatgtgataacttctgtacccagcgaattgtgtttacatgagatgtcctcagatgcttcacttccaggggatccagaggcctatcctgctgctgtgtcaagcggtggagccattcatctgcagacaggaggtggatattttggcctaagctttacttgtcctagtctcaaaaatcctattagcaagaaatcctggactcgcaaattaaaaagctgggcatacaggctacggcagtcaaccagctttttcaagagatcaaaagtccgtcaagtggaaacagaagagatgagatcagcaattgctcctgatcccattcctctgacacgggagtccacagctgatactagggctttgaatagatgtaaagcgatgagtggatcatttcagcggggtcggttccaggtgattacaattcctcagcagcagtcagcaaaaatgacatcttttggaatagaacacatatcagtgttcagtgagacaaaccattctagtgaagaagcctttattaaaacagcaaagtctcagttggtagaaatagaacctgccacacaaaatccaaaaacttcgttttcttatgagaagttacaagctcttcaggaaacctgtaaagaaaataaaggagttcccaaacaaggtgacaacttcttatctttcagcgcagcttgtgagactgatgtatcttcagtgaccccagaaaaggaatttgaagaaacttcagccacaggaagtagcatgcagtctggatctgaactgttgcttaaagagagagagatattgactgctgggaaacagcctagctctgatagtgaattttcagccagtcttgctggcagtggaaagtcagtggcaaagactggtccagagagtaatcagtgcttaccacaccacgaagaacaagcttatgctcaaacacagagttcactcttctattcgccatcttccccaatgagcagtgatgatgaatcagaaatagaggatgaggacttgaaggtggagcttcaaagattacgagaaaaacacattcaggaggtggtaaatcttcaaacccagcagaataaggagctgcaggagctctatgaacgccttcggtcaattaaagatagcaaaacccaatctactgagattcctttgccacctgcatcaccacgtcgaccaagatctttcaaaagcaaacttcgaagccgcccccagtccttgacacatgtggacaatggcatagttgctacagggaaaagctgccttataaatgagttggaaaatccactgtgtgtggagagtaatgcagcatcatgccaacagtctccagccagtaaaaaagggatgttcacagatgacttacacaagctggtggatgactggacaaaggaagcagtaggaaattctcttattaagccaagtttaaaccaacttaaacaaagtcaacacaaactagagacagaaaactggaataaagtatctgaaaatactccgtctactatgggctacacatcaacatggatttcttctctgtcccaaatccgtggagctgtcccaacttccttgccacaaggactctcactcccttcatttcctgggccattatcatcatatggaatgcctcacgtttgtcagtataatgctgtggcgggggcggggtatccagtacagtgggtaggaatttcaggaacaacacaacaatctgtagtaattcccgcccaatctgggggaccattccagccagggatgaatatgcaggcatttccaacttcatcagtgcagaatcctgccacaatccctcctggtcctaaatgaatcagagtagatggtgataaaaagggaggttttttcagaattattttcaggacacccaagatattaaagtttcttcctcttgggttctgtcatattttccctcatttgagtttactttagactatatattttttgttccagtgtggtatttgatacagctcatcattctgtagaaatgtgcagtttgcagatagaacactgcacacagaaatgttttttcacttcaaattctatcctctttgatacttgattttttaaaaatactgttcagaatgctttaataagctcagcttgagcattaccatttccaggacactttccatgaattgttgagaagctccccatcccccgcctttttttttttttttttaactgctgctatctgcagctggatactcttctttaaaaatgtttaaaaattatttagattgattctccccaaatgtggatgaactgagaccctccatcagccagagtcttatgggatcttcacttcacatgtttgtcttaggtttacctttcacagaaggcagggtaacttgctgcaggaaacgttttggtgtataaaattagaatcacttttttttttttttttgagatggagtctctctctgtcacccaggttggagtgcagtggtgtgatcttggctcactgctgcaacctccccctcctgggttcaagcgattctcctgcctcagcctcctgagtagctgggactacaggcgccagccaccatgcctggctaatttttgtatttttagtagaggatggggtttcactatgttggccagactggtctcaaactcctaaccttgtgatccgccctccttagcccccccaaaaaattacaataattttgtcaaccaatacagaacatgagccctttttaaatgtgatttcccgtcatcacagcagtaggatgaagccttgttttgggtgagacagagggaaagggaaaaaacagaattgtaacagttccttgattctgcagatactgctgctgttttacgatttcagtaataattcaaagcagctgtctccttgtttctcacatgcatactacattggttttgagcatctgagaggcattggtttgtcttgcattcttttgcaaggcatatattgcagctgatatgaatctcgtttggggggaatccttgtattcctaacaagggggattaaagctacacctcaatccattcttctgaagtgaaatttacttgacacagtaggtttcgagacttacatatgaaacactggctttacagggttctcagagatgtggggtatacactgtcctgcagtgagatagtagaccctagaaggatactatttaagttgtccttagctctttttaattacaatttttagttgttagaatttctttttagtatctatagtatcttagatgattttagatcttaaatgagtttggcagcctctttagaatctgagagagatcactgtcaagttgcactttactgggttttatccagttttaggaggaggggaggcaatgtcaaaatgtacacctttggtttttaagaaggttaactataataatgttaaaggctagtcacagggttacctaatgctcagtctgtgaaacctaaatagaattcttaaaatgttatttaccaactaagtattcatgttcaaattacttaccttccactctgaagactttaaggtcatttctaatacacatttacctaattaggagttctgtctactagtaaacattccaaattgctacccaacattactgttaacagattttcctccgtattcttctaaaaattataccccatgggcttgccaggtaatgacgaaaacttaatgggtgtacttttttttttttttgcacagtctactttgtgacattaagtacctcttttcc

SEQ ID NO: 62494 - DNA, 626 bp, Homo sapiens
ggacctgggaaggagcataggacagggcaaggcgggataaggaggggcaccacagcccttaaggcacgagggaacctcactgcgcatgctcctttggtgcccacctcagtgcgcatgttcactgggcgtcttcccatcggccccttcgccagtgtggggaacgcggcggagctgtgagccggcgactcgggtccctgaggtctggattctttctccgctactgagacacggcggacacacacaaacacagaaccacacagccagtcccaggagcccagtaatggagagccccaaaaagaagaaccagcagctgaaagtcgggatcctacacctgggcagcagacagaagaagatcaggatacagctgagatcccagtgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaaatgaagacaagctgaaacaacgcaagctggttttatattagatatttgacttaaactatctcaataaagttttgcagctttcaccaaaaaaaaaaaaaaa

SEQ ID NO: 62495 - DNA, 481 bp, Homo sapiens
gggaacgcggcggagctgtgagccggcgactcgggtccctgaggtctggattctttctccgctactgagacacggcggacacacacaaacacagaaccacacagccagtcccaggagcccagtaatggagagccccaaaaagaagaaccagcagctgaaagtcgggatcctacacctgggcagcagacagaagaagatcaggatacagctgagatcccaggtgctgggaagggaaatgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaaatgaagacaagctgaaacaacgcaagctggttttatattagatatttgacttaaactatctcaataaagttttgcagctttcaccaaaaaaaaaa

SEQ ID NO: 62496 - DNA, 785 bp, Homo sapiens
gggaacgcggcggagctgtgagccggcgactcgggtccctgaggtctggattctttctccgctactgagacacggcgggtaggtccacaggcagatccaactgggagttgaagtgtgagtgagagtgaagaggaaccagcaggcttccggagggttgtgtggtcagtgactcagagtgagaaggccctcgaagtcgtcgtccctctcatgcggtgccacgcccatggaccttcttgtctcgtcacggccataactagggaggaaggagggccgaggagtggaggggctcaggcgaagctggggtgctgttgggggtatccgagtcccagaagcacctggaaccccgacagaagattctggactccccagacgggaccaggagagggacggcatgagcgacacacacaaacacagaaccacacagccagtcccaggagcccagtaatggagagccccaaaaagaagaaccagcagctgaaagtcgggatcctacacctgggcagcagacagaagaagatcaggatacagctgagatcccagtgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaaatgaagacaagctgaaacaacgcaagctggttttatattagatatttgacttaaactatctcaataaagttttgcagctttcaccaaaaaaaaaa

SEQ ID NO: 62497 - DNA, 1644 bp, Homo sapiens
taattctaaattctgatgcagaacgtatcagtgaaactccctcccactgtctcttgtattagcatcaaggaagcgagaaaaaataagcaccctgagaatggagacagtgtttgaagagatggatgaagaaagcacaggaggagtttcatcttcgaaagaagaaatagtccttggccagagactccatctaagctttccttttagcattatcttctcaactgttctctactgtggtgaggttgcctttggtttatacatgtttgaaatttatcgaaaagctaatgacacattctggatgtcatttaccatcagctttattattgtgggggcaattttggatcaaattatcctgatgtttttcaacaaagacttgaggagaaataaggctgcattacttttttggcacattcttcttttaggacctattgtgaggtgtttgcacaccattagaaattaccacaaatggttgaaaaatcttaaacaggagaaggaagagactcaagttagcatcacaaagagaaacacgatgctggaaagggagattgcattctcaatccgggataatttcatgcagcagaaggctttcaagtacatgtcagtgattcaggcttttctcggttctgttccacaattaattttgcagatgtatatcagtctcactatacgagaatggcctttgaatagagcattgctgatgacattttccctgttatcagttacttatggggccattcgctgcaatatactggccatccagatcagcaatgatgatactaccattaagctaccgccgatagaattcttctgtgtcgtgatgtggcgttttttggaggttatctcacgtgtagtgactctggcattgttcattgcatctctgaaactgaagagcctacccgttttgttaatcatatattttgtatcattgttggcaccgtggctggagttttggaaaagtggagctcatcttcctggcaacaaagaaaataattccaatatggtgggtacagtactgatgcttttcttgatcacactgctatatgctgccatcaacttctcctgctggtcagcagtgaaactgcagttgtcagatgacaaaataattgacgggagacagaggtggggccatagaatcctacactacagctttcagttttttagaaaatgtgataatgatattggtatttaggttctttggagggaaaactttgctgaattgttgtgactcattaattgccgtgcagctcatcataagctacctattggccactggctttatgctcctcttctatcagtatttgtacccatggcagtcaggcaaagtgttgccaggacgtactgaaaatcagccagaagcaccgtactattatgtaaacatcgagaaaactgaaaagaataaaaataagcagctgaggaattactgtaactcctgcaatagggttggatatttttcaatcagaaaaagtatgacatgttcataaaatatacatatatactttcacagaacaatgagtaaagatgctgaatgtgacttgttaagaggctcttaaatttaaaaaatatacacagcaaaatcttggaagtggtttctaataaaattcatttatgttctcctgtgaaaaaaaaaaaaagaaaaaaaaaaaaaaa

SEQ ID NO: 62498 - DNA, 856 bp, Homo sapiens
aagcggcccaaagcggggttgcgccggggcctccggggccgaggtgggcctgctcattggaagatcgcatcgcagccatgagcagtaaggatttcttcgcgtgtggacactctggccattgggctcggggatgccctagaggaggagctggagggcgaagaggtggaggccatggcagaggttctcaatgtggttccaccaccctatcttacacctgttactgctgtggtgagtccggtcgtaatgctaagaactgtgtccttctcggaaacatctgctacaactgtgggagaagcggccacatcgccaaagactgtaaggatcctaaacgagagagacgccaacactgttatacctgcggcagactaggacatctggctcgtgactgtgatcgtcagaaagagcagaaatgctactcttgcggcaaacttgggcacattcagaaagactgcgcccaggtcaagtgttaccgatgcggcgagattggccacgtggccatcaattgcagcaaggcgaggccaggtcaactgctaccgctgcggcaaatcccgacatctagccaaggaatgtcccagtgaggttaccacttaaatcttcccccccaccccccacccttttgctgattgataattgtattattttctccgaaaacttcactcaccgaaaggtcgatagattgaggctactctcaggcaagtgagctttaattaccatgttaaaggaggaaagagctagaaaaaaaaacctcaaaaaagtttatcattggtagatgccccacgattaacgtgttgattctgccccacgggcaaatctagttattaaatagtcattctgagcaccaaaaaaaaaaaaaaaa

SEQ ID NO: 62499 - DNA, 2646 bp, Homo sapiens
agtttctcctttgttttacgtttgggaggaggtggcattggaaatagcagagtgcttcgcggtaacaggggttggagtgcaatggtgtgatctcagctcactgcaacccctgcctcccaggctccagcgatcctcccacctcagcctcctgaatagctgaccaccagcacactaggcaaacccaccccactcaccgcctcccttgggaattcagacctaaccatcgctgagctgaaacaaatgtactgaggctggagcctgtgtgaacagaacagaagaggccttcactctagtagtgctcacagtccagcaggtgtttgctgaagacagcttactcagatcactactgcctggaggtggttgatatatcctggtgtaaaccttcaagaagggcacaggcaggaaaacatgagccagcaactgaagaaacgggcaaagacaagacaccagaaaggcctgggtggaagagcccccagtggggctaagcccaggcaaggcaagtcaagccaagacctgcaggcggaaatagaacctgtcagcgcggtgtgggccttatgtgatggctatgtgtgctatgagcctggccctcaggctctcggaggggatgatttctcagactgttacatagaatgcgtcataaggggtgagttttctcaacccatcctggaagaggactcactttttgagtccttggaatacctaaagaaaggatcagaacaacagctttctcaaaaggttttcgaagcaagctcccttgaatgttctttggaatacatgaaaaaaggggtaaagaaagagcttccacaaaagatagttggagagaattcgcttgagtattctgagtacatgacaggcaagaagcttccgcctggaggaatacctggcattgacctatcagatcctaaacagctcgcagaatttgctagaaagaagccccccataaataaagaatatgacagtctgagcgcaatcgcttgtcctcagagtggatgcactaggaagttgaggaatagagctgccctgagaaagcatctcctcattcatggtccccgagaccacgtctgtgcggaatgtgggaaagcgttcgttgagagctcaaaactaaagagacatttcctggttcatactggagagaagccgtttcggtgcacttttgaagggtgcggaaagcgcttctctctggactttaatttgcgtacgcacgtgcgcatccacacgggggagaaacgtttcgtgtgtccctttcaaggctgcaacaggaggtttattcagtcaaataacctgaaagcccacatcctaacgcatgcaaatacgaacaagaatgaacaagagggaaagtagtcctccaacaggatgaagcagattaacagaagagtgatcagtgacaaacatgcctcattgattattgtttctaggaaggaatttctaaatcaatattgcaaccccaaaagcggttataatttggtgttactaagatgctcctacactttgtgataccgttttaaggacatggtgcatttttttttcttttatttgttttatttagaactttttttatttgttttatttagaactttgtgtgttcttaaagtgtgcttccaacaggaaggtcagtgataaattttcaaaagcataaccttcaatatattatctgttggattattggatataagacttattttcatgtactataaatatgaaaataactttgatttttaattgtgtagtttccatttcttagcttttgccttttaaatttatacttcagccaggcatagtgactgatgcctgtaatcccaacactttgttgggaggccaaagcaggaggatagcttgaggccaggagttccagaccagcctgggcaacatagtgagatcctgtctctacaaaaaaaattgtttttatttgtatttatatatttttatttttgtttttgttggtaggcgtctcgctctgtcacccaggctggagtctagtgtcgtgatcttggctcactgcaacctccacctcccgggttcaagtgattctctggcctcagcctcccaagtagctgggactacaggtgtgtgtcaccacgcccggctaatttttgtatttttagtagagatggggtttcaccatgttggccaggctagtctcaaactcctgacctccagtgatctgcccacctcggcctcccaaagtgctgggattacaggtgtgagccactgtgcctggccccccacaacatgtttaaacttagctaggcctggttgcatacgcctgtgttcccagctactcaggaggctgaagcaggaggatagcttgagcccaggagtttgaggctacagtgagctgtgattgcaccactgtactccagactggataacagcaagagcccatcttttaaaaaaagtaaaaattaaaaatatacttcatggttcatgtcatagccctagagaatgaaaaatttgcagtagatagtcaataaatgaatcagtagttaaatattccttaaagtcaactgtatttcattgtgatttttgttttctttttatcattgtatcaaactatatggaaatcatatggttagatgtgattatttgataatgttagtccatttgaatccattttagatatttcacaattaaagaatatgaaacttc

SEQ ID NO: 62500 - DNA, 1685 bp, Homo sapiens
ctttctggacttggactccttgggagtcgtttctcggccatttgacccgtgggacttgtgggttttgtgctgctttttctttctttcttccccttttccaacttcagcaatacacccagatgttagtcgagtcacgtcccgccgccctctgcccttgaaatgctggcaagtacgcagccccgcgatcgtcacgtgacgccggggttcagcgtatccttgctgggcaaccgtcttagagaccagcactgctggctgcaccatgaatgtgatctacccactggcagtccccaaggggcgcagactctgctgtgaggtgtgcgaagccccagccgagcgggtgtgcgcggcctgcacagtcacttattactgtggcgtggtacatcagaaggctgactgggacagcatccatgagaaaatatgtcagctcttgattccactgcgcacttccatgcccttctacaattcagaggaagaacggcagcatggcctgcagcagctgcagcagcggcagaagtatttgattgaattctgctacaccatagcccagaaatacctctttgaagggaaacacgaagatgctgtaccagcagctttgcagtcccttcgcttccgtgtgaagctgtatggcctgagctccgtagagcttgtgcctgcttacctgctgttggccgaggccagccttggtctgggccgaatcgttcaggctgaagaatatctattccaagcccagtggacagtcctcaaatcaactgactgtagtaatgccacccactctttactgcatcggaatctgggacttctctatatagctaagaaaaactatgaagaggcccgttatcatctggccaatgatatttattttgccagttgtgcatttggaacagaggacattaggacttcaggaggctacttccacctggctaatatattctatgaccttaaaaagttggacctggcagacacattgtacaccaaggtctctgagatctggcatgcatatttgaacaatcactatcaagtcctctcacaggctcacatccaacaaatggatttactgggcaaactatttgagaatgacactggcttggatgaagcccaagaagcagaagccattcgcatcctgacttcaatcttgaacattcgagaatctacatctgacaaagccccccaaaaaaccatctttgttctgaagatcctggtcatgctttactacctgatgatgaattcttcaaaggcacaggaatatggcatgagggccctcagtctagccaaagaacaacagcttgatgtccatgagcaaagcaccattcaagagttattaagtctcatttcaactgaagaccatcccattacttagtgacccatgagctctgcatcaagggttattccaggggctactgaagatctaatatattccagccttgcacaactgctttgaggtactgtagactgctgaagtttccaccctcttcccctgggattgcacacatagctgttatttttttcttacacagcatattaagggaatataaagctttaggcatagaaatcactaaaaactgtgtttgtcatgacctttgtacttgatttatcatgactttgtatgactgagtaatatgtagtcagatcactaatatggtatttgtaattaaactacaaatagtttgtcaaaaaaaaaaaaaaaa

SEQ ID NO: 62501 - DNA, 5653 bp, Homo sapiens
gacaaagagaactaatgctttgtgctgattcatatttgaatcgaggcattgggaaccctgtatgccttgtttgtggaaagaaccagtgacaccatcactgagcttcctaaaagttcgaagaagttagaggactatacactttcttttgaacttttataataaatatttgctctggtttttggaacccagggctgttagaggggtgagtgacaagtcttacaagtggccttattccaactccagaaattgcccaacggaactttgagattatatgcaatcgaaagtgacaggaaacatgccaactcaatccctcttaatgtacatggatgggccagaagtgattggcagctctcttggcagtccgatggagatggaggatgccttgtcaatgaaagggaccgctgttgttccattccgagctacacaagaaaaaaatgtcatccaaatcgaggggtatatgcccttggattgcatgttctgcagccagaccttcacacattcagaagaccttaataaacatgtcttaatgcaacaccggcctaccctctgtgaaccagcagttcttcgggttgaagcagagtatctcagtccgcttgataaaagtcaagtgcgaacagaacctcccaaggaaaagaattgcaaggaaaatgaatttagctgtgaggtatgtgggcagacatttagagtcgcttttgatgttgagatccacatgagaacacacaaagattctttcacttacgggtgtaacatgtgcggaagaagattcaaggagccttggtttcttaaaaatcacatgcggacacataatggcaaatcgggggccagaagcaaactgcagcaaggcttggagagtagtccagcaacgatcaacgaggtcgtccaggtgcacgcggccgagagcatctcctctccttacaaaatctgcatggtttgtggcttcctatttccaaataaagaaagtctaattgagcaccgcaaggtgcacaccaaaaaaactgctttcggtaccagcagcgcgcagacagactctccacaaggaggaatgccgtcctcgagggaggacttcctgcagttgttcaacttgagaccaaaatctcaccctgaaacggggaagaagcctgtcagatgcatccctcagctcgatccgttcaccaccttccaggcttggcagctggctaccaaaggaaaagttgccatttgccaagaagtgaaggaatcggggcaagaagggagcaccgacaacgacgattcgagttccgagaaggagcttggagaaacaaataagggcagttgtgcaggcctctcgcaagagaaagagaagtgcaaacactcccacggcgaagcgccctccgtggacgcggatcccaagttacccagtagcaaggagaagcccactcactgctccgagtgcggcaaagctttcagaacctaccaccagctggtcttgcactccagggtccacaagaaggaccggagggccggcgcggagtcgcccaccatgtctgtggacgggaggcagccggggacgtgttctcctgacctcgccgcccctctggatgaaaatggagccgtggatcgaggggaaggtggttctgaagacggatctgaggatgggcttcccgaaggaatccatctggataaaaatgatgatggaggaaaaataaaacatcttacatcttcaagagagtgtagttattgtggaaagtttttccgttcaaattattacctcaatattcatctcagaacgcatacaggtgaaaaaccatacaaatgtgaattttgtgaatatgctgcagcccagaagacatctctgaggtatcacttggagagacatcacaaggaaaaacaaaccgatgttgctgctgaagtcaagaacgatggtaaaaatcaggacactgaagatgcactattaaccgctgacagtgcgcaaaccaaaaatttgaaaagattttttgatggtgccaaagatgttacaggcagtccacctgcaaagcagcttaaggagatgccttctgtttttcagaatgttctgggcagcgctgtcctctcaccagcacacaaagatactcaggatttccataaaaatgcagctgatgacagtgctgataaagtgaataaaaaccctacccctgcttacctggacctgttaaaaaagagatcagcagttgaaactcaggcaaataacctcatctgtagaaccaaggcggatgttactcctcctccggatggcagtaccacccataaccttgaagttagccccaaagagaagcaaacggagaccgcagctgactgcagatacaggccaagtgtggattgtcacgaaaaacctttaaatttatccgtgggggctcttcacaattgcccggcaatttctttgagtaaaagtttgattccaagtatcacctgtccattttgtaccttcaagacattttatccagaagttttaatgatgcaccagagactggagcataaatacaatcctgacgttcataaaaactgtcgaaacaagtccttgcttagaagtcgacgtaccggatgcccgccagcgttgctgggaaaagatgtgcctcccctctctagtttctgtaaacccaagcccaagtctgctttcccggcgcagtccaaatccctgccatctgcgaaggggaagcagagccctcctgggccaggcaaggcccctctgacttcagggatagactctagcactttagccccaagtaacctgaagtcccacagaccacagcagaatgtgggggtccaaggggccgccaccaggcaacagcaatctgagatgtttcctaaaaccagtgtttcccctgcaccggataagacaaaaagacccgagacaaaattgaaacctcttccagtagctccttctcagcccaccctcggcagcagtaacatcaatggttccatcgactaccccgccaagaacgacagcccgtgggcacctccgggaagagactatttctgtaatcggagtgccagcaatactgcagcagaatttggtgagccccttccaaaaagactgaagtccagcgtggttgcccttgacgttgaccagcccggggccaattacagaagaggctatgaccttcccaagtaccatatggtcagaggcatcacatcactgttaccgcaggactgtgtgtatccgtcgcaggcgctgcctcccaaaccaaggttcctgagctccagcgaggtcgattctccaaatgtgctgactgttcagaagccctatggtggctccgggccactttacacttgtgtgcctgctggtagtccagcatccagctcgacgttagaaggaaaaaggcctgtgtcatatcaacacttatctaacagcatggcacaaaagagaaactatgagaattttattgggaatgcacattatcgaccaaatgacaaaaaaacttgattcactaattagggggaaaaaaggtcttggtggatgtcagtgcttactccccatgaaattaaattttacttcatcctttgagaagcgaatggtgaaagctactgaaataagctgtgattgtactgtacataaaacatatgaggaatctgcaaggaacactacagttgtgtaaagttgttctgttaacttttgtaccaaatagcaatacaaactagttggaacagttggaacttacatacatggggactggaaatctctattttgtccctgaataatatttttcttagaattgaccaaataagaagtggaatttttgcatacttgagcgctgctgaaaagaaatcatttgggttgggtggggcgggatgggggaaaagtatataatgcttgcacctcaggtaaaaatctgtaaatatctaagttgtaaacctgcttgttcaaatactgtgtgtattccttttctctaatgcagctcatcacttggagcagtttctgctattgtgctctttcatttaaaatgtatgtttttttttttttaaactgtcaatgattttgtattatgttgaatccacccaaatctattgttgtcttaaaattgttaatggaagtattgaccctctatgatatgtgctgcagatatcgaggtcagccattcggaagctggcagcattttatcgcaactttgagcatctcagatggggaaggcaccttcttcctcgcctctccagattgtcctggaacctccaggatccttgactgagggcgttgggatggcttgtaggatttttaagagagtgtgtctacagacaagcattttctctgtagagcagccacacgttgtataaacataaactgtatgtgcagttatttaaatttgtttctgtcaaattaatcatttttgttggacgattcagtggcgggggggttttgcctaaattagtatataaaaacaaaaatgctaaattatatctgtgaattgcaggtattggggaacagttttaagggaaattttggggggaacattttaggtttgtatttggtagtcttaatgtatctggcatttgggtgaactgtggacatactagagttgattatagacacattgattttgaataaggaactgctggccgagcccgctgggagtctagaaagagaaaatctgtttctagacctcagttattttcccatttttggttgttttgaagcagtaacatttttctcagtgcacatgcaatttgggttttagagaagatggccaccagctggcttcctagatattttaaacttttgttctttaatatgctgtccatggctgagtttattagtacatgggcttagtgaccacaaaatattttattaagaaactgtttcaaaaataaatttgcactgttcatttttctggcctcgctgttctccatagagcaagggtaatcctagaaaaaattttttttttttaaattatgcaacgtaagatgtcctccttgatagaagtcttagctcctgtgttacaagggagaactcatttgagatcagtctgttggcattgcaatgaagtgctttgtatcaggaaagtgtacactattgaccttttttcctgttcacaagctgagccatatgtacataatctagattttgttttcatagttttgcacttttatagcctatttttgaagattaacacatttgcaagatgattgactcaatctttgcctaatccaatgagtgttacagagagcttgctgtgactagaaccataaatcttaaagggggtatgtgataatagagggctggaatttaaacctgtatttaaaaaaaagaatcaccaaatctatttgaaaacaagtcgatttgtattatgctggaattttttgggctttcagatttctctttttaaccacatttctgaatgtataaaaataccaattattttcctacagccctttgtacttcaaaatatgtttttgtgtccatcagtattaactattggtatactactggttttatatttttttttctttgagacaacagtacatataatagaggtacaattcgttggatttttgtttatgtatttatttcattccagtttgatttattttaattgttgatacttaagttgtcgaacagtagacattacttgttttatttatgatatatttcagcttaaagttatgttattatatgtggaagtgtaaatatagatttggtgttttgcaaaaaaaaaaaaaaaaaaaa

SEQ ID NO: 62502 - DNA, 2782 bp, Homo sapiens
ctatcccctctgggaggtgagtcagcgcggaacctctgcatctacggcgagctttcctggcctgggcgttggactcgcagttctgccttcccaggaccctgcccttccccagaaggagcaggagaaaatgaccaagtttcaggagatggtgacattcaaggatgtggctgtggtcttcaccagggaggagctggggttgctggaccttgcccagagaaagctgtaccaagatgtgatgctggagaacttcaggaacctgctgtcagtgggctatcaacccttcaaactagatgtgatattacagttgggaaaagaagacaagcttcggatgatggagacagaaatccaaggagatgggtgttcaggacacaagaatcaaaatgagatagatacccttcaagaagtaagattaagattcctttcatatgaagaccttatatgctggcaaatatgggaacaatttacaagtaaattaaccagtaatcaagacctaataataaatcttcaaggcaagaggtccaagttgctaaaacaaggtgattccccctgtcaggtgtggacaggagaatctagtcaggtctctgaagatgagaactatgtaataaagctacaaggggagagttcaaatagcataaaaaatcaagagcttccattgaggaccacctgggatttctggaggaaaatgtatctgagagaaccacagaattatcagagtaggtgtcagcaaattgatgtaaaaaataagctctgtaaatgtgatcattgtgttaggcaaagaattgctcatcaacatgatgatcatggagtacacaaaagagagaaagcttttagccacaataattgtggaaaagactgtgtgaaggaatcatcccagcatagcataatccaatcaggagagcaaacctctgatgaaaatggaaaaggcttaagtgttggctctaatcttgaacttcaccagcaactacacttaagagacaagcctcatgtaaatgttgagtacgggaagggcataggttacagctcagggcttcccaggcatcagtgtttccatataggagagaaatgctataggaatggtgacagtggtgagggcttcagtcagggctcacatctgcaacctcatcagagagtcagcacaggagagaacctctacagatgtcaggtatatgcccggagctccaaccagaactcctgtcttccctctcatgagcttactcacccaggagagaagttgtgtacatgtggcaggtgtgggaagggcttccatcatagcttagattttgacattcactgtgtagacagtgctggagagagagcctgtaaatgtgatgtatatgataaaggcttcagtcagacatcacaacttcaagcccatcagagaggtcactctagagacaagacatacaaatgggaagtaagtgacaggatatttaataggaattctggtcttcaccagagagttcacactggagagaaaccatataaatgtgaggtatgtgataagggcttcagtaaggcctcaaatcttcaagcccatcagagaatccacactggagagaaaccctacaaatgtgatgtgtgtgataagaacttcagccgtaattcccaccttcaggcccatcagagagtccatacaggagagaaaccctacaaatgtgacacatgtgggaaggacttcagtcagatctctcatcttcaggcccatcagagagttcacacaggagagaagccatacaaatgtgagacatgtgggaagggctttagtcagagttcgcatctccaagaccatcagcaagtccatactggagagaatccctacaaatgtgatgtgtgtgggaaaggcttcagttggagttcacatcttcaagcccatcagagagtccacacaggagagaaaccatacaaatgtgaagaatgtaggaaaggcttcatctggaactcatatcttcatgttcatcagaggatccacacgggagagaaaccctataaatgtggcatgtgtggtaagagcttcagtcagacttcacatcttcaagcccatcagagagtccatactggagagaaaccatacaaatgttttgtgtgtggtaagggctttagtaagagttcgttgtcttcagattcatcagagagtccatgatggtgatgaatctattaatcatgatgagtgtgataggggtgctcttcaagacttagacttcccattttcctcagaaaatccacacagcacagaatatttataaaatgtcatgttttaagaattcatgagctgagtttttatagttatctgaattccattgaagaaaacctatttttgtatgaatatgaccagtttcaagcagagcccaaaatgtcacagttgtcaagagaacacacaacagagaaaccctataaagaatgatacaatatgtttcaatcagaaccttcacatccaataagcaatatgcaggagtgaagccttcaaaatgataagtaaggtcagaatttagcaaaagtataatgagggacatgacaaaatctgtgtccactagaatctaagctccatgcaggaacattgtttactgctgcatgatcgtgaccttgaacaagtacctaagaaatagtggcttccctggaattgtttaacttgataggaaaaatctatcatatataggacatatatttgaatattttagtgagctcagccccaattcgtcattataattgtactgggaaaaggattcttgcaagaagccttaaaatgaattcaaggaaatgacatttaattaaaacacataaaacc

SEQ ID NO: 62503 - DNA, 6598 bp, Homo sapiens
ttttcttctgcacttctgtctggagaggtctgtagccactgagggccccggtcggggccgctttgcaggtccctagtcaggaccgagcaggggagtaggataggaatccccgccgcacctttgtacgagcctgaccccttccgtgggtttgttcctgggtcgccgtcaagctgcggtctctcctcccccgcccttcagccccgcggtctccaggggcggcgccctgggtctggaacgcggttgccaccgaggaggcggcggccctgcgtctggaacgccgttgccaccgaggaggcggcggccccgagcgcgcctggaagccccgggcaaccggccagggtcgggcacaggtggggtccgtcaggccgcccggggctcctctgtcccagctctgcggcccagggggtgacgtgatggcggcagcggtgctgacggaccgggcccaggtgtctgtgacctttgatgatgtggctgtgactttcaccaaggaggagtgggggcagctggacctagctcagcggaccctgtaccaggaggtgatgctggaaaactgtgggctcctggtgtctctggggtgtcctgttcccaaagctgagctgatctgccacctagagcatgggcaggagccatggaccaggaaggaagacctctcccaagacacctgtccaggcgacaaaggaaaacctaagaccacagaacctaccacttgtgagccagccttgtcagagggaatctcacttcagggacaagtgacacaaggaaactcagtggactcacagttggggcaagccgaggatcaggatgggctatcagaaatgcaggaaggacacttcagaccaggaatagatccccaggagaagtctcctgggaagatgagccctgaatgtgatggtttagggacagctgatggtgtgtgttcaaggattggacaggagcaagtctctccaggagatagagtccgtagccataactcatgtgagtcaggtaaagatcccatgattcaggaagaggaaaataactttaaatgcagtgaatgtggaaaagtatttaacaagaaacacctccttgctggacatgagaaaattcactctggagttaagccctatgaatgcacagaatgtgggaaaacctttattaagagcacacatctcctgcaacatcacatgatccacactggggagaggccctatgagtgcatggagtgtggaaaggccttcaaccgcaagtcataccttacccagcaccagcggattcacagtggagagaagccttacaagtgcaatgaatgcggaaaggccttcacccaccgctccaattttgtcttgcataacaggagacacactggagaaaaatcctttgtgtgcacagaatgtggccaagtctttcgacataggccaggctttctccggcactatgttgtccacagtggtgagaatccctatgagtgcttggagtgtggcaaggtcttcaaacacaggtcatatctcatgtggcaccagcagactcataccggggagaagccctatgagtgcagtgaatgtgggaaggtcttcttggagagtgcagccctgattcaccactatgtcatccacactggagagaagccctttgagtgcctcgagtgtgggaaggctttcaaccaccgatcctacctcaagaggcaccagcggattcacactggggagaagcccttcgtgtgcagtgaatgtggaaaggccttcacccactgctctacttttatcttgcataaaagggcccacactggagaaaagcctttcgagtgcaaagagtgtgggaaagcctttagcaatcggaaggacctcattcgccacttcagcatccacactggagagaagccctatgagtgcgtggagtgtggaaaggccttcacccgcatgtcgggcctcacgaggcacaagcggattcatagtggagagaagccctatgaatgtgttgagtgtgggaaatcgttttgctggagcacaaacctcattcgacatgccattatccacactggagagaagccctataaatgtagtgaatgtggaaaggccttcagtcgcagctcgtccctcactcagcatcaaaggatgcatactgggaaaaatcccatcagtgtaacagatgtgggaagaccttttacaagtggacaaacctcagttacccttcgagaacttcttttagggaaggactttttgaatgtaaccactgaggcaaatattttgccagaggaaacatcttcctctgcatctgatcaaccataccaaagagaaaccccacaagtgtcttcactgtgagaaaaccttctgttgctgaatattacttgtcatctgaagagtcatattagaaattcgttcagtctagagccttattctccatctgataatttatcctggagagagacccagtggttattgtgcacataggagaaccttcagctgcatctttctccttagtttacagtgcaattttatctcaggaattatttttaaaaggaggaggggacatagaaaaaatgaaatgcaagcacacatcttttcaggcttctctgccaagcctatggcgctttgtcatggatttcttagtgtatttgggggaagggaaatgtttcaaggtaaagaaccttgaccctttatgtgcttgtatgtacatttattgctatccagtgtcagaacagttagtttaggaaaagtatgcaaactttaatcgcacatcttctgtattccacaatagtacttactcttgagaagcataactttatgacaacttagggggcttgagccatgaaatactcacgtttaagtcagtaaggatacacatgttaacattcaggcttttgtcttgatgcccgtcttttggtttacgtcatcattgtagccatatggtaaatttttatttgttaaatttttaaaaattacttagctcaaaatgtcagtggtaaatttttaaattgagtaaagtgattcttctttgctcttatttaaaatcgacagcatttctagttcctttgacattccatataatttttaggattagtttgtacttatttacaaaacagtcttgttcagatttttacagaaattgagttaagtctgtggattaatctgttaagaattggtatctttactatgttgggtcttgtagttcatgagtgcaggagtaggcctcttaatttataatagttaagcattccttaaagtatttcattaatgttaaaaattttcagcgtatagatccctatgcatttttgttagaatttgcatcctagggtgcttttttgtttgtgtgtgtgtgtaatttgagtgattgtaaatggcattgatgtttgaactttgaattgcacacaatttttggtagtatacagaaatataatatttttggacattgttttgctaccctgcaaccttattgagttcacttattatttttagctatttctttcgacagaatccttggaattttctatatagaaatgtcatctgcaaatacagaccattttttatctttcatcttacctgtaatcctagcactttgagaccactaaggcaggtggatcacctgaggccaggagttcgagaccagcctggccaacatggcaaaaccctgtctactaaaaatacaaaaattagccaggcatggtggcgtgtgcctgtaatcccagctgctggggggctgaggcaggaggatcagttgaacgtgggaggcagaggttgcagtgagctgagatctcaccactgcactccagcctgggcaacagagcgagactctgtctcaacaacaacaacaaaaagtcctgaacatgattgtggaagtgtgttgctctttcaagttctatcactttttgtttgcaaagttcaaagctgtattgtttggtacatatacatgtaggtttgccaagtctttgtggtgaattgactcttctgtcattatgtgatgtcatttttttgccttttaatagtcttgtcaatactttacctgatgttctcatagtgactcctgcatattttgattaatgtttgcatggttaatatttcttcattttattttaaagcttacctgtatcattacttatgaagtcagtttctttgaacagcatatactcaggccatgctttttttattcattctgcatatgtctctcttaattggtatgttgaaatgatttacattaaaataattattgatattttagggcttaagtgtgcccttaaatgatttttgtgttcttttttattgttcctctgttatttggggttgtttactagtcttcctataggttacttcaccttttttttttttaataatttgatttgatacatatgtagtgttttttagtatagatcctccttgacttatgatggggttatgtcacaataaacccattgcaagttgaaaatactatgtcaaatatgcatttaatacacctaccctgctgaacatcatagccgatcttgccttcagaatgctcagaaaatttacattagcctgcagttgggcaaaatcatctaacacaaggcctactttataataaagttactgcaaagaattttaaataaaaattcaagtgtggtttctactgaatgcatgtcgcattcgcaccattgtaaagtcaagtagtaagtcgaaccatcctaagtcagggactgtctgtatatatctgcattttttagtgattgttctactattacagtgtaaatatataacttatgacagtttaataagttatcagcaatttagcactttacttccattaggttcctttagcttacctactaatgtaactatcttaagtaatagtaattcctcttcaaaaattgagcgctatgttgcaagatgtaatttttcttttccttttttttgagaccaagtctcactctgtcacccacgctggagtgctgtgatgcgatctcggctctctgcaacctctgcctcccgggttcaagcaattaactgcctcagcttccctagtaatggattacaggcgcccgccaccacgcctggctaatttttgtatttttagtagagacggggtttcaccatcttggccaggttggtcttgaactcttgacctcatgatccacccgcctcggccccccaaagtgctggggttacaggtgtgagccactgcacccggccacaagatgtaatttttactttatctctcacacgtattttacaaaacgtcatgagaaacattgtctcttgaccttttttttttttttttttttttaaagagacagagtctcactctgtcacccaggctggagtgcagtggcacgatcttggctcactgcaacctccgcctcctgggttcaagcgattctcctgcctcagcctcctgagtagctgggattacaggtgtgcgccgccacacccagctaattttgtatttttagtagagacggggtttcaccatgttgctcaggctggtctcaaactcctgaccttgtgatccgccaaccttggcctgtcgacctctttacccattccattgttcattcttctttcttgaaatcccaaaccttctattaacatttcttttcagttatacactgaactttactgtagcctttcttctagagtaacaaatgttctttgttttccttcctctaaagatgtctttatgtttccttcattcccaaagaatatttttgtggaatataagattcagagttggcagttgttttcttttagacttcagagatgtatctctctgttctgtacattattgtttaatataagaaacctactagcattcaaataatcattccctattttacaatgcatcagttctgtcaagcttcattcaaagtgtttttcattgtctctagtgttcagaagtttggctgtgatgtgcgtggcatggaagtttttgggtgtattctatttggcgctccctggtgcttgcccagctttttgatctgtaggattatgccttttgcaaaatttggggaactttcaactattatttcttcaaatattttttcaccccccagtcttgtcttttttagggacttcaataacatgagtggcagatcttgttttacactcccatgggtccttcaggctctcatcttttttctttttccagtctattttctgtcttgttaatattgattaatttttattgaccttccatggtcctcactgattgttttctttgtcatacctaatctgttgagtttgtgcagtgagttttcattttggttttgtattttccagttgtttaatttccattgggtgggttcttttgtacaccttctgtttctttgcttattttttaacgccaaagaaagactctcagagaatagacaactatattccaaagtcatggttctctggtggtttgtcttgacatttgaatagaaatgttaaactatctgggggaatagaaagcccacagtcttctgagttgtgctacaccaatatttctatgaacagatcttacaactgagagtgatctgcagatttttcagagtcatgttctccatggaatgtttgtaaaattccctagctctctgcactgagctgagatcgtgccactgcactccagcctgggcaacagagcgagactccatctcaaaaaaaaaaaaaaaaaa

SEQ ID NO: 62504 - DNA, 4589 bp, Homo sapiens
gggaaatagagtcctggcgctgccgcggaggatcctgggtgcagccgctcagagaagcttctcgcgcacaggaagtcgctgcgaggaggcgcgtgtgcggggagttgaatctcccgctcccttgaggctggggttgcgtctgttgacgcggccgactacaatcccgagccctgccagccgggaacacggaggggaaggaggaggagcttaaaagaggctactgaaccccagttggccatggctgaggaatttgtgaccctcaaggatgtcggcatggacttcaccttgggagactgggagcagctcgggctggaacagggggacacgttctgggacacagcgttggacaattgccaggacctcttcctgctggaccccccaagacccaacctgacctcccacccagatggcagtgaagatctggagcctctggcaggaggaagcccagaagcaacaagccctgatgtgactgagaccaagaactctcctctgatggaggatttcttcgaagaaggattctcccaggagattatagagatgttatccaaggatggcttctggaactccaatttcggagaagcctgtatagaggacacctggttagatagtttgctaggcgatccagaaagtcttctgaggtctgatattgccaccaacggggaaagtcccacggaatgcaagagtcatgaattaaagagaggactcagtcctgtgtccaccgtttccacgggagaagattccatggtgcataatgtttctgaaaagaccctcacaccagctaagtctaaggaatataggggtgagtttttctcctactccgaccacagccagcaggattctgttcaggaaggggagaaaccatatcaatgtagtgaatgtgggaaaagcttcagtgggagttaccgtcttacccagcactggatcactcatactagggagaaacccactgtccatcaagagtgtgagcaaggttttgaccggaatgcttccctttctgtgtatccgaaaactcacacgggctacaaattctatgtgtgtaatgaatatgggacaacttttagtcagagtacatacctgtggcatcagaaaactcacactggagaaaaaccatgtaagagtcaagatagtgaccacccacccagtcatgacacacagcctggtgagcatcagaaaactcacacagatagtaagtcctacaactgtaacgaatgcggcaaggcttttacccggatcttccaccttactcggcaccagaagatccacactcggaaacgctatgagtgttccaagtgccaggcgaccttcaacttgagaaaacacctcatccaacatcagaaaactcacgctgcaaaaactacctctgagtgtcaggagtgtgggaagatttttaggcacagttcgctgctcattgaacaccaggctcttcatgctggagaggagccttataagtgtaacgaacgtgggaaatccttcaggcataactctaccctaaagatccatcagagggttcacagtggagagaagccttacaaatgcagtgagtgtgggaaggccttccaccggcacactcaccttaatgaacatcggcgaattcatacaggctacagaccccacaaatgtcaggaatgcgtcaggagtttcagccggccctcacatctgatgcgacatcaggccattcacaccgcagaaaagccctatagctgtgctgaatgcaaggagactttcagcgataacaatcgccttgtgcaacaccagaaaatgcacactgtcaaaaccccatatgaatgtcaggagtgcggagaacgcttcatttgcggctcaaccctgaagtgccacgagagtgttcacgccagagaaaaacaaggattttttgtgagtgggaagatcttggatcagaacccagaacagaaagagaagtgctttaagtgtaacaaatgtgagaaaacctttagctgcagcaaatacctaactcagcacgagaggattcacaccaggggagtgaagccctttgaatgtgaccagtgtgggaaagcctttggccaaagtactcggctcattcaccatcaaagaatccactctagagtgaggctgtataaatggggtgagcaagggaaagccatcagcagtgcctcccttatcaaacttcagtccttccacacaaaggagcacccttttaaatgtaacgaatgcggaaagaccttcagccacagtgcacacctctcaaaacatcagttaattcacgctggagagaatccctttaaatgtagtaagtgtgacagagtcttcacccagagaaactaccttgttcagcatgagcgaactcatgccagaaagaagccgttggtgtgtaacgaatgcgggaaaacgttccgtcagagctcatgcctttctaagcatcagagaattcactcaggtgagaagccctatgtatgtgattactgcgggaaggccttcggcctgagtgctgagcttgtccgccaccagagaattcacactggagaaaagccttatgtttgtcaggaatgcgggaaagccttcacccagagctcatgcctttctattcaccggagagttcacactggggagaagccctacagatgtggtgaatgtgggaaagcctttgcccagaaagcaaatctaacacagcaccagagaattcacacaggggagaagccttactcctgtaatgtgtgtggcaaagcttttgtcctcagtgcccatctcaaccagcacctgagagttcacacccaggagacactttatcagtgtcaacgttgccagaaagcctttcggtgccactcgagcctcagccgccatcagcgtgtacacaacaagcagcaatactgcctgtagccattgggtggcagcagagtcccagaatatgagaccgttactcggatgttgaaagttggaaactatcccattgcaagtttctctccaaataaatgcatctaaagattgattagaaagtttgtgcgcatgtttttcattataacaatgaaaacacaaaagtggagaagctgtacaacgtcaggattcagaggtaggctctggagccagtctaccttgagttaaatcccacctctgccatctactacctaagtgaccttgggaaggtcagaaaaatctctcagggcctcggtgtccttatctgtaaaatgggcatcacctacctcagagggcttttctgaggattaaataaataaatgtgaagcacttagaactgatggccagcacatgagggctcaccaagtgtaagccacaaatacacatcagctatagcacaaatatacttgtgttacaagaaaggaattagtaatctgtgtttactgtagttaatgttcttacaatgtatcgcttttaatttaagttttccttttttacagtttttctccagcactttactcttcttaagtgcctggccttttttgtccctttatctctcctggtttttttcttaagccccagaaagccaaaaagaacatgtaaactcttcacctcaactagctacaaccttccactcctaacctcccaagcttctcacttaaagaggactccctatcccacaaacacatgctccctcttcctatgaccttcctccatttaacagtgttggttatgcaataagacacccaatttttcatgggagttgacaccaaaacacagctggattccatcaggaaagctgcattgatcagggtgttaaccgcatatgaaacaacccatatggaagacatacttaggggtcaaacctgtggtgtgtggaagtgaccactgggatgtcatcattcaccatttatccaggatggccgctcaccaggcaatttgctaggctcgggggcgggtagtatccatacactatgcactactgctctgaagcttctggaatcagaaatgaacccattttcatcgacgattgctgttagttgacaagtgacatcttgaaaatgccacattccctcatgtcacaggaagttctgggatcaccaaggattgttggagagtccagtgagatggaaccacacaaccagttccctaccagtgtcttgtcagctctgggtgtttgttccctgccactaagtggctcagtcacacctttgctgaaacacagtagtcttatgaaaagcactggacacatactttgaatacctttcatattttaggtgctgaaaatggtgagggagtgagtgctctgcacccttgggcttttcaactcttgcacctggagttctgctggttaagtttgttaaacttagttgaaactgggaacctgttggctaaccattggggccttacactgtttttcaaatggttgcaacatttaacttctcgcacatggttcccgtcctctggagctctgtcttgtcggggagatgggcatgttgtataccaaaagagtgtacaaagtgttgcagggctgtgacacaatagggactctatggaaaactggcagccattgggtgtgggggcagtctgtaaatcagtcacctgtgttgctgcaggccaaggtagaaacgccctccgtgtgtgcatatttgttggttctctgattaaagttttgagtctaaaaaaaaaaaaaaaaaaaaaaa

SEQ ID NO: 62505 - DNA, 4711 bp, Homo sapiens
gggaaatagagtcctggcgctgccgcggaggatcctgggtgcagccgctcagagaagcttctcgcgcacaggaagtcgctgcgaggaggcgcgtgtgcggggagttgaatctcccgctcccttgaggctggggttgcgtctgttgacgcggccgactacaatcccgagggagactcacattgggacttgtcctcctcctcctggacattttgggggctcgtcagcatggacagcgagtcagccatgggtggaagggaggctttctcacagctcccttgtgcttcccacagccctgccagccgggaacacggaggggaaggaggaggagcttaaaagaggctactgaaccccagttggccatggctgaggaatttgtgaccctcaaggatgtcggcatggacttcaccttgggagactgggagcagctcgggctggaacagggggacacgttctgggacacagcgttggacaattgccaggacctcttcctgctggaccccccaagacccaacctgacctcccacccagatggcagtgaagatctggagcctctggcaggaggaagcccagaagcaacaagccctgatgtgactgagaccaagaactctcctctgatggaggatttcttcgaagaaggattctcccaggagattatagagatgttatccaaggatggcttctggaactccaatttcggagaagcctgtatagaggacacctggttagatagtttgctaggcgatccagaaagtcttctgaggtctgatattgccaccaacggggaaagtcccacggaatgcaagagtcatgaattaaagagaggactcagtcctgtgtccaccgtttccacgggagaagattccatggtgcataatgtttctgaaaagaccctcacaccagctaagtctaaggaatataggggtgagtttttctcctactccgaccacagccagcaggattctgttcaggaaggggagaaaccatatcaatgtagtgaatgtgggaaaagcttcagtgggagttaccgtcttacccagcactggatcactcatactagggagaaacccactgtccatcaagagtgtgagcaaggttttgaccggaatgcttccctttctgtgtatccgaaaactcacacgggctacaaattctatgtgtgtaatgaatatgggacaacttttagtcagagtacatacctgtggcatcagaaaactcacactggagaaaaaccatgtaagagtcaagatagtgaccacccacccagtcatgacacacagcctggtgagcatcagaaaactcacacagatagtaagtcctacaactgtaacgaatgcggcaaggcttttacccggatcttccaccttactcggcaccagaagatccacactcggaaacgctatgagtgttccaagtgccaggcgaccttcaacttgagaaaacacctcatccaacatcagaaaactcacgctgcaaaaactacctctgagtgtcaggagtgtgggaagatttttaggcacagttcgctgctcattgaacaccaggctcttcatgctggagaggagccttataagtgtaacgaacgtgggaaatccttcaggcataactctaccctaaagatccatcagagggttcacagtggagagaagccttacaaatgcagtgagtgtgggaaggccttccaccggcacactcaccttaatgaacatcggcgaattcatacaggctacagaccccacaaatgtcaggaatgcgtcaggagtttcagccggccctcacatctgatgcgacatcaggccattcacaccgcagaaaagccctatagctgtgctgaatgcaaggagactttcagcgataacaatcgccttgtgcaacaccagaaaatgcacactgtcaaaaccccatatgaatgtcaggagtgcggagaacgcttcatttgcggctcaaccctgaagtgccacgagagtgttcacgccagagaaaaacaaggattttttgtgagtgggaagatcttggatcagaacccagaacagaaagagaagtgctttaagtgtaacaaatgtgagaaaacctttagctgcagcaaatacctaactcagcacgagaggattcacaccaggggagtgaagccctttgaatgtgaccagtgtgggaaagcctttggccaaagtactcggctcattcaccatcaaagaatccactctagagtgaggctgtataaatggggtgagcaagggaaagccatcagcagtgcctcccttatcaaacttcagtccttccacacaaaggagcacccttttaaatgtaacgaatgcggaaagaccttcagccacagtgcacacctctcaaaacatcagttaattcacgctggagagaatccctttaaatgtagtaagtgtgacagagtcttcacccagagaaactaccttgttcagcatgagcgaactcatgccagaaagaagccgttggtgtgtaacgaatgcgggaaaacgttccgtcagagctcatgcctttctaagcatcagagaattcactcaggtgagaagccctatgtatgtgattactgcgggaaggccttcggcctgagtgctgagcttgtccgccaccagagaattcacactggagaaaagccttatgtttgtcaggaatgcgggaaagccttcacccagagctcatgcctttctattcaccggagagttcacactggggagaagccctacagatgtggtgaatgtgggaaagcctttgcccagaaagcaaatctaacacagcaccagagaattcacacaggggagaagccttactcctgtaatgtgtgtggcaaagcttttgtcctcagtgcccatctcaaccagcacctgagagttcacacccaggagacactttatcagtgtcaacgttgccagaaagcctttcggtgccactcgagcctcagccgccatcagcgtgtacacaacaagcagcaatactgcctgtagccattgggtggcagcagagtcccagaatatgagaccgttactcggatgttgaaagttggaaactatcccattgcaagtttctctccaaataaatgcatctaaagattgattagaaagtttgtgcgcatgtttttcattataacaatgaaaacacaaaagtggagaagctgtacaacgtcaggattcagaggtaggctctggagccagtctaccttgagttaaatcccacctctgccatctactacctaagtgaccttgggaaggtcagaaaaatctctcagggcctcggtgtccttatctgtaaaatgggcatcacctacctcagagggcttttctgaggattaaataaataaatgtgaagcacttagaactgatggccagcacatgagggctcaccaagtgtaagccacaaatacacatcagctatagcacaaatatacttgtgttacaagaaaggaattagtaatctgtgtttactgtagttaatgttcttacaatgtatcgcttttaatttaagttttccttttttacagtttttctccagcactttactcttcttaagtgcctggccttttttgtccctttatctctcctggtttttttcttaagccccagaaagccaaaaagaacatgtaaactcttcacctcaactagctacaaccttccactcctaacctcccaagcttctcacttaaagaggactccctatcccacaaacacatgctccctcttcctatgaccttcctccatttaacagtgttggttatgcaataagacacccaatttttcatgggagttgacaccaaaacacagctggattccatcaggaaagctgcattgatcagggtgttaaccgcatatgaaacaacccatatggaagacatacttaggggtcaaacctgtggtgtgtggaagtgaccactgggatgtcatcattcaccatttatccaggatggccgctcaccaggcaatttgctaggctcgggggcgggtagtatccatacactatgcactactgctctgaagcttctggaatcagaaatgaacccattttcatcgacgattgctgttagttgacaagtgacatcttgaaaatgccacattccctcatgtcacaggaagttctgggatcaccaaggattgttggagagtccagtgagatggaaccacacaaccagttccctaccagtgtcttgtcagctctgggtgtttgttccctgccactaagtggctcagtcacacctttgctgaaacacagtagtcttatgaaaagcactggacacatactttgaatacctttcatattttaggtgctgaaaatggtgagggagtgagtgctctgcacccttgggcttttcaactcttgcacctggagttctgctggttaagtttgttaaacttagttgaaactgggaacctgttggctaaccattggggccttacactgtttttcaaatggttgcaacatttaacttctcgcacatggttcccgtcctctggagctctgtcttgtcggggagatgggcatgttgtataccaaaagagtgtacaaagtgttgcagggctgtgacacaatagggactctatggaaaactggcagccattgggtgtgggggcagtctgtaaatcagtcacctgtgttgctgcaggccaaggtagaaacgccctccgtgtgtgcatatttgttggttctctgattaaagttttgagtctaaaaaaaaaaaaaaaaaaaaaaa

SEQ ID NO: 62506 - DNA, 2060 bp, Homo sapiens
aaagaagagtcacatcacgtaggtgatgggcctagagatatttcacaatgccttctgtaattagaacccagaaaaaagagttatatcatttgggttaaaggtcttgtgatatgtcacaatcccaactaagggcaggacccaggcagaaaaggagagtcacttcctttgatgattggtccagagatacattacaatttcccctgaggacagctctcatgcagaagaggaactgaatatactgcatggcccaggtatctgcagatttatggctaaaagaccaggaccccctggaagccgagaaatgggactgttgacattcagagacatagctatagaattctctctggaggaatggcaatgcctggattgtgctcagcggaatttatatagagatgtgatgttagagaactacagaaacctggtctccctgggtattgctgtctctaagccagacttgatcacctgtctggagcaaaataaagagtcccagaatataaagagaaatgagatggtagccaaacacccagttacgcgttcccatttcacccaagaccttcagccagagcagggcatcaaagattcactccaaaaagtaataccaagaacatatggaaaatgtggacatgagaaattacaatttaaaaaatgctgtaaaagtgtgggtgaatatgaggtgcacaagggaggttatagtgaagttaaccaatgtttgtcaactacccaaaacaaaatatttcagactcataaatatgtcaaagtctttggtaaattttcaaattccaatagagataaaacaagatatactggaaataaacatttcaaatgtaacaaatatggcaaatcattttgcatgctttcacacctaaatcaacatcaggtaattcatactagggagaagtcctacaaatgcaaagaatgtggcaaatcctttaactgctcctcaaaccatactacacataaaataattcatactggagagaaaccatatagatgtgaggaatgtggcaaagcctttagctggtctgcaaaccttactagacataagagaactcatactggagagaaaccctacacgtgtgaagaatgtggccaagcctttaggcgctcctcagcacttactaaccacaagagaattcatactggagagagaccctacaaatgtgaagaatgtggcaaagcctttagcgtatcctcaaccctcactgaccacaagagaattcatactggagagaaaccctgcaggtgtgaggaatgtggcaaagcctttagctggtcctcaaaccttactagacataagagaattcatactagagagaaaccctatgcctgtgaagaatgtggccaagcctttagcttatcctcgaaccttatgagacataggagaattcatactggagagaaaccctacacatgtgaagaatgtggccaagactttaggcgctcctcagcacttactatccacaagagaattcatactggagagagaccctacaaatgtgaagagtgtggcaaagtctttagcttatcctcaaccctcactgaccacaagagaattcatactggagagagaccctacaaatgtgaagaatgtggcaaagcctttagcttatcctcaaccctcactgaccacaagagaattcatactggagagagaccctacacatgtgaagaatgtggcaaagcctttaattgctcctcaacccttatgcaacataagagaattcatactggagagaaaccctacaaatgtgaagaatgtgagcaagcttttaagtggcattcaagtcttgctaaacataagataattcacactggagagaaaccctacaaatgtgaataatatggcaaagtccaccctcaggccttataatacataaaataatttacactggaaaaaaacactacaaatgtagagaatgtggccaagcctttaaccagttccaaaccttaattgaatgtaagagaattcatattggacagaaattttataaatgtaaaaaaatgtaacaaagcctttaaccaaccctcaaaccttaataaacctaagagaatttatttta

SEQ ID NO: 62507 - DNA, 2060 bp, Homo sapiens; identical to SEQ ID NO: 62506

SEQ ID NO: 62508 - DNA, 312 bp, Homo sapiens
atgagtggttttgcttgtttgtttgttttccagggactgttgacattcagagacatagctatagaattctctctggaggaatggcaatgcctggattgtgctcagcggaatttatatagagatgtgatgttagagaactacagaaacttggtctccctgggtattgctgtctctaagccagacttgatcacctgtctggagcaaaataaagagtcccagaatataaagagaaatgagatggtagccaaacgcccagattatttaaagaatgcttatgatgtttttatgatggctgtatcttttttctcataa

SEQ ID NO: 62509 - DNA, 3176 bp, Homo sapiens
gccgccataggccagtgccggggtttaagggccaggaaaggaagcattcagggaatttaggtgtagccagaagaaaatcaggtcctggctccccagaagcaagagagttcaagtgaaggaaggaggaggttcctggatgtggatgtcatcatttctgggaacactcttaaatggagactcagatttcttagccaaaatttagggaggatccagaagaaaccaaagacgaagcatcccagttcttgggtatttcctgaaacagaagaaaatgacaaaggcccaggaatcactgaccctggaggatgtggctgtggacttcacctgggaggagtggcagttcctgagccctgctcagaaggacctgtaccgggatgtgatgttggagaactacagcaaccttgtgtcagtggggtatcaagccggcaaacctgatgccctcaccaagttggaacaaggagaaccactatggacactagaagatgaaatccacagtccagcccacccagaaattgagaaagctgatgatcatctgcagcagcccttgcaaaaccaaaaaatactgaagaggacgggacaacgctatgaacacggaagaactttgaaatcatatttaggtttaaccaaccagagcagaagatacaacagaaaggagcctgctgagtttaatggagatggagcttttctccatgataatcatgaacaaatgcctacggaaattgaattccctgaaagtagaaaacccatcagcaccaagtcacaattccttaaacatcagcaaacacacaacatagagaaagcccatgaatgcactgactgtgggaaagctttcctcaagaagtctcagctcactgagcataagagaattcatacaggaaagaaaccccacgtgtgtagcttgtgtgggaaagccttctacaagaagtacaggctcactgaacacgagagagctcacagaggagagaaaccccacgggtgtagcttgtgtgggaaagccttctacaagaggtacaggctcactgaacacgagagagctcacaaaggagagaaaccatacgggtgcagtgaatgtgggaaagccttccccaggaaatctgagcttactgaacatcaaaggattcacacgggaattaagccccatcaatgcagcgaatgtgggagagctttctccagaaaatcactactcgttgtacatcagcgaactcatacaggagagaagcctcatacatgcagtgaatgtggaaaaggcttcattcagaagggcaatctcaacatacatcaacgaactcacactggagagaaaccttatggatgcattgactgtggcaaggccttcagccagaagtcttgccttgtagcacatcagagatatcatacaggaaagactccctttgtatgtcctgaatgtgggcaaccctgttcacagaagtcaggactcattagacatcagaaaattcactcaggagagaaaccctataaatgcagtgactgtgggaaagccttccttacaaagacaatgctcattgtacatcacagaactcacacgggagagagaccctatggctgtgatgagtgtgagaaagcttacttctatatgtcttgccttgttaaacataagagaatacactcaagggagaaacggggggattcagtgaaggtggaaaatccttccacagcaagtcacagcttaagtcctagtgaacatgtgcaggggaaaagccctgttaatatggtaactgtggcaatggtggcagggcagtgtgagtttgcccacatcctgcattcatgataaacagtttgctgtttgatcatatagcctccagcggaatgctgagtttgtcatgtcccatgggcctttggctccctgcactaatatgtatagtagggtttacaagatatgaaatatattttacttttttatatcttataaacctcactacccctcccacaatattgtttttcatttactatcttgatcatagagtttggctggggaggggggcagttttagaggcttccacttggtgttcctcagaatgatatctcttactccgggggccaaggtaggggttagcttttgttctctttgtagtttagattgtatctcttgccttgttcaagttcacaaatctttttgtgtatacacatatgtacatgaaaatgatgttcatgctttttattattttacccttcattatttcattttttatagttctcatagctatgtctttcagttcactaatcttttttccacagtgtttaatctgtcattaatcccatccaaagtatgttttctctcagaaattgtaatttttaacctctaataatttgacatgggtttttccctgttatatctttcatatctttatttatcatggttttacttttaacctatttatgctttcatatttaaagtgggtgtttagtgggcaacatacagttgggccttccttttttatccagttaacaatctctgtctttttactggggtatttagatcatttacgtttaatgtattgatgtttttaggtttaaattactaacttactatttgttgtttattctatgtcttctttgttctccttttcttctttttctgctttcccttagagtagctgagtgtgtttatattacatattgtctcctttgttggcttattaactgtaaatccttgtcatttgattccttgagattttatagcatacatcattgtgagggattgcatatttatgtcctctccaaatttacatgttgaagtcctaatccctaagggatggcattaggaagtgtgacctttggaaggtaattacatcttgaaagtggaaccctcatgatgagattatgtgtcttatgagacaacacagaagagagtttgttttctctttctctgctctttgccatgtgaagacagaatgagatgaccatgcataaaccaggaaatggactctcactggacactagacctgccaacaccttgattgtgttttagagtccagttctagagactcctcagcctctggaacgtgagaaatgaatgtttgttaaggcagtcagtcagtctatggtgtattttttctagtagcctgaactgactgaaagaaaatcatgaacttatcattctaacttcaaggacattatatcacttactgtataataaaataatcttacagtaaaaaaaa

SEQ ID NO: 62510 - DNA, 1583 bp, Homo sapiens
gggtacttgatccaggtatatgtcacattcccaactgttggctgggcccaagcaaattagtaaaataaattaggtgctgtgtgaaagtatacgccacaatcacacctgcgggaaggaccaggaataaatttcacaattctacgtatttcccagctttaggtctgagagtctacacttctgagctccagttcttctcttcactgctctgcgtcctctgttcctagaggccaagccactgtggccttgtgttctgcaggtatccgcagatttatggctaaaagaccgggatcccctggaagccgagaaatgggactgttgacattcagagatgtagtcatagaattctctctggaggagtggcaatgcctggatcacgctcagcagaatttatatagagatgtgatgttagagaactacagaaacctggtctccctgggtattgctgtctctaagccagacttgatcacctgtctggagcaaaataaagagccttggaatataaagagaaatgagatggtaaccaaacacccagttatgtgttctcatttcacccaagaccttccgccagagctaggcataaaagattcactccaaaaagtaataccaagaagatatggaaaaagtggacatgacaatttacaagtaaaaacatgtaaaagcatgggtgagtgtgaggtgcaaaaaggaggttgtaatgaagttaaccaatgtttgtcaactacccaaaacaaaatatttcagactcataaatgtgtcaaagtcttcggcaaattttcaaattccaatagacataagacaagacatactggaaagaaacatttcaaatgtaaaaaatatggcaaatcattttgcatggtttcacaactacatcaacatcagataattcatactagggagaattcctaccaatgtgaagaatgcggcaaacccttcaactgctcttcaaccctttctaaacataaaagaattcatactggagagaaaccctacagatgtgaggaatgtggcaaagcttttacctggtcctcaacccttactaaacataggagaattcatactggagaaaaaccctacacatgtgaagaatgtggccaagcctttagccgctcctcaacacttgctaaccacaagagaattcatactggagagaaaccatacacatgtgaagaatgtggcaaagcctttagcttatcctcatccctcacttaccacaagagaattcatactggagagaaaccctacacatgtgaaaaatgtggcaaagcctttaactgctcctcaacccttaagaaacataagataattcatactggagagaaaccctacaaatgtaaagaatgtgggaaagcctttgccttctcctcaactcttaatactcataagaggattcatactggagaggaaccctacaaatgtgaagaatgtgacaaagcttttaagtggtcctcaagtcttgctaatcataagagtatgcatactggagagaaaccctacaaatgtgaataatgtgataaagtccagccttcagaccttataatacataaaataatttatacttgaaaaaatcaaaaaaaaaaaaaaaa

SEQ ID NO: 62511 - DNA, 2154 bp, Homo sapiens
gcgcaaacggcgagggcgtggctaccagccgctgcgctccgctctggggtctcctcaccccagaaggccctcaggtggaggaagggcctcaggtggaggtaggacctgtgctggccgcgggagaggtaaacagaacaccaggacatcccagagtctgggaaatggactcagtggtctttgaggatgtggctgtgaacttcacccaggaggagtgggctttgctgggtccctctcagaagaaactctacagagatgtgatgcaagaaacctttgttaacttggcctctataggggaaaactgggaggagaagaacattgaagatcacaaaaatcaggggagaaagctaagaagtcatatggtagagaggctctgtgaaaggaaagaaggtagtcagtttggagaaaccatcagtcagactccaaatcctaaaccaaacaagaaaacttttactagagtaaaaccatatgaatgtagtgtgtgtggaaaggactatatgtgtcattcatctcttaataggcacatgagatctcatactgaacatagatcatatgaatatcacaaatatggagagaaatcatatgaatgtaaggaatgtgggaaaagattcagctttcgaagttcatttcgaatacatgaaagaactcacactggagagaaaccctataaatgtaaacagtgtggtaaggctttcagttggcccagttcctttcaaatacatgaaagaactcatactggagagaaaccttatgaatgtaaggaatgtgggaaggccttcatttatcacacaacctttcgaggacacatgagaatgcacacaggggagaaaccctataaatgtaaagaatgcgggaaaacgttcagtcatcccagttcttttcgaaatcatgaaagaactcactctggagagaaaccctatgaatgtaaacaatgtggaaaagctttcagatattaccaaacttttcaaatacatgaaaggactcacactggggaaaaaccctatcagtgtaagcaatgtggtaaagctcttagttgtcccacatcctttcgaagtcatgaaaggattcacactggagaaaaaccctataaatgtaaaaaatgtgggaaagccttcagttttcctagttcctttagaaaacatgaaagaattcatacaggagagaaaccctatgattgtaaggaatgtgggaaagcattcatttctcttccaagctatcgaagacatatgataatgcacactggaaatggaccttataaatgcaaggaatgtgggaaagcctttgattgtcctagttcttttcaaatccatgaacgaactcacactggagagaaaccctatgaatgtaaacagtgtggtaaagccttcagttgttccagttcctttcgaatgcatgaaagaactcacactggagagaaaccccatgaatgtaaacaatgtggtaaagccttcagttgttccagttctgttcgaatacatgaaaggactcacactggagagaaaccctatgaatgtaaacagtgtggtaaagccttcagttgttccagttcctttcgaatgcatgaaagaattcacactggagagaaaccctatgaatgtaaacagtgtggtaaagcctttagtttttctagttcctttcggatgcatgaaaggactcacactggagagaaaccctatgaatgtaaacaatgtggtaaagccttcagttgttccagttcctttcgaatgcatgaaaggactcacactggggagaaaccctatgaatgtaaacagtgtggtaaggcgtttagttgttccagttccattcgaatacatgaaaggactcacactggagagaaaccttatgagtgtaaacaatgtggtaaggccttcagttgttctagttctgttcgaatgcatgaaaggactcacactggagtgaaaccctatgaatgtaaacaatgtgacaaagccttcagttgctcacgttcctttcgaatccatgaacgaactcacactggagagaaaccctatgcatgtcaacaatgtggtaaagccttcaagtgttcccgttcctttcgaatacatgaaagagttcatagtggagagtaaccctatgtatataagcaatatggcaaagttttcagttgtcctatttccttttttttttttttttttt

SEQ ID NO: 62512 - DNA, 2446 bp, Homo sapiens
agtgagccgagcagaggggccgcctccgcccgcacccagcatgcttcgccgaggctataaggcctctgaaaggcgaagacacttgagcgagaggctcagctggcaccaagaccaggcgctgagtagcagcatctacctcctacgagagatgggccccactggcttcctgctgagggaggaggagccggaatacatggatttccgagtttttctaggaaatcctcacgtttgtaactgttccacatttccgaaaggaggggaactttgtaagcatatctgctgggtcttgttgaaaaaattcaagcttccaaggaaccatgaatctgctttacaactgggtcttggagaaagagagataagtgacttgcttcgggggatacatcgagttcaaactccccaaccaggaacaaatgacgaaaatgaacatgttgaagaagatgggtacattaaacagaaggaaattgattcagaggatatctgctctatttgtcaagagctacttttagagaaaaagcttcctgtcaccttttgcaggtttggctgtggcaatagtattcatataaaatgcatgaagatcttagctaattatcagagtacatcaaacacttccatgttgaaatgtcctctgtgcaggaaagagtttgcaccattaaaactgattttggaggaattcaaaaactctagcaaactagtagctgcagcagaaaaagagagactggacaaacaccttgggattccctgtaataactgcaaacagtttccaattgaggggaagtgttataagtgtaccgaatgcatagaatatcacttatgccaggaatgttttgatagctgctgccatctttcccacacgtttacatttcgtgagaaaagaaaccaaaaatggagatcactagaaaaaagagcagatgaagttgtaaaatacatagatactaaaaatgagattgaagaaaagatgtcacattttcaagaaaagcaaggccaagtttacacaccaaaacacattgtaagatcactgcctctccaactgattactaagaatagtaagctgcttgctccaggctaccagtgtctactttgtttgaaggcatttcatcttggtcaacatacaagattgctaccatgtactcacaagtttcacaggaagtgtattgacaactggttattccacaagtgcaattcatgccctattgatggacaagttatatataaccctttaacttggaaaaattcagcagtgaatggacaagcacatcagtctgtttcaaacagagacatcattcatctatcaaagcagaaagaaccagatctttttattcctggtactggattagtcttaaaacaaaatagacttggaattttacctagcatacctcagtgtaattttgatgaattgaatacacctcaaagcccaaaagatgcctatgaaaatacaacaatagataatctatgctctatcaaattagataattcaaattcaaaaaaattaacctatgattataaaattagccaacattttcccaggtatcttcaagatttacccactgtgtcatttgggaaaataccatctcaaacactgcttcctcctattgttcataagaatattgtgtgtcccactgcaatggaaagtccatgcatcagtggaaaatttcacactagtctaagccggatgaccaaaggctgtaaatgtaataaccacaacctaaagaagactcctgccactaaaataagagaggacaacaagagatcaactttacttccagaggatttcaatcttattgtcaattggagcacagctaaacttagtttgtctaaaaggtatagtaactgtatgggggaaattacacgaaaatgtagtcatctatcaagacagcctgtgtctcactctgtaaatacaaaaagtactgagctatctttaataatagaaggagttcaattgtgaaaaagtttactatctgaaaatatttgaatgttgaatataaaaaaatgttttatatagaacataaaaagcacacatagtcttgacaaatgtatataaaattctctgttggaatttgcctacttacctataaacagctcactacacttaaaggaaatgattctattacttatatgacttacagcattaggtgtcttcatgaatatattcaggatgttataaataatgaataatttttagagcctttatcttattttactctgattttagaaatgttttacttaaattaaggaaatagatttttcctactttgagtcactgttttcaaatatttttcacggtagcacataacatgcagggattactccccggtacttctgtattttttgcatttttcttgcactagtaattaccacaaacctataaaaaaaaaccttaaaaaactccataaaggagttttcttatacataaaatgaaaataaaatgaaatactatcagctatgtcac

SEQ ID NO: 62513 - protein, 1359 aa, Homo sapiens
MVGEGPYLISDLDQRGRRRSFAERYDPSLKTMIPVRPCARLAPNPVDDAGLLSFATFSWLTPVMVKGYRQRLTVDTLPPLSTYDSSDTNAKRFRVLWDEEVARVGPEKASLSHVVWKFQRTRVLMDIVANILCIIMAAIGPVILIHQILQQTERTSGKVWVGIGLCIALFATEFTKVFFWALAWAINYRTAIRLKVALSTLVFENLVSFKTLTHISVGEVLNILSSDSYSLFEAALFCPLPATIPILMVFCAAYAFFILGPTALIGISVYVIFIPVQMFMAKLNSAFRRSAILVTDKRVQTMNEFLTCIRLIKMYAWEKSFTNTIQDIRRRERKLLEKAGFVQSGNSALAPIVSTIAIVLTLSCHILLRRKLTAPVAFSVIAMFNVMKFSIAILPFSIKAMAEANVSLRRMKKILIDKSPPSYITQPEDPDTVLLLANATLTWEHEASRKSTPKKLQNQKRHLCKKQRSEAYSERSPPAKGATGPEEQSDSLKSVLHSISFVVRKGKILGICGNVGSGKSSLLAALLGQMQLQKGVVAVNGTLAYVSQQAWIFHGNVRENILFGEKYDHQRYQHTVRVCGLQKDLSNLPYGDLTEIGERGLNLSGGQRQRISLARAVYSDRQLYLLDDPLSAVDAHVGKHVFEECIKKTLRGKTVVLVTHQLQFLESCDEVILLEDGEICEKGTHKELMEERGRYAKLIHNLRGLQFKDPEHLYNAAMVEAFKESPAEREEDAGIIVLAPGNEKDEGKESETGSEFVDTKVPEHQLIQTESPQEGTVTWKTYHTYIKASGGYLLSLFTVFLFLLMIGSAAFSNWWLGLWLDKGSRMTCGPQGNRTMCEVGAVLADIGQHVYQWVYTASMVFMLVFGVTKGFVFTKTTLMASSSLHDTVFDKILKSPMSFFDTTPTGRLMNRFSKDMDELDVRLPFHAENFLQQFFMVVFILVILAAVFPAVLLVVASLAVGFFILLRIFHRGVQELKKVENVSRSPWFTHITSSMQGLGIIHAYGKKESCITYHLLYFNCALRWFALRMDVLMNILTFTVALLVTLSFSSISTSSKGLSLSYIIQLSGLLQVCVRTGTETQAKFTSVELLREYISTCVPECTHPLKVGTCPKDWPSRGEITFRDYQMRYRDNTPLVLDSLNLNIQSGQTVGIVGRTGSGKSSLGMALFRLVEPASGTIFIDEVDICILSLEDLRTKLTVIPQDPVLFVGTVRYNLDPFESHTDEMLWQVLERTFMRDTIMKLPEKLQAEVTENGENFSVGERQLLCVARALLRNSKIILLDEATASMDSKTDTLVQNTIKDAFKGCTVLTIAHRLNTVLNCDHVLVMENGKVIEFDKPEVLAEKPDSAFAMLLAAEVRL

SEQ ID NO: 62514 - protein, 405 aa, Homo sapiens
MLSSFLSPQNGTWADTFSLLLALAVALYLGYYWACVLQRPRLVAGPQFLAFLEPHCSITTETFYPTLWCFEGRLQSIFQVLLQSQPLVLYQSDILQTPDGGQLLLDWAKQPDSSQDPDPTTQPIVLLLPGITGSSQDTYVLHLVNQALRDGYQAVVFNNRGCRGEELRTHRAFCASNTEDLETVVNHIKHRYPQAPLLAVGISFGGILVLNHLAQARQAAGLVAALTLSACWDSFETTRSLETPLNSLLFNQPLTAGLCQLVERNRKVIEKVVDIDFVLQARTIRQFDERYTSVAFGYQDCVTYYKAASPRTKIDAIRIPVLYLSAADDPFSPVCALPIQAAQHSPYVALLITARGGHIGFLEGLLPWQHWYMSRLLHQYAKAIFQDPEGLPDLRALLPSEDRNS

SEQ ID NO: 62515 - protein, 480 aa, Homo sapiens
MLFRNRFLLLLALAALLAFVSLSLQFFHLIPVSTPKNGMSSKSRKRIMPDPVTEPPVTDPVYEALLYCNIPSVAERSMEGHAPHHFKLVSVHVFIRHGDRYPLYVIPKTKRPEIDCTLVANRKPYHPKLEAFISHMSKGSGASFESPLNSLPLYPNHPLCEMGELTQTGVVQHLQNGQLLRDIYLKKHKLLPNDWSADQLYLETTGKSRTLQSGLALLYGFLPDFDWKKIYFRHQPSALFCSGSCYCPVRNQYLEKEQRRQYLLRLKNSQLEKTYGEMAKIVDVPTKQLRAANPIDSMLCHFCHNVSFPCTRNGCVDMEHFKVIKTHQIEDERERREKKLYFGYSLLGAHPILNQTIGRMQRATEGRKEELFALYSAHDVTLSPVLSALGLSEARFPRFAARLIFELWQDREKPSEHSVRILYNGVDVTFHTSFCQDHHKRSPKPMCPLENLVRFVKRDMFVALGGSGTNYYDACHREGF

SEQ ID NO: 62516 - protein, 426 aa, Homo sapiens
MAGLGFWGHPAGPLLLLLLLVLPPRALPEGPLVFVALVFRHGDRAPLASYPMDPHKEVASTLWPRGLGQLTTEGVRQQLELGRFLRSRYEAFLSPEYRREEVYIRSTDFDRTLESAQANLAGLFPEAAPGSPEARWRPIPVHTVPVAEDKLLRFPMRSCPRYHELLREATEAAEYQEALEGWTGFLSRLENFTGLSLVGEPLRRAWKVLDTLMCQQAHGLPLPAWASPDVLRTLAQISALDIGAHVGPPRAAEKAQLTGGILLNAILANFSRVQRLGLPLKMVMYSAHDSTLLALQGALGLYDGHTPPYAACLGFEFRKHLGNPAKDGGNVTVSLFYRNDSAHLPLPLSLPGCPAPCPLGRFYQLTAPARPPAHGVSCHGPYEAAIPPAPVVPLLAGAVAVLVALSLGLGLLAWRPGCLRALGGPV

SEQ ID NO: 62517 - protein, 92 aa, Homo sapiens
MAGLGFWGHPAGPLLLLLLLVLPPRALPEGPLVFVALVRRPHPGLPLAPPGLALTSPVPRYSAMATGPRWPPTPWTHTRRWPPPCGHEAWAS

SEQ ID NO: 62518 - protein, 92 aa, Homo sapiens; identical to SEQ ID NO: 62517

SEQ ID NO: 62519 - protein, 333 aa, Homo sapiens
MAGLGFWGHPAGPLLLLLLLVLPPRALPEGPLVFVALVFRHGDRAPLASYPMDPHKEVASTLWPRGLGQLTTEGVRQQLELGRFLRSRYEGFLSRLENFTGLSLVGEPLRRAWKVLDTLMCQQAHGLPLPAWASPDVLRTLAQISALDIGAHVGPPRAAEKAQLTGGILLNAILANFSRVQRLGLPLKMVMYSAHDSTLLALQGALGLYDGHTPPYAACLGFEFRKHLGNPAKDGGNVTVSLFYRNDSAHLPLPLSLPGCPAPCPLGRFYQLTAPARPPAHGVSCHGPYEAAIPPAPVVPLLAGAVAVLVALSLGLGLLAWRPGCLRALGGPV

SEQ ID NO: 62520 - protein, 543 aa, Homo sapiens
MRKPAAGFLPSLLKVLLLPLAPAAAQDSTQASTPGSPLSPTEYERFFALLTPTWKAETTCRLRATHGCRNPTLVQLDQYENHGLVPDGAVCSNLPYASWFESFCQFTHYRCSNHVYYAKRVLCSQPVSILSPNTLKEIEASAEVSPTTMTSPISPHFTVTERQTFQPWPERLSNNVEELLQSSLSLGGQEQAPEHKQEQGVEHRQEPTQEHKQEEGQKQEEQEEEQEEEGKQEEGQGTKEGREAVSQLQTDSEPKFHSESLSSNPSSFAPRVREVESTPMIMENIQELIRSAQEIDEMNEIYDENSYWRNQNPGSLLQLPHTEALLVLCYSIVENTCIITPTAKAWKYMEEEILGFGKSVCDSLGRRHMSTCALCDFCSLKLEQCHSEASLQRQQCDTSHKTPFVSPLLASQSLSIGNQVGSPESGRFYGLDLYGGLHMDFWCARLATKGCEDVRVSGWLQTEFLSFQDGDFPTKICDTDYIQYPNYCSFKSQQCLMRNRNRKVSRMRCLQNETYSALSPGKSEDVVLRWSQEFSTLTLGQFG

SEQ ID NO: 62521 - protein, 435 aa, Homo sapiens
MWAPPAAIMGDGPTKKVGNQAPLQTQALQTASLRDGPAKRAVWVRHTSSEPQEPTESKAAKERPKQEVTKAVVVDLGTGYCKCGFAGLPRPTHKISTTVGKPYMETAKTGDNRKETFVGQELNNTNVHLKLVNPLRHGIIVDWDTVQDIWEYLFRQEMKIAPEEHAVLVSDPPLSPHTNREKYAEMLFEAFNTPAMHIAYQSRLSMYSYGRTSGLVVEVGHGVSYVVPIYEGYPLPSITGRLDYAGSDLTAYLLGLLNSAGNEFTQDQMGIVEDIKKKCCFVALDPIEEKKVPLSEHTIRYVLPDGKEIQLCQERFLCSEMFFKPSLIKSMQLGLHTQTVSCLNKCDIALKRDLMGNILLCGGSTMLSGFPNRLQKELSSMCPNDTPQVNVLPERDSAVWTGGSILASLQGFQPLWVHRFEYEEHGPFFLYRRCF

SEQ ID NO: 62522 - protein, 415 aa, Homo sapiens
MATRNSPMPLGTAQGDPGEAGTRPGPDASLRDTGAATQLKMKPRKVHKIKAVIIDLGSQYCKCGYAGEPRPTYFISSTVGKRCPEAADAGDTRKWTLVGHELLNTEAPLKLVNPLKHGIVVDWDCVQDIWEYIFRTAMKILPEEHAVLVSDPPLSPSSNREKYAELMFETFGIPAMHVTSQSLLSIYSYGKTSGLVVESGHGVSHVVPISEGDVLPGLTSRADYAGGDLTNYLMQLLNEAGHAFTDDHLHIIEHIKKKCCYAAFLPEEELGLVPEELRVDYELPDGKLITIGQERFRCSEMLFQPSLAGSTQPGLPELTAACLGRCQDTGFKEEMAANVLLCGGCTMLDGFPERFQRELSLLCPGDSPAVAAAPERKTSVWTGGSILASLQAFQQLWVSKEEFEERGSVAIYSKC

SEQ ID NO: 62523 - protein, 377 aa, Homo sapiens
MFNPHALDSPAVIFDNGSGFCKAGLSGEFGPRHMVSSIVGHLKFQAPSAEANQKKYFVGEEALYKQEALQLHSPFERGLITGWDDVERLWKHLFEWELGVKPSDQPLLATEPSLNPRENREKMAEVMFENFGVPAFYLSDQAVLALYASACVTGLVVDSGDAVTCTVPIFEGYSLPHAVTKLHVAGRDITELLMQLLLASGHTFPCQLDKGLVDDIKKKLCYVALEPEKELSRRPEEVLREYKLPDGNIISLGDPLHQAPEALFVPQQLGSQSPGLSNMVSSSITKCDTDIQKILFGEIVLSGGTTLFHGLDDRLLKELEQLASKDTPIKITAPPDRWFSTWIGASIVTSLSSFKQMWVTAADFKEFGTSVVQRRCF

SEQ ID NO: 62524 - protein, 739 aa, Homo sapiens
MFLLLALLTELGRLQAHEGSEGIFLHVTVPRKIKSNDSEVSERKMIYIITIDGQPYTLHLGKQSFLPQNFLVYTYNETGSLHSVSPYFMMHCHYQGYAAEFPNSFVTLSICSGLRGFLQFENISYGIEPVESSARFEHIIYQMKNNDPNVSILAVNYSHIWQKDQPYKVPLNSQIKNLSKLLPQYLEIYIIVEKALYDYMGSEMMAVTQKIVQVIGLVNTMFTQFKLTVILSSLELWSNENQISTSGDADDILQRFLAWKRDYLILRPHDIAYLLVYRKHPKYVGATFPGTVCNKSYDAGIAMYPDAIGLEGFSVIIAQLLGLNVGLTYDDITQCFCLRATCIMNHEAVSASGRKIFSNCSMHDYRYFVSKFETKCLQKLSNLQPLHQNQPVCGNGILESNEECDCGNKNECQFKKCCDYNTCKLKGSVKCGSGPCCTSKCELSIAGTPCRKSIDPECDFTEYCNGTSSNCVPDTYALNGRLCKLGTAYCYNGQCQTTDNQCAKIFGKGAQGAPFACFKEVNSLHERSENCGFKNSQPLPCERKDVLCGKLACVQPHKNANKSDAQSTVYSYIQDHVCVSIATGSSMRSDGTDNAYVADGTMCGPEMYCVNKTCRKVHLMGYNCNATTKCKGKGICNNFGNCQCFPGHRPPDCKFQFGSPGGSIDDGNFQKSGDFYTEKGYNTHWNNWFILSFCIFLPFFIVFTTVIFKRNEISKSCNRENAEYNRNSSVVSESDDVGH

SEQ ID NO: 62525 - protein, 820 aa, Homo sapiens
MKMLLLLHCLGVFLSCSGHIQDEHPQYHSPPDVVIPVRITGTTRGMTPPGWLSYILPFGGQKHIIHIKVKKLLFSKHLPVFTYTDQGAILEDQPFVQNNCYYHGYVEGDPESLVSLSTCFGGFQGILQINDFAYEIKPLAFSTTFEHLVYKMDSEEKQFSTMRSGFMQNEITCRMEFEEIDNSTQKQSSYVGWWIHFRIVEIVVVIDNYLYIRYERNDSKLLEDLYVIVNIVDSILDVIGVKVLLFGLEIWTNKNLIVVDDVRKSVHLYCKWKSENITPRMQHDTSHLFTTLGLRGLSGIGAFRGMCTPHRSCAIVTFMNKTLGTFSIAVAHHLGHNLGMNHDEDTCRCSQPRCIMHEGNPPITKFSNCSYGDFWEYTVERTKCLLETVHTKDIFNVKRCGNGVVEEGEECDCGPLKHCAKDPCCLSNCTLTDGSTCAFGLCCKDCKFLPSGKVCRKEVNECDLPEWCNGTSHKCPDDFYVEDGIPCKERGYCYEKSCHDRNEQCRRIFGAGANTASETCYKELNTLGDRVGHCGIKNATYIKCNISDVQCGRIQCENVTEIPNMSDHTTVHWARFNDIMCWSTDYHLGMKGPDIGEVKDGTECGIDHICIHRHCVHITILNSNCSPAFCNKRGICNNKHHCHCNYLWDPPNCLIKGYGGSVDSGPPPKRKKKKKFCYLCILLLIVLFILLCCLYRLCKKSKPIKKQQDVQTPSAKEEEKIQRRPHELPPQSQPWVMPSQSQPPVTPSQSHPQVMPSQSQPPVTPSQSQPRVMPSQSQPPVMPSQSHPQLTPSQSQPPVTPSQRQPQLMPSQSQPPVTPS

SEQ ID NO: 62526 - protein, 786 aa, Homo sapiens
MFRLWLLLAGLCGLLASRPGFQNSLLQIVIPEKIQTNTNDSSEIEYEQISYIIPIDEKLYTVHLKQRYFLADNFMIYLYNQGSMNTYSSDIQTQCYYQGNIEGYPDSMVTLSTCSGLRGILQFENVSYGIEPLESAVEFQHVLYKLKNEDNDIAIFIDRSLKEQPMDDNIFISEKSEPAVPDLFPLYLEMHIVVDKTLDYWGSDSMIVTNKVIEIVGLANSMFTQFKVTIVLSSLELWSDENKISTVGEADELLQKFLEWKQSYLNLRPHDIAYLLIYMDYPRYLGAVFPGTMCITRYSAGVALYPKEITLEAFAVIVTQMLALSLGISYDDPKKCQCSESTCIMNPEVVQSNGVKTFSSCSLRSFQNFISNVGVKCLQNKPQMQKKSPKPVCGNGRLEGNEICDCGTEAQCGPASCCDFRTCVLKDGAKCYKGLCCKDCQILQSGVECRPKAHPECDIAENCNGSSPECGPDITLINGLSCKNNKFICYDGDCHDLDARCESVFGKGSRNAPFACYEEIQSQSDRFGNCGRDRNNKYVFCGWRNLICGRLVCTYPTRKPFHQENGDVIYAFVRDSVCITVDYKLPRTVPDPLAVKNGSQCDIGRVCVNRECVESRIIKASAHVCSQQCSGHGVCDSRNKCHCSPGYKPPNCQIRSKGFSIFPEEDMGSIMERASGKTENTWLLGFLIALPILIVTTAIVLARKQLKKWFAKEEEFPSSESKSEGSTQTYASQSSSEGSTQTYASQTRSESSSQADTSKSKSEDSAEAYTSRSKSQDSTQTQSSSN

SEQ ID NO: 62527 - protein, 903 aa, Homo sapiens
MAIQFRSLFPLALPGMLALLGWWWFFSRKKGHVSSHDEQQVEAGAVQLRADPAIKEPLPVEDVCPKVVSTPPSVTEPPEKELSTVSKLPAEPPALLQTHPPCRRSESSGILPNTTDMRLRPGTRRDDSTKLELALTGGEAKSIPLECPLSSPKGVLFSSKSAEVCKQDSPFSRVPRKVQPGYPVVPAEKRSSGERARETGGAEGTGDAVLGEKVLEEALLSREHVLELENSKGPSLASLEGEEDKGKSSSSQVVGPVQEEEYVAEKLPSRFIESAHTELAKDDAAPAPPVADAKAQDRGVEGELGNEESLDRNEEGLDRNEEGLDRNEESLDRNEEGLDRNEEIKRAAFQIISQVISEATEQVLATTVGKVAGRVCQASQLQGQKEESCVPVHQKTVLGPDTAEPATAEAAVAPPDAGLPLPGLPAEGSPPPKTYVSCLKSLLSSPTKDSKPNISAHHISLASCLALTTPSEELPDRAGILVEDATCVTCMSDSSQSVPLVASPGHCSDSFSTSGLEDSCTETSSSPRDKAITPPLPESTVPFSNGVLKGELSDLGAEDGWTMDAEADHSGGSDRNSMDSVDSCCSLKKTESFQNAQAGSNPKKVDLIIWEIEVPKHLVGRLIGKQGRYVSFLKQTSGAKIYISTLPYTQSVQICHIEGSQHHVDKALNLIGKKFKELNLTNIYAPPLPSLALPSLPMTSWLMLPDGITVEVIVVNQVNAGHLFVQQHTHPTFHALRSLDQQMYLCYSQPGIPTLPTPVEITVICAAPGADGAWWRAQVVASYEETNEVEIRYVDYGGYKRVKVDVLRQIRSDFVTLPFQGAEVLLDSVMPLSDDDQFSPEADAAMSEMTGNTALLAQVTSYSPTGLPLIQLWSVVGDEVVLINRSLVERGLAQWVDSYYTSL

SEQ ID NO: 62528 - protein, 593 aa, Homo sapiens
MAIQFRSLFPLALPGMLALLGWWWFFSRKKGHVSSHDEQQVEAGAVQLRADPAIKEPLPVEDVCPKVVSTPPSVTEPPEKELSTVSKLPAEPPALLQTHPPCRRSESSGILPNTTDMRLRPGTRRDDSTKLELALTGGEAKSIPLECPLSSPKGVLFSSKSAEVCKQDSPFSRVPRKVQPGYPVVPAEKRSSGERARETGGAEGTGDAVLGEKVLEEALLSREHVLELENSKGPSLASLEGEEDKGKSSSSQVVGPVQEEEYVAEKLPSRFIESAHTELAKDDAAPAPPVADAKAQDRGVEGELGNEESLDRNEEGLDRNEEGLDRNEESLDRNEEGLDRNEEIKRAAFQIISQVISEATEQVLATTVGKVAGRVCQASQLQGQKEESCVPVHQKTVLGPDTAEPATAEAAVAPPDAGLPLPGLPAEGSPPPKTYVSCLKSLLSSPTKDSKPNISAHHISLASCLALTTPSEELPDRAGILVEDATCVTCMSDSSQSVPLVASPGHCSDSFSTSGLEDSCTETSSSPRDKAITPPLPESTVPFSNGVLKGELSDLGAEDGWTMDAEADHSGVAAPPPGKRGTLITRCPGFFEC

SEQ ID NO: 62529 - protein, 137 aa, Homo sapiens
MSETQNSTSQKAMDEDNKAASQTMPNTQDKNYEDELTQVALALVEDVINYAVKIVEEERNPLKNIKWMTHGEFTVEKGLKQIDEYFSDAPIVVSYVGDHQALVHRPGMVRFRENWQKNLTDAKYSFMESFPFLFNRV

SEQ ID NO: 62530 - protein, 89 aa, Homo sapiens
MSETQNSTSQKAMDEDNKAASQTMPNTQDKNYEDELTQVALALVEDVINYAVKIVEEERNPLKNIKWMTHGEFTVEKGLKQIDEYFSVS

SEQ ID NO: 62531 - protein, 197 aa, Homo sapiens
MSETQNSTSQKAMDEDNKAASQTMPNTQDKNYEDELTQVALALVEDVINYAVKIVEEERNPLKNIKWMTHGEFTVEKGLKQIDEYFSKCVSKKCWAHGVEFVERKDLIHSFLYIYYVHWSISTADLPVARISAGTYFTMKVSKTKPPDAPIVVSYVGDHQALVHRPGMVRFRENWQKNLTDAKYSFMESFPFLFNRV

SEQ ID NO: 62532 - protein, 409 aa, Homo sapiens
MADAPKEGRLTRFLDFTQLMDMASESVGGKILFATDDFFAPAENLIKSDSPCFKEHEYTEFGKWMDGWETRRKRIPGHDWCVLRLGIQGVIRGFDVDVSYFTGDYAPRVSIQAANLEEDKLPEIPERGIRTGAAATPEEFEAIAELKSDDWSYLVPMTELKPGNPASGHNYFLVNSQQRWTHIRLNIFPDGGIARLRVFGTGQKDWTATDPKEPADLVAIAFGGVCVGFSNAKFGHPNNIIGVGGAKSMADGWETARRLDRPPILENDENGILLVPGCEWAVFRLAHPGVITRIEIDTKYFEGNAPDSCKVDGCILTTQEEAVIRQKWILPAHKWKPLLPVTKLSPNQSHLFDSLTLELQDVITHARLTIVPDGGVSRLRLRGFPSSICLLRPREKPMLKFSVSFKANP

SEQ ID NO: 62533 - protein, 162 aa, Homo sapiens
MADGWETARRLDRPPILENDENGILLVPGCEWAVFRLAHPGVITRIEIDTKYFEGNAPDSCKVDGCILTTQEEEAVIRQKWILPAHKWKPLLPVTKLSPNQSHLFDSLTLELQDVITHARLTIVPDGGVSRLRLRGFPSSICLLRPREKPMLKFSVSFKANP

SEQ ID NO: 62534 - protein, 731 aa, Homo sapiens
MKAGRINKRNARGESQLHLAVRRGNLPLVKALIESGADVNLNDNAGWTPLHEASNEGSIDIIVELLKAGAKVNCENIDGILPLHDAVANNHLKAAEILLQNGANPNQKDQKQKSALDEADDEKMKELLRSYGAIETVNRDESDAIVNEKIPAVRSKRHKQCFCDDGKTIDSSSLSHQERSRESLSVHQTLSAILQDIEEKQEYLLEFEIRNPEDAEQYIEKMLKIKKIMDNVLAKQKAERDDLAKKYRVSIESFKHGALREQLANLAARQKSLLVVAKKQKKISLKIQNCRNVTSLPCLSLRKLPPRSEISSEKDSQELTSLENLEHPQSGSLSPVSGSMQETQLSLETWNYSQNTNICLNSEAVRRGEFSGNDMNSKQNGSDCTLDGFPKSRHSDGTEKNKLPSQPVAFIGQTEYSQKENDLTEATDKDHEFYVSSPVIGKLNISETASVLAENAAHPSNIICDQDLSNYDPKRGNRKTSSQQSPTGASESLAHQGIAVLGSDTVHQMKPYLKKSVSVVPCADDSQISSSSGSGQQDTIKKALNYSTAPKKKCIQIKDLILLGRINPGNNILEFKTQETTHKASILLNGKLKVESGQIYKNPVTWLKDLLGGNSYVTWNYAWSKVTYLGKELLRYVSEDAPILPEPNSVPQQYQPCLPEVACLDDPVQEPNKSMFEKTKFGQGTSRESMQSSPRYLQINEILLISDQEFLPCHIMDQHWKFCVECEELTP

SEQ ID NO: 62535 - protein, 266 aa, Homo sapiens
MESEGPPESESSEFFSQQEEENEEEEAQEPEETGPKNPLLQPALTGDVEGLQKIFEDPENPHHEQAMQLLLEEDIVGRNLLYAACMAGQSDVIRALAKYGVNLNEKTTRGYTLLHCAAAWGRLETLKALVELDVDIEALNFREERARDVAARYSQTECVEFLDWADARLTLKKYIAKVSLAVTDTEKGSGKLLKEDKNTILSACRAKNEWLETHTEASINELFEQRQQLEDIVTPIFTKMTTPCQVKSAKSVTSHDQKRSQDDTSN

SEQ ID NO: 62536 - protein, 151 aa, Homo sapiens
MRIVPTILLNFGADPDLRDIRYNTVLHYAVCGQSLSLVEKLLEYEADLEAKNKDGYTPLLVAVINNNPKMVKFLLEKGADVNASDNYQRTALILAVSGEPPCLVKLLLQQGVELCYEGIVDSQLRNMFISMVLLHRYPQFTASHGKKKHAK

SEQ ID NO: 62537 - protein, 548 aa, Homo sapiens
MGSAARARLFSVLADLRVRLSRALQRRAGGEVQTRPPPPSPGRGSELGASAQRPPGPAFLAAPAFGAGLAVGRLRRLARTGTGACDYACGRARASFGGGSLSRRRPLAPGPAGSRRWARAVPGACGSLRAVDPRGLPAFLTPAAWRPRELHLPSIRIAQLLPRAPAAFAPQAPAETARKAGSSTPDHKRTLGRAAGHKVTMSTFLSTITENSVPRVGEGPGRAGSLRYHGPDWRIFHRLALGSRRAHHHHGPGWRQHWRQGQAGHRCQGSFDLYFILDKSGSVNNNWIDLYMWVEETVARFQSPNIRMCFITYSTDGQTVLPLTSDKNRIKNGLDQLQKIVPDGHTFMQAGFRKAIQQIESFNSGNKVPSMIIAMTDGELVAHAFQDTLREAQKARKLGANVYTLGVADYNLDQITAIADSPGHVFAVENGFKALRSTIDALTSKVCLDVTSVEPSSECVGEPYHVVIHGNGFQNLKKRDEVICRFIFNESTIIDEKPTSIDNNSMNCPGPKLEKPGEEYSIEVSLNKGKTFFKSNVSITSTTCPSLK

SEQ ID NO: 62538 - protein, 257 aa, Homo sapiens
MWVEETVARFQSPNIRMCFITYSTDGQTVLPLTSDKNRIKNGLDQLQKIVPDGHTFMQAGFRKAIQQIESFNSGNKVPSMIIAMTDGELVAHAFQDTLREAQKARKLGANVYTLGVADYNLDQITAIADSPGHVFAVENGFKALRSTIDALTSKVCLDVTSVEPSSECVGEPYHVVIHGNGFQNLKKRDEVICRFIFNESTIIDEKPTSIDNNSMNCPGPKLEKPGEEYSIEVSLNKGKTFFKSNVSITSTTCPSLK

SEQ ID NO: 62539 - protein, 727 aa, Homo sapiens
MDNRKEPPFFNDDNMGPFYYRLHFCDTMELFIETLTGTCFELRVSPFETVISVKAKIRRLEGIPICRQHLIWNNMELENDYCLNDYNISEGCTLKLVLAMRGGPINTRRVPTDDPLRKMAEYLDSSRVEVWEKTSCSKQVTFLVYREGDQLNFFPAVDRGDGTLTPLSDSSKKIDFHLHVLRRKGEHRMSGGSMYNSDTDEDEETEPSSSGQQIIENSITMNKMKLLKAKMKNMNLSKKPKKAVKIKPHPPVAPRPSSGSTAPSRHRLLRVLPNIGQSCSPAFGNAYPPEISRNGISSLATQLSAERYISSITGEFLKEDNSWENNTLSHFSSNVKLPPQIPHLELGNDQELADSVLHLGSSLPRQTKHFLGNLPSSNGNIVLPSEECVTEQSLLPKVGSPASFAEGNADEQSSGLEGACKVNLELLLTNADKGLKAPEQHLKHVAGVLNGESVETSVLNYRELSPHKNRLLSPLRCSASMSLHNSLVKPERQSKCFEFGKLQPSSSQSLDVQNITDSSFSRTTCFQGVKVDSLGKRSDVISKVEARDITEMTNKASKEPVGCVNNISFLASLAGSTSRNRLQSTRGAGRLQNSGTGLSTNLQHFQEENFRKSSPQLEHTGVFLSTHGVGMNGNNAAAGKSVGECTTHHLPPVKAPLQTKKKTTNHCFLCGKKTGLASSYECRCGNNFCASHRYAETHGCTYDYKSAGRRYLHEANPVVNAPKLPKI

SEQ ID NO: 62540 - protein, 257 aa, Homo sapiens
MTAAVFFGCAFIAFGPALALYVFTIATEPLRIIFLIAGAFFWLVSLLISSLVWFMARVIIDNKDGPTQKYLLIFGAFVSVYIQEMFRFAYYKLLKKASEGLKSINPGETAPSMRLLAYVSGLGFGIMSGVFSFVNTLSDSLGPGTVGIHGDSPQFFLYSAFMTLVIILLHVFWGIVFFDGCEKKKWGILLIVLLTHLLVSAQTFISSYYGINLASAFIILVLMGTWAFLAAGGSCRSLKLCLLCQDKNFLLYNQRSR

SEQ ID NO: 62541 - protein, 1344 aa, Homo sapiens
MDQREPLPPAPAENEMKYDTNNNEEEEGEQFDFDSGDEIPEADRQAPSAPETGGAGASEAPAPTGGEDGAGAETTPVAEPTKLVLPMKVNPYSVIDITPFQEDQPPTPVPSAEEENVGLHVPCGYLVPVPCGYAVPSNLPLLLPAYSSPVIICATSLDEEETPEVTEDRQPNSLSSEEPPTSEDQVGREDSALARWAADPANTAWMENPEEAIYDDVPRENSDSEPDEMIYDDVENGDEGGNSSLEYGWSSSEFESYEEQSDSECKNGIPRSFLRSNHKKQLSHDLTRLKEHYEKKMRDLMASTVGVVEIQQLRQKHELKMQKLVKAAKDGTKDGLERTRAAVKRGRSFIRTKSLIAQDHRSSLEEEQNLFIDVDCKHPEAILTPMPEGLSQQQVVRRYILGSVVDSEKNYVDALKRILEQYEKPLSEMEPKVLSERKLKTVFYRVKEILQCHSLFQIALASRVSEWDSVEMIGDVFVASFSKSMVLDAYSEYVNNFSTAVAVLKKTCATKPAFLEFLKQEQEASPDRTTLYSLMMKPIQRFPQFILLLQDMLKNTSKGHPDRLPLQMALTELETLAEKLNERKRDADQRCEVKQIAKAINERYLNKLLSSGSRYLIRSDDMIETVYNDRGEIVKTKERRVFMLNDVLMCATVSSRPSHDSRVMSSQRYLLKWSVPLGHVDAIEYGSSAGTGEHSRHLAVHPPESLAVVANAKPNKVYMGPGQLYQDLQNLLHDLNVIGQITQLIGNLKGNYQNLNQSVAHDWTSGLQRLILKKEDEIRAADCCRIQLQLPGKQDKSGRPTFFTAVFNTFTPAIKESWVNSLQMAKLALEEENHMGWFCVEDDGNHIKKEKHPLLVGHMPVMVAKQQEFKIECAAYNPEPYLNNESQPDSFSTAHGFLWIGSCTHQMGQIAIVSFQNSTPKVIECFNVESRILCMLYVPVEEKRREPGAPPDPETPAVRASDVPTICVGTEEGSISIYKSSQGSKKVRLQHFFTPEKSTVMSLACTSQSLYAGLVNGAVASYARAPDGSWDSEPQKVIKLGVLPVRSLLMMEDTLWAASGGQVFIISVETHAVEGQLEAHQEEGMVISHMAVSGVGIWIAFTSGSTLRLFHTETLKHLQDINIATPVHNMLPGHQRLSVTSLLVCHGLLMVGTSLGVLVALPVPRLQGIPKVTGRGMVSYHAHNSPVKFIVLATALHEKDKDKSRDSLAPGPEPQDEDQKDALPSGGAGSSLSQGDPDAAIWLGDSLGSMTQKSDLSSSSGSLSLSHGSSSLEHRSEDSTIYDLLKDPVSLRSKARRAKKAKASSALVVCGGQGHRRVHRKARQPHQEELAPTVMVWQIPLLNI

SEQ ID NO: 62542 - protein, 200 aa, Homo sapiens
MGNGLSDQTSILSNLPSFQSFHIVILGLDCAGKTTVLYRLQFNEFVNTVPTKGFNTEKIKVTLGNSKTVTFHFWDVGGQEKLRPLWKSYTRCTDGIVFVVDSVDVERMEEAKTELHKITRISENQGVPVLIVANKQDLRNSLSLSEIEKLLAMGELSSSTPWHLQPTCAIIGDGLKEGLEKLHDMIIKRRKMLRQQKKKR

SEQ ID NO: 62543 - protein, 200 aa, Homo sapiens; identical to SEQ ID NO: 62542

SEQ ID NO: 62544 - protein, 200 aa, Homo sapiens; identical to SEQ ID NO: 62542

SEQ ID NO: 62545 - protein, 1044 aa, Homo sapiens
MGVALRKLTQWTAAGHGTGILEITPLNEAILKEIIVFVESFIYKHPQEAKFVFVEPLEWNTSLAPSAFESGYVVSETTVKSEEVDKNGQPLLFLSVPQIKIRSFGQLSRLLLIAKTGKLKEAQACVEANRDPIVKILGSDYNTMKENSIALNILGKITRDDDPESEIKMKIAMLLKQLDLHLLNHSLKHISLEISLSPMTVKKDIELLKRFSGKGNQTVLESIEYTSDYEFSNGCRAPPWRQIRGEICYVLVKPHDGETLCITCSAGGVFLNGGKTDDEGDVNYERKGSIYKNLVTFLREKSPKFSENMSKLGISFSEDQQKEKDQLGKAPKKEEAAALRKDISGSDKRSLEKNQINFWRNQMTKRWEPSLNWKTTVNYKGKGSAKEIQEDKHTGKLEKPRPSVSHGRAQLLRKSAEKIEETVSDSSSESEEDEEPPDHRQEASADLPSEYWQIQKLVKYLKGGNQTATVIALCSMRDFSLAQETCQLAIRDVGGLEVLINLLETDEVKCKIGSLKILKEISHNPQIRQNIVDLGGLPIMVNILDSPHKSLKCLAAETIANVAKFKRARRVVRQHGGITKLVALLDCAHDSTKPAQSSLYEARDVEVARCGALALWSCSKSHTNKEAIRKAGGIPLLARLLKTSHENMLIPVVGTLQECASEENYRAAIKAERIIENLVKNLNSENEQLQEHCAMAIYQCAEDKETRDLVRLHGGLKPLASLLNNTDNKERLAAVTGAIWKCSISKENVTKFREYKAIETLVGLLTDQPEEVLVNVVGALGECCQERENRVIVRKCGGIQPLVNLLVGINQALLVNVTKAVGACAVEPESMMIIDRLDGVRLLWSLLKNPHPDVKASAAWALCPCIKNAKDAGEMVRSFVGGLELIVNLLKSDNKEVLASVCAAITNIAKDQENLAVITDHGVVPLLSKLANTNNNKLRHHLAEAISRCCMWGRNRVAFGEHKAVAPLVRYLKSNDTNVHRATAQALYQLSEDADNCITMHENGAVKLLLDMVGSPDQDLQEAAAGCISNIRRLALATEKARYT

SEQ ID NO: 62546 - protein, 1435 aa, Homo sapiens
MREKGRRKKGRTWAEAAKTVLEKYPNTPMSHKEILQVIQREGLKEIRSGTSPLACLNAMLHTNSRGEEGIFYKVPGRMGVYTLKKDVPDGVKELSEGSEESSDGQSDSQSSENSSSSSDGGSNKEGKKSRWKRKVSSSSPQSGCPSPTIPAGKVISPSQKHSKKALKQALKQQQQKKQQQQCRPSISISSNQHLSLKTVKAASDSVPAKPATWEGKQSDGQTGSPQNSNSSFSSSVKVENTLLGLGKKSFQRSERLHTRQMKRTKCADIDVETPDSILVNTNLRALINKHTFSVLPGDCQQRLLLLLPEVDRQVGPDGLMKLNGSALNNEFFTSAAQGWKERLSEGEFTPEMQVRIRQEIEKEKKVEPWKEQFFESYYGQSSGLSLEDSKKLTASPSDPKVKKTPAEQPKSMPVSEASLIRIVPVVSQSECKEEALQMSSPGRKEECESQGEVQPNFSTSSEPLLSSALNTHGLSSILPIKCPKDEDLLEQKPVTSAEQESEKNHLTTASNYNKSESQESLVTSPSKPKSPGVEKPIVKPTAGAGPQETNMKEPLATLVDQSPESLKRKSSLTQEEAPVSWEKRPRVTENRQHQQPFQVSPQPFLNRGDRIQVRKVPPLKIPVSRISPMPFHPSQVSPRARFPVSITSPNKTGARTLADIKAKAQLVKAQRAAAAAAAAAAAAASVGGTIPGPGPGGGQGPGEGGEGQTARGGSPGSDRVSETGKGPTLELAGTGSRGGTRELLPCGPETQPQSETKTTPSQAQPHSVSGAQLQQTPPVPPTPAVSGACTSVPSPAHIEKLDNEKLNPTRATATVASVSHPQGPSSCRQEKAPSPTGPALISGASPVHCAADGTVELKAGPSKNIPNPSASSKTDASVPVAVTPSPLTSLLTTATLEKLPVPQVSATTAPAGSAPPSSTLPAASSLKTPGTSLNMNGPTLRPTSSIPANNPLVTQLLQGKDVPMEQILPKPLTKVEMKTVPLTAKEERGMGALIATNTTENSTREEVNERQSHPATQQQLGKTLQSKQLPQVPRPLQLFSAKELRDSSIDTHQYHEGLSKATQDQILQTLIQRVRRQNLLSVVPPSQFNFAHSGFQLEDISTSQRFMLGFAGRRTSKPAMAGHYLLNISTYGRGSESFRRTHSVNPEDRFCLSSPTEALKMGYTDCKNATGESSSSKEDDTDEESTGDEQESVTVKEEPQVSQSAGKGDTSSGPHSRETLSTSDCLASKNVKAEIPLNEQTTLSKENYLFTRGQTFDEKTLARDLIQAAQKQMAHAVRGKAIRSSPELFSSTVLPLPADSPTHQPLLLPPLQTPKLYGSPTQIGPSYRGMINVSTSSDMDHNSAVPGSQVSSNVGDVMSFSVTVTTIPASQAMNPSSHGQTIPVQAFSEENSIEGTPSKCYCRLKAMIMCKGCGAFCHDDCIGPSKLCVSCLVVR

SEQ ID NO: 62547 - protein, 355 aa, Homo sapiens
MDFIFHEKQEGFLCAQHCLNNLLQGEYFSPVELASIAHQLDEEERMRMAEGGVTSEEYLAFLQQPSENMDDTGFFSIQVISNALKFWGLEIIHFNNPEYQKLGIDPINERSFICNYKQHWFTIRKFGKHWFNLNSLLAGPELISDTCLANFLARLQQQAYSVFVVKGDLPDCEADQLLQIISVEEMDTPKLNGKKLVKQKEHRVYKTVLEKVSEESDESGTSDQDEEDFQRALELSRQETNREDEHLRSTIELSMQGSSGNTSQDLPKTSCVTPASEQPKKIKEDYFEKHQQEQKQQQQQSDLPGHSSYLHERPTTSSRAIESDLSDDISEGTVQAAVDTILEIMRKNLKIKGEK

SEQ ID NO: 62548 - protein, 355 aa, Homo sapiens [sequence omitted]

SEQ ID NO: 62549 - protein, 236 aa, Homo sapiens
MTGYEARLITFGTWMYSVNKEQLARAGFYAIGQEDKVQCFHCGGGLANWKPKEDPWEQHAKWYPGCKYLLEEKGHEYINNIHLTRSLEGALVQTTKKTPSLTKRISDTIFPNPMLQEAIRMGFDFKDVKKIMEERIQTSGSNYKTLEVLVADLVSAQKDTTENELNQTSLQREISPEEPLRRLQEEKLCKICMDRHIAVVFIPCGHLVTCKQCAEAVDRCPMCSAVIDFKQRVFMS

SEQ ID NO: 62550 - protein, 106 aa, Homo sapiens
MMTLVPRARTRAGQDHYSHPCPRFSQVLLTEGIMTYCLTKNLSDVNILHRLLKNGNVRNTLLQSKVGLLTYYVKLYPGEVTLLTRPSIQMRLCCITGSVSKPRSQK

SEQ ID NO: 62551 - protein, 106 aa, Homo sapiens
MMTLVPRARTRAGQDHYSHPCPRFSQVLLTEGIMTYCLTKNLSDVNILHRLLKNGNVRNTLLQSKVGLLTYYVKLYPGEVTLLTRPSIQMRLCCITGSVSRPRSQK

SEQ ID NO: 62552 - protein, 106 aa, Homo sapiens; identical to SEQ ID NO: 62551

SEQ ID NO: 62553 - protein, 158 aa, Homo sapiens
MRLTAEFAIVSLIYIERLVSYADIDICPTNWKRIVLGAILLASKVWSDMAVWNEDYCKLFKNITVEEMNELERQFLKLINYNNSITNSVYSRFYFDLRTLAHNNGLYSPVYLLDRERAWKLEAFSRMEQDKVFYSAAKNGSLSADDLIHLQRAKAILF

SEQ ID NO: 62554 - protein, 158 aa, Homo sapiens; identical to SEQ ID NO: 62553

SEQ ID NO: 62555 - protein, 137 aa, Homo sapiens
  VARIANT 132,135: Xaa = Any Amino Acid
MPQAAHSVSAVLEKAQTHAETSKDKKPALGNRQEHSGPRTAPSPACPASSGAEVQGYQQQPRHAPPRPRTQAAGASPPCQTTSCRHSHHPWTTQSSRRPWTSCSLPPRSPRGLLMPHPRKRHEASMFRSSKXIKXMN

SEQ ID NO: 62556 - protein, 137 aa, Homo sapiens; identical to SEQ ID NO: 62555
  VARIANT 132,135: Xaa = Any Amino Acid

SEQ ID NO: 62557 - protein, 137 aa, Homo sapiens; identical to SEQ ID NO: 62555
  VARIANT 132,135: Xaa = Any Amino Acid

SEQ ID NO: 62558 - protein, 137 aa, Homo sapiens; identical to SEQ ID NO: 62555
  VARIANT 132,135: Xaa = Any Amino Acid

SEQ ID NO: 62559 - protein, 137 aa, Homo sapiens; identical to SEQ ID NO: 62555
  VARIANT 132,135: Xaa = Any Amino Acid

SEQ ID NO: 62560 - protein, 137 aa, Homo sapiens; identical to SEQ ID NO: 62555
  VARIANT 132,135: Xaa = Any Amino Acid

SEQ ID NO: 62561 - protein, 321 aa, Homo sapiens
MGSSVSTLAGASWRPSVQPQPTLTEQLEHRHPGHSFQIMKCYFTDHRGEQSPTDGTTLSLTSPESTEESVEVFWPGTIQREGSSPRPGPAIPREEGLYFAARDRGMRDWSSSPSSESSEYQSYSQYQSCCSCMCDEDNAAPQSVCAFYTHVQTVRGVAVAWETEAGFEPVTRKPRIHEAQFIKRQRWNGSSFEMASNTDMRWDLEACKSNCSPEPEDIDLLECCLQELREPPDWLVTTNYGVRCVACCRVLPSLDALLEHAQHGIREGFSCQIFFEEMLERRRAQGQAHDQQLEEEQSPSDNSECSRPQGEVLSAQQQEKQ

SEQ ID NO: 62562 - protein, 321 aa, Homo sapiens; identical to SEQ ID NO: 62561

SEQ ID NO: 62563 - protein, 1637 aa, Homo sapiens
MAQGRERDEGPHSAGGASLSVRWVQGFPKQNVHFVNDNTICYPCGNYVIFINIETKKKTVLQCSNGIVGVMATNIPCEVVAFSDRKLKPLIYVYSFPGLTRRTKLKGNILLDYTLLSFSYCGTYLASYSSLPEFELALWNWESSIILCKKSQPGMDVNQMSFNPMNWRQLCLSSPSTVSVWTIERSNQEHCFRARSVKLPLEDGSFFNETDVVFPQSLPKDLIYGPVLPLSAIAGLVGKEAETFRPKDDLYPLLHPTMHCWTPTSDLYIGCEEGHLLMINGDTLQVTVLNKIEEESPLEDRRNFISPVTLVYQKEGVLASGIDGFVYSFIIKDRSYMIEDFLEIERPVEHMTFSPNYTVLLIQTDKGSVYIYTFGKEPTLNKVLDACDGKFQAIDFITPGTQYFMTLTYSGEICVWWLEDCACVSKIYLNTLATVLACCPSSLSAAVGTEDGSVYFISVYDKESPQVVHKAFLSESSVQHVVYDQQGIFLLVGTAEGKVFIINANSSSSFQIIGFTEVAKDILQISTVSLLETDIVEVMVLSSLPEAGRSRLEMFTLPTLLPQVSTTFADERGRLKDEIIHKYLYELEHALSSAVLGFQSNQIYGFCSQVPYICSYLLPEEEHTGIYILKPYKKVQSRQYGPGLLYLSSHGLWLITIAKCGILCIRDVYTLETFAWCRSHSHQGHGIQSMRISMDGQNILVNGRDDGTLVYLKWKRFGGHLASEILDYYQKLLISLSSAMDKENHYLSTTPKVSVDLGSDSEHTKQKASTDLSQDELVLTDVKKEIPWIQQKSQEAIKKEVNLFSKKRKEIKQGIKSLSKTILNMMEENDKLENIAKLDQQEFGLDLEELERLHDESQEEVAKMIKDVEMHNLAKSYLAELIKEECWNSMAVKGRALKCFHIPCVVENFPMKARTVEELKELERVLQQKKIEAECLKLRKEIVEAQSGVKLIKQRHEEDDEEEEEEDKTVKYSNLPNYLLGSLSTDFGVDTSLLSSQLELHSREEKINQIILLKDIIYKVKTVFNNEFDAAYKQKEFEIARVKERNVRIREIILDLELEEAVWQPEFEDCEKPERTLVVQDEEITAHKHIKPWHKAKELIVNHEKEHWLLIQDASTRLRALMDMMGGVLEVKKEDILRMVIPQPAFMAKPDAVWTEEERKQFKDYEKKVKELNEERDKYRKSLEAELKKLQNSIQESTQAFDEHLKRLFERRVKAEMVTNQEELKISNLAFSLLLDEELSSREKFLNNYLTRKQHEKVMDRSFKKEFSEIPGHQVDILYKLFKRRPRISKQKTHSETTSVVPFGELPGSGKLNKDAFAQLMKAMDELDNISNMPEGLDPLVWNHFCMTRRAKVENEQKVKQKAADLLEMATFLQKRVEEEEKVQQEIERVFHELILLQEEKVRFQLNLTIQILLKQGQVELENFQLVLEYSDAILINKNIIEDLNSVIRTQGQKKVASMMESKDVHKRILQIEWEHKKMEMEREDLNQKAWDIQMLFFSRDRQKYLNEPNYEALISIQIGIMEQTIAVLDKMHKKNVENCKKLLKKLGKFSNQKDIANYALSCNLREELVAVSERKDICNAMGSKLTCEKIVKERYENMMQQQKLTNISKQQAEQISILQTEVERLRMKTFPALVQM

SEQ ID NO: 62564 - protein, 154 aa, Homo sapiens
MEPSKTFMRNLPITPGYSGFVPFLSCQGMSKEDDMNHCVKTFQEKTQRYKEQLRELCCAVATAPKLKPVNSEETVLQALHQYNLQYHPLILECKYVKKPLQEPPIPGWAGYLPRAKVTEFGCGTRYTVMAKNCYKDFLEITERAKKAHLKPYEE

SEQ ID NO: 62565 - protein, 699 aa, Homo sapiens
MLKLSGEGLRDSYHSRRDQIALKNLQSDVTEAKSDFTKETLASQNTKMISSIVISQMIDENKSRENRASLPLPCAIAQSRAHHAKQSLANRSGVNIHRAFALLPGRLGIPAPSDERGPEAELPPKEERPCGGPRRGFASITITARRVGPPARALVWGTAGDSLCPKCRAEDTLFQAPPALANGAHPGRHQRSFACTEFSRNSSVVRLKVPEAHTGLCERRKYWVTHADDKETSFSPDTPLSGKSPLVFSSCVHLRVSQQCPDSIYYVDKSLSVPIEPPQIASPKMHRSVLSLNLNCSSHRLTADGVDGLVNREPISEALKQELLEGDQDLVGQRWNPGLQESHLKETPSLRRVHLGTGACPWSGSFPLENTELANVGANQVTVRKGEKDHTTHCHASDHANQLSIHIPGWSYRAVHTKVFSGSSKRQQGEVCMTVSAPPVEQKPTRHFLPIGDSSPSDDCLSRDLSEPTERRHQSFLKPRILFPGFLCPLQDVCASLQEDNGVQIESKFPKGDYTCCDLVVKIKECKKSEDPTTPEPSPAAPSPAPRDGAGSPGLSEDCSESQQTPARSLTLQEALEVRKPQFISRSQERLKKLEHMVQQRKAQRKEDLRQKQSLLPIRTSKKQFTIPHPLSDNLFKPKERCISEKEMHMRSKRIYDNLPEVKKKKEEQRKRVILQSNRLRAEVFKKQLLDQLLQRNAV

SEQ ID NO: 62566 - protein, 876 aa, Homo sapiens
MAEEEGRLHSVQGLLSLQDLQNVNTPLMRKLARLKLGLVEMALDMLQFIWEEAHGQQSEQGSLEKLLADYLQNTSDYTSVGLQWFTLKRTLAHGALAQLGSLQPLSVGCVEIRARLLGLAGRALHLLAMQADPVHPTCYWEAGPSVGAKLSGLKSLELEVEEEGATKSSRDPPASRAAPEEHCRRGEDLKRRMVLAQQYLAQASEVLLQCLQVALGSGLLDVAAAASLEMVECVGTLDPATTCQFLALSQSCSASETMRDVLLAATANTSSSQLAALLQLQHQLRCQDRTTTSLGARVEQRLAAVSKAWQNLCVTEQHFNLLNEMPPTFWILFLHLSGDRSRLYGAAYEKPKFITAAKGKVQAVGGSCKVMRLAISPTAFSHLLACAQQFRKQTQAQVYSEDMALNIGSEPEGLQVEEKERPVQRLSSVLGPLEELLQPLFPLLSLSKARVQTPAVVADSGKSKGKDKERKTSTGQHSTVQPEVADKIVLVTDRHLLELPLEGLSVFDEGTISSVSREFSLQMLWNRLHKEETEGGVKKEGRSRDPKKRSLAKKGRKGSIPRTIPPDCIIVDSDNFKFVVDPYEEAQGPEMLTPVSITQDILERFQDTFTSRWAGHLGSKHFPSQAQWEQALGSCSGFFFYGMESFLSHILVERLVAMNLQECQVAVLLDLARSYQSLKRHMESVEHRRSVGRWEANWRNGASPSEDEWRRGGEPRRGFSDLEGQAAAAPKLRAPSHHAQLGPVWAAAPSHRVVQAWTCLPSAAGAPALASALGSAPLPTHPHLPAPIPSSQLALPFLGLSPALGAASARDPPPATSRKAAAWTSSSACLCAPWGLRRGWSCVSSRGQDKGGLPLAALVLSCLDQKTIQTVSLFLI

SEQ ID NO: 62567 - protein, 258 aa, Homo sapiens
MSLESLFQHIIFTEHQAEESRRLMREVRSEITRCREKIKKATEELNEEKIKLESKVQQFFEKSFFLQLLKAHENALEKQYSEITNHRNMLLQTFEAIKKQMIEEEDKFIKEITDFNNDYEITKKRELLMKENVKIEISDLENQANMLKSEMKSMEHDSSQLNELQKQKSELIQELFTLQRKLKVFEDEENESICTTKYLEAEKIKISEKPQNDTECLRLKKELELYKEDDMESVYEALQTEIEFLELTLAQKDLQESK

SEQ ID NO: 62568 - protein, 236 aa, Homo sapiens
MPGSPVTSGYYGVRRSFLSDSDFHNSKQFSNDVYTSSVGKPFPCESSAGQSHAALLEPYFPQEPYGDYRPPALTPNAGSLFSASPLPPLLPPPFPGDPAHFLFRDSWEQTLPDGLSQPDPVSADALLTLPPSTSCLSQLESGSIAQHRGSSWGSSLAGAQSYSLHALEDLHHTPGYPTPPPYPFTPFMTVSNDLPPKVGPLSPDEEADTGSLHDPSPWVKEDGSIAWGSYECRRAY

SEQ ID NO: 62569 - protein, 406 aa, Homo sapiens
MTQTLDTREDPLNLGGGGGGGCGCGWAHSASLSSWSSCHRRRPGAPAYNRPHRYSPKTEYGPPRKQPKQQHGPGFWFQPPVCSNWGCWGGPWRPPPPGFWKFPCPVQVFRVYGLHPLCFCCCSCWSGSWNPGWVKPPGRKKRWGRRGRGLRHHPRHSYPRSPPADVSTLPRPVKLYEWREPGMRAPPNTTQFIMNQIYEDMRQQEKVERQQEALRAQKATVSGEASPARSSGNDAPPGGSKETWGLQETLYGFVQNPSLAFSPNPEENQSLAPLLVEEEEEKKNDDEEEYDQEVCDAKEASEEEEEVEDEEEEVEDEEEEEVEEAEYVEEGEEELEEEELEEEEEVLEENEQRGEEFHLPLEMPLSIFVEAEEKRENFISCTFLNPEQIIPKVPQESLFMAQDFNC

SEQ ID NO: 62570 - protein, 893 aa, Homo sapiens
MEKDDPPQLVTPTSVKAIILRIEAAQLTRAQEDISTQLSDILDNVNCVINRFQEELGYDLKENAKSQQRDPKGKKRFILLEKIASFSKDAMMKEKHLYDILRWLGDWGDTLTYEIGPRKSEEEAAALDEWIEVTEKVLPLSLIATKRGIESLTALCSTLIEGQKKRSQVSKRTFWQGWQGRSPQTSPSHPQPLSPEQMLQDQHTMNTKASEVTSMLQELLDSTMFSKGEVRAIRYMATVVENLNKALILQHKENRSLETKYRHLQMQATKELSSQRLHFQQFMEVLESRRDALLKQVEILGGRYHDLLLMKQALEFQLKKAQNATGQAEDLAEVSVDSPGPSERETLPRKETVMEESQQEPMKEEQLFSPLPPSPMAMIRDSGAIAAGHQPLSTMTVRSRVADVFGSKDTESLEPVLLPLVDRRFPKKWERPVAESLGHKDKDQEDYFQKGGLQIKFHCSKQLSLESSRQVTSESQEEPWEEEFGREMRRQLWLEEEEMWQQRQKKWALLEQEHQEKLRQWNLEDLAREQQRRWVQLEKEQESPRREPEQLGEDVERRIFTPTSRWRDLEKAELSLVPAPSRTQSAHQSRRPHLPMSPSTQQPALGKQRPMSSVEFTYRPRTRRVPTKPKKSASFPVTGTSIRRLTWPSLQISPANIKKKVYHMDMEAQRKNLQLLSEESELRLPHYLRSKALELTTTTMELGALRLQYLCHKYIFYRRLQSLRQEAINHVQIMKETEASYKAQNLYIFLENIDRLQSLRLQAWTDKQKGLEEKHRECLSSMVTMFPKLQLEWNVHLNIPEVTSPKPKKCKLPAASPRHIRPSGPTYKQPFLSRHRACVPLQMARQQGKQMEAVWKTEVASSSYAIEKKTPASLPRDQLRGHPDIPRLLTLDV

SEQ ID NO: 62571 - protein, 652 aa, Homo sapiens
MNWVGGSRSRVLIKQERRKQKEYFEKHRLKSKMKSLGVLSPVKNSAVSLDILNLYMVNQISCKKKIPETVRKPTHVNMNRDIKMPLRKHNLELTMSPHCVPSKLCLDDTETNVNCQRLSSKEDLGPVQSQGMDSYSMLHPQFSKIENCSFTPSSFSVELPSNRHISKLNFTSGIAPTPQKLAYEKKQNDQRSTVNCSDSLLSKLNKSQDVFSPSHKTTRFGTLFERLNSLGNRNLLTKSPAVIMDEDCRSTDEIRQSDYITEKHSIQHIWGKNGKEVSNFLEDVNQSTPNLLSENCDSFVSQNMINVLNIDEQRIKKTFNKCDYDSMGDTCVVTSSDKNHVTDRCIRNIFTVPELTFSNSTLNKTSYPEKCQPNKKYQREYNKNERNDLSTSFENDYYPSSSERKEKFENDYQEKTPQKSIQKYPANSMGNIPSEELHSKQSWDFGLDEILMEEGGIYSLKSKRISTKKISLDSAQSSRSTSYSPRPTDSCFSSSSDLPSEDEDQISQQIEDSNRMTIKTKEKMNNFYVERMAKLSGDRIVKNDDKIHKQNENFYQFSVKNNTDQFPQLQCNSAHILQNKTNDNCVLQAARCDAGIQTESESVMEEKLDVAIQCDLISKCTCRSDVSLCNLERCSGNIKADTTGGQEIHKNN

SEQ ID NO: 62572 - protein, 127 aa, Homo sapiens
MAQHPCQDQEQKVEMTSKQQRSTSIEETMRPQEKQVTITETLWDQVLTVFKDIQKELQEDARIRGMSNCSMTPMTSAPRTGSIRPPDSLMTPKLRRLQFSSGEQPSGGRIHNLKTQLFSQSAYYPGP

SEQ ID NO: 62573 - protein, 462 aa, Homo sapiens
MASPLPSGFPARRNSRLDVFLRRHLPPEVYDAVRAYEPCIVVSNSENHILKYVVLSDRLVYLTENPPKSIRRVVALRDVVAIDLIDDYPEFLSSPDREISQHIRIIYSSTVLKKECKKSNSVRKFLFPFHHTKANNKKVKEEKNGLAFWRSKESRSLKESPLRSEEKIKHFSQLKSELFLKDNSLRRILSLLMELKVAAQKNFILKRLFWKTSDLFYFIVNKLHEYLPESRDKNALQNQSQRVDELVACIEIIQTLVLMFRETETESSRLNTLAAKKGALFNLLVILISEPQIPKSCPVFDIQLVADSALVRMSFDAELQKLILEYTNTATALLYEILLVFQQGNLGLGSTKFAISWIMSFLQSCPPIITFVASIVKQVVRGLSASFQLLSPCQAVLLYQQFYILKSCLRHSRTLAEYIRNNYREEFRYFIHMPALQKRLPLCYPITQPTIQLFHEVLKLVE

SEQ ID NO: 62574 - protein, 462 aa, Homo sapiens; identical to SEQ ID NO: 62573

SEQ ID NO: 62575 - protein, 250 aa, Homo sapiens
MDMLQDLESLQFEYGVPEEDRIWLYLQGRSRGLMIEACAHATFFCKLLYNLRASLNKNQSSRHLSIGSLNSATPEEFKVGIIGGGHLGKQLAGTLLQLGPIPAESLRISTRRPETLGELQKLGIKCFYHNADLVSWADVIFLCCLPSQLPNICVEIYTSLEKASIVYSFVAAIPLPRLKLLLNHTNILRPQYQYDEDSVSVWGANKGVIAALQDPTILQATCPYSPAGHGSTYFWHSFENYFPVGPLLSY

SEQ ID NO: 62576 - protein, 825 aa, Homo sapiens
MVGKSQQTDVIEKKKHMAIPKSSSPKATHRIGNTSGSKGSYSAKAYESIRVSSELQQTWTKRKHGQEMTSKSLQTDTIVEEKKEVKLVEETVVPEEKSADVREAAIELPESVQDVEIPPNIPSVQLKMDRSQQTSRTGYWTMMNIPPVEKVDKEQQTYFSESEIVVISRPDSSSTKSKEDALKHKSSGKIFASEQPEFQPATNSNEEIGQKNISRTSFTQETKKGPPVLLEDELREEVTVPVVQEGSAVKKVASAEIEPPSTEKFPAKIQPPLVEEATAKAEPRPAEETHVQVQPSTEETPDAEAATAVAENSVKVQPPPAEEAPLVEFPAEIQPPSAEESPSVELLAEILPPSAEESLSEEPPAEILPPPAEKSPSVEPLGEIRSPSAQKAPIEVQPLPAEGALEEASAKVEPPTVEETLADVQPLLPEEAPREEARELQLSTAMETPAEEAPTEFQSPLPKETTAEEASAEIQLLAATEPPADETPAEARSPLSEETSAEEAHAEVQSPLAEETTAEEASAEIQLLAAIEAPADETPAEAQSPLSEETSAEEAPAEVQSPSAKGVSIEEAPLELQPPSGEETTAEEASAAIQLLAATEASAEEAPAEVQPPPAEEAPAEVQPPPAEEAPAEVQPPPAEETPAEVQPPPAEEAPAEVQPPPAEEAPAEVQPPPAEEAPAEVQSLPAEETPIEETLAAVHSPPADDVPAEEASVDKHSPPADLLLTEEFPIGEASAEVSPPPSEQTPEDEALVENVSTEFQSPQVAGIPAVKLGSVVLEGEAKFEEVSKINSVLKDLSNTNDGQAPTLEIESVFHIELKQRPPEL

SEQ ID NO: 62577 - protein, 151 aa, Homo sapiens
MDASLSMLANCEKLSLSTNCIEKIANLNGLKNLRILSLGRNNIKNLNGLEAVGDTLEELWISYNFIEKLKGIHIMKKLKILYMSNNLVKDWAEFVKLAELPCLEDLVFVGNPLEEKHSAENNWIEEATKRVPKLKKLDGTPVIKGDEEEDN

SEQ ID NO: 62578 - protein, 587 aa, Homo sapiens
MNDSLFVSLDRLLLEFVFQYEQDISTKEEMIQRINKCCEDIKENKVTICRIHETINATDEEIDHYCKHSEEIKDNCRNWKPTCDVFRKHEDYMQDQFTVYQGTVEKDKEMYHDYICQYKEVLKQYQLKYSETPFSREYYEKKREHEEIQSRVLACTEQLKMNETIFMKFRVPAPFPSLTKWTLNIVNLRCETQDILKHASNLTKSSSELKKEVDEMEIEINYLNQQISRHNETKALSETLEEKNKNTENRKELKERIFGKDEHVLTLNKTQSSQLFLPYESQKLVRPIKMHSSEPRVADIKEESSVKQSKLANIDFRQKENDTQIFNDSAVDNHSKCSHITTITSSQKFMQVRLLTPQKQSNSNQWSEKGDKDAEYGDKGTVRQVRESKCTSQAIYTEHFGKSIENDSDEVEERAENFPRTSEIPIFLGTPKAVKAPESLEKIKFPKTPPFEINRNRNAVPEVQTEKESPGLSFLMSYTSRSPGLNLFDSSVFDTEISSDQFNEHYSARNLNPLSSEQEIGNLFEKPEGEDGFTFSFPSDTSTHTFGAGKDDFSFPFSFGQGQNSIPSSSLKGFSSSSQNTTQFTFF

SEQ ID NO: 62579 - protein, 140 aa, Homo sapiens
MDTGQRADPSNPGDKEGDLQGLWQELYQLQAKQKKLKREVEKHKLFEDYLIKVLEKIPEGCTGWEEPEEVLVEATVKHYGKLFTASQDTQKRLEAFCQMIQAVHRSLESLEEDHRALIASRSGCVSCRRSATASRSSGGS

SEQ ID NO: 62580 - protein, 422 aa, Homo sapiens
MYRVPEFYARRKRLGGQTPYLMDQLGLRLGMWYWKDETRTLEFRRFAAEDSVQWLLKHHPHFTPAAEVKEKGKKGKAVHFAETDGPASDRLTDKRLAAKDDKSAKAVEKRGQQGTITLDDVKFVTLLLLQDTEMQRICSFTTFMRNKNLDNFLMALLYYLSHYLEKNSLEKKPKSYMVGLVEKKEMELVLSELEAAQRYLAQKYCILVLGLAVPDKHHMCCGKEKISDTQKDWKFFESFYTFCTYVAWIVFRRQHLTEIEEEVGRLFRTNMFNIPRRRREDEESGGEKKRMTFVQFRRMMAKRPAIKKAINMRSPVMSTLLPSLREKAQNVFEKKYHQVDVRFPAEMQKHVGTLDSVPMPVVGILGEPRCLFNPHTLHPLDPEENTKSFGRYPSLMENNNMRIQDTLDLVMKTLSSHTSCPK

SEQ ID NO: 62581 - protein, 220 aa, Homo sapiens
MFQGQRGWFCGSVSQDLRQFWVAEGGTISDPRAADFLFSCDASHPDTLRIYQSLDYIEDNATVFHAYYLSAVANAKIKNSVALGHFILPPACLQKEIRRKIGSFIWEQDQHFLIEKHDEVTPNEIKTLRENSELATEHKKELSKSPEKHFIRTPVVEKQMYFPLQNYPVNNMVTGYISIDAMKKFLGELHDFIPGTSGYLAYHVQNEINMSAIKNKLKRK

SEQ ID NO: 62582 - protein, 874 aa, Homo sapiens
MEVLREKVEEEEEAEREEAAEWAEWARMEKMMRPVEVRKEEITLKQETLRDLEKKLSEIQITVSAELPAFTKDTIDISKLPISYKTNTPKEEHLLQVADNFSRQYSHLCPDRVPLFLHPLNECEVPKFVSTTLRPTLMPYPELYNWDSCAQFVSDFLTMVPLPDPLKPPSHLYSSTTVLKYQKGNSFDFSTLLCSMLIGSGYDAYCVNGYGSLDLCHMDLTREVCPLTVKPKETIKKEEKVLPKKYTIKPPRDLCSRFEQEQEVKKQQEIRAQEKKRLREEEERLMEAEKAKPDALHGLRVHSWVLVLSGKREVPENFFIDPFTGHSYSTQDEHFLGIESLWNHKNYWINMQDCWNCCKDLIFDLGDPVRWEYMLLGTDKSQLSLTEEDDSGINDEDDVENLGKEDEDKSFDMPHSWVEQIEISPEAFETRCLNGKKVIQYKRAKLEKWAPYLNSNGLVSRLTTYEDLQCTNILEIKEWYQNREDMLELKHINKTTDLKTDYFKPGHPQALRVHSYKSMQHEMDRVIEFYETARVDGLMKREETPRTMTEYYQGRPDFLSYRHASFGPRVKKLTLSSAESNPRPIVKITERFFRNPAKPAEEDVAERVFLVAEERIQLRYHCREDHITASKREFLRRTEVDSKGNKIIMTPDMCISFEVEPMEHTKKLLYQYEAMMHLKREEKLSRHQVWESELEVLEILKLREEEEAAHTLTISIYDTKRNEKSKEYREAMERMMHEEHLRQVETQLDYLAPFLAQLPPGEKLTCWQAVRLKDECLSDFKQRLINKANLIQARFEKETQELQKKQQWYQENQVTLTPEDEDLYLSYCSQAMFRIRILEQRLNRHKELAPLKYLALEEKLYKDPRLGELQKIFA

SEQ ID NO: 62583 - protein, 384 aa, Homo sapiens
MGVTGAHGFPCCGKGSVEVAEMRDDLSQHQIQEEQELEADMLEQKPQLQVDLDLDPDPDPDPELEIGQVPALLESELYPALKLEAELDTEANSNEESDFEEPMQLVCKIESAHSNMGLPTPQTFRPWSLNSNCRSFTEENHVSACHHSISAQTSKHLFWANKLIQASEHSLQRAINMQLNNGSAGQPIRSPLREAIPTNALCSEEQLQIPDAHSAPPTTSSQAPSPLLSSDLPPPIDLTELITFASSLAMASSSRMDLPSLEHMMKAPPQEALEPSTEPLLTTVEEREPENHAETLPEKPREARAPLKSWSQEDKNFAQSYFDFSKPGIKRATIKGQIQLLQSPATSPLLQGSKEDSVPPGKEKENPLLVKIHFKLSAPTIPEK

SEQ ID NO: 62584 - protein, 248 aa, Homo sapiens
MDKHGVKTPLWKKETEELRAEDAEQEEGKEGSEDEDEDNQRPLEDSATEGEEPPRVAEEGEGRERRSVSYCPLRQESSTQQVALLRRADSGFWGWLGPLALLGGLTAPTDRKRSLPEEPCVLEIRRRPPRRGGCACCELLFCKKCRSLHSHPAYVAHCVLDHPDLGKAGGRWELLSAPAPSLCALHHFLAPDPLPTFSLGARSPLRRIPQDRPFSAAAQSAPIHQEGPLLVLGSHLSPSAPSAEPSIT

SEQ ID NO: 62585 - protein, 570 aa, Homo sapiens
MAYEKSTDISDVSRSMFLYPWLEYPDKTKELRKAMAPVHLPLSCYQMPKEEFPPSPECWRQHPSKPNSVPYCYFKKPEIYTHWHDLYDQREEREAEKMLRKMRDDCRYIKEVHQTHIKMFHLPMSKLTIKSEMRSRPLEPTQDPLKWQRLRELTKSLESPREDEQFYAAQALGCLRISDKFVMEALQQVAQTGPEKVKYEAYRTLAILGCLNKHVIRALIKQLKEKNEGQRMETLTGLRMALNSWAAVSKDKRTQVGDEGKLVPVLQTLIKKSSSEASLEAALCLGFLRPCSNMVQEFLLQCLCQGLKTQRMKALRMLVKVMHVHSAPVIKAILDQLCSSSVLEDRFEATQMLKTIGLEQIQAQGLEELTFNLLRRKTHNEPFLAVRQAVAQTVEELKLKPTMMNLVEAQLMNPDATARQEAVISLGVLGIRSPQVFHLLLDLLDAENHQAVKKSLQETLILCASIDPWIQNKLKNKVLSVYEAPKTNVKAEPTRFQKEPENPEELTIQDFRLAKLNPLFIAKSITKVGQKKTPAFPPCCSKPRKHRPQVIGPWQPRIKKQLRVLAEIAK

SEQ ID NO: 62586 - protein, 408 aa, Homo sapiens
MENQLWHNTVRCCNQYQESPHDAEDILLLLLGLIVLVNIGINVATMMWHGLQNALDKMIDWATQKNEIQASESPPSGPPDKAQDVHIHCILDPVQVKMSRPTQYSSFSCHHFSNHHSSSLLRCVRRRRRRHRRCRRRCCNHQQRPQNYRQIPHSHSVFRNPHRSQKMSQLHRVPFFDQEDPDSYLEEEDNLPFPYPKYPRRGWGGFYQRAGLPSNVGLWGHQGGILASLPPPSLYLSPELRCMPKRVEARSELRLQSYGRHGSQSRLWGNVEAEQWASSPPPPHRLPPNPSWVPVGHSPYPSVGWMLYDSWDQRRRGTEGFERPPASVSRNARPEAQGCREHHSPQSHQQSLLGHAYGQSHRSPHPSTEPLGYSSQDPREVRRRAADWAEALPAWRPLTTSASLTVLD

SEQ ID NO: 62587 - protein, 97 aa, Homo sapiens
MINLHRLCIIHAISATCKDEKGKQEMETGQQPSGLSATLTKVKCAKRQKTVVRVRFYMLSMKNKACRKNLSKGYNQRPEGSKEESHMVVKEKRKGDH

SEQ ID NO: 62588 - protein, 695 aa, Homo sapiens
MIWLRNRRCLEPLQGTPKWVPVLGELQKTLQKGEYLPLRPLPMFESNFVQVTHQGGPVFVNHRTNRLAMGVAASLPGLVLPDILLIGQPAEDRDCSGLVLTRMIPLDLVHLCVHDLSAWRLKLRLVSGRQYYLALDAPDNEVGFLFHCWVRLINLLQEPAPTWTPRTTRTAPLDMPLAEAPASTWHLQDQPISRHAVRVAERNFPHKTVAAQRQRKAKALKRSFKSQAVGDSVPLIWSQLEHADVRKKPAEKNSLDPCLWHQDTEDLMDSGGSTLSSAASVPEAPSCTCFIVETPTWIGSSPEGPSCVSSSPEGPSCTCSIPEGPSRTCSIPEGPSHTCSIPEGLSCVSFSPKGLSRIPGRAVLERSQSGGKPEPVVTVRTQETDVVEMTTQAKSPESPFTVTKKESKDILISQTKEVTLEAFRGQGKLEDWAHWAKLEERSPDLPGVRSKELEQRKRWVKAKELAVEGPSQEHSRPFSVEALTLTKLMITANSKEQPSKSALVSLPSWLLATPQASATSMMASVPSRPGQLSLLEGKPVVVREQPESHTWVKEGKRPWGEMKEQPWGEMKEPPWDPKGPPKVPFRSKPTSASLKREGISQAPIPLTASPWEDLRPSPLSETLISKMEATARASQQPKRVSQEPMRMPAQHPLATVGSSSEILLPMLLELETVRNTATKAEEIQEESGVLNLLPR

SEQ ID NO: 62589 - protein, 834 aa, Homo sapiens
MIWLRNRRCLEPLQGTPKWVPVLGELQKTLQKGEYLPLRPLPMFESNFVQVTHQGGPVFVNHRTNRLAMGVAASLPGLVLPDILLIGQPAEDRDCSGLVLTRMIPLDLVHLCVHDLSAWRLKLRLVSGRQYYLALDAPDNEVGFLFHCWVRLINLLQEPAPTWTPRTTRTAPLDMPLAKAPASTWHLQDQPISRHAVRVAERNFPHKTVAAQRQRKAKALKRSFKSQAVGDSVPLIWSQLEHADVRKKPAEKNSLDPCLWHQDTEDLMDSGGSTLSSAASGLAPYPPAACLSTPYSSIPRGREKAGPMGSHQGPGPPPCQKAPSGPVTSCKAPFLVDQSQKLPAVPASSWKPPPGLAPPQKAPAASAPPRKAPAVPAPSQKAPAVPAPSQKAPAIPAPSRKASAASASPRKASAVPAPPQKTPPPSQKAPSVPTIPQKAVSPTAPKKKSLLLPAPSQKALPTSPTQYQMALSPPASRGKLPGDFDVLPTGIPGRAVLERSQSGGKPEPVVTVRTQETDVVEMTTQAKSPESPFTVTKKESKDILISQTEEVTLEAFRGQGKLEDWAHWAKLEERSPDLPGVRSKELEQRKRWVKAKELAVEGPSQEHSRPFSVEALTLTKLMITANSKEQRSKSALVSLPSWLLATPQASATSMMASVPSRPGQLSLLEGKPVVVREQPESHTWVKEGKRPWGEMKEPPWDPKGPPKVPFRSKPTSASLKREGISQAPIPLTASPWEDLRPSPLSETLISKMEATARASQQPKRVSQEPMRMPAQHPLATVGSSSEILLPMLLELETVRNTATKAEEIQEESGVLNLLPSLQHSQHSEWPDAGA

SEQ ID NO: 62590 - protein, 289 aa, Homo sapiens
MGTLSCDSTPRLATAPLGRRVTEGQIPETGLRKSCGTATLENGSGPGLYVLPSTVGFINHDCTRVASPAYSLVRRPSEAPPQDTSPGPIYFLDPKVTRFGRSCTPAYSMQGRAKSRGPEVTPGPGAYSPEKVPPVRHRTPPAFTLGCRLPLKPLDTSAPAPNAYTMPPLWGSQIFTKPSSPSYTVVGRTPPARPPQDPAEIPGPGQYDSPDANTYRQRLPAFTMLGRPRAPRPLEETPGPGAHCPEQVTVNKARAPAFSMGIRHSKRASTMAATTPSRPAGHRLPGRCC

SEQ ID NO: 62591 - protein, 214 aa, Homo sapiens
MTLLLCLVCLTAALAHGCLHCHSNFSKKFSFYRHHVNFKSWWVGDIPVSGALLTDWSDDTMKELHLAIPAKITREKLDQVATAVYQMMDQLYQGKMYFPGYFPNELRNIFREQVHLIQNAIIESRIDCQHRCGIFQYETISCNNCTDSHVACFGYNCESSAQWKSAVQGLLNYINNWHKQDTSMSLVSPALRCLEPPHLANLTLEDAAECLKQH

SEQ ID NO: 62592 - protein, 238 aa, Homo sapiens
MVLLLLVAIPLLVHSSRGPAHYEMLGRCRMVCDPHGPRGPGPDGAPASVPPFPPGAKGEVGRRGKAGLRGPPGPPGPRGPPGEPGRPGPPGPPGPGPGGVAPAAGYVPRIAFYAGLRRPHEGYEVLRFDDVVTNVGNAYEAASGKFTCPMPGVYFFAYHVLMRGGDGTSMWADLMKNGQVRASAIAQDADQNYDYASNSVILHLDVGDEVFIKLDGGKVHGGNTNKYSTFSGFIIYPD

SEQ ID NO: 62593 - protein, 246 aa, Homo sapiens
MLWRQLIYWQLLALFFLPFCLCQDEYMESPQTGGLPPDCSKCCHGDYSFRGYQGPPGPPGPPGIPGNHGNNGNNGATGHEGAKGEKGDKGDLGPRGERGQHGPKGEKGYPGIPPELQIAFMASLATHFSNQNSGIIFSSVETNIGNFFDVMTGRFGAPVSGVYFFTFSMMKHEDVEEVYVYLMHNGNTVFSMYSYEMKGKSDTSSNHAVLKLAKGDEVWLRMGNGALHGDHQRFSTFAGFLLFETK

SEQ ID NO: 62594 - protein, 319 aa, Homo sapiens
MLWRQLIYWQLLALFFLPFCLCQDEYMEVSGRTNKVVARIVQSHQQTGRSGSRREKVRERSHPKTGTVDNNTSTDLKSLRPDELPHPEVDDLAQITTFWGQSPQTGGLPPDCSKCCHGDYSFRGYQGPPGPPGPPGIPGNHGNNGNNGATGHEGAKGEKGDKGDLGPRGERGQHGPKGEKGYPGIPPELQIAFMASLATHFSNQNSGIIFSSVETNIGNFFDVMTGRFGAPVSGVYFFTFSMMKHEDVEEVYVYLMHNGNTVFSMYSYEMKGKSDTSSNHAVLKLAKGDEVWLRMGNGALHGDHQRFSTFAGFLLFETK

SEQ ID NO: 62595 - protein, 147 aa, Homo sapiens
MTAIRLREFIERRPVIPPSIFIAHQGRDVQGYYPGQLARLHFDHSAKRAPRPLIDLTIPPKTKYHYQPQLDQQTLIRYICLRRHSKPAEPWYKETTYRRDYSLPFYEIDWNQKLATVSLNPRPLNSLPELYCCEERSSFERNAFKLK

SEQ ID NO: 62596 - protein, 183 aa, Homo sapiens
MEKRELKASVPKFDKIPWLSEASLVNKPLVLSLPRRYPHTSATFLTSSKKNMNLPILFQVPDVLSKARRNQCDSMLLRNQQLCSTCQEMKMVQPRTMKIPDDPKASFENCMSYRMSLHQPKFQTTPEPFHDDIPTENIHYRLPILGPRTAVFHGLLTEAYKTLKERQRSSLPRKEPIGKTTRQ

SEQ ID NO: 62597 - protein, 261 aa, Homo sapiens
MENFSLLSISGPPISSSALSAFPDIMFSRATSLPDIAKTAVPTEASSPAQALPPQYQSIIVRQGIQNTVLSPDCSLGDTQHGEKLRRNCTIYRPWFSPYSYFVCADKESQLEAYDFPEVQQDEGKWDNCLSEDMAENICSSSSSPENTCPREATKKSRHGLDSITSQDILMASRWHPAQQNGYKCVACCRMYPTLDFLKSHIKRGFREGFSCKVYYHKLKALWSKEQKARLGDRLSSGSCQAFNSPAEHLRQIGGEAYLCL

SEQ ID NO: 62598 - protein, 508 aa, Homo sapiens
MNENKDTDSKKSEEYEDDFEKDLEWLINENEKSDASIIEMACEKEENINQDLKENETVMEHTKRHSDPDKSLQDEVSPRRNDIISVPGIQPLDPISDSDSENSFQESKLESQKDLEEEEDEEVRRYIMEKIVQANKLLQNQEPVNDKRERKLKFKDQLVDLEVPPLEDTTTFKNYFENERNMFGKLSQLCISNDFGQEDVLLSLTNGSCEENKDRTILVERDGKFELLNLQDIASQGFLPPINNANSTENDPQQLLPRSSNSSVSGTKKEDSTAKIHAVTHSSTGEPLAYIAQPPLNRKTCPSSAVNSDRSKGNGKSNHRTQSAHISPVTSTYCLSPRQKELQKQLEEKREKLKREEERRKIEEEKEKKRENDIVFKAWLQKKREQVLEMRRIQRAKEIEDMNSRENRDPQQAFRLWLKKKHEEQMKERQTEELRKQEECLFFLKGTEGRERAFKQWLRRKRMEKMAEQQAVRERTRQLRLEAKRSKQLQHHLYMSEAKPFRFTDHYN

SEQ ID NO: 62599 - protein, 180 aa, Homo sapiens
MAESGKEKIKWTTTIIISSSLKSYEVATALENRSHKVRYSDSVENGSIIFSLSGVAFLLMDTKECLLSTEEIFLAKIEKFINIHQNSFLVLSAALHGPEEWKLMFRIQQRFLGCNLRILPVHNTVNAINLMCTIAKTTSKPYIDSICYRMITAKAYIIEQSPVWKTLQKIKLNSDSVNPN

SEQ ID NO: 62600 - protein, 194 aa, Homo sapiens
MFLTAVNPQPLSTPSWQIETKYSTKVLTGNWMEERRKFTRDTDKTPQSIYRKEYIPFPDHRPDQISRWYGKRKVEGLPYKHLITHHQEPPHRYLISTYDDHYNRHGYNPGLPPLRTWNGQKLLWLPEKSDFPLLAPPTNYGLYEQLKQRQLTPKAGLKQSTYTSSYPRPPLCAMSWREHAVPVPPHRLHPLPHF

SEQ ID NO: 62601 - protein, 414 aa, Homo sapiens
MRESQDAAGAHGWNRVGSTATKWFTGAPFGVQSHRFDISAVYPNWKKFSTFTEAPYSTRYSTQVSHIGPGTYSSKETCFSKKKLMKEVDTGWAKAQEATRLTQLPHFQYQAIMKEKRLKEQKLGPCSYNLKDFLEQLREKPCSTRGLLSSGEVRFRGLTGNYYPGPGNYGEKGNPYTKLEENAWNRSHSEGLMCRMSNKPHPRPHQGSGLGPGTYFFKSDLETYVARSVGTRGPYDTFSGDRSKPLPYGHYSMQKKKPRELMNFKSFVEELNSHHNKKHGVFSKLPRNPKTPTERIYWANLSQCPRTLATSGPSFWLPQEKKCKPVNQPPFLLTSKGSGAKACQMIMGSWNPVGVGRYLNTWLMETKDRRQRYRSLFLSGSKRYLSDLARDMLMQIRLFCWKGLEVINFGLSPM

SEQ ID NO: 62602 - protein, 199 aa, Homo sapiens
MASPKGFFNYLTYFLAAGAVTLGIGFFALASALWFLICKRREIFQNSKFKAIDERCRQRPSMAKIKSHSQCVFISRNFHTGRFQLQEEQRKKEAAHIKAIKDHSKDEPQLATKNIICDPSETSSTTNRSSVTLSLSTLPSDSYYSQSIEAADDWFSDDSLVKRNSPMPSLGEPLMEKVFSYLSTISLEEGTESVLNDTL

SEQ ID NO: 62603 - protein, 199 aa, Homo sapiens; identical to SEQ ID NO: 62602

SEQ ID NO: 62604 - protein, 341 aa, Homo sapiens
MVPAAGALLWVLLLNLGPRAAGAQGLTQTPTEMQRVSLRFGGPMTRSYRSTARTGLPRKTRIILEDENDAMADADRLAGPAAAELLAATVSTGFSRSSAINEEDGSSEEGVVINAGKDSTSRELPSATPNTAGSSSTRFIANSQEPEIRLTSSLPRSPGRSTEDLPGSQATLSQWSTPGSTPSRWPSPSPTAMPSPEDLRLVLMPWGPWHCHCKSGTMSRSRSGKLHGLSGRLRVGALSQLRTEHKPCTYQQCPCNRLREECPLDTSLCTDTNCASQSTTSTRTTTTPFPTIHLRSSPSLPPASPCPALAFWKRVRIGLEDIWNSLSSVFTEMQPIDRNQR

SEQ ID NO: 62605 - protein, 354 aa, Homo sapiens
MALDSTIAHLSLRNNNIDDRGAQLLGQALSTLHSCNRTLVSLNLGFNHIGDEGAGYIADGLRLNRSLLWLSLAHNRIQDKGALKLAEVLRAFELTHTEVVERRRLLLEKGTQERSRSPSSSRHGDSKTDREKSQMVGISNSALVDKTDKTQTMKTPKGLGKKKEKSWELAKKEEKLGSGQSPTQGTPKKEDATKAGKGKVTIPEQKPSRAKGIKIGSREKRSILLESEQLVVEATEVVNPLLEPVEHRDGKVFMPGNKVLLHLNLIRNRITEVGLEGFLATVQYQMQFSKAKSASKGPVGLLWLSLAVSPFHSLLLKQTLPLSAVILDSCCRQLLSPHFQGRKIASPHNVLRTP

SEQ ID NO: 62606 - protein, 408 aa, Homo sapiens
MPVISSRQDCDSATSTVTDILCAAEVKSSKGTEDRGRILGDSNLQVSKLLSQFPLKSTETSKVPDNKNVLDKTRVTKDFLQDNLFSGPGPKEPTGLSPFLLLPPRPPPARPDKLPELPAQKRQLPVFAKICSKPKADPAVERHHLMEWSPGTKEPKKGQGSLFLSQWPQSQKDACGEEGCCDAVGTASLTLPPKKPTCPAEKNLLYEFLGATKNPSGQPRLRNKVEVDGPELKFNAPVTVADKNNPKYTGNVFTPHFPTAMTSATLNQPLWLNLNYPPPPVFTNHSTFLQYQGLYPQQAARMPYQQALHPQLGCYSQQVMPYNPQQMGQQIFRSSYTPLLSYIPFVQPNYPYPQRTPPKMSANPRDPPLMAGDGPQYLFPQGYGFGSTSGGPLMHSPYFSSSGNGINF

SEQ ID NO: 62607 - protein, 290 aa, Homo sapiens [sequence omitted]

SEQ ID NO: 62608 - protein, 1052 aa, Homo sapiens
MPLSRRGRGSRLAGSRAATSNLPRATALSPKSAGRGALSISHAQLLTRRRHSSEQVPPESEPRADFRSGKWLQEPATGDARDSRQALRARMSSKHRICSQEEVVIPCAYDSDSESVDLELSNLEIIKKGSSSIELTDLDIPDIPGLHCEPLSHSPRHLTQQDPLSEAIVEKLIQSIQKVFNGELKGELEKLKFLGDLSSLSQALPYDETAKSFIHSHIADIVHTLNVLVQEERPHSLSSSMRQEVFVTIADLSYQDVHLLLGSEDRAELFSLTIKSIITLPSVRTLTQIQEIMPNGTCNTECLYRQTFQAFSEMLQSLVVKDPHLENLDTIIKHLVPWLQSVKDHERERATASMAQVLKCLSKHLNLKLPLRFQRLGHLVALMALLCGDPQEKVAEEAAEGIHSLLHITLRLKYITHDKKDQQNLKRALTKCREFLELHSSAAKCFYNCPFRIAQVFEGFLDSNELCQFIMTTFDTLKTLKHPCIQRSAGELLLTLAKNTESQFEKVPEIMGVICAQLSIISQPRVRQQIINTVSLFISRPKYTDIVLSFLLCHPVPYNRHLAEVWRMLSVELPSTTWILWRLLRKLQKCHNEPAQEKMAYVAVAATDALYEVFLGNRLRAATFRLFPQLLMTLLIQIHHSIGLTMSDVDIPSGLYTEQEVPSEVTPLCFAMQATKTLLLRTCCLQEFNIMEKNKGWALLGGKDGHLQGLFLLANALLERNQLLAQKVMYLLVPLLNRGNDKHKLTSAGFFVELLRSPVAKRLPSIYSVARFKDWLQDGNHLFRILGLRGLYNLVGHQEMREDIKSLLPYIVDSLRETDEKIVLSAIQILLQLVRTMDFTTLAAMMRTLFSLFGDVRSDVHRFSVTLFGAAIKSVKNPDKKSIENQVLDSLVPLLLYSQDENDAVAEESRQVLTICAQFLKWKLPQEVYSKDPWHIKPTEAGTICRFFEKKCKGKINILEQTLMYSKNPKLPIRRSAVLFVGLLSKYMDHNELRRMGTDWIEDDLRDLLCDPEPSLCIIASQTLLLVQMARAEPKPKQRVNWLQKLMGRSSA

SEQ ID NO: 62609 - protein, 165 aa, Homo sapiens
MTRLCLPRPEAREDPIPVPPRGLGAGEGSGSPVRPPVSTWGPSWAQLLDSVLWLGALGLTIQAVFSTTGPALLLLLVSFLTFDLLHRPAGHTLPQRKLLTRGQSQGAGEGPGQQEALLLQMGTVSGQLSLQDALLLLLMGLGPLLRACGMPLTLLGLAFCLHPWA

SEQ ID NO: 62610 - protein, 153 aa, Homo sapiens
MGNYSSHKRTKAPKQARKERPADMDKAWWKSFLNHLTRKKPATRIVLILPLDKRQPLANAGQRIDYASGAGLGSPAAPRLRGAGEGSEREPRMPVLLLLRRQEARRPEEGGARAALSWPRLLSRFRSPGKAPREAGPAEEQPRKRCRCPRPQL

SEQ ID NO: 62611 - protein, 227 aa, Homo sapiens
MSYFRTPQTHPGPLPSGQGGAASPGLSLGLCSPVEPVVVASGGTGPLSQKAEQVAPAAQAWGPALAMPQARGCPGGTSWETLRKEYSRNCHKFPHVRQLESLGWDNGYSRSRAPDLGGPSRPRPLMLCGLSPRVLPVPSEAVGKEASSQPDICILTLAMMIAGIPTVPVPGVREEDLIWAAQAFMMAHPEPEGAVEGARWEQAHAHTASGKMPLVRSKRGQPPGSCL

SEQ ID NO: 62612 - protein, 90 aa, Homo sapiens
MDDMSPRLRAFLSEPIGEKDVCWVDGISHELAINLVTKGINKAYILLGQFLLMHKNEAEFQRWLICCFGATECEAQQTSHCLKEWCACFL

SEQ ID NO: 62613 - protein, 90 aa, Homo sapiens; identical to SEQ ID NO: 62612

SEQ ID NO: 62614 - protein, 318 aa, Homo sapiens
MSTHVAGLGLDKMKLGNPQSFLDQEEADDQQLLEPEAWKTYTERRNALREFLTSDLSPHLLKRHHARMQLLRKCSYYIEVLPKHLALGDQNPLVLPSALFQLIDPWKFQRMKKVGTAQTKIQLLLLGDLLEQLDHGRAELDALLRSPDPRPFLADWALVERRLADVSAVMDSFLTMMVPGRLHVKHRLVSDVSATKIPHIWLMLSTKMPVVFDRKASAAHQDWARLRWFVTIQPATSEQYELRFRLLDPRTQQECAQCGVIPVAACTFDVRNLLPNRSYKFTIKRAETSTLVYEPWRDSLTLHTKPEPLEGPALSHSV

SEQ ID NO: 62615 - protein, 154 aa, Homo sapiens
MQGIDRWIPSIPPLQNHSAVNRRHFSAPQKLHADCEKEMLDGGVPGTTVRVSFDFSCLEMVRELWMWNVEEEEHEVGISTWGGQHCGCPAKSLPGPHPGGVSAPQSASQLMVKLLVWQKSVHKLRKIAAQSEEWSCILNKISTHPFVSKEHDGT

SEQ ID NO: 62616 - protein, 68 aa, Homo sapiens
MQMQMELISLNAFINNFWNINKRYLKILKIVIQKEHLKEHLTRLHPWRKEHLTRLKAWWKEHLTNRIQ

SEQ ID NO: 62617 - protein, 1984 aa, Homo sapiens
MELTPGAQQQGINYQELTSGWQDVKSMMLVPEPTRKFPSGPLLTSVRFSNLSPESQQQDVKSLEFTVEPKLQSVKHVKLSSVSLQQTIKSVELAPGSLPQRVKYGEQTPRTNYQIMESSELIPRPGHQFAKYAEMIPQPKYQIPKSANLISIPIYHATESSEMAQGLAYKGIDTVEKSVGLTPKLTGRAKESLGMLLQPDLQVPKFVDLTPMVRDQGSKFLGLTPEKSYQILETMELLSQSRPRVKDVGELYMKPLQQTVEYEGITPELKHYFTEAMGLTAEARIQANEFFGMTPKPTSQATGFAERSPRLCPQNLECVEVISEKRLQGEESVVLIPKSLHHVPDSASGMTPGLGHRVPESVELTSKSGVQVEKTLQLTPKPQHHVGSPGIISGLGHQVPESVNLTCKQWLQMEESLEVPLKQTSQVIGHEESVELTSEARQHREVSMGLTKSKNQSMKSPGTTPGPLGRIVEFMRISPEPLDQVTESARTQLQVAQSEEVILIDVPKVVQSVKVTPGPPFQIVKSVTIPRPTPQMVEYIELTPKLQYVRPSEHHTGPCLQDVKSTKLITKPKHQILETVELTGFQIVKTMLIPGPSLQIVKSEELAPGPIPLVVEPIGVALESGIEAINCVDLLPRPHLQELIVPAELTPSPCTQVKSAELTSPQTSPFEEHTILTHKQGLQAVKSTVIKTEPPKVMETEDLNLGHVCQNRDCQKLTSEELQVGTDFSRFLQSSSTTLISSSVRTASELGGLWDSGIQEVSRALDIKNPGTDILQPEETYIDPTMIQSLTFPLALHNQSSDKTANIVENPCPEILGVDVISKETTKRKQMEELENSLQRHLPQSWRSRSRTFQAESGVQKGLIKSFPGRQHNVWESHAWRQRLPRKYLSTMLMLGNILGTTMERKLCSQTSLAERATADTCQSIQNLFGIPAELMEPSQSLPEKGPVTISQPSVVKNYIQRHTFYHGHKKRMALRIWTRGSTSSIIQQYSGTRVRIKKTNSTFNGISQEVIQHMPVSCAGGQLPVLVKSESSLSIFYDREDLVPMEESEDSQSDSQTRISESQHSLKPNYLSQAKTDFSEQFQLLEDLQLKIAAKLLRSQIPPDVPPPLASGLVLKYPICLQCGRCSGLNCHHKLQTTSGPYLLIYPQLHLVRTPEGHGEVRLHLGFRLRIGKRSQISKYRERDRPVIRRSPISPSQRKAKIYTQASKSPTSTIDLQSGPSQSPAPVQVYIRRGQRSRPDLVEKTKTRAPGHYEFTQVHNLPESDSESTQNEKRAKVRTKKTSDSKYPMKRITKRLRKHRKFYTNSRTTIESPSRELAAHLRRKRIGATQTSTASLKRQPKKPSQPKFMQLLFQSLKRAFQTAHRVIASVGRKPVDGTRPDNLWASKNYYPKQNARDYCLPSSIKRDKRSADKLTPAGSTIKQEDILWGGTVQCRSAQQPRRAYSFQPRPLRLPKPTDSQSGIAFQTASVGQPLRTVQKDSSSRSKKNFYRDETSSQESKNLSTPGTRVQARGRILPGSPVKRTWHRHLKDKLTHKEHNHPSFYRERTPRGPSERTRHNPSWRNHRSPSERSQRSSLERRHHSPSQRSHCSPSRKNHSSPSERSWRSPSQRNHCSPPERSCHSLSERGLHSPSQRSHRGPSQRRHHSPSERSHRSPSERSHRSSSERRHRSPSQRSHRGPSERSHCSPSERRHRSPSQRSHRGPSERRHHSPSKRSHRSPARRSHRSPSERSHHSPSERSHHSPSERRHHSPSERSHCSPSERSHCSPSERRHRSPSERRHHSPSEKSHHSPSERSHHSPSERRRHSPLERSRHSLLERSHRSPSERRSHRSFERSHRRISERSHSPSEKSHLSPLERSRCSPSERRGHSSSGKTCHSPSERSHRSPSGMRQGRTSERSHRSSCERTRHSPSEMRPGRPSGRNHCSPSERSRRSPLKEGLKYSFPGERPSHSLSRDFKNQTTLLGTTHKNPKAGQVWRPEATR

SEQ ID NO: 62618 - protein, 525 aa, Homo sapiens
MEGPAEWGPEAALGPEAVLRFLAERGGRALHAELVQHFRGALGGEPEQRARARAHFKELVNAVATVRVDPADGAKYVHLKKRFCEGPSEPSGDPPRIQVTAEPEAPDGPAGPEARDRLPDAAAPESLPGQGRELGEGEPPAPAHWPPLSAGARRKNSRRDVQPLPRTPAPGPSEDLELPPHGCEEADRGSSLVGATAQRPARQNLRDLVMGSSPQLKRSVCPGGSSPGSSSGGGRGRGGGDSDSASVASSSAEEESSGGGSVTLDPLEHAWMLSASDGKWDSLEGLLTCEPGLLVKRDFITGFTCLHWAAKHGRQELLAMLVNFANKHQLPVNIDARTSGGYTALHLAAMHGHVEVVKLLVGAYDADVDIRDYSGKKASQYLSRSIAEEIKNLVGALDEGDGESAAGSGGGRWRLSKVLPSHLITYKLSHALEDGGDHHHHHHSAEGWVGGKAKDPGRKASGSSSGRIKPRLNKIRFRTQIVHTTPSFRDPEQPLEGRGEEGVGEERPVKGHSPFTLRPKSNVFG

SEQ ID NO: 62619 - protein, 904 aa, Homo sapiens
MSYIKSNLELYQQYTAMAPKLLARISKLLMICQNAGISVPKGIRNIFEFTWEELISDPSVPTPSDILGLEVSFGAPLVVLMEPTFVQVPTLKKPLPPPPPAPPRPVLLATTGAAKRSTLSPTMARQVRTHQETLNRFQQQSIHLLTELLRLKMKAMVESMSVGANPLDITRRFVEASQLLHLNAKEMAFNCLISTAGRSGYSSGQLWKESLANMSAIGVNSPYQLIYHSSTACLSFSLSAGKEAKKKIGKSRTTEDVSMPPLHRGVGTPANSLEFSDPCPEAREKLQELCRHIEAERTTWKGRNISYPMILRNYKAKMPSHLMLARKGDSQTPGLHYPPTAGAQTLSPTSHPSSANHHFSQHCQEGKAPKKAFKFHYTFYDGSSFVYYPSGNVAVCQIPTCCRGRTVTCLFNDIPGFSLLAVFNTEGQGCVHYNLKTSCPYVLILDEEGGTTNDQQGYVVHKWSWTSRTETLLSLEYKVNEEMKLKVLGQDSITVTFTSLNETVTLTVSANNCPHGMAYDKRLNRRISNMDDKVYKMSRALAEIKKRFQKTVTQFINSILLAAGLFTIEYPTKKEEEEFVRFKMRSRTHPERLPKLSLYSGESLLRSQSGHLESSIAETLKDEPESAPVSPVRKTTKIHTKAKVTSRGKAREGRSPTRWAALPSDCPLVLRKLMLKEDTRAGCKCLVKAPLVSDVELERFLLAPRDPSQVLVFGIISSQNYTSTGQLQWLLNTLYNHQQRGRGSPCIQCRYDSYRLLQYDLDSPLQEDPPLMVKKNSVVQGMILMFAGGKLIFGGRVLNGYGLSKQNLLKQIFRSQQDYKMGYFLPDDYKFSVPNSVLSLEDSESVKKAESEDIQGSSSSLALEDYVEKELSLEAEKTREPEVELHPLSRDSKITSWKKQASKK

SEQ ID NO: 62620 - protein, 127 aa, Homo sapiens [sequence omitted]

SEQ ID NO: 62621 - protein, 901 aa, Homo sapiens
MVSFVIGDEHVVLPNFEPESCRFTEQSLLIMKAIGNVIANFKDKGKLSAALKDLQTAHYPVPFHDKELTAQHFRVFHLSLWRLMKKVQITKPPPNFKFAFRAMVLDLELLNSSLEEVSLVEWLDVKYCMPTSDKEYSAEEVAAAIKIQAMWRGTYVRLLMKARIPDTKENISVADTLQKVWAVLEMNLEQYAVSLLRLMFKSKCKSLESYPCYQDEETKIAFADYTVTYQEQPPNSWFIVFRETFLVHQDMILVPKVYTTLPICILHIVNNDTMEQVPKVFQKVVPYLYTKNKKGYTFVAEAFTGDTYVAASRWKLRLIGSSAPLPCLSRDSPCNSFAIKEIRDYYIPNDKKILFRYSVKVLTPQPATIQVRTSKPDAFIKLQVLENEETMVSSTGKGQAIIPAFHFLKSEKGLSSQSSKHILSFHSASKKEQEVYVKKKAAQGIQKSPKGRAVSAIQDIGLPLVEEETTSTPTREDSSSTPLQNYKYIIQCSVLYNSWPLTESQLTFVQALKDLKKSNTKAYGERHEELINLGSPDSHTISEGQKSSVTSKTTRKGKEKSSEKEKTAKEKQAPRFEPQISTVHPQQEDPNKPYWILRLVTEHNESELFEVKKDTERADEIRAMKQAWETTEPGRAIKASQARLHYLSGFIKKTSDAESPPISESQTKPKEEVETAARGVKEPNSKNSAGSESKEMTQTGSGSAVWKKWQLTKGLRDVAKSTSSESGGVSSPGKEEREQSTRKENIQTGPRTRSPTILETSPRLIRKALEFMDLSQYVRKTDTDPLLQTDELNQQQAMQKAEEIHQFRQHRTRVLSIRNIDQEERLKLKDEVLDMYKEMQDSLDEARQKIFDIREEYRNKLLEAEHLKLETLAAQEAAMKLETEKMTPAPDTQKKKKGKKK

SEQ ID NO: 62622 - protein, 390 aa, Homo sapiens
MHEHATPVTSAYGERHEELINLGSPDSHTISEGQKSSVTSKTTRKGKEKSSEKEKTAKEKQAPRFEPQISTVHPQQEDPNKPYWILRLVTEHNESELFEVKKDTERADEIRAMKQAWETTEPGRAIKASQARLHYLSGFIKKTSDAESPPISESQTKPKEEVETAARGVKEPNSKNSAGSESKEMTQTGSGSAVWKKWQLTKGLRDVAKSTSSESGGVSSPGKEEREQSTRKENIQTGPRTRSPTILETSPRLIRKALEFMDLSQYVRKTDTDPLLQTDELNQQQAMQKAEEIHQFRQHRTRVLSIRNIDQEERLKLKDEVLDMYKEMQDSLDEARQKIFDIREEYRNKLLEAEHLKLEALSAQEAAMKLETEKMTPAPDTQKKKKGKKK

SEQ ID NO: 62623 - protein, 901 aa, Homo sapiens; identical to SEQ ID NO: 62621

SEQ ID NO: 62624 - protein, 390 aa, Homo sapiens; identical to SEQ ID NO: 62622

SEQ ID NO: 62625 - protein, 232 aa, Homo sapiens
MEGMDVDLDPELMQKFSCLGTTDKDVLISEFQRLLGFQLNPAGCAFFLDMTNWNLQAAIGAYYDFESPNISVPSMSFVEDVTIGEGESIPPDTQFVKTWRIQNSDVIWVILSVEVGGLLGVTQQLSSFETEFNTQPHRKVEGNFNPFASPQKNRQSDENNLKDPGGSEFDSISKNTWAPAPDTWAPAPDQTEQDQNRLSQNSVNLSPSSHANNLSVVTYSKGLHGPYPFGQS

SEQ ID NO: 62626 - protein, 298 aa, Homo sapiens
MEGMDVDLDPELMQKFSCLGTTDKDVLISEFQRLLGFQLNPAGCAFFLDMTNWNLQAAIGAYYDFESPNISVPSMSFVEDVTIGEGESIPPDTQFVKTWRIQNSGAEAWPPGVCLKYVGGDQFGHVNMVMVRSLEPQEIADVSVQMCSPSRAGMYQGQWRMCTATGLYYGDVIWVILSVEVGGLLGVTQQLSSFETEFNTQPHRKVEGNFNPFASPQKNRQSDENNLKDPGGSEFDSISKNTWAPAPDTWAPAPDQTEQDQNRLSQNSVNLSPSSHANNLSVVTYSKGLHGPYPFGQS

SEQ ID NO: 62627 - protein, 469 aa, Homo sapiens
MAEEREPELYLKWKHCETPGVKTLCNLKHCETPGVKTLCNLKKLLNRLQKDHREDVYLYISGHLNPNKLYQPPETILQHWPNAHRPKGERASEVGEPPAGKVARMKEALAHFTIHTALVPSEAQDTPLFRYLNPQASLSHTSEEDFLPVEAVREGKEEKKGGPPGRGPPGWRRREELRLPDLKVLCYQEAGSRGTRDRHHYVSSYLAGATSADRYRMFLRFQKEVLAKQDLLKNDFTGSKAAAGHERKLQQELQKMCTCSPQQFNRLHVFEKVFEDICNSSLIFGDLLKKVKDEYELYMATLLESQPAAQYEALLAQLKALGQRPVKTADMDLAREELRMLVTATKAALEQNDRLRSELEMELALLQSAKERSESSEKHIIDENQLTLTEKVEKKRCEILSKWDEIQALEKEIKTTLVHTGISDITENRIKSIEHEAIQLETENMILKKKIKGPLEIYQGICKIRGNRR

SEQ ID NO: 62628 - protein, 167 aa, Homo sapiens [sequence omitted]

SEQ ID NO: 62629 - protein, 229 aa, Homo sapiens
MKQQQWCGMTAKMGTVLSGVFTIMAVDMYLIFEQKHLGNGSCTEITPKYRGASNIINNFIICWSFKIVLFLSFITILISCFLLYSVYAQIFRGLVIYIVWIFFYETANVVIQILTNNDFDIKEVRIMRWFGLVSRTVMHCFWMFFVINYAHITYKNRSQGNIISYKRRISTAEILHSRNKRLSISSGFSGSHLESQYFERQSFHTSIFTCLSPVPSSAPSTCRYTIDVC

SEQ ID NO: 62630 - protein, 508 aa, Homo sapiens
MGRRNENCANSLRVSNISQENLSHWNLDSEVPVSENKNLPAGRDGAAGGKINKNYLEIPVEQLMLEPNLSVHSQKSTQNSKQGIFQLWNCPLNEGSTIEKREFKKSSVETGFNVINHPIRVFTLNHPLTIASVDKQVGPYPGLPMPLGLCWPYADGDFFKNRNEIHVSSCSTIENNDGETLPAPNWNLKHGNSSVEENFTDESDLSENEKTNDTLLSYFKKVDLNLKPETIKNVEEPFTEEPNEVFPYPDFLPPPFSALDLHNLALSKSDNWKVTVDPAETSVEHLITRLLELERLQHMTIQKERPRLQTTFCTPAVTERPSSSKATPKVRQPKLCDSLSLQIPCVDKSQEKSKNNSGSCKLEQNALKRNWSNAGKYRWNSRPLSLKSSSTPKQLIETYDKNPKSSILSPCQELSFKPTIGHTNQSMVKMISTRCLPWRSPMPVSPIPLTFPENQKEEIKAPKRNFGTKKKLYRQNIVLNRPFSIQKLNCLSPSLIAKDKCCSPIEQK

SEQ ID NO: 62631 - protein, 316 aa, Homo sapiens
MLPSSIQISGEPLSGAEVRDICRGLRDNAVRLLSLRGCRLCDRDFGRICRALAGATSLAQLNLNLGVVSSPSRIKQLAEALRTNRSIQSLFLHGSPLTDAGLALLNPALALHPALVALDLGDCMLGDEAINLICGLLPPDGAKSGLKELTLSANPGITPKGWSRLAIAVAHSSQVRVLNLDYNPLGDHVAGMLAVAVASSRTLEVLDLEGTGLTNQSAQTLLDMVENYPTALRSLVLAENSISPELQQQICDLLSEGEEEEEVAGGAGDTQEWERGREPAAHQRGSSSWMCPSDPSSQMVLMTSGLGDSLLAETEM

SEQ ID NO: 62632 - protein, 622 aa, Homo sapiens
MPPTQAESVIRSIIREIGQECAAHGEIVSETLIAFMVKAVVLDPSNGFNMDRTLMKSDVQNLVKLCMTRLLDTKNPSLDTIKMQVYFDMNYTNRVEFLEEHHRVLESRLGSVTREITDNRACAKEELESLYRKIISYVLLRSGLGSPTDIKTVREVTAALQSVFPQAELGTFLTLSKKDKERQLKELTMIVTGIRLFNRDCGKGGEGIDDLPAVLHVAIPATMQHIDYQLETARSQVYRYTAILEKAANDPLMRAELQPYMLKEALYNIRQYEVFLQIILSDIITGAQEVEMMTKQLGAHLEQLKMTIKSKIAVPTSQVFPIFIALSTLWTSLQDETIVVGVLSNLFTHIQPFLGAHELYFPERVMQCHLNGATVKTDVCRMKEHMEDRVNVADFRKLEWLFPETTANFDKLLIQYRGFCAYTFAATDGLLLPGNPAIGILKYKEKYYTFNSKDAAYSFAENPEHYIDIVREKAKKNTELIQLLELHQQFETFIPYSQMRDADKHYIKPITKCESSTQTNTHILPPTIVRSYEWNEWELRRKAIKLANLRQKVTHSVQTDLSHLRRENCSQVYPPKDTSTQSMREDSTGVPRPQIYLAGLRGGKSEITDEVKVNLTRDVDET

SEQ ID NO: 62633 - protein, 505 aa, Homo sapiens
MPPTQAESVIRSIIREIGQECAAHGEIVSETLIAFMVKAVVLDPSNGFNMDRTLMKSDVQNLVKLCMTRLLDTKNPSLDTIKMQVYFDMNYTNRVEFLEEHHRVLESRLGSVTREITDNRACAKEELESLYRKIISYVLLRSGLGSPTDIKTVREVTAALQSVFPQAELGTFLTLSKKDKERQLKELTMIVTGIRLFNRDCGKGGEGIDDLPAVLHVAIPATMQHIDYQLETARSQVYRYTAILEKAANDPLMRAELQPYMLKEALYNIRQYEVFLQIILSDIITGAQEVEMMTKQLGAHLEQLKMTIKSKIAVPTSQVFPIFIALSTLWTSLQDETIVVGVLSNLFTHIQPFLGAHELYFPERVMQCHLNGATVKTDVCRMKEHMEDRVNVADFRKLEWLFPETTANFDKLLIQYRGFCAYTFAATDGLLLPGNPAIGILKYKEKYYTFNSKDAAYSFAENPEHYIDIVREKAKKNTELIQLLELHQQFETFIPYSQVSRVNIL

SEQ ID NO: 62634 - protein, 402 aa, Homo sapiens
MPPVSRSSYSEDIVGSRRRRRSSSGSPPSPQSRCSSWDGCSRSHSRGREGLRPPWSELDVGALYPFSRSGSRGRLPRFRNYAFASSWSTSYSGYRYHRHCYAEERQSAEDYEKEESHRQRRLKERERIGELGAPEVWGPSPKFPQLDSDEHTPVEDEEEVTHQKSSSSDSNSEEHRKKKTSRSRNKKKRKNKSSKRKHRKYSDSDSNSESDTNSDSDDDKKRVKAKKKKKKKKHKTKKKKNKKTKKESSDSSCKDSEEDLSEATWMEQPNVADTMDLIGPEAPIIHTSQDEKPLKYGHALLPGEGAAMAEYVKAGKRIPRRGEIGLTSEEIGSFECSGYVMSGSRHRRMEAVRLRKENQIYSADEKRALASFNQEERRKRESKILASFREMVHKKTKEKDDK

SEQ ID NO: 62635 - protein, 1857 aa, Homo sapiens
  VARIANT 1316: Xaa = Any Amino Acid
MFGLKVKKKRNKAEKGLILANKAAKDSQGDTEALQEEPSHQEGPRGDLVHDDASIFPVPSASPKRRSKLLTKIHDGEVRSQNYQIAITITEARQLVGENIDPVVTIEIGDEKKQSTVKEGTNSPFYNEYFVFDFIGPQVHLFDKIIKISVFHHKLIGSVLIGSFKVDLGTVYNQPGHQFCNKWALLTDPGDIRTGTKGYLKCDISVMGKGDVLKTSPKTSDTEEPIEKNLLIPNGFPLERPWARFYVRLYKAEGLPKMNSSIMANVTKAFVGDSKDLVDPFVEVSFAGQMGRTTVQKNCADPVWHEQVIFKEMFPPLCRRVKIQVWDEGSMNDVALATHFIDLKKISNEQDGDKGFLPTFGPAWINLYGSPRNHSLMDDYQEMNEGFGEGVSFRGRILVEIAVEILSGRAQESKFSKALKELKLPSKDKDSKSSKGKDKADKTEDGKSQQASNKTNSTEVEVESFDVPPEIVPEKNEEFLLFGAFFEATMIDRKIGDKPISFEVSIGNFGNLIDGGSHYGSKKSAESAEEDLLPLLHEGQGDVAHDVPIPMASTTHPEKPLVTEGNRNYNYLPFEAKKPCVYFISSWGDQTFRLHWSNMLEKMADFLEESIEEVRELIKISQEAPEEKMKTVLSDFISRSSAFISEAEKKPKMLNQTTLDKKRLTLCWQELEAMCKEAKGIIQQQKKKLSVDEMIHEAQNFVEKIRFLVDEPQHTIPDVFIWMLSNNRRVAYARIASKDLLYSPVAGQMGKHCGKIKTHFLKPPGKRPAGWSVQAKVDVYLWLGSIKHASAILDNLPVGYEAEMSSKGAGTNHPPSNLLYQEQHVFQLRAHMYQARGLIAADSNGLSDPFAKVTFLSHCQTTKIISQTLSPTWNQMLLFNDLVLHGDVKELAESPPLVVVELYDSDAVGKPEYLGATVAAPVVKLADQDYEPPRLCYHPIFCGNLSGGDLLAVFELLQVPPSGLQGLPPVEPPDITQIYPVPANIRPVLSKYRVEVLFWGVREMKKVQLLSVDRPQALIECGGQGVKSCVIQSYKNNPNFSIQADAFEVELPENELLHPPLSICVVDWRAFGRSTLVGTYTINYLKQFLCKLREPLAPITQVDGTQPGHDISDSLTATESSGAHSSSQDPPADHIYVDVEPPPTVVPDSAQAQPAILVDVPDSSPMLEPEHTPVAQEPPKDGKPKDPRKPSRRSTKRRKRTIADESAENVIDWWSKYYASLKKAQKAKERNPKGKKGNTEAKPDEVVVDIEDGPKKKKDKMLKKKPKDDGIPNLAILQIYDGDLESEFNNFEDWVKTFELFRGKSTEDDHGLDGDXVIGKFKGSFCIYKSPQDSSSEDSGQLRIQQGIPPNHPVTVLIRVYIVAAFNLSPADPDGKSDPYIVIKLGKTEIKDRDKYIPKQLNPVFGRSFEIQATFPKESLLSILIYDHDMIGTDDLIGETKIDLENRFYSKHRAICGLQSQYEIEGYNAWRDTSKPTEILTKLCKDNKLDGPYFHPGKIQIGNQVFSGKTIFTEEDTDETVESYEHLALKVLHSWEDIPEVGCRLVPEHIETRPLYHKDKPGMEQGRLQMWVDMFPKDMPQPGPPVDISPRRPKGYELRVTIWNTEDVILEDENIFTGQKSSDIYVKGWLKGLEDDKQETDVHYNSLTGEGNFNWRFLFPFQYLPAEKQMVITKRENIFSLEKMECKTPAVLVLQVWDFERLSSDDFLGTLEMNLNSFPRAAKSAKACDLAKFENASEETKISIFQQKRVRGWWPFSKSKELTGKVEAEFHLVTAEEAEKNPVGKARKEPEPLAKPNRPDTSFSWFMSPFKCLYYLIWKNYKKYIIIAFILIILIIFLVLFIYTLPGAISRRIVVGS

SEQ ID NO: 62636 - protein, 294 aa, Homo sapiens
MNFILFIFIPGVFSLKSSTLKPTIEALPNVLPLNEDVNKQEEKNEDHTPNYAPANEKNGNYYKDIKQYVFTTQNPNGTESEISVRATTDLNFALKNDKTVNATTYEKSTIEEETTTSEPSHKNIQRSTPNVPAFWTMLAKAINGTAVVMDDKDQLFHPIPESDVNATQGENQPDLEDLKIKIMLGISLMTLLLFVVLLAFCSATLYKLRHLSYKSCESQYSVNPELATMSYFHPSEGVSDTSFSKSAESSTFLGTTSSDMRRSGTRTSESKIMTDIISIGSNNEMHENDESVTR

SEQ ID NO: 62637 - protein, 340 aa, Homo sapiens
MEAHEIIEEPHITMDAEKHPPSKDPSAEDLQENHISESFLKPSTSETPLEPHTSESPLVPSPSQIPLEAHSPETHQEPSISETPSETPTYEASLDSPISVVPEKHLTLPPQSRDYVCLSSSDTLKEDLSSESSSNEVPWTRRSTHLSESESLPEHCLSGPSSQVQVDTTEKQEEEAGEVEKGVDASDSTAHTAQPGHQLGNTARPVFPARQTELVEVAKAMHREEFGAQVNNLFQWEKDAALNAIQTDRIRNSSSGILAPAHLHCDCLYLALSTKPPWCKGALALQAISIKTEEAKPKATSRQALDPDRLWVSTLAGAAPITYGTVSGLGMSPDAFVDTC

SEQ ID NO: 62638 - protein, 474 aa, Homo sapiens
MKTKCICELCSCGRHHCPHLPTKIYDETEKPCLLSEYTENYPFYHSYLPRESFKPRREYQKGSIPMEGLTTSRRDFGPHKVAPVKVHQYDQFVPSEENMDLLTTYKKDYNPYPVCRVDPIKPRDSKYPCSDKMECLPTYKADYLPWNQPRREPLRLEHKYQPASVRFDNRTTHQDDYPIKGLVKTISCKPLAMPKLCNIPLEDVTNYKMSYVAHPVEKRFVHEAEKFRPCEIPFESLTTQKQSYRGLMGEPAKSLKPLARPPGLDMPFCNTTEFRDKYQAWPMPRMFSKAPITYVPPEDRMDLLTTVQAHYTCPKGAPAQSCRPALQIKKCGRFEGSSTTKDDYKQWSSMRTEPVKPVPQLDLPTEPLDCLTTTRAHYVPHLPINTKSCKPHWSGPRGNVPVESQTTYTISFTPKEMGRCLASYPEPPGYTFEEVDALGHRIYKPVSQAGSQQSSHLSVDDSENPNQRELEVLA

SEQ ID NO: 62639 - protein, 409 aa, Homo sapiens
MQRRRRPPPPTSRLPEGCGGGGGGSEEVEVQFSAGRWGSAAAVSAAAAAATRSTEEEEERLEREHFWKIINAFRYYGTSMHERVNRTERQFRSLPANQQKLLPQFLLHLDKIRKCIDHNQEILLTIVNDCIHMFENKEYGEDGNGKIMPASTFDMDKLKSTLKQFVRDWSETGKAERDACYQPIIKEILKNFPKERWDPSKVNILVPGAGLGRLAWEIAMLGYACQGNEWSFFMLFSSNFVLNRCSEINKYKLYPWIHQFSNNRRSADQIRPIFFPDVDPHSLPPGSNFSMTAGDFQEIYSECNTWDCIATCFFIDTAHNVIDYIDTIWKILKPGGIWINLGPLLYHFENLANELSIELSYEDIKNVVLQYGFKVEVEKESVLSTYTVNDLSMMKYYYECVLFVVRKPQ

SEQ ID NO: 62640 - protein, 431 aa, Homo sapiens
MFWRRLRPGAQDLAPKGLPGDGDFRRSSDPRLPKLTPPALRAALGARGSGDWRIPGGGAAWWPEGDAKPGVGVGRLPPRLPALLTATRRAVRKRGLLRSLLPPPLLSAGASRESAPRQPGPGERERPRRRVAREDPDFLGAFLGELLPSRFREFLHQLQEKCTEEPEPLTSPAPQHQRGVLEHCPGSPRCPNCSFLPDLWGQSSHLQDSLTKISLQQTPILGPLKGDHSQFTTVRKANHRPHGAQVPRLKAALTHNPSGEGSRPCRQRCPFRVRFADETLQDTTLRYWERRRSVQQSVIVNQKAALPVASERVFGSVGKRLESLPKALYPGAKEETLASSSCWDCAGLSTQKTQGYLSEDTSMNSSLPFCSWKKAAAQRPRSSLRAFLDPHRNLEQESLLPNRVLQSVLKQGCPKGYHLLLASATLQPDKR

SEQ ID NO: 62641 - protein, 218 aa, Homo sapiens [sequence omitted]

SEQ ID NO: 62642 - protein, 218 aa, Homo sapiens [sequence omitted]

SEQ ID NO: 62643 - protein, 1445 aa, Homo sapiens
MGNLVIPLGKGRAGRVESGQRIPPPAPRPSVECTGDDIALQMEKMLFPLKSPSATWLSPSSTPWMMDFILTSVCGLVLLFLLLLYVHSDPPSPPPGRKRSSREPQRERSGRSRSRKISALKACRILLRELEETRDLNYLLESHLRKLAGEGSSHLPLGGDPLGDVCKPVPAKAHQPHGKCMQDPSPASLSPPAPPAPLASTLSPGPMTFSEPFGPHSTLSASGPPEPLLPLKCPATQPHVVFPPSPQPHGPLASSPPPPDSSLAGLQCGSTTCPVPQSSPLHNQVLPPPTRVISGLGCSSDPIWDLYCWREAATTWGLSTYSHGKSQPRHLPDHPSEASFWGDPTPKHMEVGGCTFIHPDVQKLLETLIAKRALMKMWQEKERKRADHPHMTSLGKEWDITTLNPFWNVSTQPQQLPRPQQVSDATTVGNHLQQKRSQLFWDLPSLNSESLATTVWVSRNPSSQNAHSVPLDKASTSLPGEPEVEASSQLSQAPPQPHHMAQPQHFTPAWPQSQPPPLAEIQTQAHLSPPVPSLGCSSPPQIRGCGASYPTSQERTQSVIPTGKEYLEWPLKKRPKWKRVLPSLLKKSQAVLSQPTAHLPQERPASWSPKSAPILPGVVTSPELPEHWWQGRNAIHQEQSCGPPSRLQASGDLLQPDGEFPGRPQSQAEDTQQALLPSQPSEFAGKGRKDVQKTGFRSSGRFSDKGCLGSKLGPDPSRDQGSGRTSVKALDEDKEAEGDLRRSWKYQSVSSTPRDPDKEHLENKLQIHLARKVGEIKEGWIPMPVRRSWLMAKCAVPKSDTHRKPEKLASWRGGKAHVNTSQELSFLHPCTQQILEVHLVRFCVRHSWGTDLQSLEPINVWSGEAQAPPFPQSTFTPWASWVSRVESVPKVPIFLGKRPQSGPGDNRTTSKSVPTVSGPLAAPPPEQEGVQRPPRGSQSADTHGRSEAFPTGHKGRGCSQPPTCSLVGRTWQSRTVLESGKPKPRLEGSMGSEMAGNEAWLESESMSPGDPCSSRALQELSIGSQWARAEDALQALKVGEKPPTWEVTLGASVRASSGSVQEDLRSTGALGTTGNPSASSVCVAQDPEQLHLKAQVVSEIALIVQVDSEEQLPGRAPGILLQDGATGLCLPGRHMDMLTAADRLPTQAPLSTSQSVSGKNMTASQGPCALLWKGGDSPGQQEPGSPKAKAPQKSQKTLGCAGKGEAHRRPRTGEQGHRSKGPRTSEASGRSHPAQAREIGDKQERKYNQLQLEKGQTPPESHFQRKISHHPQGLHPRKGGTRWEDVLQKGKPGADAFQSWGSGPPRQFMDCMADKAWTISRVVGQILVDKLGLQWGRGPSEVNRHKGDFHAQENVPSCCHRGHCHQERSREMRALACSPKATPKGHHCPVKNRGIRDRDSSWAPPPREPVSPAGPHHHRPRMASTSGGPHPQLQELMSAQRCLAS

SEQ ID NO: 62644 - protein, 1508 aa, Homo sapiens
MFSALKYHAIDYLYENVVRKKFYRDALLLRIPSCLYQDESYHVAVTDNKFRRPWTRVSAVSVPGMTDTSVLDQWKASFFVEDFLEKKTITRMVTQINCEFEEVVPSSNPDSQIEVEEVSLYTHMDYNEVFTPVSCLEKCSALQNQNQDLFIDDKGILFVSSRKHLPTLPTLLSRLKLFLVKDPLLDFKGQIFTEANFSRECFSLQETLEAFVKEDFCMDKVNFCQEKLEDTICLNEPSSFLIEYEFLIPPSLKPEIDIPSLSELKELLNPVPEIINYVDEKEKLFERDLTNKHGIEDIGDIKFSSTEILTIQSQSEPEECSKPGELEMPLTPLFLTCQHSSVNSLRTELQTFPLSPVCKINLLTAEESANEYYMMWQLERCRSPLNPFLLTVPRIQEPHSQYSVTDLKKIFSVKEESLVINLEKAEWWKQAGLNLKMMETLEHLNTYLCHDNLSSNDTKIEIFLPTKVLQLESCLEHKSRSSPIALIDEKSTNAHLSLPQKSPSLAKEVPDLCFSDDYFSDKGAAKEEKPKNDQEPVNRIIQKKENNDHFELDCTGPSIKSPSSSIIKKASFEHGKKQENDLDLLSDFIMLRNKYKTCTSKTEVTNSDEKHDKEACSLTLQEESPIVHINKTLEEINQERGTDSVIEIQASDSQCQAFCLLEAAASPILKNLVSLCTLPTANWKFATVIFDQTRFLLKEQEKVVSDAVRQGTIDEREMTFKHAALLHLLVTIRDVLLTCSLDTALGYLSKAKDIYNSILGPYLGDIWRQLEIVQFIRGKKPETNYKIQELQCQILSWMQSQQQIKVLIIIRMDSDGEKHFLIKILNKIEGLTLTVLHSNERKDFLESEGVLRGTSSCVVVHNQYIGADFPWSNFSFVVEYNYVEDSCWTKHCKELNIPYMAFKVILPDTVLERSTLLDRFGGFLLEIQIPYVFFASEGLLNTPDILQLLESNYNISLVERGCSESLKLFGSSECYVVVTIDEHTAIILQDLEELNCEKASDNIIMRLMALSLQYRYCWIILYTKETLNSEYPLTEKTLHHLALIYAALVSFGLNSEELDVKLIIAPGVEATALIIRQIADHSLMTSKRDPHEWLDKSWLKVSPSEEEMYLLDFPCINPLVAQLMLNKGPSLHWILLATLCQLQELLPEVPEKVLKHFCSITSLFKIGSSSITKSPQISSPQENRNQISTLSSQSSASDLDSVIQEHNEYYQYLGLGETVQEDKTTTLNDNSSIMELKGISSFLPPVTSYNQTSYWKDSSCKSNIGQNTPFLINIESRRPAYNSFLNHSDSESDVFSLGLTQMNCETIKSPTDTQKRVSVVPRFINSQKRRTHEAKGFINKDVSDPIFSLEGTQSPLHWNFKKNIWEQENHPFNLQYGAQQTACNKLYSQKGNLFTDQQKCLSDESEGLTCESSKDETFWRELPSVPSLDLFRASDSNANQKEFNSLYFYQRAGKSLGQKRHHESSFNSGDKESLTGFMCSQLPQFKKRRLAYEKVPGRVDGQTRLRFF

SEQ ID NO: 62645 - protein, 702 aa, Homo sapiens
MVAHINNSRLKAKGVGQHDNAQNFGNQSFEELRAACLRKGELFEDPLFPAEPSSLGFKDLGPNSKNVQNISWQRPKDIINNPLFIMDGISPTDICQGILGDCWLLAAIGSLTTCPKLLYRVVPRGQSFKKNYAGIFHFQIWQFGQWVNVVVDDRLPTKNDKLVFVHSTERSEFWSALLEKAYAKLSGSYEALSGGSTMEGLEDFTGGVAQSFQLQRPPQNLLRLLRKAVERSSLMGCSIEVTSDSELESMTDKMLVRGHAYSVTGLQDVHYRGKMETLIRVRNPWGRIEWNGAWSDSAREWEEVASDIQMQLLHKTEDGEFWMSYQDFLNNFTLLEICNLTPDTLSGDYKSYWHTTFYEGSWRRGSSAGGCRNHPGTFWTNPQFKISLPEGDDPEDDAEGNVVVCTCLVALMQKNWRHARQQGAQLQTIGFVLYAVPKEFQNIQDVHLKKEFFTKYQDHGFSEIFTNSREVSSQLRLPPGEYIIIPSTFEPHRDADFLLRVFTEKHSESWELDEVNYAEQLQEEKVSEDDMDQDFLHLFKIVAGEGKEIGVYELQRLLNRMAIKFKSFKTKGFGLDACRCMINLMDKDGSGKLGLLEFKILWKKLKKWMDIFRECDQDHSGTLNSYEMRLVIEKAGIKLNNKVMQVLVARYADDDLIIDFDSFISCFLRLKTMFTFFLTMDPKNTGHICLSLEQWLQMTMWG

SEQ ID NO: 62646 - protein, 299 aa, Homo sapiens
MTLSVLSRKDKERVIRRLLLQAPPGEFVNAFDDLCLLIRDEKLMHHQGECAGHQHCQKYSVPLCIDGNPVLLSHHNVMGDYRFFDHQSKLSFKYDLLQNQLKDIQSHGIIQNEAEYLRVVLLCALKLYVNDHYPKGNCNMLRKTVKSKEYLIACIEDHNYETGECWNGLWKSKWIFQVNPFLTQVTGRIFVQAHFFRCVNLHIEISKDLKESLEIVNQAQLALSFARLVEEQENKFQAAVLEELQELSNEALRKILRRDLPVTRTLIDWHRILSDLNLVMYPKLGYVIYSRSVLCNWII

SEQ ID NO: 62647 - protein, 906 aa, Homo sapiens
MAGNVKKSSGAGGGSGSGGSGSGGLIGLMKDAFQPHHHHHHHLSPHPPGTVDKKMVEKCWKLMDKVVRLCQNPKLALKNSPPYILDLLPDTYQHLRTILSRYEGKMETLGENEYFRVFMENLMKKTKQTISLFKEGKERMYEENSQPRRNLTKLSLIFSHMLAELKGIFPSGLFQGDTFRITKADAAEFWRKAFGEKTIVPWKSFRQALHEVHPISSGLEAMALKSTIDLTCNDYISVFEFDIFTRLFQPWSSLLRNWNSLAVTHPGYMAFLTYDEVKARLQKFIHKPGSYIFRLSCTRLGQWAIGYVTADGNILQTIPHNKPLFQALIDGFREGFYLFPDGRNQNPDLTGLCEPTPQDHIKVTQEQYELYCEMGSTFQLCKICAENDKDVKIEPCGHLMCTSCLTSWQESEGQGCPFCRCEIKGTEPIVVDPFDPRGSGSLLRQGAEGAPSPNYDDDDDERADDTLFMMKELAGAKVERPPSPFSMAPQASLPPVPPRLDLLPQRVCVPSSASALGTASKAASGSLHKDKPLPVPPTLRDLPPPPPPDRPYSVGAESRPQRRPLPCTPGDCPSRDKLPPVPSSRLGDSWLPRPIPKVPVSAPSSSDPWTGRELTNRHSLPFSLPSQMEPRPDVPRLGSTFSLDTSMSMNSSPLVGPECDHPKIKPSSSANAIYSLAARPLPVPKLPPGEQCEGEEDTEYMTPSSRPLRPLDTSQSSRACDCDQQIDSCTYEAMYNIQSQAPSITESSTFGEGNLAAAHANTGPEESENEDDGYDVPKPPVPAVLARRTLSDISNASSSFGWLSLDGDPTTNVTEGSQVPERPPKPFPRRINSERKAGSCQQGSGPAASAATASPQLSSEIENLMSQGYSYQDIQKALVIAQNNIEMAKNILREFVSISSPAHVAT

SEQ ID NO: 62648 - protein, 656 aa, Homo sapiens
MFEAIFPSTPQARLKRDPREKPGLSSFRSTFRQQSSLGLCIPCLMLPKEASPSERHSSMSSSMARALVLLQSMASRDARCPEWKPHQKPRTLSKSVQTISRYYRKTSEPKDAASLTGFMSKMELRRVFPTHPDCPQFSTRATSMSHCGSPTEADLSGEIDNSSETWRGTQDLFLARRGSDTNVDGYLLPFSKSICEFDYLRKRRKSQTLSPVTSSSVASQSCLRKRMPWYLSVIHEKDHCLSELEIQVQKKDEEILLLQEEREALKTQLKCLLKGKGQETSMSPGRREQLSDASLKLGRLSLLKAFSRHEEELQHWWQMQEESAAPERGKEPDLGGGEEDEGLEGEPDGVEDTGAWGGVSQMGSVHEEGSEEEEEEEGDKDEDSEERELPEEEEIPRRRASSLAESFEEELLAQLEEYEQVILDFQFNLEATRTRYSLATGVIASLQQQVDFQETQLRKINTENETLQKELRERRQQLQAMTDKFSNLREDKKHQEMMGLIEKDNQLLRQQVSELERKLTKRDCVISELDTKVSQLQEQVELDQNHLQRWKQLQEDLQSKKEMIQQAEQHTRVALESSQSRLERLRNKIIQATFSISGTKSLANEISDNDILEALQRIISERSDYYNQLKQKGVKVPPLQQSEAFLTSKSKKGTSK

SEQ ID NO: 62649 - protein, 341 aa, Homo sapiens
MGEPGPPSPPAPKAAPGLIDSFSEMNNYRRAMQKMAEDILSLRRQASILEGENRILRSRLAQQEEEEGQGKASEAQNTVSMKQKLLLSELDMKKLRDRVQHLQNELIRKNDREKELLLLYQAQQPQAALLKQYQGKLQKMKALEETVRHQEKVIEKMERVLEDRLQDRSKPPPLNRQQGKPYTGFPMLSASGLPLGSMGENLPVELYSVLLAENAKLRTELDKNRHQQAHHSAATGPAGGPRGVGSRRRLDREATRDAWPRPLRVHRDPARTGSPLWYFRQVQPPGQAGTRSEPDPVPGKPVRGLSSTLGTREAGSGHTAAGARKRFQAPLELHHHRTACE

SEQ ID NO: 62650 - protein, 563 aa, Homo sapiens
MSSNLLPTLNSGGKVKDGSTKEDRPYKIFFRDLFLVKENEMAAKETEKFMNRNMKVYQKTTFSSRMKSHSYLSQLAFYPKRSGRSFEKFGPGPAPIPRLIEGSDTKRTVHEFINDQRDRFLLEYALSTKRNTIKKFEKDIAMRERQLKKAEKKLQDDALAFEEFLRENDQRSVDALKMAAQETINKLQMTAELKKASMEVQAVKSEIAKTEFLLREYMKYGFFLLQMSPKHWQIQQALKRAQASKSKANIILPKILAKLSLHSSNKEGILEESGRTAVLSEDASQGRDSQGKPSRSLTRTPEKKKSNLAESFGSEDSLEFLLDDEMDVDLEPALYFKEPEELLQVLRELEEQNLTLFQYSQDVDENLEEVNKREKVIQDKTNSNIEFLLEQEKMLKANCVREEEKAAELQLKSKLFSFGEFNSDAQEILIDSLSKKITQVYKVCIGDAEDDGLNPIQKLVKVESRLVELCDLIESIPKENVEAIERMKQKEWRQKFRDEKMKEKQRHQQERLKAALEKAVAQPKKKLGRQLVFHSKPPSGNKQQLPLVNETKTKSQEEEYFFT

SEQ ID NO: 62651 - protein, 588 aa, Homo sapiens
MKLEFTEKNYNSFVLQNLNRQRKRKEYWDMALSVDNHVFFAHRNVLAAVSPLVRSLISSNDMKTADELFITIDTSYLSPVTVDQLLDYFYSGKVVISEQNVEELLRGAQYFNTPRLRVHCNDFLIKSICRANCLRYLFLAELFELKEVSDVAYSGIRDNFHYWASPEGSMHFMRCPPVIFGRLLRDENLHVLNEDQALSALINWVYFRKEDREKYFKKFFNYINLNAVSNKTLVFASNKLVGMENTSSHTTLIESVLMDRKQERPCSLLVYQRKGALLDSVVILGGQKAHGQFNDGVFAYIIQENLWMKLSDMPYRAAALSATSAGRYIYISGGTTEQISGLKTAWRYDMDDNSWTKLPDLPIGLVFHTMVTCGGTVYSVGGSIAPRRYVSNIYRYDERKEVWCLAGKMSIPMDGTAVITKGDRHLYIVTGRWLVKGYISRVGVVDCFDTSTGDVVQCITFPIEFNHRPLLSFQQDNILCVHSHRQSVEINLQKVKASKTTTSVPVLPNSCPLDVSHAICSIGDSKVFVCGGVTTASDVQTKDYTINPNAFLLDQKTGKWKTLAPPPEALDCPACCLAKLPCKILQRI

SEQ ID NO: 62652 - protein, 623 aa, Homo sapiens
MAAESGELIGACEFMKDRLYFATLRNRPKSTVNTHYFSIDEELVYENFYADFGPLNLAMVYRYCCKLNKKLKSYSLSRKKIVHYTCFDQRKRANAAFLIGAYAVIYLKKTPEEAYRALLSGSNPPYLPFRDASFGNCTYNLTILDCLQGIRKGLQHGFFDFETFDVDEYEHYERVENGDFNWIVPGKFLAFSGPHPKSKIENGYPLHAPEAYFPYFKKHNVTAVVRLNKKIYEAKRFTDAGFEHYDLFFIDGSTPSDNIVRRFLNICENTEGAIAVHCKAGLGRTGTLIACYVMKHYRFTHAEIIAWIRICRPGSIIGPQQHFLEEKQASLWVQGDIFRSKLKNRPSSEGSINKILSGLDDMSIGGNLSKTQNMERFGEDNLEDDDVEMKNGITQGDKLRALKSQRQPRTSPSCAFRSDDTKGHPRAVSQPFRLSSSLQGSAVTLKTSKMALSPSATAKRINRTSLSSGATVRSFSINSRLASSLGNLNAATDDPENKKTSSSSKAGFTASPFTNLLNGSSQPTTRNYPELNNNQYNRSSNSNGGNLNSPPGPHSAKTEEHTTILRPSYTGLSSSSARFLSRSIPVSAQTPPPGPQNPECNFCALPSQPRLPPKKFNSAKEAF

SEQ ID NO: 62653 - protein, 188 aa, Homo sapiens
MFSCCFPTSRGCCFRNGGSESLFRRCRRRLIPHPRRLSPVVIRRIQVPQDSLGQALAGQATPEIPLGLQLHTVLVQEIQELIEAQTLAPGPCAEVRALPAPAAEPEPAWEEAPPERALELEGAPAKDQTNEELPEITEVPESIKRRLGRRVPAATPAPRGNLLLQAWMRVHSWASRLFAPNVLPGTGP

SEQ ID NO: 62654 - protein, 273 aa, Homo sapiens
MSRVVSLLLGAALLCGHGAFCRRVVSGQKVCFADFKHPCYKMAYFHELSSRVSFQEARLACESEGGVLLSLENEAEQKLIESMLQNLTKPGTGISDGDFWIGLWRNGDGQTSGACPDLYQWSDGSNSQYRNWYTDEPSCGSEKCVVMYHQPTANPGLGGPYLYQWNDDRCNMKHNYICKYEPEINPTAPVEKPYLTNQPGDTHQNVVVTEAGIIPNLIYVVIPTIPLLLLILVAFGTCCFQMLHKSKGRTKTSPNQSTLWISKSTRKESGMEV

SEQ ID NO: 62655 - protein, 193 aa, Homo sapiens
MPTTSRPALDVKGGTSPAKEDANQEMSSVAYSNLAVKDRKAVAILHYPGVASNGTKASGAPTSSSGSPIGSPTTTPPTKPPSFNLHPAPHLLASMQLQKLNSQYQGMAAATPGQPGEAGPLQNWDFGAQAGGAESLSPSAGAQSPAIIDSDPVDEEVLMSLVVELGLDRANELPELWLGQNEFDFTADFPSSC

SEQ ID NO: 62656 - protein, 207 aa, Homo sapiens
MVATCLQVVGFVTSFVGWIGVIVTTSTNDWVVTCGYTIPTCRKLDELGSKGLWADCVMATGLYHCKPLVDILILPGYVQACRALMIAASVLGLPAILLLLTVLPCIRMGQEPGVAKYRRAQLAGVLLILLALCALVATIWFPVCAHRETTIVSFGYSLYAGWIGAVLCLVGGCVILCCAGDAQAFGENRFYYTAGSSSPTHAKSAHV

SEQ ID NO: 62657 - protein, 179 aa, Homo sapiens
MAIKERVEGRAKVPYKFRDSLKRFSFSPTGMLKILRLSLILGALACFIITQANESFITITSLEICIVVFFILIYVLTLHHLLTYLHWPLLDLTNSIITAVFLSVVAILAMQEKKRRHLLYVGGSLCLTAVIVCCIDAFVVTTKMRTNLKRFLGVEVERKLSPAKDAYPETGPDAPQRPA

SEQ ID NO: 62658 - protein, 124 aa, Homo sapiens
MAIKERVEGRAKVPYKFRDSLKRFSFSPTGMLKILRLSLILGALACFIITQANESFITITSLEICIVVFFILIYVLTLHHLLTYLHWPLLDLTNSIITAVFLSVVAILAMQEKKRRHLLYVGGR

SEQ ID NO: 62659 - protein, 169 aa, Homo sapiens
MDPEHAKPESSEAPSGNLKQPETAAALSLILGALACFIITQANESFITITSLEICIVVFFILIYVLTLHHLLTYLHWPLLDLTNSIITAVFLSVVAILAMQEKKRRHLLYVGGSLCLTAVIVCCIDAFVVTTKMRTNLKRFLGVEVERKLSPAKDAYPETGPDAPQRPA

SEQ ID NO: 62660 - protein, 114 aa, Homo sapiens
MDPEHAKPESSEAPSGNLKQPETAAALSLILGALACFIITQANESFITITSLEICIVVFFILIYVLTLHHLLTYLHWPLLDLTNSIITAVFLSVVAILAMQEKKRRHLLYVGGR

SEQ ID NO: 62661 - protein, 122 aa, Homo sapiens
MDPEHAKPESSEAPSGNLKQPETAAALASSGSVDLTNSIITAVFLSVVAILAMQEKKRRHLLYVGGSLCLTAVIVCCIDAFVVTTKMRTNLKRFLGVEVERKLSPAKDAYPETGPDAPQRPA

SEQ ID NO: 62662 - protein, 116 aa, Homo sapiens
MDPEHAKPESSEAPSGNLKQPETAAALDLTNSIITAVFLSVVAILAMQEKKRRHLLYVGGSLCLTAVIVCCIDAFVVTTKMRTNLKRFLGVEVERKLSPAKDAYPETGPDAPQRPA

SEQ ID NO: 62663 - protein, 61 aa, Homo sapiens
MDPEHAKPESSEAPSGNLKQPETAAALDLTNSIITAVFLSVVAILAMQEKKRRHLLYVGGR

SEQ ID NO: 62664 - protein, 92 aa, Homo sapiens
MDPEHAKPESSEAPSGNLKQPETAAALASSGSVVSSVPKAQRNISAKTAPRKHPAVSIRSAQSAAAARPQGSEGTAPSRILPTVSLQLCSFQ

SEQ ID NO: 62665 - protein, 92 aa, Homo sapiens; identical to SEQ ID NO: 62664

SEQ ID NO: 62666 - protein, 91 aa, Homo sapiens
MDPEHAKPESSEAPSGNLKQPETAAALSLILGALACFIITQANESFITITSLEICIVVFFILIYVLTLHHLLTYLHWPLLNAEYRKQTKQI

SEQ ID NO: 62667 - protein, 91 aa, Homo sapiens; identical to SEQ ID NO: 62666

SEQ ID NO: 62668 - protein, 38 aa, Homo sapiens
MDPEHAKPESSEAPSGNLKQPETAAALEADKANMSNFN

SEQ ID NO: 62669 - protein, 45 aa, Homo sapiens
MDPEHAKLTLHHLLTYLHWPLLAAELSLSHRMPSTGSRQSKYEQL

SEQ ID NO: 62670 - protein, 38 aa, Homo sapiens; identical to SEQ ID NO: 62668

SEQ ID NO: 62671 - protein, 540 aa, Homo sapiens
MGPGERAGGGGDAGKGNAAGGGGGGRSATTAGSRAVSALCLLLSVGSAAACLLLGVQAAALQGRVAALEEERELLRRAGPPGALDAWAEPHLERLLREKLDGLAKIRTAREAPSECVCPPGPPGRRGKPGRRGDPGPPGQSGRDGYPGPLGLDGKPGLPGPKGEKGAPGDFGPRGDQGQDGAAGPPGPPGPPGARGPPGDTGKDGPRGAQGPAGPKGEPGQDGEMGPKGPPGPKGEPGVPGKKGDDGTPSQPGPPGPKGEPGSMGPRGENGVDGAPGPKGEPGHRGTDGAAGPRGAPGLKGEQGDTVVIDYDGRILDALKGPPGPQGPPGPPGIPGAKGELGLPGAPGIDGEKGPKGQKGDPGEPGPAGLKGEAGEMGLSGLPGADGLKGEKGESASDSLQESLAQLIVEPGPPGPPGPPGPMGLQGIQGPKGLDGAKGEKGASGERGPSGLPGPVGPPGLIGLPGTKGEKGRPGEPGLDGFPGPRGEKGDRSERGEKGERGVPGRKGVKGQKGEPGPPGLDQPCPVGPDGLPVPGCWHK

SEQ ID NO: 62672 - protein, 684 aa, Homo sapiens
MAGPRACAPLLLLLLLGELLAAAGAQRVGLPGPPGPPGPPGKPGQDGIDGEAGPPGLPGPPGPKGAPGKPGKPGEAGLPGLPGVDGLTGRDGPPGPKGAPGERGSLGPPGPPGLGGKGLPGPPGEAGVSGPPGGIGLRGPPGPPGLPGLPGPPGPPGPPGHPGVLPEGATDLQCPSICPPGPPGPPGMPGFKGPTGYKGEQGEVGKDGEKGDPGPPGPAGLPGSVGLQGPRGLRGLPGPLGPPGDRGPIGFRGPPGIPGAPGKAGDRGERGPEGFRGPKGDLGRPGPKGTPGVAGPSGEPGMPGKDGQNGVPGLDGQKGEAGRNGAPGEKGPNGLPGLPGRAGSKGEKGERGRAGELGEAGPSGEPGVPGDAGMPGERGEAGHRGSAGALGPQGPPGAPGVRGFQGQKGSMGDPGLPGPQGLRGDVGDRGPGGAAGPKGDQGIAGSDGLPGDKGELGPSGLVGPKGESGSRGELGPKGTQGPNGTSGVQGVPGPPGPLGLQGVPGVPGITGKPGVPGKEASEQRIRELCGGMISEQIAQLAAHLRKPLAPGSIGRPGPAGPPGPPGPPGSIGHPGARGPPGYRGPTGELGDPGPRGNQGDRGDKGAAGAGLDGPEGDQGPQGPQGVPGTSKDGQDGAPGEPGPPGDPGLPGAIGAQGTPGICDTSACQGAVLGGVGEKSGSRSS

SEQ ID NO: 62673 - protein, 80 aa, Homo sapiens
MFPLARNALSSLKIQSILQSMARHSHVKHSPDFHDKYGNAVLASGTAFCVATWVFTATQIGIEWNLSPVGRVTPKEWKHQ

SEQ ID NO: 62674 - protein, 698 aa, Homo sapiens
MQDDLLMDKSKTQPQPQQQQRQQQQPQPESSVSEAPSTPLSSETPKPEENSAVPALSPAAAPPAPNGPDKMQMESPLLPGLSFHQPPQQPPPPQEPAAPGASLSPSFGSTWSTGTTNAVEDSFFQGITPVNGTMLFQNFPHHVNPVFGGTFSPQIGLAQTQHHQQPPPPAPAPQPAQPAQPPQAQPPQQRRSPASPSQAPYAQRSAAAAYGHQPIMTSKPSSSSAVAAAAAAAAASSASSSWNTHQSVNAAWSAPSNPWGGLQAGRDPRRAVGVGVGVGVGVPSPLNPISPLKKPFSSNVIAPPKFPRAAPLTSKSWMEDNAFRTDNGNNLLPFQDRSRPYDTFNLHSLENSLMDMIRTDHEPLKGKHYPPSGPPMSFADIMWRNHFAGRMGINFHHPGTDNIMALNNAFLDDSHGDQALSSGLSSPTRCQNGERVERYSRKVFVGGLPPDIDEDEITASFRRFGPLVVDWPHKAESKSYFPPKGYAFLLFQEESSVQALIDACLEEDGKLYLCVSSPTIKDKPVQIRPWNLSDSDFVMDGSQPLDPRKTIFVGGVPRPLRAVELAMIMDRLYGGVCYAGIDTDPELKYPKGAGRVAFSNQQSYIAAISARFVQLQHNDIDKRVEVKPYVLDDQMCDECQGTRCGGKFAPFFCANVTCLQYYCEYCWASIHSRAGREFHKPLVKEGGDRPRHVPFRWS

SEQ ID NO: 62675 - protein, 300 aa, Homo sapiens
MSKCARKKYIKTNPRQMTMETVESQHDGSITASLTESKSAHVQTQTGQNSIPALAQVAAIAETDESAESEGVIDSHKRREILSRRPSYRKILNELSSDVPGVPKIEEERSEEEGTPPSIATMAVPTSIYQTSTGQYIAIAQGGTIQISNPGSDGVQGLQALTMTNSGAPPPGATIVQYAAQSADGTQQFFVPGSQVVVQAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 62676 - protein, 109 aa, Homo sapiens
MAVTGDDTAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 62677 - protein, 121 aa, Homo sapiens
MAVTGDDTDEETELAPSHMAAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 62678 - protein, 113 aa, Homo sapiens
MNRTQELSGQLSAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 62679 - protein, 96 aa, Homo sapiens
MPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 62680 - protein, 245 aa, Homo sapiens
MVAAIAETDESAESEGVIDSHKRREILSRRPSYRKILNELSSDVPGVPKIEEERSEEEGTPPSIATMAVPTSIYQTSTGQYIAIAQGGTIQISNPGSDGVQGLQALTMTNSGAPPPGATIVQYAAQSADGTQQFFVPGSQVVVQAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 62681 - protein, 182 aa, Homo sapiens
MVAAIAETDESAESEGVIDSHKRREILSRRPSYRKILNELSSDVPGVPKIEEERSEEEGTPPSIATMAVPTSIYQTSTGQYTATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 62682 - protein, 270 aa, Homo sapiens
MWWHQHNLCFRRPIEEDYSSGDVEEKVAAIAETDESAESEGVIDSHKRREILSRRPSYRKILNELSSDVPGVPKIEEERSEEEGTPPSIATMAVPTSIYQTSTGQYIAIAQGGTIQISNPGSDGVQGLQALTMTNSGAPPPGATIVQYAAQSADGTQQFFVPGSQVVVQAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 62683 - protein, 207 aa, Homo sapiens
MWWHQHNLCFRRPIEEDYSSGDVEEKVAAIAETDESAESEGVIDSHKRREILSRRPSYRKILNELSSDVPGVPKIEEERSEEEGTPPSIATMAVPTSIYQTSTGQYTATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 62684 - protein, 96 aa, Homo sapiens; identical to SEQ ID NO: 62679

SEQ ID NO: 62685 - protein, 221 aa, Homo sapiens
MTMETVESQHDGSITASLTESKSAHVQTQTGQNSIPALAQVAAIAETDESAESEGVIDSHKRREILSRRPSYRKILNELSSDVPGVPKIEEERSEEEGTPPSIATMAVPTSIYQTSTGQYTATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 62686 - protein, 415 aa, Homo sapiens
MDFDKKGGKGETEEGRRMSKAGGGRSSHGIRSSGTSSGVLMVGPNFRVGKKIGCGNFGELRLGKNLYTNEYVAIKLEPIKSRAPQLHLEYRFYKQLSATEGVPQVYYFGPCGNYNAMVLELLGPSLEDLFDLCDRTFTLKTVLMIAIQLITRMEYVHTKSLIYRDVKPENFLVGRPGTKRQHAIHIIDFGLAKEYIDPETKKHIPYREHKSLTGTARYMSINTHLGKEQSRRDDLEALGHMFMYFLRGSLPWQGLKADTLKERYQKIGDTKRATPIEVLCENFPEEMATYLRYVRRLDFFEKPDYDYLRKLFTDLFDRSGFVFDYEYDWAGKPLPTPIGTVHTDLPSQPQLRDKTQPHSKNQALNSTNGELNADDPTAGHSNAPITAPAEVEVADETKCCCFFKRRKRKSLQRHK

SEQ ID NO: 62687 - protein, 142 aa, Homo sapiens
MPRCRWLSLILLTIPLALVARKDPKKNETGVLRKLKPVNASNANVKQCLWFAMQEYNKESEDKYVFLVVKTLQAQLQVTNLLEYLIDVEIARSDCRKPLSTNEICAIQENSKLKRKLSCSFLVGALPWNGEFTVMEKKCEDA

SEQ ID NO: 62688 - protein, 778 aa, Homo sapiens
MEEPRATPQLYLGLVLQLLPRVMAALPEGVRPNSNPYGFPWELVICAAVLGFVAVPFFLWRSFRSVRSRLYVGREKELAIALSGLIEEKCRLLEKFSLVQKEYEGYEVESSLEDASFEKEATEAQSLEANCEKLNRSNSELEHEILCLEKGIKEEKSKHSEQDEVMADISKKIQSLEDESKSLKSLLTEAKMTFKGFQMNEEKLEIGIQDASSENCQLQESQKQLLQEAEVWKEQVSELNKQKITFEDSKVHAEQVLNDKENHIETLTERLLKIKDQAAVLEEDITDDGNLELEMNSELKDGAYLDNPPKGALKKLIHAAKLNASLTTLEGERNQFIFSYLKLIKPRKSLESILKIFRRNKHLCSRKTHILKVRIRNFNRKLMTELYQENEMKLYRKLIVEENNRLEKEKLSKVDEMISHATEELETCRKRAKDLEEELERTILFYQGKIIYHEKKAHDNCLAAWTAERNLNDLRKENAHKRQKLAETEFKIKLLEKDPYALDVPNTAFGREHSSYGPSPLGRPSSETRAFLYLPTLLEGPLRLSPLLPGGGGRGPRGPGNPLDHQITKERGESSCDRFTDPHKAPSDTGPLSPPWEQDRRMMFPPPGQSYPDSALPPQRQDRFYSNSARRSGLAELRSFNIPSLDKMDGSMPSEMESSGNDTKDNLGNLNVADSSLPAGNEVSGPGFVPPPLAPIRGPLFPVDTRGPFMRRGPPFPPPPPGTMFGASPDYFPPRDVPGPPRAPFAMRNVCPPRGFPPYLPPRPGFCPHPHPHILKIE

SEQ ID NO: 62689 - protein, 799 aa, Homo sapiens
MSERTQEQDFVIITVDDSDDNNDCSIEMVEVSETADNSTNDIADDSTYVTADNPTDDTATQPNFPGGNDGHHRPLQMSYGSGSVTQAGVQWHDHSSLQPQPLGLKQFFHLSLPSSWDDRRTPPCPVAHGDQIVSQINHPVHLRRYSYNSEEVDFPKRGRFYTPEVQSSISPPAERQETHAWASPAVTSLESAACHELQEADLSESLSYPRIVSSSSLQQYVAQGGSFPCFGMPWNFISGGAESTNAVISFANATTAVPMAVLSRRESSLANNPGVVNYSALPENENVGPGRALSSFCFHPNLEMPERPANSSKNSTETANYPTLMGNYNGQNTASLSVFIPPYFAEKIILTEMPGTTETNVENNSQTVYYPALSGNTSAPYPASSYLPITSNFESGPQMSYGTMSYSTEMKNNCDQDDASASACLTPDFALLPLNILVKVDTNTENSVNTMNRSTLLDSDSGQDSSSSSVCIPPKYGYLGDPKRNVRVLKIHLLAVQNMAKPKQAACYLVRILFSKEILISSSVDIHLKDSQSLDPNKMAALREYLATTFPTCDLHEHGKDWQDCISGINSMIYCLCSEGKSTPKTVRKNKKRTNRVASASADRNDQRGRDGGEGCSWMFQPMNNSKMRVKRNLQPNSNAIPEGMREPSTDNPEEPGEAWSYFGRPWRNIRMPCSVLTLAKTKSCASLSARYLIQKLFTKDVLVQSNVYGNLKHGLCALDPNKISALREFLQENYPICDLSENGRDWKSCVTSINSGIRSLRHDVRRAEARSQSLPAVTPPELEQESKPGDPDATDPST

SEQ ID NO: 62690 - protein, 237 aa, Homo sapiens
MNSRRREPITLQDPEAKYPLPLIEKEKISHNTRRFRFGLPSPDHVLGLPVGNYVQLLAKIDNELVVRAYTPVSSDDDRGFVDLIIKIYFKNVHPQYPEGGKMTQYLENMKIGETIFFRGPRGRLFYHGPGNLGIRPDQTSEPKKTLADHLGMIAGGTGITPMLQLIRHITKDPSDRTRMSLIFANQTEEDILVRKELEEIARTHPDQFNLWYTLDRPPIGPWSAEGATLLSNSAQFH

SEQ ID NO: 62691 - protein, 276 aa, Homo sapiens
MNSRRREPITLQDPEAKYPLPLIEKEKISHNTRRFRFGLPSPDHVLGLPVGNYVQLLAKIDNELVVRAYTPVSSDDDRGFVDLIIKIYFKNVHPQYPEGGKMTQYLENMKIGETIFFRGPRGRLFYHGPGNLGIRPDQTSEPKKTLADHLGMIAGGTGITPMLQLIRHITKDPSDRTRMSLIFANQTEEDILVRKELEEIARTHPDQFNLWYTLDRPPIGWKYSSGFVTADMIKEHLPPPAKSTLILVCGPPPLIQTAAHPNLEKLGYTQDMIFTY

SEQ ID NO: 62692 - protein, 651 aa, Homo sapiens
MSLPRLLKVNIRTYDNSIPISESSRKSWNQKHFALTFPKPLQRGTNDKSRPLKSQITVTRHDKRKLEEGQKPAHKWIRHSFRKILQWPPIYTAAREQTPFRHLYTSKTHLKKAEYKKSKDEKGGTPLKKDSKKKGGSYATNPESKQIVEEKTKRQNEADKTPLKSSHENEQSKKSKSSSETNPESQNSKTVSKNCSQKDKKDSKNSKKTNTEFLHTKNNPKKDLKRSKTSNDPISEICSENSLNVDFLMLVGQSDDESINFDAWLRNYSQNNSKNYSLKYTKYTKKDTKKNAKKSSDAESEDSKDAKKDSKKVKKNVKKDDKKKDVKKDTESTDAESGDSKDERKDTKKDKKKLKKDDKKKDTKKYPESTDTESGDAKDARNDSRNLKKASKNDDKKKDAKKITFSTDSESELESKESQKDEKKDKKDSKTDNKKSVKNDEESTDADSEPKGDSKKGKKDEKKGKKDSKKDDKKKDAKKNAESTEMESDLELKKDKKHSKEKKGSKKDIKKDARKDTESTDAEFDESSKTGFKTSTKIKGSDTESEESLYKPGAKKKIDESDGTSANSKMEGLESKRGFRMSSKKTTFNEKGEKASTGRVPPSREKPPLPACEPSLPSPKVRRLCWCKMPPPPPKPRYAPLPEAPWIHKLL

SEQ ID NO: 62693 - protein, 657 aa, Homo sapiens
MSLPRLLKVNIRTYDNSIPISESSRKSWNQKHFALTFPKPLQRGTNDKSRPLKSQITVTRHDKRKLEEGQKPAHKWIRHSFRKILQWPPIYTAAREQTPFRHLYTSKTHLKKAEYKKSKDEKGGTPLKKDSKKKGGSYATNPESKQIVEEKTKRQNEADKTPLKSSHENEQSKKSKSSSETNPESQNSKTVSKNCSQKDKKDSKNSKKTNTEFLHTKNNPKKDLKRSKTSNDPISEICSENSLNVDFLMLVGQSDDESINFDAWLRNYSQNNSKNYSLKYTKYTKKDTKKNAKKSSDAESEDSKDAKKDSKKVKKNVKKDDKKKDVKKDTESTDAESGDSKDERKDTKKDKKKLKKDDKKKDTKKYPESTDTESGDAKDARNDSRNLKKASKNDDKKKDAKKITFSTDSESELESKESQKDEKKDKKDSKTDNKKSVKNDEESTDADSEPKGDSKKGKKDEKKGKKDSKKDDKKKDAKKNAESTEMESDLELKKDKKHSKEKKGSKKDIKKDARKDTESTDAEFDESSKTGFKTSTKIKGSDTESEESLYKPGAKKKIDESDGTSANSKMEGLESKRGFRMSSKKTTFNEKGEKASTGRVPPSREKPPLPACEPSLPSPKVRRLCWCKMPPPPPKPRYAPLIQRRQRLGVRRCQLLM

SEQ ID NO: 62694 - protein, 651 aa, Homo sapiens; identical to SEQ ID NO: 62692

SEQ ID NO: 62695 - protein, 657 aa, Homo sapiens; identical to SEQ ID NO: 62693

SEQ ID NO: 62696 - protein, 660 aa, Homo sapiens
MSHVVVKNDPELDQQLANLDLNSEKQSGGASTASKGRYIPPHLRNREASKGFHDKDSSGWSCSKDKDAYSSFGSRDSRGKPGYFSERGSGSRGRFDDRGRSDYDGIGNRERPGFGRFERSGHSRWCDKSVEDDWSKPLPPSERLEQELFSGGNTGINFEKYDDIPVEATGSNCPPHIENFSDIDMGEIIMGNIELTRYTRPTPVQKHAIPIIKGKRDLMACAQTGSGKTAAFLLPILSQIYTDGPGEALKAVKENGRYGRRKQYPISLVLAPTRELAVQIYEEARKFSYRSRVRPCVVYGGADIGQQIRDLERGCHLLVATPGRLVDMMERGKIGLDFCKYLVLDEADRMLDMGFEPQIRRIVEQDTMPPKGVRHTMMFSATFPKEIQMLARDFLDEYIFLAVGRVGSTSENITQKVVWVEDLDKRSFLLDILGATGSDSLTLVFVETKKGADSLEDFLYHEGYACTSIHGDRSQRDREEALHQFRSGKSPILVATAVAARGLDISNVRHVINFDLPSDIEEYVHRIGRTGRVGNLGLATSFFNEKNMNITKDLLDLLVEAKQEVPSWLENMAYEHHYKGGSRGRSKSNRFSGGFGARDYRQSSGSSSSGFGASRGSSSRSGGGGYGNSRGFGGGGYGGFYNSDGYGGNYNSQGVDWWGN

SEQ ID NO: 62697 - protein, 724 aa, Homo sapiens
MGDEDWEAEINPHMSSYVPIFEKDRYSGENGDNFNRTPASSSEMDDGPSRRDHFMKSGFASGRNFGNRDAGECNKRDNTSTMGGFGVGKSFGNRGFSNSRFEDGDSSGFWRESSNDCEDNPTRNRGFSKRGGYRDGNNSEASGPYRRGGRGSFRGCRGGFGLGSPNNDLDPDECMQRTGGLFGSRRPVLSGTGNGDTSQSRSGSGSERGGYKGLNEEVITGSGKNSWKSEAEGGESSDTQGPKVTYIPPPPPEDEDSIFAHYQTGINFDKYDTILVEVSGHDAPPAILTFEEANLCQTLNNNIAKAGYTKLTPVQKYSIPIILAGRDLMACAQTGSGKTAAFLLPILAHMMHDGITASRFKELQEPECIIVAPTRELVNQIYLEARKFSFGTCVRAVVIYGGTQLGHSIRQIVQGCNILCATPGRLMDIIGKEKIGLKQIKYLVLDEADRMLDMGFGPEMKKLISCPGMPSKEQRQTLMFSATFPEEIQRLAAEFLKSNYLFVAVGQVGGACRDVQQTVLQVGQFSKREKLVEILRNIGDERTMVFVETKKKADFIATFLCQEKISTTSIHGDREQREREQALGDFRFGKCPVLVATSVAARGLDIENVQHVINFDLPSTIDEYVHRIGRTGRCGNTGRAISFFDLESDNHLAQPLVKVLTDAQQDVPAWLEEIAFSTYIPGFSGSTRGNVFASVDTRKGKSTLNTAGFSSSQAPNPVDDESWD

SEQ ID NO: 62698 - protein, 724 aa, Homo sapiens; identical to SEQ ID NO: 62697

SEQ ID NO: 62699 - protein, 631 aa, Homo sapiens
MSHWAPEWKRAEANPRDLGASWDVRGSRGSGWSGPFGHQGPRAAGSREPPLCFKIKNNMVGVVIGYSGSKIKDLQHSTNTKIQIINGESEAKVRIFGNREMKAKAKAAIETLIRKQESYNSESSVDNAASQTPIGRNLGRNDIVGEAEPLSNWDRIRAAVVECEKRKWADLPPVKKNFYIESKATSCMSEMQVINWRKENFNITCDDLKSGEKRLIPKPTCRFKDAFQQYPDLLKSIIRVGIVKPTPIQSQAWPIILQGIDLIVVAQTGTGKTLSYLMPGFIHLDSQPISREQRNGPGMLVLTPTRELALHVEAECSKYSYKGLKSICIYGGRNRNGQIEDISKGVDIIIATPGRLNDLQMNNSVNLRSITYLVIDEADKMLDMEFEPQIRKILLDVRPDRQTVMTSATWPDTVRQLALSYLKDPMIVYVGNLNLVAVNTVKQNIIVTTEKEKRALTQEFVENMSPNDKVIMFVSQKHIADDLSSDFNIQGISAESLHGNSEQSDQERAVEDFKSGNIKILITTDIVSRGLDLNDVTHVYNYDFPRNIDVYVHRVGYIGRTGKTGTSVTLITQRDSKMAGELIKILDRANQSVPEDLVVMAEQYKLNQQKRHRETRSRKPGQRRKEFYFLS

SEQ ID NO: 62700 - protein, 353 aa, Homo sapiens
MLGACFPHLSSGDVMVFGPGGLGQPVLHPVLVLGHHQQPVLGFGSKLVVGPVVGPQACLGVQFALSAVLALPLPLEGGRRRGFGLGGLQPRVAEDLIDVEPLADVGLQHAVDEVLALAGQVLGAREVHTVLLLDTQHLPDVGVVIGHGAADHDVQDHAQAPDVIHLGLVGDALQHLGGCICCRPAEGLAEDDAPIAVPQAALGEAKVRQLDVEVLVEEKVLALEVPVDDVQVVAVLDGGGELSEHLACHVLMQGSLALDELEEVALDAKLHDDVDPSVRGLKDLVSLDDGAVVDSCQDVHLPRKESLHKVSRCFLAVDDLDSHIELEALRVGRFDFCVGTLAKIDAYDVTLLP

SEQ ID NO: 62701 - protein, 319 aa, Homo sapiens
MLFWVLGLLILCGFLWTRKGKLKIEDITDKYIFITGCDSGFGNLAARTFDKKGFHVIAACLTESGSTALKAETSERLRTVLLDVTDPENVKRTAQWVKNQVGEKGLWGLINNAGVPGVLAPTDWLTLEDYREPIEVNLFGLISVTLNMLPLVKKAQGRVINVSSVGGRLAIVGGGYTPSKYAVEGFNDSLRRDMKAFGVHVSCIEPGLFKTNLADPVKVIEKKLAIWEQLSPDIKQQYGEGYIEKSLDKLKGNKSYVNMDLSPVVECMDHALTSLFPKTHYAAGKDAKIFWIPLSHMPAALQDFLLLKQKAELANPKAV

SEQ ID NO: 62702 - protein, 849 aa, Homo sapiens
MSEERSLSLLAKAVDPRHPNMMTDVVKLLSAVCIVGEESILEEVLEALTSAGEEKKIDRFFCIVEGLRHNSVQLQVACMQLINALVTSPDDLDFRLHIRNEFMRCGLKEILPNLKCIKNDGLDIQLKVFDEHKEEDLFELSHRLEDIRAELDEAYDVYNMVWSTVKETRAEGYFISILQHLLLIRNDYFIRQQYFKLIDECVSQIVLHRDGMDPDFTYRKRLDLDLTQFVDICIDQAKLEEFEEKASELYKKFEKEFTDHQETQAELQKKEAKINELQAELQAFKSQFGALPADCNIPLPPSKEGGTGHSALPPPPPLPSGGGVPPPPPPPPPPPLPGMRMPFSGPVPPPPPLGFLGGQNSPPLPILPFGLKPKKEFKPEISMRRLNWLKIRPHEMTENCFWIKVNENKYENVDLLCKLENTFCCQQKERREEEDIEEKKSIKKKIKELKFLDSKIAQNLSIFLSSFRVPYEEIRMMILEVDETRLAESMIQNLIKHLPDQEQLNSLSQFKSEYSNLCEPEQFVVVMSNVKRLRPRLSAILFKLQFEEQVNNIKPDIMAVSTACEEIKKSKSFSKLLELVLLMGNYMNAGSRNAQTFGFNLSSLCKLKDTKSADQKTTLLHFLVEICEEKYPDILNFVDDLEPLDKASKVSVETLEKNLRQMGRQLQQLEKELETFPPPEDLHDKFVTKMSRFVISAKEQYETLSKLHENMEKLYQSIIGYYAIDVKKVSVEDFLTDLNNFRTTFMQAIKENIKKREAEEKEKRVRIAKELAERERLERQQKKKRLLEMKTEGDETGVMDNLLEALQSGAAFRDRRKRTPMPKDVRQSLSPMSQRPVLKVCNHGNKPYL

SEQ ID NO: 62703 - protein, 652 aa, Homo sapiens
MLLNWLRILSWRNTWDNRSHSFSARPLLSTYPKADDFHHTIFSNLERLDKLQPTLEASEESLVHKDRGDGERPVNVRVVQVAPLRRESSKYSGITCQENNLDAKKGVASLPGFNVKSHPDPGIVIGITPHGDTIHDITNEDAVHDTTDEDAVHGTADEDAVQGIADEDAVHGIADWDAIQGLADRDAVHGFADGDAVKGIADGDATQGIAEGDDVHGIADGVAVQGIADEDAVQLIADEDPVHGITKEDATQGFANKDAAQGIANEEAIHGIPNEVAIQGVANDDAVQGGIANEDATEGIANDDAVHGITNEDTAQGIANWDAVQDIANWDAVHCIANEDGFHGIDNEDAVQGIADWDAAQGIADGVAAQGIALDDAVHGIANKDAAQGIANWDAVQDIANEDGFHGIDNEDAVQGITNWDVVQGIANWDTVHSFADGVAFHGIADGDAVQGIALDDAVHGIANEDAAQGIANWDAVQDIANEDGFHGIDIEDAAQGIDNEDAFQGIANREAFHGIADGDAVQGIADGVAVHGIADGVVVHGIADWDAAQGIADGDAVHGIADEEAAQGIANWDAVQDINNEDGFHGIANEDATQGIADGDAAQGIADGDAVQGIADWDTVHGFANRVAIHGFANRVAFHSIANGVPSRASL

SEQ ID NO: 62704 - protein, 428 aa, Homo sapiens
MDSLWGPGAGSHPFGVHNTRLSPDLCPGKIVLRALKESGAGMPEQDKDPRVQENPGDQRRVPEVTGDAPSAFRPLRDNGGLSPFVPGPGPLQTDLHAQRSEIRYNPTSQTSWTSSCTNRNAISSSYSSTGGLPGLKRRRGPASSHCQLTLSSSKTVSEDRPQAVSSGHTQCEKAADIAPGQTLTLRNDSSTSEASRPSTHKFPLLPRRRGEPLMLPPPLELGYRVTVEDLDREKEAAFQRINSALQVEDKAISDCRPSRPSHTLSSLATGASGLPAVSKAPSMDAQQETHKSQDCLGLLDPLASAAGVPSTAPMSGKKHRPPGPLFSSSDPLPATSSDSQDSAQVTSLIPAPFPAASMDAGMRRTRHGTSAPAAAAAAPPRSTLNPTLGSLLEWMEALHISGPQPQLQQVPRGQNQRSQTSWTSSCPK

SEQ ID NO: 62705 - protein, 428 aa, Homo sapiens [sequence omitted]

SEQ ID NO: 62706 - protein, 1963 aa, Homo sapiens
MKQRKGQGSGGSRGRKKRGLSDISPSTSLPPLVEGQLRCFLKLTVNRVIWKIAKPPTCVLVRVRWWGETSDGTLFCPRDALQTEPKAVRTTTRYAIRCGPKQFTSYLTDMAVLVLEVITKLDGLPIGRVQINGLAQLSPTHQTNGFFTIVSSTSKKLGELQVSLALEPLSETYDSYHPLPTTDMTENVLLSKQGFRENTEPSSTQFQVPSRPRDIHTIKIDGKELAANSSRSTTPRGKDHVCFAENPDTIKDSSFGLQHSLNSGQSLESVTLKGRAPRKQMSLLNSSEFQPQIRTVAKSHSDSCILSSNNLPTKDLLSALLEQGNKLRNAMVISAMKSSPETSMLLDQVHPPINEDSLRASTQIRAFSRNRFKDHIEDHLLPSTENTFWRHDTKADTRAIQLLLGSAELSQGNFWDGLGSPPDSPSPGSDVYCISELNDPQYDQSLLENLFYTAPKSDTSISDFLSEEDDIVPSKKISQSTALARSSKVLESSDHKLKKRSAGKRNRNLVEQQMLSETPEDAQTMTLSVDRLALLGRTHSVRIIIETMGVPPDSPQMTPGKKSYAGPPPKVTTAKKRTFFVEYHFPVGFSESGLGKTALITEVVRLASSKITDGKVKFQQRFVFPVQFGGPMIEHWWNSNLTFQIYVKKTPQKKPEVIGSVSLSLRAVIQSELLSFSDQLPVQQENGQSPFGPLKVTMELITDNKDFTGINTKLSGNTHYTPLCAPTSPNKALPELNQDVTCTKNPQNLNQIHEETAKKAQNLVLPNRKSPSPVAPHPSTFVATPASHNLVNQTNGTTKESALLLHVLLMVPDGKDFISGESEKQSPCNVYLNCKLFSTEEVTRSVIAWGTTQPVFNFSQVIPVSLSSKYLERLKNNVMVIETWNKVRSPGQDKLLGLVKLPLHQFYMSFKDAKISRLLLDAQYPVVAVDSYMPVIDVFSGHQNGSLRVFLAMGSSNQIMALQRLKNEEGTLPPFSPRPAHFLDQPTAASVAMAEDRGNGLMEHCFEIHIEMVKGLAPLQATVWGEADCYVQYYFPVQHSQSSVLKGPEFLENGITLKPFRTATTLCVPDPIFNSEHHHSLLLPAEVPVQRLLLSAFSAQGLVPGGGVQFEIWCRYYYPNVRDQKVAKGTLPLSRICAMVATQHREDVGIQTFNLPLTPRIENRKELRNQSSGLLDVGLRYRRSPRTAEGVLAARTVSISVQIIRACGLQAAAKALAEQEPALQFSATVGVNASVTTHLSFLPQGEQRRTHPVACSFCPEFSHHVEFTCNLVTQHCSGEACFLAELLEFAEVIFAVYHENTKSASDIISIESCKEYLLGVVKVPTKELLIKRSGITGWYPIILPEDGGLPRGLELMQKIVGGLELSISFTHRGDRERVLEAAEHLGWSFENSLKDFVRMDEGEPATVTISTPRLWLSIHCVLLAGHNHIHKNTYCYLRYKFYDHEAFWTPLKKPKESVNKKQIMVTFKASKRAEVTRGPSLLWYFREERLEIQVWRAYGNDSVERPHQTDSWIGSAYVDLARLGERSARTLTVSGVYPLFGRNASNLSGAALRVHVVLSSLSSHLEPTHELDSMDCSSHSESEQLPRRNDEVQLSPPEVISCHQKSPASTQVPCSSTTAEVRLTQEGPADLDGTFAVSILVERAMHLSLKGSPLTERKVSIPSCCVSFATADESSPVYTQVVENTDSPIWNFQQQSRLSKELLLDPQQTLVFKVWHKGDEERVIGFASVDLSPLLSGFQFVCGWYNITDFSGECQGQIKVAVSPLESLIHFKEERQARRGVETSKSLIPIYSPFSFPASDTYAAFSSHMARQTLDQLAHASSKELDFSSPGRSDTTRSQASRHEEHVQNIRRFHESLHLQGEAPLPCDDKLTTSPLSSQTSILTSLRKNLSELDQIQRYFRQKLTKPFLPLSPQTQTAISQHQESCRDHLGPGASSLDPGSQCILEKSSNLVLQVSSLITGSY

SEQ ID NO: 62707 - protein, 1153 aa, Homo sapiens
MPRAQLLESNAPIHMENLPFPLKLLSASSLNTPSSTPWVLDIFLTLVFALGLFFLLLPYFSYLRCDNPPSPSPRKRKLVESAREAWRRLGTCFHNCRDPPGEVGKRTPDGASRSSHEPMEDAAPIVSPLASPDPRTKHPQDLASTPPPGPMTTSVSSLSASQPPEPSLLLERPSPEPPALFPHPPHTPDPLACSPPPPKGFTPPPLRDSTLLTPSHCDSVALPLDTVPQSLSPREDLAASVPAISGLGGSNSQVSALSWSQETTKTWCIFNSSVQQDHLSRQRDTTMSPLLFQAQPLSHLGPESQPFISSTPQFRPTPMAQAEAQAHLQSSFPVLSPAFLSPMKNTGVACPASQNKVQALSLPETQHPERPLLRKQLEGGLALPSRVQKSQDVFSVSTPNLPQERLTSILPENFPVSPELWRQLEQYMGQRGRIQESLDLMQLQDELPGTSQAKGKPRPWQSSTSTGESSKEAQTVKFQLERDPCPHLGQILGETPQNLSRGMESFPGKVLGATSEESERNLRKPLRSDSGSDLLRRTERNHIENILKAHMGRKLGQTNEGLIPVSVRRSWLAVNQAFPVSNTHVKTSNLAAPKSRKACVNTAQVLSFLELCTQQVLEAHIVRFWAKHRWGLPLRVLKPIQCFQLEKVSSLSLIQLAGPSSDTCESGAGSKVEVATLLGEPPMASLRKQVLTKPSVHMPERLQASSPACKQFQRAPRGIPSSNDHGSLKAPTAGQEGRWPSKPLTYSLKGSTQQSRSLGAQSSRAGETREAVPQPTVPLGTCMRANLQATSEDVRGFKAPGASKSSLLPRMSVSQDPRKLCLMEEAVSEFEPGMATKSETQPQVSAAVVLLPDGQASVVPHASENLASQVPQGHLQSTPTGNMQASQELCDLMSARRSNMGHKEPRNPNCQGSCKSQSPMFPPTHKRENSRKPNLEKHEEMFQGLRTPQLTPGRKTEDTRQNEGVQLLPSKKQPPSISHFGENIKQFFETIFSKKERKPAPVTAESQKTVKNRSCVYGSSAEAERLMTAVGQIPEENMSLCHARHASKVNQQRQQFQAPVCGFPCNHRHPFYSDHSRMLSYAASSQQATLKNQSRPNRDRQIRDQQPLKSVRCNNEQWGLRHPQLLLPKKAVSPVSPPQHRPKTPSASSHHHH

SEQ ID NO: 62708 - protein, 1158 aa, Homo sapiens
MPRAQLLESNAPIHMENLPFPLKLLSASSLNTPSSTPWVLDIFLTLVFALGLFFLLLPYFSYLRCDNPPSPSPRKRKLVPPVSCSLLGPHLEKGDFGQLSGPDPPGEVGKRTPDGASRSSHEPMEDAAPIVSPLASPDPRTKHPQDLASTPPPGPMTTSVSSLSASQPPEPSLLLERPSPEPPALFPHPPHTPDPLACSPPPPKGFTPPPLRDSTLLTPSHCDSVALPLDTVPQSLSPREDLAASVPAISGLGGSNSQVSALSWSQETTKTWCIFNSSVQQDHLSRQRDTTMSPLLFQAQPLSHLGPESQPFISSTPQFRPTPMAQAEAQAHLQSSFPVLSPAFLSPMKNTGVACPASQNKVQALSLPETQHPERPLLKKQLEGGLALPSRVQKSQDVFSVSTPNLPQERLTSILPENFPVSPELWRQLEQHMGQRGRIQESLDLMQLQDELPGTSQAKGKPRPWQSSTSTGESSKEAQTVKFQLERDPCPHLGQILGETPQNLSRGMESFPGKVLGATSEESERNLRKPLRSDSGSDLLRRTERNHIENILKAHMSRKLGQTNEGLIPVSVRRSWLAVNQAFPVSNTHVKTSNLAAPKSRKACVNTAQVLSFLELCTQQVLEAHIVRFWAKHRWGLPLRVLKPIQCFQLEKVSSLSLIQLAGPSSDTCESGAGSKVEVATLLGEPPMASLRKQVLTKPSVHMPERLQASSPACKQFQRAPRGIPSSNDHGSLKAPTAGQEGRWPSKPLTYSLKGSTQQSRSLGAQSSRAGETREAVPQPTVPLGTCMRANLQATSEDVRGFKAPGASKSSLLPRMSVSQDPRKLCLMEEAVSEFEPGKATKSETQPQVSAAVVLLPDGQASVVPHASENLASQVPQGHLQSMPTGNMQASQELCDLMSARRSNMGHKEPRNPNCQGSCKSQSPMFPPTHKRENSRKPNLEKHEEMFQGLRTPQLTPGRKTEDTRQNEGVQLLPSKKQPPSISHFGENIKQFFQTIFSKKERKPAPVTAESQKTVKNRSCVYGSSAEAERLMTAVGQIPEENMSLCHARHASKVNQQRQQFQAPVCGFPCNHRHPFYSDHSRMLSYAASSQQATLKNQSRPNRDRQIRDQQPLKSVRCNNEQWGLRHPQLLLPKKAVSPVSPPQHRPKTPSASSHHHH

SEQ ID NO: 62709 - protein, 296 aa, Homo sapiens
MGAAAPAESADLGNFWKAGEPLLQGPDALAAPMSRSPSTPQTTPSPQGRQSPWPLRSLTQSHIEYFQWGRPVPSTHLIEVRPTQDPAKPQRVVSEGWRRPALPGETALGRDLSCAWEGCMKGGLCRAWNPGRTWSPVTIGIAPPERQESPWRSPGQRARPAGRPAAQELLDPCTRETLLGALSQCPKGSARFDGPLWFEVSDSKGGRRNLQPRPSAFKPLSKNGAVASFVPRPGPLKPSLGPWSLSFCDDAWPSVLVQPAPSAIWDFWEATTPSCGSCSRVSFALEVTQSAGPFGS

SEQ ID NO: 62710 - protein, 749 aa, Homo sapiens
MEVVPAEVSSLLPEEIMDTGITLVDDDSIEAVIVSSPIPMETELEEIVNINSTGDSTATPISTEPITVYSNHTNQVAVNTTITKADSNTTVKPAFPSGLQKLGAQTPVTISANQIILNKVSQTSDLKLGNQTLKPDGQKLILTTLGKSGSPIVLALPHSQLPQAQKVTTQAQSGDAKLPPQQIKVVTIGGRPEVKPVIGVSALTPGSQLINTTTQPSVLQTQQLKTVQIAKKPRTPTSGPVITKLIFAKPINSKAVTGQTTQVSPPVIAGRVLSQSTPGTPSKTITISESGVIGSTLNSTTQTPNKIAISPLKSPNKAVKSTVQTITVGGVSTSQFKTIIPLATAPNVQQIQVPGSKFHYVRLVTATSASSSTQPVSQNPSTNTQPLQQAKPVVVNTTPVRMSVPIVSAQAVKQVVPKPINPTSQIVTTSQPQQRLIMPATPLPQIQPNLTNLPPGTVLAPAPGTGNVGYAVLPAQYVTQLQQSSYVSIASNSTFTGTSGIQTQARLPFNGIIPSESASRPRKPCNCTKSLCLKLYCDCFANGEFCNNCNCTNCYNNLEHENERQKAIKACLDRNPEAFKPKIGKGKEGESDRRHSKGCNCKRSGCLKNYCECYEAKIMCSSICKCIGCKNFEESPERKTLMHLADAAEVRVQQQTAAKTKLSSQISDLLTRPTPALNSGGGKLPFTFVTKEVAEATCNCLLAQAEQADKKGKSKAAAERMILEEFGRCLMSVINSAGKAKSAPCAMNC

SEQ ID NO: 62711 - protein, 242 aa, Homo sapiens
MGEASPPAPARRHLLVLLLLLSTLVIPSAAAPIHDADAQESSLGLTGLQSLLQGFSRLFLKGNLLRGIDSLFSAPMDFRGLPGNYHKEENQEHQLGNNTLSSHLQIDKMTDNKTGEVLISENVVASIQPAEGSFEGDLKVPRMEEKEALVPIQKATDSFHTELHPRVAFWIIKLPRRRSHQDALEGGHWLSEKRHRLQAIRDGLRKGTHKDVLEEGTESSSHSRLSPRKTHLLYILRPSRQL

SEQ ID NO: 62712 - protein, 373 aa, Homo sapiens
MPNDEAFSKPSTPSEAPHAPGVPPQGRAGGFGKASGALVGAASGSSAGGSSRGGGSGSGASDLGAGSKKSPRLPKCARCRNHGYASPLKGHKRFCMWRDCQCKKCNLIAERQRVMAAQVALRRQQAQEEELGISHPIPLPSAAELLVKRENNGSNPCLMTECSGTSQPPPASVPTTAASEGRMVIQDIPAVTSRGHVENTPDLVSDSTYYSSFYQPSLFPYYNNLYNCPQYSMALAADSASGEVGNPLGGSPVKNSLRGLPGPYVPGQTGNQWQMKNMENRHAMSSQYRMHSYYPPPSYLGQSVPQFFTFEDAPSYPEARASVFSPPSSQDSGLVSLSSSSPISNKSTKAVLECEPASEPSSFTVTPVIEEDE

SEQ ID NO: 62713 - protein, 1472 aa, Homo sapiens
MSYVHTTVNEMSRVYLATERRYNYTTPKTFLEQIKLYQNLLAKKRTELVAKIERLENGLMKLQSTASQVDDLKAKLAIQEAELKQKNESADQLIQVVGIEAEKVSKEKAIADQEEVKVEVINKNVTEKQKACETDLAKAEPALLAAQEALDTLNKNNLTELKSFGSPPDAVVNVTAAVMILTAPGGKIPKDKSWKAAKIMMGKVDTFLDSLKKFDKEHIPEACLKAFKPYQGNPTFDPEFIRSKSTAAAGLCSWCINIVRFYEVYCDVAPKRQALEEANAELAEAQEKLSRIKNKIAELNANLSNLTSAFEKATAEKIKCQQEADATNRVILLANRLVGGLASENIRWAESVENFRSQGVTLCGDVLLISAFVSYVGYFTKKYRNELMEKFWIPYIHNLKVPIPITNGLDPLSLLTDDADVATWNNQGLPSDRMSTENATILGNTERWPLIVDAQLQGIKWIKNKYRSELKAIRLGQKSYLDVIEQAISEGDTLLIENIGETVDPVLDPLLGRNTIKKGKYIKIGDKEVEYHPKFRLILHTKYFNPHYKPEMQAQCTLINFLVTRDGLEDQLLAAVVAKERPDLEQLKANLTKSQNEFKIVLKELEDSLLARLSAASGNFLGDTALVENLETTKHTASEIEEKVVEAKITEVKINEARENYRPAAERASLLYFILNDLNKINPVYQFSLKAFNVVFEKAIQRTTPANEVKQRVINLTDEITYSVYMYTARGLFERDKLIFLAQVTFQVLSMKKELNPVELDFLLRFPFKAGVVSPVDFLQHQGWGGIKALSEMDEFKNLDSDIEGSAKRWKKLVESEAPEKEIFPKEWKNKTALQKLCMVRCLRPDRMTYAIKNFVEEKMGSKFVEGRSVEFSKSYEESSPSTSIFFILSPGVDPLKDVEALGKKLGFTIDNGKLHNVSLGQGQEVVAENALDVAAEKGHWVILQNIHLVARWLGTLDKKLERYSTGSHEDYRVFISAEPAPSPETHIIPQGILENAIKITNEPPTGMHANLHKALDLFTQDTLEMCTKEMEFKCMLFALCYFHAVVAERRKFGAQGWNRSYPFNNGDLTISINVLYNYLEANPKVPWDDLRYLFGEIMYGGHITDDWDRRLCRTYLAEYIRTEMLEGDVLLAPGFQIPPNLDYKGYHEYIDENLPPESPYLYGLHPNAEIGFLTVTSEKLFRTVLEMQPKETDSGAGTGVSREEKVKAVLDDILEKIPETFNMAEIMAKAAEKTPYVVVAFQECERMNILTNEMRRSLKELNLGLKGELTITTDVEDLSTALFYDTVPDTWVARAYPSMMGLAAWYADLLLRIRELEAWTTDFALPTTVWLAGFFNPQSFLTAIMQSMARKNEWPLDKMCLSVEVTKKNREDMTAPPREGSYVYGLFMEGARWDTQTGVIAEARLKELTPAMPVIFIKAIPVDRMETKNIYECPVYKTRIRGPTYVWTFNLKTKEKAAKWILAAVALLLQV

SEQ ID NO: 62714 - protein, 309 aa, Homo sapiens
MVDYYEVLGLQRYASPEDIKKAYHKVALKWHPDKNPENKEEAERKFKEVAEAYEVLSNDEKRDIYDKYGTEGLNGGGSHFDDECEYGFTFHKPDDVFKEIFHERDPFSFHFFEDSLEDLLNRPGSSYGNRNRDAGYFFSTASEYPIFEKFSSYDTGYTSQGSLGHEGLTSFSSLAFDNSGMDNYISVTTSDKIVNGRNINTKKIIESDQEREAEDNGELTFFLVNSVANEEGFAKECSWRTQSFNNYSPNSHSSKHVSQYTFVDNDEGGISWVTSNRDPPIFSAGVKEGGKRKKKKRKEVQKKSTKRNC

SEQ ID NO: 62715 - protein, 232 aa, Homo sapiens
MANYYEVLGVQASASPEDIKKAYRKLALRWHPDKNPDNKEEAEKKFKLVSEAYEVLSDSKKRSLYDRAGCDSWRAGGGASTPYHSPFDTGYTFRNPEDIFREFFGGLDPFSFEFWDSPFNSDRGGRGHGLRGAFSAGFGEFPAFMEAFSSFNMLGCSGGSHTTFSSTSFGGSSSGSSGFKSVMSSTEMINGHKVTTKRIVENGQERVEVEEDGQLKSVTVNGKEQLKWMDSK

SEQ ID NO: 62716 - protein, 358 aa, Homo sapiens
MAATLGSGERWTEAYIDAVRRNKYPEDTPPESHDPCGCCNCMKAQKEKKSENEWTQTRQGEGNSTYSEEQLLGVQRIKKCRNYYEILGVSRDASDEELKKAYRKLALKFHPDKNCAPGATDAFKAIGNAFAVLSNPDKRLRYDEYGDEQVTFTAPRARPYNYYRDFEADITPEELFNVFFGGHFPTGNIHMFSNVTDDTYYYRRRHRHERTQTQKEEEEEKPQTTYSAFIQLLPVLVIVIISVITQLLATNPPYSLFYKSTLGYTISRETQNLQVPYFVDKNFDKAYRGASLHDLEKTIEKDYIDYIQTSCWKEKQQKSELTNLAGLYRDERLKQKAESLKLENCEKLSKLIGLRRGG

SEQ ID NO: 62717 - protein, 199 aa, Homo sapiens
MACNIPNQRQRTLSTTGEALYEILGLHKGASNEEIKKTYRKLALKHHPDKNPDDPAATEKFKEINNAHAILTDISKRSIYDKYGSLGLYVAEQFGDENVNTYFMLSSWWAKALFVIVGLLTGCYFCCCLCCCCNCCCGHCRPESSVPEEDFYVSPEDLEEQIKSDMEKDVDFPVFLQPTNANEKTQLIKEGSRSYCTDS

SEQ ID NO: 62718 - protein, 189 aa, Homo sapiens
MSTVKEAAHRLSKSEMSLYAVLDLKKGASPEDFKKSYSHSALLPHPPFEYHLGRKLALRYHPDKNPGNAQAAEIFKEINAAHAILSDSKKRKIYDQHGSLGIYLYDHFGEEGVRYYFILNSCWFKTLVILCTLLTCCCFCCCCCFCCGALKPPPEQDSGRKYQQNVQSQPPRSGAKCDFRSEENSEDDF

SEQ ID NO: 62719 - protein, 513 aa, Homo sapiens
MIRTPLSASAHRLLLPGSRGRPPRNMQPTGREGSRALSRRYLRRLLLLLLLLLLRQPVTRAETTPGAPRALSTLGSPSLFTTPGVPSALTTPGLTTPGTPKTLDLRGRAQALMRSFPLVDGHNDLPQVLRQRYKNVLQDVNLRNFSHGQTSLDRLRDGLVGAQFWSASVSCQSQDQTAVRLALEQIDLIHRMCASYSELELVTSAEGLNSSQKLACLIGVEGGHSLDSSLSVLRSFYVLGVRYLTLTFTCSTPWAESSTKFRHHMYTNVSGLTSFGEKVVEELNRLGMMIDLSYASDTLIRRVLEVSQAPVIFSHSAARAVCDNLLNVPDDILQLLKKNGGIVMVTLSMGVLQCNLLANVSTVADHFDHIRAVIGSEFIGIGGNYDGTGRFPQGLEDVSTYPVLIEELLSRSWSEEELQGVLRGNLLRVFRQVEKVREESRAQSPVEAEFPYGQLSTSCHSHLVPQNGHQATHLEVTKQPTNRVPWRSSNASPYLVPGLVAAATIPTFTQWLC

SEQ ID NO: 62720 - protein, 132 aa, Homo sapiens
MTVTGLGWRDVLEAIKATRPIANPNPGFRQQLEEFGWASSQKLRRQLEERFGESPFRDEEELRALLPLCKRCRQGSATSASSAGPHSAASEGTVQRLVPRTPREAHRPLPLLARVKQTFSCLPRCLSRKGGK

SEQ ID NO: 62721 - protein, 235 aa, Homo sapiens
MGNGMTKVLPGLYLGNFIDAKDLDQLGRNKITHIISIHESPQPLLQDITYLRIPVADTPEVPIKKHFKECINFIHCCRLNGGNCLVHCFAGISRSTTIVTAYVMTVTGLGWRDVLEAIKATRPIANPNPGFRQQLEEFGWASSQKLRRQLEERFGESPFRDEEELRALLPLCKRCRQGSATSASSAGPHSAASEGTVQRLVPRTPREAHRPLPLLARVKQTFSCLPRCLSRKGGK

SEQ ID NO: 62722 - protein, 132 aa, Homo sapiens; identical to SEQ ID NO: 62720

SEQ ID NO: 62723 - protein, 89 aa, Homo sapiens
MSDRKAVIKNADMSEDMQQDAVDCATQAMEKYNIEKDIAAYIKKEFDKKYNPTWHCIVGRNFGSYVTHETKHFIYFYLGQVAILLFKSG

SEQ ID NO: 62724 - protein, 268 aa, Homo sapiens
MNGTANPLLDREEHCLRLGESFEKRPRASFHTIRYDFKPASIDTSCEGELQVGKGDEVTITLPHIPGSTPPMTVFKGNKRPYQKDCVLIINHDTGEYVLEKLSSSIQVKKTRAEGSSKIQARMEQQPTRPPQTSQPPPPPPPMPFRAPTKPPVGPKTSPLKDNPSPEPQLDDIKRELRAEVDIIEQMSSSSGSSSSDSESSSGSDDDSSSSGGEDNGPASPPQPSHQQPYNSRPAVANGTSRPQGSNQLMNTLRNDLQLSESGSDSDD

SEQ ID NO: 62725 - protein, 353 aa, Homo sapiens
MGSLYSEYLNPNKVQEHYNYTKETLETQETTSRQVASAFIVILCCAIVVENLLVLIAVARNSKFHSAMYLFLGNLAASDLLAGVAFVANTLLSGSVTLRLTPVQWFAREGSAFITLSASVFSLLAIAIERHVAIAKVKLYGSDKSCRMLLLIGASWLISLVLGGLPILGWNCLGHLEACSTVLPLYAKHYVLCVVTIFSIILLAIVALYVRIYCVVRSSHADMAAPQTLALLKTVTIVLGVFIVCWLPAFSILLLDYACPVHSCPILYKAHYFFAVSTLNSLLNPVIYTWRSRDLRREVLRPLQCWRPGVGVQGRRRVGTPGHHLLPLRSSSSLERGMHMPTSPTFLEGNTVV

SEQ ID NO: 62726 - protein, 217 aa, Homo sapiens [sequence omitted]

SEQ ID NO: 62727 - protein, 1585 aa, Homo sapiens
MNSQPQTRSPFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYGTPFYPSQPVYQSAPIIVPTQQQPPPAKREKKTIRIRDPNQGGKDITEEIMSGGGSRNPTPPIGRPTSTPTPPQQLPSQVPEHSPVVYGTVESAHLAASTPVTAASDQKQEEKPKPDPVLKSPSPVLRLVLSGEKKEQEGQTSETTAIVSIAELPLPPSPTTVSSVARSTIAAPTSSALSSQPIFTTAIDDRCELSSPREDTIPIPSLTSCTETSDPLPTNENDDDICKKPCSVAPNDIPLVSSTNLINEINGVSEKLSATESIVEIVKQEVLPLTLELEILENPPEEMKLECIPAPITPSTVPSFPPTPPTPPASPPHTPVIVPAAATTVSSPSAAITVQRVLEEDESIRTCLSEDAKEIQNKIEVEADGQTEEILDSQNLNSRRSPVPAQIAITVPKTWKKPKDRTRTTEEMLEAELELKAEEELSIDKVLESEQDKMSQGFHPERDPSDLKKVKAVEENGEEAEPVRNGAESVSEGEGIDANSGSTDSSGDGVTFPFKPESWKPTDTEGKKQYDREFLLDFQFMPACIQKPEGLPPISDVVLDKINQPKLPMRTLDPRILPRGPDFTPAFADFGRQTPGGRGVPLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMSHKKVGALWREADLSWKDFLPEGEDVHNFLLEQKLDFIESDSPCSSEALSKKELSAEELYKRLEKLIIEDKANDEQIFDWVEANLDEIQMSSPTFLRALMTAVCKAAIIADSSTFRVDTAVIKQRVPILLKYLDSDTEKELQALYALQASIVKLDQPANLLRMFFDCLYDEEVISEDAFYKWESSKDPAEQNGKGVALKSVTAFFTWLREAEEESEDN

SEQ ID NO: 62728 - protein, 430 aa, Homo sapiens
MQHVSSSQSSQRHVQWPGACPGAGEEQPACSQPSLPLTLPSPSHQLQQLMQVQTQSPTQPSPGPGQALQNVRAGAPGPGLGLCSSSPTGDFVDASVLVRQISLSPSSGGHFVFQDGSGLTQIAQGAQVQLQHPGTPITVRERRPSQPHTQSGGTIHHLGPQSPAAAGGAGLQPLAGPSHITTANLPPQISSIIQGQLVQQQQVLQGPPLPRPLGFERTPGVLLPGAGGAAGFGMTSPPPPTSPSRTAVPPGLSSLPLTSVGNTGMKKVPKKLEEIPPASPEMAQMRKQCLDYHHQEMQALKEVFKEYLIELFFLQHFQGNMMDFLAFKERLYGPLQAYLRQNDLDIEEEEEEHFEVINDEVKVVARKHGQPGTPVAIATQLPPWTSAAFPAQQQPLQPLAPTTVLSVSADWNALLQRPNKYIWGLQYLEM

SEQ ID NO: 62729 - protein, 632 aa, Homo sapiens
MTTSALRRQVKNIVHNYSEAEIKVREATSNDPWGPPSSLMSEIADLTFNTVAFTEVMGMLWRRLNDSGKNWRHVYKALTLLDYLLKTGSERVAHQCRENLYTIQTLKDFQYIDRDGKDQGVNVREKVKQVMALLKDEERLRQERTHALKTKERMALEGIGIGSGQLGFSRRYGEDYSRSRGSPSSYNSSSSSPRYTSDLEQARPQTSGEEELQLQLALAMSREEAEKPVPPASHRDEDLQLQLALRLSRQEHEKEVRSWQGDGSPMANGAGAVVHHQRDREPEREERKEEEKLKTSQSSILDLADIFVPALAPPSTHCSADPWDIPGFRPNTEASGSSWGPSADPWSPIPSGTVLSRSQPWDLTPMLSSSEPWGRTPVLPAGPPTTDPWALNSPHYKLPSTGADPWGASLETSDTPGGASTFDPFAKPPESTETKEGLEQALPSGKPSSPVELDLFGDPSPSSKQNGTKEPDALDLGILGEALTQPSKEARACRTPESFLGPSASSLVNLDSLVKAPQVAKTRNPFLTGLSAPSPTNPFGAGETGRPTLNQMRTGSPALGLAGGPVGAPLGSMTYSASLPLPLSSVPAGLTLPASVSVFPQAGAFAPQPLLPTPSSAGPRPPPPQTGTNPFL

SEQ ID NO: 62730 - protein, 538 aa, Homo sapiens
MALPYHIFLFTVLLPSFTLTAPPPCRCMTSSSPYQEFLWRMQRPGNIDAPSYRSLSKGTPTFTAHTHMPRNCYHSATLCMHANTHYWTGKMINPSCPGGLGVTVCWTYFTQTGMSDGGGVQDQAREKHVKEVISQLTRVHGTSSPYKGLDLSKLHETLRTHTRLVSLFNTTLTGLHEVSAQNPTNCWICLPLNFRPYVSIPVPEQWNNFSTEINTTSVLVGPLVSNLEITHTSNLTCVKFSNTTYTTNSQCIRWVTPPTQIVCLPSGIFFVCGTSAYRCLNGSSESMCFLSFLVPPMTIYTEQDLYSYVISKPRNKRVPILPFVIGAGVLGALGTGIGGITTSTQFYYKLSQELNGDMERVADSLVTLQDQLNSLAAVVLQNRRALDLLTAERGGTCLFLGEECCYYVNQSGIVTEKVKEIRDRIQRRAEELRNTGPWGLLSQWMPWILPFLGPLAAIILLLLFGPCIFNLLVNFVSSRIEAVKLQMEPKMQSKTKIYRRPLDRPASPRSDVNDIKGTPPEEISAAQPLLRPNSAGSS

SEQ ID NO: 62731 - protein, 854 aa, Homo sapiens
MALEQALQAARQGELDVLRSLHAAGLLGPSLRDPLDALPVHHAARAGKLHCLRFLVEEAALPAAARARNGATPAHDASATGHLACLQWLLSQGGCRVQDKDNSGATVLHLAARFGHPEVVNWLLHHGGGDPTAATDMGALPIHYAAAKGDFPSLRLLVEHYPEGVNAQTKNGATPLYLACQEGHLEVTQYLVQECGADPHARAHDGMTPLHAAAQMGHSPVIVWLVSCTDVSLSEQDKDGATAMHFAASRGHTKVLSWLLLHGGEISADLWGGTPLHDAAENGELECCQILVVNGAELDVRDRDGYTAADLSDFNGHSHCTRYLRTVENLSVEHRVLSRDPSAELEAKQPDSGMSSPNTTVSVQPLNFDLSSPTSTLSNYDSCSSSHSSIKGQHPPCGLSSARAADIQSYMDMLNPELGLPRGTIGKPTPPPPPPSFPPPPPPPGTQLPPPPPGYPAPKPPVGPQAADIYMQTKNKLRHVETEALKKELSSCDGHDGLRRQDSSRKPRAFSKQPSTGDYYRQLGRCPGETLAARPGMAHSEEVRARQPARAGCPRLGPAARGSLEGPSAPPQAALLPGNHVPNGCAADPKASRELPLPPPPPPPPLPEAASSPPPAPPLPLESAGPGCGQRRSSSSTGSTKSFNMMSPTGDNSELLAEIKAGKSLKPTPQSKGLTTVFSGIGQPAFQPDSPLPSVSPALSPVRSPTPPAAGFQPLLNGSLVPVPPTTPAPGVQLDVEALIPTHDEQGRPIPEWKRQVMVRKMQLKMQEEEEQRRKEEEEEARLASMPAWRRDLLRKKLEEEREQKRKEEERQKQEELRREKEQSEKLRTLGYDESKLAPWQRQVILKKGDIAKY

SEQ ID NO: 62732 - protein, 406 aa, Homo sapiens
MESLRGYTHSDIGYRSLAVGEDIEEVNDEKLTVTSLMARGGEDEENTRSKPEYGTEAENNVGTEGSVPSDDQDREGGGGHEPEQQQEEPPLTKPEQQQEEPPLLELKQEQEEPPQTTVEGPQPAEGPQTAEGPQPPERKRRRRTAFTQFQLQELENFFDESQYPDVVARERLAARLNLTEDRVQVWFQNRRAKWKRNQRVLMLRNTATADLAHPLDMFLGGAYYAAPALDPALCVHLVPQLPRPPVLPVPPMPPRPPMVPMPPRPPIAPMPPMAPVPPGSRMAPVPPGPRMAPVPPWPPMAPVPPWPPMAPVPTGPPMAPVPPGPPMARVPPGPPMARVPPGPPMAPLPPGPPMAPLPPGPPMAPLPPGPPMAPLPPRSHVPHTGLAPVHITWAPVINSYYACPFF

SEQ ID NO: 62733 - protein, 370 aa, Homo sapiens
MDLWNWDEASPQEVPPGNKLAGLGRLPRLPQRVWGGCPGGASADPNPLSPAEGAKLGFCFPDLALQGDTPTATAETCWKGTSSSLASFPQLDWGSALLHPEVPWGAEPDSQALPWSGNWTDMACTAWDSWSGASQTLGPAPLGPGPIPAAGSEGAAGQNCVPVAGEATSWSRAQAAGSNTSWDCSVGPDGDTYWGSGLGGEPRTDCTISWGGPAGPDCTTSWNPGLHAGGTTSLKRYQSSALTVCSEPSPQSDRASLARCPKTNHRGPIQLWQFLLELLHDGARSSCIRWTGNSREFQLCDPKEVARLWGERKRKPGMNYEKLSRGLRYYYRRDIVRKSGGRKYTYRFGGRVPSLAYPDCAGGGRGAETQ

SEQ ID NO: 62734 - protein, 514 aa, Homo sapiens
MEDSEFLAYVELLDEVEQGSVRAKASSVSLHAERTWMEKMKVEDLNVCEPASPAPEAPATSLLNDLKYSPSEEEEVTYTVINQFQQKFGAAILHIKKQNVLSVAAEGANVCRHGKLCWLQVATNCRVYLFDIFLLGSRAFHNGLQMILEDKRILKVIHDCRWLSDCLSHQYGILLNNVFDTQVADVLQFSMETGGYLPNCITTLQESLIKHLQVAPKYLSFLEKRQKLIQENPEVWFIRPVSPSLLKILALEATYLLPLRLALLDEMMSDLTTLVDGYLNTYREGSADRLGGTEPTCMELPEELLQLKDFQKQRREKAAREYRVNAQGLLIRTVLQPKKLVTETAGKEEKVKGFLFGKNFRIDKAPSFTSQDFHGDVNLLKEESLNKQATNPQHLPPTEEGETSEDSSNKLICTKSKGSEDQRITQKEHFMTPKHEFQASLSLKEETEQLLMVENKEDLKCTKQAVSMSSFPQETRVSPSDTFYPIRKTVVSTLPPCPALEKIDSWISPFLNLP

SEQ ID NO: 62735 - protein, 169 aa, Homo sapiens
MSERVERNWSTGGWLLALCLAWLWTHLTLAALQPPTATVLVQQGTCEVIAAHRCCNRNRIEERSQTVKCSCFSGQVAGTTRAKPSCVDDLLLAAHCARRDPRAALRLLLPQPPSSCRDGGVRWSPACRGRSVRCSRTCRDGAAAVDTKSKPPRSHDSSWGSRPGQERLD

SEQ ID NO: 62736 - protein, 133 aa, Homo sapiens
MSERVERNWSTGGWLLALCLAWLWTHLTLAALQPPTATVLVQQGTCEVIAAHRCCNRNRIEERSQTVKCSCFSGQVAGTTRAKPSCVDASIVLQRWWCQMEPCLPGEECKVLPDLSGWSCSSGHKVKTTKVTR

SEQ ID NO: 62737 - protein, 105 aa, Homo sapiens
MAKMFDLRTKIMIGIGSSLLVAAMVLLSVVFCLYFKVAKALKAAKDPDAVAVKNHNPDKVCWATNSQAKATTMESCPSLQCCEGCRMHASSDSLPPCCCDINEGL

SEQ ID NO: 62738 - protein, 389 aa, Homo sapiens
MSEIRFTNLTWDQVITLDQVLDEVIPIHGKGNFPTMEVKPKDIIHVVKDQLIGQGIIVKDARLNGSVASYILASHNGISYKDLDVIFGVELPGNEEFQVVKDAVLDCLLDFLPKDVKKEKLSPDIMKDAYVQKLVKVCNGHDCWSLISLSNNTGKNLELKFVSSLRRQFEFSVDSFQIVLDPMLDFYSDKNAKLTKESYPVVVAESMYGDFQEAMTHLQHKLICTRKPEEIRGGGLLKYCSLLVHGFKPACMSEIKNLERYMCSRFFIDFPHIEEQQKKIESYLHNHFIGEGMTKYDYLMTLHGVVNESTVCLMSYERRQILHLITMMALKVLGELNILPNTQKVTCFYQPAPYFAAEARYPIYVIPEPPPVSFQPYHPLHFRGSNGMS

SEQ ID NO: 62739 - protein, 645 aa, Homo sapiens
MGDRRPQDRPRSQGMDSKPWYCDKPPSKYFAKRKHRRLRFPPVDTQNWVFVTEGMDDFRYACQSPEDTLVCRRDEFLLPKISLRGPQADRKSRKKKLLKKAALFSELSPVQPARKAFVEEVEAQLMTKHPLAMYPNLGKDMPPDLLLQVLKQLDPERKLEDAWARCEAREKTTEVPTESGKYPCGESCPRPPETPVSRLRPQLPKTPVSSRRPEPPKTRAPSLRPEPPKTRVSSLHPEPPETRASHLRVDPPETGVSHLCPEPPKTLVSSVHPEPPDTGASHLCPEPPETRVSHLHPESPETGVSHLRPEPSKTQVSSLCPEPPEAGVSHLCLEPPNTHRVSSFLLQVLKLDSEKKLEDARARCEGQEMTTEELTKPGKYHFWESCPRPFESRMPHLRLVLPITRRMASLCLKPPKTRRVSSLCPEPTKTGASHLKELFQEDTPSTMECVSDSLQRRHTSRKLRDFKWAGDLGVNEESISSLFDFTPECRTTDQDQKIKKANECASRLMYGMELDDMDEVEFLRIKYWDRRRRAAPHSYSAQRGRIRYGPWYFEPKLGKKLRSDEPLIDPKPVLEKPDEPDILDGLYGPIAFKDFILSKGYRMPGVIEKLFAKKGWTYDSVKTPIQRAVQVYKYKEDVTDASKED

SEQ ID NO: 62740 - protein, 392 aa, Homo sapiens
MITLITEQLQKQTLDELKCTRFSISLPLPDHADISNCGNSFQLVSEGASWRGLPHCSCAEFQDSLNFSYHPSGLSLHLRPPSRGNSPKEQPFSQVLRPEPPDPEKLPVPPAPPSKRHCRSLSVPVDLSRWQPVWRPAPSKLWTPIKHRGSGGGGGPQVPHQSPPKRVSSLRFLQAPSASSQCAPAHRPYSPPFFSLALAQDSSRPCAASPQSGSWESDAESLSPCPPQRRFSLSPSLGPQASRFLPSARSSPASSPELPWRPRGLRNLPRSRSQPCDLDARKTGVKRRHEEDPRRLRPSLDFDKMNQKPYSGGLCLQETAREGSSISPPWFMACSPPPLSASCSPTGGSSQVLSESEEEEEGAVRWGRQALSKRTLCQRDFGDLDLNLIEEN

SEQ ID NO: 62741 - protein, 224 aa, Homo sapiens
MASTAGYIVSTSCKHIIDDQHWLSSAYTQFAVPYFIYDIYAMFLCHWHKHQVKGHGGDDGAARAPGSTWAIARGYLHKEFLMVLHHAAMVLVCFPLSVVWRQGKGDFFLGCMLMAEVSTPFVCLGKILIQYKQQHTLLHKVNGALMLLSFLCCRVLLFPYLYWAYGRHAGLPLLAVPLAIPAHVNLGAALLLAPQLYWFFLICRGACRLFWPRSRPPPACQAQD

SEQ ID NO: 62742 - protein, 594 aa, Homo sapiens
MNADFLLPYYTAQSGSSMSMFDTTMGKLQRQLYKGEYDIFKYAPIFESDFIQITKRGEVIDVHNRVRMVTMGIARTSPILPLPDVMLLARPATGCEEYAGHGQATKRKKRKAAKNLELTRLLPLRFVRISVQDHEKQQLRLKFATGRSCYLQLCPALDTRDDLFAYWEKLIYLLRPPMESNSSTCGIPAEDMMWMPVFQEDRRSLGAVNLQGKGDQDQVSIQSLHMVSEVCGATSAAYAGGEGLQNDFNKPTNVLNASIPKTSTELAEEPATGGIKEAAAAGAAAGAATGTVAGALSVAAANSAPGQVSAAIAGAATIDAGGNKGNMALAGTASMAPNSTKVAVAGAAGKSSEHVSSASMSLSREGSVSLAIAGVVLTSRTAAEADMDAAAGPPVSTRQSKSSLSGQHGRERTQASAEGCKEGRERREKDRALGRSSHRRRTGESRHKTRGDKIAQKSSSRSSFSHRANRDDKKEKGCGNPGSSRHRDSHKGVSHTPISKESRTSHKSGRSLWTTSSGSSKGLGRVSSFLRNVRANLTTKVVGTPHGRDVDVMAKMAERSTNVAIAETAEGGQGLEMVGSMTPDIMETVTFEAH

SEQ ID NO: 62743 - protein, 241 aa, Homo sapiens
MEDCCMLPYYTAQSSPAMGMFNTSMGKLQRQLYKGEYTIFRYAPMFESDFIQISKRGEVIDVHNRARMVTMGIVRTSPCLTLPDVMLLARPAAVCDNARCGPATQKRESPPAEILELTRLLPLMFVKITIHNSVKKQLHLKLATGRSFYLQLCPPSDASEDLFVHWENLVYILRPPVEAYSDTRAILAGNTLDSSVLEEVQRSPVGYAMKFCEEKEQFRISRLHMNAEMFGSTYCDYTIEI

SEQ ID NO: 62744 - protein, 263 aa, Homo sapiens
MGCIQSIGGKARVFREGITVIDVKASIDPVPTSIDESSSVVLRYRTPHFRASAQVVMPPIPKKETWVVGWIQACSHMEFYNQYGEQGMSSWELPDLQEGKIQAISDSDGVNYPWYGNTTETCTIVGPTKRDSKFIISMNDNFYPSVTWAVPVSESNVAKLTNIYRDQSFTTWLVATNTSTNDMIILQTLHWRMQLSIEVNPNRPLGQRARLREPIAQDQPKILSKNEPIPPSALVKPNANDAQVLMWRPKYGQPLVVIPPKHR

SEQ ID NO: 62745 - protein, 414 aa, Homo sapiens
MSSDTNVNKSASPTATAEEQPVEPDGPLPGSDNNQEKKVRLSPAKMSTKNSTDLVEYVDKSHAFLPIIPNTQRGQLEDRLNNQARTIAFLLEQAFRIKEDISACLQGTHGFRKEESLARKLLESHIQTITSIVKKLSQNIEILEDQIRARDQAATGTNFAVHEINIKHLQGVGDLRGRVARCDSSIVKLSGDIHLFRQEHRQIEKAIQEFVPALETLSKNLDMKVMQLLGKIETASSEQTSNLKMVQGDYRHEMNLLEFKFHSLSSNLYEEVENNKKWTENQFLKYRKDHLGHINECLKVLQEKLEKSENKMEEKLLQLSSKVENFINTQKQETQLSKVKHMENKLSKKMEQMEKQIWGELETMQNEYQSGFKSIHDSLSSLQQIQKTKMDLEKYKVQKDLKKLQRKIVELQEV

SEQ ID NO: 62746 - protein, 186 aa, Homo sapiens
MAAWGKKHAGKDPVRDECEERNRFTETREEDVTDEHGEREPFAETDEHTGANTKKPEDTAEDLTAKRKRMKMDKTCSKTKNKSKHALRKKQLKRQKRDYIHSLKLLNVLEEYITDEQKEEEEEEGEEEELIRIFQEQQKKWQQYRSVRRERLKEMKLLRDQFVKALEDFEDLCDRVFSDEDSELDN

SEQ ID NO: 62747 - protein, 345 aa, Homo sapiens
MEPQRIMPPSKPHPPVVGKVTHHSIELYWDLEKKAKRQGPQEQWFRFSIEEEDPKMHTYGIIYTGYATKHVVEGLEPRTLYRFRLKVTSPSGECEYSPLVSVSTTREPISSEHLHRAVSVNDEDLLVRILQGGRVKVDVPNKFGFTALMVAAQKGYTRLVKILVSNGTDVNLKNGSGKDSLMLACYAGHLDVVKYLRRHGASWQARDLGGCTALHWAADGGHCSVIEWMIKDGCEVDVVDTGSGWTPLMRVSAVSGNQRVASLLIDAGANVNVKDRNGKTPLMVAVLNNHEELVQLLLDKGADASVKNEFGKGVLEMARVFDRQSVVSLLEERKKKQRPKKSCVC

SEQ ID NO: 62748 - protein, 183 aa, Homo sapiens
MAGGPPNTKAEMEMSLAEELNHGRQGENQEHLVIAEMMELGSRSRGASQKKQKLEQKAAGSASAKRVWNMTATRPKKMGSQLPKPRMLRESGHGDAHLQEYAGNFQGIRFHYDRNPGTDAVAQTSLEEFNVLEMEVMRRQLYAVNRRLRALEEQGATWRHRETLIIAVLVSASIANLWLWMNQ

SEQ ID NO: 62749 - protein, 318 aa, Homo sapiens
MGEKAVPLLRRRRVKRSCPSCGSELGVEEKRGKGNPISIQLFPPELVEHIISFLPVRDLVALGQTCRYFHEVCDGEGVWRRICRRLSPRLQDQDTKGLYFQAFGGRRRCLSKSVAPLLAHGYRRFLPTKDHVFILDYVGTLFFLKNALVSTLGQMQWKRACRYVVLCRGAKDFASDPRCDTVYRKYLYVLATREPQEVVGTTSSRACDCVEVYLQSSGQRVFKMTFHHSMTFKQIVLVGQETQRALLLLTEEGKIYSLVVNETQLDQPRSYTVQLALRKVSHYLPHLRVACMTSNQSSTLYVTDPILCSWLQPPWPGG

SEQ ID NO: 62750 - protein, 580 aa, Homo sapiens
MGEKAVPLLRRRRVKRSCPSCGSELGVEEKRGKGNPISIQLFPPELVEHIISFLPVRDLVALGQTCRYFHEVCDGEGVWRRICRRLSPRLQDQGSGVRPWKRAAILNYTKGLYFQAFGGRRRCLSKSVAPLLAHGYRRFLPTKDHVFILDYVGTLFFLKNALVSTLGQMQWKRACRYVVLCRGAKDFASDPRCDTVYRKYLYVLATREPQEVVGTTSSRACDCVEVYLQSSGQRVFKMTFHHSMTFKQIVLVGQETQRALLLLTEEGKIYSLVVNETQLDQPRSYTVQLALRKVSHYLPHLRVACMTSNQSSTLYVTDQGGVYFEVHTPGVYRDLFGTLQAFDPLDQQMPLALSLPAKILFCALGYNHLGLVDEFGRIFMQGNNRYGQLGTGDKMDRGEPTQVCYLQRPITLWCGLNHSLVLSQSSEFSKELLGCGCGAGGRLPGWPKGSASFVKLQVKVPLCACALCATRECLYILSSHDIEQHAPYRHLPASRVVGTPEPSLGARAPQDPGGMAQACEEYLSQIHSCQTLQDRTEKMKEIVGWMPLMAAQKDFFWEALDMLQRAEGGGGGVGPPAPET

SEQ ID NO: 62751 - protein, 442 aa, Homo sapiens
MDEESELIQPQDQSCWAFLPDLCLCRVFWWLGDRDRSRAALVCRKWNQMMYSAELWRYRTITFSGRPSRVHASEVESAVWYVKKFGRYLEHLEVKFMNPYNAVLTKKFQVTMRGLLSCLSKSNNRLKSLSIQYLELDRLVWRNSIRSSFISSLSFFLKKMGKRLDYLNLKGARLTVEQGCQILDSLSYMRNENVISELNIEDYFSHHLAVYNSPQFKKTMSTFHNLVSLNLNYNCISDELLENLCENASTLRTINIKCHVHDPHGQVIWGMSWAKLARQATNLKVNFFFERIMKYERLARILLQEIPIRSISLRSCYFSDPDCSMRPTLIDLLPTFRHTLQKLTCEFNNNHESLDEELHLLIISCRKLFYFKIWAFLDVSFVERILKSQKERQCALRVFKARIYTNRYETNEEDKTLQEIYRKYRKLIESELSYFVIVYSVM

SEQ ID NO: 62752 - protein, 461 aa, Homo sapiens
MSRINKNVVLALLTLTSSAFLLFQLYYYKHYLSTKNGAGLSKSKGSRIGFDSTQWRAVKKFIMLTSNQNVPVFLIDPLILELINKNFEQVKNTSHGSTSQCKFFCVPRDFTAFALQYHLWKNEEGWFRIAENMGFQCLKIESKDPRLDGIDSLSGTEIPLHYICKLATHAIHLVVFHERSGNYLWHGHLRLKEHIDRKFVPFQKLQFGRYPGAFDRPELQQVTVDGLEVLIPKDPMHFVEEVPHSRFIECRYKEARAFFQQYLDDNTVEAVAFRKSAKELLQLAAKTLNKLGVPFWLSSGTCLGWYRQCNIIPYSKDVDLGIFIQDYKSDIILAFQDAGLPLKHKFGKVEDSLELSFQGKDDVKLDVFFFYEETDHMWNGGTQAKTGKKFKYLFPKFTLCWTEFVDMKVHVPCETLEYIEANYGKTWKIPVKTWDWKRSPPNVQPNGIWPISEWDEVIQLY

SEQ ID NO: 62753 - protein, 500 aa, Homo sapiens
MKLSEKSVAEGIPGAVPPAEIYVEEDLAQQDKISALQKGYSKVLCQTLSERNSEITSLKNEGENLKRDNAITSGMVSSLQKDILAKDEQVQQLKEEVSHLKSQNKDKDHQLEALGSRCSVLKEELKQEDAHRELREAQEKELKLCKTQIQDMEKEMKKLRAELRKSCTEQSVISRTLREKSKLEHFRSQVIKATYGRAKPFRDKPVTDQQLIEKITQVTEDNINFQQKKWTLQKETQLSNSKQEETTENIEKLRTSLDSCQACMKISCCSHDLKKEVDLLQHLQVSPPVSGLQKVVLDVLRHALSWLEEVEQLLRDLGILPSSPNKGFSLYLIYLLEHYKKLMSQAQELQIKFNSSQETQQSLLQEKLREHLAEKEKLNEERLEQEEKLKAKIRQLTEEKAALEEYITQERNRAKETLEEERKRMQELESLLAQQKKALAKSITQWKVLEKPRPTRPHVILYQKLEQPPWGSADTSSRPKDSGVEGQEGLGEPSLRITEL

SEQ ID NO: 62754 - protein, 1101 aa, Homo sapiens
MILRPPRPCGTISALQKGYSKVLCQTLSERNSEITSLKNEGENLKRDNAITSGMVSSLQKDILAKDEQVQQLKEEVSHLKSQNKDKDHQLEALGSRCSVLKEELKQEDAHRELREAQEKELKLCKTQIQDMEKEMKKLRAELRKSCTEQSVISRTLREKSKVEEKLQEDSRRKLLQLQEMGNRESVIKINLERAVGQLEHFRSQVIKATYGRAKPFRDKPVTDQQLIEKITQVTEDNINFQQKKWTLQKETQLSNSKQEETTENIEKLRTSLDSCQACMKISCCSHDLKKEVDLLQHLQVSPPVSGLQKVVLDVLRHALSWLEEVEQLLRDLGILPSSPNKGFSLYLIYLLEHYKKLMSQAQELQIKFNSSQETQQSLLQEKLREHLAEKEKLNEERLEQEEKLKAKIRQLTEEKAALEEYITQERNRAKETLEEERKRMQELESLLAQQKKALAKSITQEKNRVKEALEEEQTRVQELEERLARQKEISESNIAYEKRKAKEAMEKEKKKVQDLENRLTKQKEELELKEQKEDVLNNKLSDALAMVEETQKTKATESLKAESLALKLNETLAELETTKTKMIMVEERLILQQKMVKALQDEQESQRHGFEEEIMEYKEQIKQHAQTIVSLEEKLQKVTQHHKKIEGEIATLKDNDPAPKEERPQDPLVAPMTESSAKDMAYEHLIDDLLAAQKEILSQQEVIMKLRKDLTEAHSRMSDLRGELNEKQKMELEQNVVLVQQQSKELSVLKEKMAQMSSLVEKKDRELKALEEALRASQEKHRLQLNTEKEQKPRKKTQTCDTSVQIEPVHTEAFSSSQEQQSFSDLGVRCKGSRHEEVIQRQKKALSELRARIKELEKARSPDHKDHQNESFLDLKNLRMENNVQKILLDAKPDLPTLSRIEILAPQNGLCNARFGSAMEKSGKMDVAEALELSEKLYLDMSKTLGSLMNIKNMSGHVSMKYLSRQEREKVNQLRQRDLDLVFDKITQLKNQLGRKEELLRGYEKDVEQLRRSKVSIEMYQSQVAKLEDDIYKEAEEKALLKEALERMEHQLCQEKRINRAIRQQKESVEEHELRNAKESTPCNCAFKEKDRQALPHLPAV

SEQ ID NO: 62755 - protein, 500 aa, Homo sapiens; identical to SEQ ID NO: 62753

SEQ ID NO: 62756 - protein, 1101 aa, Homo sapiens
MILRPPRPCGTISALQKGYSKVLCQTLSERNSEITSLKNEGENLKRDNAITSGMVSSLQKDILAKDEQVQQLKEEVSHLKSQNKDKDHQLEALGSRCSVLKEELKQEDAHRELREAQEKELKLCKTQIQDMEKEMKKLRAELRKSCTEQSVISRTLREKSKVEEKLQEDSRRKLLQLQEMGNRESVIKINLERAVGQLEHFRSQVIKATYGRAKPFRDKPVTDQQLIEKITQVTEDNINFQQKKWTLQKETQLSNSKQEETTENIEKLRTSLDSCQACMKISCCSHDLKKEVDLLQHLQVSPPVSGLQKVVLDVLRHALSWLEEVEQLLRDLGILPSSPNKGFSLYLIYLLEHYKKLMSQAQELQIKFNSSQETQQSLLQEKLREHLAEKEKLNEERLEQEEKLKAKIRQLTEEKAALEEYITQERNRAKETLEEERKRMQELESLLAQQKKALAKSITQEKNRVKEALEEEQTRVQELEERLARQKEISESNIAYEKRKAKEAMEKEKKKVQDLENRLTKQKEELELKEQKEDVLNNKLSDALAMVEETQKTKATESLKAESLALKLNETLAELETTKTKMIMVEERLILQQKMVKALQDEQESQRHGFEEEIMEYKEQIKQHAQTIVSLEEKLQKVTQHHKKIEGEIATLKDNDPAPKEERPQDPLVAPMTESSAKDMAYEHLIDDLLAAQKEILSQQEVIMKLRKDLTEAHSRMSDLRGELNEKQKMELEQNVVLVQQQSKELSVLKEKMAQMSSLVEKKDRELKALEEALRASQEKHRLQLNTEKEQKPRKKTQTCDTSVQIEPVHTEAFSSSQEQQSFSDLGVRCKGSRHEEVIQRQKKALSELRARIKELEKARSPDHKDHQNESFLDLKNLRMENNVQKILLDAKPDLPTLSRIEILAPQNGLCNARFGSAMEKSGKMDVAEALELSEKLYLDMSKTLGSLMNIKNMSGHVSMKYLSRQEREKVNQLRQRDLDLVFDKITQLKNQLGRKEELLRGYEKDVEQLRRSKVSVEMYQSQVAKLEDDIYKEAEEKALLKEALERMEHQLCQEKRINRAIRQQKESVEEHELRNAKESTPCNCAFKEKDRQPLPHLPAV

SEQ ID NO: 62757 - protein, 632 aa, Homo sapiens
MKAIKKSLTEEEYLYLDFSHQTEGCIFPLHTSVTLFLLSYCDCKIFKICLVVTKEVSRDSSLLRDDLIQDVEIQIISRQELPPIVQNCCLPAVVERSDNFCRAGLAVVLRHIIQKSYEADPLKKELLELLGFKKTCLKACAEVSQWTRLCELTIPLAIENFLRESSDQPPTIPVEILQLEKKLSEPVRVHNDDKLRRQKLKQQKADGVGPPLTKGKAKSKVHTQETSEGLDSSSKSLELKVAFSKLTVQEEPATTNREPSHIRKAKASDLPPLEHVFAEGLYFTLADIVLLPCIHHFLVIISRKFSEKLVEFPLLASWYQRIQEVPGVKTASKCGIQFLHLPKLLTTSTEQHPNLCEVPGVEEQSDPLFIGGPRPTMAKLMEKGIEVMFSPHPCPTWTLDWNVLPAAVSPKEGKMSSDRALRKQQQLNNLVYVVTNQAKPGDRIVDFCSGGGHVGIVLAHMLPSCQVTLIENKELSLIRAKKRSDELGLSNIWFIQANMEYFTGMFNIGVALHACGVATDMVIEHCIKTRASFVTCPCCYGFIQNTSKFNFPKSEQFKKTLSYKEHMILCRFADQTAVQLPPQRRLIGKQCMCLVDLDRARAAEECGYSVQVISMEPESCSPKNNMIVGVPI

SEQ ID NO: 62758 - protein, 781 aa, Homo sapiens
MHDECTPQQTMSSIQDTKAADIAARGELNVIETATVSPTNGEESHYTNQVQLEKNKTHMSSALVEKENNTSLNGRVLGQEESQNKMFPDNAENEDDKQIEHMTVENINGNREETHGIIQTTETEIQETSESPREEMTTSSIICDISKKYINSTLPNDSENIKHKNNIMEKEYLDVLSDVTGPQVSCYITAPSYVLQQLECRIINHMSSLIVGDNEELVSNVITIECSDKEKRVPFPIGIAIPFTARYRGNYRDIMVKVCDINLQSSYLNPNSLEGMKGGYKGTCASVKVYKLGIFSVVSCLKKESFTVTKKGLALKSSMDSRISLNYPPGVFTSPVLVQLKIQPVDPALVAHLKAQQDTFYSVQSTSPLIHIQHPSTYPFQKPVTLFLPCSPYLDKNNLGSEIDHKRRASATINRITPSYFNRTKIASIRKPRKNASECLKLLGFRSQDSGWCGLDDVVKTIQSGLVSVELYEHLERFIVLHLSSTMDNSHLVTFVKSLEEAMLSTTACIVLSHQKDNPHRIAVLVVPSKDLSQVLKDLHLEGFGGPPEPSRHFQVREGEQLLLRFTGNIFASSNGKDYGKDYTLIFHLQRKPRLELQIKEVDEFGNYSCPHYKGTIVVYKVPKGKIVPNLNQSLVINENHSQLPICKLPLKLPKHKKLINRPQSTKRVSKDPVEALWDNLLHWLAEELSEENAESLSSTLPLRRSTIQLIKLKNPDDLTEQIHEFLCFWKKSLPTFTDKLRLLARHLRKIGRSDLAEELKFKWENKVFTEPQQCFDVAPE

SEQ ID NO: 62759 - protein, 781 aa, Homo sapiens
MHDECTPQQTMSSIQDTKAADIAARGELNVIETATVSPTNGEESHYTNQVQLEKNKTHMSSALVEKENNTSLNGRVLGQEESQNKMFPDNAENEDDKQIEHMTVENINGNREETHGIIQTTETEIQETSESPREEMTTSSIICDISKKYINSTLPNDSENIKHKNNIMEKEYLDVLSDDTGPQVSCYITAPSYVLQQLECRIINHMSSLIVGDNEELVSNVITIECSDKEKRVPFPIGIAIPFTARYRGNYRDIMVKVCDINLQSSYLNPNSLEGMKGGYKGTCASVKVYKLGIFSVVSCLKKESFTVTKKGLALKSSMDSRISLNYPPGVFTSPVLVQLKIQPVDPALVAHLKAQQDTFYSVQSTSPLIHIQHPSTYPFQKPVTLFLPCSPYLDKNNLGSEIDHKRRASATINRITPSYFNRTKIASIRKPRKNASECLKLLGFRSQDSGWCGLDDVVKTIQSGLVSVELYEHLERFIVLHLSSTMDNSHLVTFVKSLEEAMLSTTACIVLSHQKDNPHRIAVLVVPSKDLSQVLKDLHLEGFGGPPEPSRHFQVREGEQLLLRFTGNIFASSNGKDYGKDYTLIFHLQRKPRLELQIKEVDEFGNYSCPHYKGTIVVYKVPKGKIVPNLNQSLVINENHSQLPICKLPLKLPKHKKLINRPQSTKRVSKDPVEALWDNLLHWLAEELSEENAESLSSTLPLRRSTIQLIKLKNPDDLTEQIHEFLCFWKKSLPTFTDKLRLLARHLRKIGRSDLAEELKFKWENKVFTEPQQCFDVAPE

SEQ ID NO: 62760 - protein, 91 aa, Homo sapiens [sequence omitted]

SEQ ID NO: 62761 - protein, 91 aa, Homo sapiens [sequence omitted]

SEQ ID NO: 62762 - protein, 1501 aa, Homo sapiens
MCKMAIIPDWLRSHPHTRKFTHSRPHSSPCRVYSRNGSPNKFRSSSTTAVANPTLSSLDVKRILFQKITDRGDELQKAFQLLDTGQNLTVSKSELRRIITDFLMPLTREQFQDVLAQIPLSTSGTVPYLAFLSRFGGIDLYINGIKRGGGNEMNCCRTLRELEIQVGEKVFKNIKTVMKAFELIDVNKTGLVRPQELRRVLETFCMKLRDEEYEKFSKHYNIHKDTAVDYNVFLKNLSINNDLNLRYCMGNQEVSLENQQAKNSKKERLLGSASSEDIWRNYSLDEIERNFCLQLSKSYEKVEKALSAGDPCKGGYVSFNYLKIVLDTFVYQIPRRIFIQLMKRFGLKATTKINWKQFLTSFHEPQGLQVSSKGPLTKRNSINSRNESHKENIITKLFRHTEDHSASLKKALLIINTKPDGPITREEFRYILNCMAVKLSDSEFKELMQMLDPGDTGVVNTSMFIDLIEENCRMRKTSPCTDAKTPFLLAWDSVEEIVHDTITRNLQAFYNMLRSYDLGDTGRIGRNNFKKIMHVFCPFLTNAHFIKLCSKIQDIGSGRILYKKLLACIGIDGPPTVSPVLVPKDQLLSEHLQKDEQQQPDLSERTKLTEDKTTLTKKMTTEEVIEKFKKCIQQQDPAFKKRFLDFSKEPNGKINVHDFKKVLEDTGMPMDDDQYALLTTKIGFEKEGMSYLDFAAGFEDPPMRGPETTPPQPPTPSKSYVNSHFITAEECLKLFPRRLKESFRDPYSAFFKTDADRDGIINMHDLHRLLLHLLLNLKDDEFERFLGLLGLRLSVTLNFREFQNLCEKRPWRTDEAPQRLIRPKQKVADSELACEQAHQYLVTKAKNRWSDLSKNFLETDNEGNGILRRRDIKNALYGFDIPLTPREFEKLWARYDTEGKGHITYQEFLQKLGINYSPAVHRPCAEDYFNFMGHFTKPQQLQEEMKELQQSTEKAVAARDKLMDRHQDISKAFTKTDQSKTNYISICKMQEVLEECGCSLTEGELTHLLNSWGVSRHDNAINYLDFLRAVENSKSTGAQPKEKEESMPINFATLNPQEAVRKIQEVVESSQLALSTAFSALDKEDTGFVKATEFGQVLKDFCYKLTDNQYHYFLRKLRIHLTPYINWKYFLQNFSCFLEETADEWAEKMPKGPPPTSPKATADRDILARLHKAVTSHYHAITQEFENFDTMKTNTISREEFRAICNRRVQILTDEQFDRLWNEMPVNAKGRLKYPDFLSRFSSETAATPMATGDSAVAQRGSSVPDVSEGTRSALSLPTQELRPGSKSQSHPCTPASTTVIPGTPPLQNCDPIESRLRKRIQGCWRQLLKECKEKDVARQGDINASDFLALVEKFNLDISKEECQQLIIKYDLKSNGKFAYCDFIQSCVLLLKAKESSLMHRMKIQNAHKMKEAGAETPSFYSALLRIQPKIVHCWRPMRRTFKSYDEAGTGLLSVADFRTVLRQYSINLSEEEFFHILEYYDKTLSSKISYNDFLRAFLQ

SEQ ID NO: 62763 - protein, 1349 aa, Homo sapiens
MNCCRTLRELEIQVGEKVFKNIKTVMKAFELIDVNKTGLVRPQELRRVLETFCMKLRDEEYEKFSKHYNIHKDTAVDYNVFLKNLSINNDLNLRYCMGNQEVSLENQQAKNSKKERLLGSASSEDIWRNYSLDEIERNFCLQLSKSYEKVEKALSAGDPCKGGYVSFNYLKIVLDTFVYQIPRRIFIQLMKRFGLKATTKINWKQFLTSFHEPQGLQVSSKGPLTKRNSINSRNESHKENIITKLFRHTEDHSASLKKALLIINTKPDGPITREEFRYILNCMAVKLSDSEFKELMQMLDPGDTGVVNTSMFIDLIEENCRMRKTSPCTDAKTPFLLAWDSVEEIVHDTITRNLQAFYNMLRSYDLGDTGRIGRNNFKKIMHVFCPFLTNAHFIKLCSKIQDIGSGRILYKKLLACIGIDGPPTVSPVLVPKDQLLSEHLQKDEQQQPDLSERTKLTEDKTTLTKKMTTEEVIEKFKKCIQQQDPAFKKRFLDFSKEPNGKINVHDFKKVLEDTGMPMDDDQYALLTTKIGFEKEGMSYLDFAAGFEDPPMRGPETTPPQPPTPSKSYVNSHFITAEECLKLFPRRLKESFRDPYSAFFKTDADRDGIINMHDLHRLLLHLLLNLKDDEFERFLGLLGLRLSVTLNFREFQNLCEKRPWRTDEAPQRLIRPKQKVADSELACEQAHQYLVTKAKNRWSDLSKNFLETDNEGNGILRRRDIKNALYGFDIPLTPREFEKLWARYDTEGKGHITYQEFLQKLGINYSPAVHRPCAEDYFNFMGHFTKPQQLQEEMKELQQSTEKAVAARDKLMDRHQDISKAFTKTDQSKTNYISICKMQEVLEECGCSLTEGELTHLLNSWGVSRHDNAINYLDFLRAVENSKSTGAQPKEKEESMPINFATLNPQEAVRKIQEVVESSQLALSTAFSALDKEDTGFVKATEFGQVLKDFCYKLTDNQYHYFLRKLRIHLTPYINWKYFLQNFSCFLEETADEWAEKMPKGPPPTSPKATADRDILARLHKAVTSHYHAITQEFENFDTMKTNTISREEFRAICNRRVQILTDEQFDRLWNEMPVNAKGRLKYPDFLSRFSSETAATPMATGDSAVAQRGSSVPDVSEGTRSALSLPTQELRPGSKSQSHPCTPASTTVIPGTPPLQNCDPIESRLRKRIQGCWRQLLKECKEKDVARQGDINASDFLALVEKFNLDISKEECQQLIIKYDLKSNGKFAYCDFIQSCVLLLKAKESSLMHRMKIQNAHKMKEAGAETPSFYSALLRIQPKIVHCWRPMRRTFKSYDEAGTGLLSVADFRTVLRQYSINLSEEEFFHILEYYDKTLSSKISYNDFLRAFLQ

SEQ ID NO: 62764 - protein, 358 aa, Homo sapiens
MDPLRRSPSPCLSSQPSSPSTPPCEMLGPVGIEAVLDQLKIKAMKMGFEFNIMVVGQSGLGKSTMVNTLFKSKVWKSNPPGLGVPTPQTLQLHSLTHVIEEKGVKLKLTVTDTPGFGDQINNDNCWDPILGYINEQYEQYLQEEILITRQRHIPDTRVHCCVYFVPPTGHCLRPLDIEFLQRLCRTVNVVPVIARADSLTMEEREAFRRRIQQNLRTHCIDVYPQMCFDEDINDKILNSKLRDRIPFAVVGADQEHLMNGRCVLGRKTKWGIIEVENMAHCEFPLLRDLLIRSHLQDLKDITHNIHYENYRVIRLNESHLLPRGPGWVNLAPASPGQLTTPRTFKVCRGAHDDSDDEF

SEQ ID NO: 62765 - protein, 384 aa, Homo sapiens
MTSTGISASVCHSKPRSQLTSKQMSCIPLVGVERVKRKLAKEKEKAIDCMSHPKEKLAQSQKKVAQLIKEKMNTQANKELIRCVILSRIIFGDHHWKCARALANLAYGYLTLRGLPVQAKKHATSAKNTLLTWKANTTSNKEKEEILEALVKLYYTLAVAWLLQNRGREAYFNLQKAERNMKELKELYKGGVCELQVSENDLTLALGRASLAIHRLNLALAYFEKAIGDVIAAKGDRTSDLISLYEEAAQIEQLRRNHNQAIQYLQQAHSVCVPLFTEVSPKTAEMSALLAKAYAMSGEAQHRDAVEIYFIRSINAYRATLGSEDFETLSTTEEFCKWLVQNGEKQIFQKRRYKHDHKRHEKMFNPISHRGNANENHHTDTRVV

SEQ ID NO: 62766 - protein, 369 aa, Homo sapiens
MPPMLWLLLHFAAPALGFYFSISCPSGKQCQQALLSGNDILLYCNSSGAHWYYLFTQGKKGRLTSLTNISNMEIMPEGSLLIKDPLPSQTGLYHCWNKNGRQVVQYEIDFQDVTTLHITHKDLGQRPLQNETLHLGSKQLIFTWWEPWQDCNRCEEPGECKRLGYRYIEEPLEEAMPCWLYLGEVLVWSSRLRPELQVEACHVQCTNNTQLRVDYVIFDNFRLDEKTEFVWLDCPLGSMYRPVNWRANDTPLTWESQLSGQDFTTFLDPSTGGRQLQVFQPAVYKCFVQQELVAQFKPAASLETLEAQWRENDAQWREARKALRGRADSVLKGLKLVLLVVTVLALLGALLKCIHPSPGRRSTQVLVVK

SEQ ID NO: 62767 - protein, 328 aa, Homo sapiens
MAGHRPSNHFCPLPGSGGGGPRGPMPLRVDTLTWLSTQAAPGRVMVWPAVRPGICPGPDVWRIPLGPLPHEFRGWIAPCRPRLGASEAGDWLRRPSEGALPGPYIALRSIPKLPPPEDISGILKELQQLAKELRQKRLSLGYSQADVGIAVGALFGKVLSQTTICRFEAQQLSVANMWKLRPLLKKWLKEVEAENLLGLCKMEMILQQSGKWRRASRERRIGNSLEKFFQRCPKPTPQQISHIAGCLQLQKDVVRVWFYNRSKMGSRPTNDASPREIVGTAGPPCPGAPVCFHLGLGLPVDIPHYTRLYSAGVAHSSAPATTLGLLRF

SEQ ID NO: 62768 - protein, 134 aa, Homo sapiens
MASGKDTCPTLPKLTNNCSDESLYKSANKYEEIHLPRFSLKQGMIPRRYVMPWKENMIFRNVNLKQAEVCGIHTGPLEDSLFLNHSERLCHGEDRKVVFQKGPPEIKIADMPLHSPLSRYQSTVISHGFRRRLV

SEQ ID NO: 62769 - protein, 224 aa, Homo sapiens
MEVLAKEDTEAAIQSILYKENSVIKGNAFIEHYDPKEYDPFYMSKKDPNFLKVTIPPFHDPLKKAQYDKDNEKRTLLQCETGKIYSIKEFKEVEKVQLHSRFPQISNSRHFITPNEWLKLPTRYIESEFCRRRRNKGSSFLEREPLCYQEGNNPSAKEAISEGYFSSLSLSQEREEDQDGSCSVSQLEWIQAWLASASTSRTQAILPPQLPEWLGLRVPATMPG

SEQ ID NO: 62770 - protein, 425 aa, Homo sapiens
MMGKLPLGVVSPYVKMSSGGYTDPLKFYATSYCTAYGREDFKPRVGSHVGTGYKSNFQPVVSCQASLEALDNPARGEQAQDHFQSVASQSYRPLEVPDGKHPLPWSMRQTSSGYGREKPSAGPPTKEVRKVHFDTQEHGPQAITGLEPREVPLLRQQQGQDPLERENFRHGPRFMTSEYNSKYLRDPLDQPDFLQKKSIGAKEGSGFTKQSHQSPIVFQPPSQALPGDPALLPGQSVTKSDFLPKTHLHGDEFLPVLARGSKRETAFSRGNERILNPRVPPPCPEPSSVSHQQFQPLHRMQQTNVALLGRETVGKKEPTGFSLNNPMYVRSPCDPDRDQRYLTTYNQGYFENIPKGLDQEGWTRGGIQPQMPGGYALSQPVSCMEATPNPMESLRHLHPHVGRTLTSADPFYQNTPHSSRCVAHS

SEQ ID NO: 62771 - protein, 485 aa, Homo sapiens
MEFLGTTQTASYCGPKKCCGLTSLPAVQAPVIQECYQPYYLPGYRYLNSWRPSLFYKIANVQTCPDESTSTLRPPTILPTLRSALFSRYSPHDWDQSNQLQVRGAEASRLWASRLTDDSMRLLQDKDQLTHQMQEGTCRNLGQRLSDIGFWKSELSYELDRLLTENQNLETVKRRLECAANEVNCPLQVALECLYHREKRIGIDLVHDNVEKNLIREVDLLKCCQEQMRKLAQRIDIQMRDNRDAQHVLERDLEDKSSAQCIDEKCFNLRNTSDCISFFHGMEKIDGTISVPETWAKFSNDNIKHSQNMRANSIQLREEAEHLFETLSDQMWRQFTDTNLAFNARISEVTDVKNKLQTQLAKTLQEIFQAENTIMLLERSIMAKEGPLKVAQTRLECRTRRPNMELCRDIPQLKLVNEVFTIDDTLQTLKLRLRETQDTLQLLVMTKCRLEHELAIKANTLCIDKEKCMGMRKTFPCTPRLVGHT

SEQ ID NO: 62772 - protein, 164 aa, Homo sapiens
MCPPVSMRYEEEGMSYLYASWMYQLQHGDQLSICFTCFKAAFLDFKDLLESEDWEEDNWDPELMEHTEAESEQEGSSGMELSWGQSPGQPVQGGSEAWGPGTLAAAPEGLEDAGLDPHFVPTELWPQEAVPLGLGLEDADWTQGLPWRFEELLTCSHWPSFFPS

SEQ ID NO: 62773 - protein, 586 aa, Homo sapiens
MSANPRWDISRALGVAKLFHLVCGVREACVTPFLTLYLRQLGLAAPWVGTLMGTKHLIAAFWAPVCAFLAKSYRKRRALLIGSLLGSVGASLLMVLVPPVDKNRVHFPCNGSSGLTSTDALPGVTLPVNITSAQESASSHPAKRTAEVEMPGFRNPPGESDRETFRDLHVYLAPSVEGARTTSQALLHPVTSGLKDHPWEVTFEVVKTALPLLTGGKGPGNPANLSGTKGKAWAFDLSLEALRRTFILSLGSVAFWELLTAPLEQVADDSLYEFLDFVDATDRYRSLWVWRLLGMSAGVCGITALVGQLDCFLMTSGPRGVVHFYGYSVVSTLALLVSIAFPIPICQQWEPSYKRVKALSIVGGDPHLILLASTTVLVGAIVSTVQNFLFWHMKDHGSGELVMGFSVALSLLGEILLHPFKATLLRKLSRTGLVGLGLSCLAGQLLYYSFLWSWWSVLPIQILSAISNRALWWAVGASVEDLATPRMERALSALFRGHFYGSGCSLGSFVGGFVVMRFSLAVLYQACCVALLLWLALLLSIQRRLPRERKIKYSKLLSMEVSDTSDSEQGTEQDWLVKAMREEHSD

SEQ ID NO: 62774 - protein, 491 aa, Homo sapiens
MSRLDFLKASHFSLGPDLRLHEGTMRTTSHRDFAYPAATREPPSLQPPPALLFPMDPRWDREERVSEAHRAFPPPSTPPWELLQAQARERTLAMQAGNLHLHEDAHAGIGLSNAHAAYGWPELPARTRERIRGARLIFDRDSLPPGDRDKLRIPPTTHQALFPPHDARPQPRAPSCHLGGPNTLKWDYTRQDGTSYQRQFQALPGPPALRCKRASSGVELGDCKISYGSTCSEQKQAYRPQDLPEDRYDKAQATAHIHCVNIRPGDGLFRDRTTKAEHFYAREPEPFVLHHDQTPESHILKGNWCPGPGSLDTFMQYFYGQPPPPTQPPSRHVPHEKLQSHVTLGEPKLLKRFFKTTMGSDYCPSEWRQVQKAPNLHLQQSYLPRGTGEFDFLTMNQKMLKPHRTPPAPVTEEMLQRCKYSHMEPPLGGLRFFSTQYKDEFPFKYQGPAALRLKNPQEGFVPLGTPHQRGCREKIDPLVPQPPMYLCPSQQ

SEQ ID NO: 62775 - protein, 613 aa, Homo sapiens
MARCRHHSGYLADDEASHSMCSARVQLPKKPLVPEMRPACKPGRVPHPPSTCGSSALQGQRRNKRHPQPFGHFLDFLTESQVLDSLETVVEKATERMAAMKTEAGVPLVEVQDPVEVPSGGRRAHARPSLSTVHRHRVRPTLCTGHPNNYPSSSSSMSNCHSSLMAGCLGSHSRDSDLGAQGSLPPVRDKLLLEKNLKRLLQLEREGKGLSQSCSQRDSLLWDSLGSQTSFQWTQEQPLSWFSGLLGSSSGVPEASEPRPGEQEPIFRKREFNKEIKSLLSQLESLDLPGYCPLREPHRTLNFLADHRLFPALQSVVSQAVDKLRGAHCRDGRPLFPTSLEPTSDLPPLGSEPAKPTNGGQPYASPRPTVSSPKMLQRKRKDRGGSPSMSSAQVATRFKLKSPCSSSRFTKKKPLPSISSKSSMSHFSNRLYEELADFLTQQAASLVIRKYEFEKDLSKQLGFFSFPITHVLRDLSLGLKKVKGSRIHLSSETHRSCLLRKLEESKRARQASRLSTSHCSTETPSVQQEPATHTAQDQATEPCRSLYTNLPASRQLSPLEPKLYMSACTGMGSSPPKSKDMDNEGRDKAEIEDEDEDEFKDEDQDEDKDEDGV

SEQ ID NO: 62776 - protein, 417 aa, Homo sapiens
MPLRKRKSPERTASSKSPEISRSHVNSIKERTSSVGLPSVIPNSTRRVSFAPNLPSMKTSQDIGDSRISLKTLLNAIKTMEGRLEGKIEILASRPLINDESPNFLKQDSVKSILERSKEELSRTVKCRNAALKESQKLKEDLEAVEDRENKKVGNFQRQLAEAKEDNCKVTIMLENVLASHSKMQGALEKVQIELGRRDSEIAGLKKERDLNQQRVQKLEAEVDQWQARMLVMEDQHNSEIESLQKALGVAREDNRKLAMSLEQALQTNNHLQTKLDHIQEQLESKELERQNLETFKDRMTEESKVEAELHAERIEALRKQFQTERETTKKVAQREVAELKKALDEANFRSVEVSRTNRELRQKLAELEKILESNKEKIKNQKTQIKLHLSAKANNAQNIERMKVVWETSSHFLDTL

SEQ ID NO: 62777 - protein, 197 aa, Homo sapiens
MLPLLQLVPAKLLNSSCSLEKTLQCSCSFHGIPTPSVQWWMGGVPVGVDGMDGSLQVTSTMLGPWANSTISLTEEPEMGMRLLCEGKNQNGTHALSILLMSRKSSLAAQAFVKGLIQGAIYAGIVIALLFLCLLPLIVKHIRKKQAKKAAAIRAKKSSKVRASQELEMSLKPEEPGKPVVATFSESRILEKQDKRAS

SEQ ID NO: 62778 - protein, 185 aa, Homo sapiens [sequence omitted]

SEQ ID NO: 62779 - protein, 407 aa, Homo sapiens; identical to SEQ ID NO: 28766

SEQ ID NO: 62780 - protein, 221 aa, Homo sapiens
MSELISNGIQIYQLPTDEETAAQANSSVSGLLPFAVVGSTDEVKVGKRMVRGRHYPWGVLQVENENHCDFVKLRDMLLCTNMENLKEKTHTQHYECYRYQKLQKMGFTDVGPNNQPVSFQEIFEAKRQEFYDQCQREEEELKQRFMQRVKEKEATFKEAEKELQDKFEHLKMIQQEEIRKLEEEKKQLEGEIIDFYKMKAASEALQTQLSTDTKKDKHRKK

SEQ ID NO: 62781 - protein, 147 aa, Homo sapiens
MIVSRYGLVGCDAGQVRPKVELSLPAFLALPKKEFKDKPEVEENNLIEEAVWQTSLKIPLPQAQVRERGGGSAGISAAHPSQLCTAGVRPSSALRASRPGWSLQTAALQEPTGADSFLPRSHKTAVDLHSARIPLYIHTKCLLMESV

SEQ ID NO: 62782 - protein, 73 aa, Homo sapiens
MAAGRCQRMEEGVMLVIQDCFSYLFSASFNCMKLKPAWQALERLTSADGLKGEAQGSTVHRAANQACAENSTV

SEQ ID NO: 62783 - protein, 73 aa, Homo sapiens; identical to SEQ ID NO: 62782

SEQ ID NO: 62784 - protein, 139 aa, Homo sapiens
MQVLHGHQFSNQWDQSLRIFWDMWHESTEFRAEPPNGFPKGLCPVAFPPGRDKGPRDRTSSRHLVSSVWLGKAPEPLILPPSRRLLNFPPFLMILFIALCLLGSHLGSGPTYPSQAQGLQPGRHSVYCASCSLGLESFW

SEQ ID NO: 62785 - protein, 1149 aa, Homo sapiens
MSGYQRLMKEVTEDLKIYVPDTICNRVSKMKENVKQNRKQRESIDKIKVKVANTRKQALQEQFDEWILDPKGMIPKSVIQNVLQEFFQNPDFKLGSHCKQLDITDSTEPRLNKMEFTEYISSHIKDLKSEMFEELLKHLCHSADEFREVIKADMRRQMFAELFLHCDHGKVGFLDRQRTLALLELFYDHSSQMLRSLLQNPRQWPFIEFEEINLTELWGDMDNQKHIYEGFDKVLLEMNTLLSANHASKTQSKLLESPDQPKLNEQRTSTPSPNPPEQQRGVTAEQGPQRISIEEQQQGKKPTAEQELYIESVIEPGTHTESTLEQGSSRRLLTEQETHRESTTEQGQHKGSIEGQGPRRVSVSEQGSSRESVAEQGSRRESIAEQDRHKGSVAEQGSRRMSAAEQGSLRESVIEEPYQKSEQGPYGEIISEEQEDIGSTSQSRKDSILKSTKYGEPITSEYIEVPLQEKRSWEQTYEEEIFLSSELQEEVPTLSRKDHFPETTKKEVQKDKPCEPKSQKIEGKSWSGEFFTCNWKMKYVTFEDEEQANLIYGNSRFTAKLHIQFPKPHPGHEVRLSSKQFQNYIELVVSELRGNEDQVLESVVEFLINALERSHIESLRNSARRKWLHQIQCAAETSGVSLEPVYSETFKALMQDAEAHGNKKISAHISLLEENLLLPEKGNVLLRNVACTLDDAQFVLNRVLYRDMKGISFTVVDEGKPIHVPQVQYHGNIFFWNQSRNKHDYNGSFLALPLQDAYMRIFGVLAVDTLRDPHEINIFLPHEIRFYQGVANVFSTAYHYVHSREHILHIVITGIGWLYDVTSSITSITTYFVEPSPAQDSDYVLRNMMVTGQLGLTEIHKNPPTIHRKSCIFRDFLFKCTDSSEVVLASACGETHIVVPLRERTGEALGVLDFNIGQNRMLLCQEYKDLQKMMKVVQVACYEILGEFSGEIKKKYILEIENVREVQRAGILFFRIMLLELQESIQLLNSMEFVSLLLYDHTLVTEPNSPQDSKSMELEANVKLVRDILKAVILFFHPELEFSSDFGSWDKCKFYVNKYLVNNICAFDPTAKHVEVNVQLIDEYIRDHSRTEVWKFGNVVIEHLYHWIHICSALMKITKQLNSGITPPLPSKTDNYMYAKMPGEGLQEK

SEQ ID NO: 62786 - protein, 1576 aa, Homo sapiens
MENILCFLNSYTETGLSPDSHWLDIDPNFICLSGLGLFILYLFYVVLTLYSSPTEKNNDIQKHQGRAKRRRKGGTFKGFPDWKSFQREEEEERKLLSLLKSFGPPVSCSPRGQHHDTNHFRRLLCPDPVCRVCKRATADIQQLLSWESLKDAAPSVSPLASSASATESSFTLASTPSATPPEDLILSPRPKASPPPPLILSPDLITTLADLFSPSPLRDPLPPQPVSPLDSKFPIDHSPPQQLPFPLLPPHHIERVESSLQPEASLSLNTIFSFGSTLCQDISQAMNPIDSCARHHGPPIPSALPPEDCTVTQSKSSLTILKTFPEMLSLGGSGGSSTSAPTIKGIDHSHLASSEFTWWQPHAKDSFSSNFVPSDFMEELLTLHSSEAFLGGHSVANLIEPVNISFLSHDILALLERQVKKRGDFLMWKENGKKPGSFPKQLRPNYQLNSSRNMLTSIAVKHDLAESFPFWASKGKLEWQHIHQQPPHSKCFEDHLEQKYVQLFWGLPSLHSESLHPTVLVQRGHSSMFVFFNGITNTSISHESPVLPPPQPLSLPSTQPLPLPQTLPQGQSPHLTQVKSLAQPQSPFRALLPSPLFLIRICGVCFHRPQNEARSLLPSEINHLEWNVLQKVQESLWGLPSVVQKSQEDFCPPAPNPELVRKSFKVHVPISIIPGDFPLSSEVRKKLEQHIRRRLIQRRWGLPRRIHESLSLLRPQSKISELSVSERIHGPLNISLVEGQRCNVLKKSASSFPRSFHERSSNMLSMENVGNYQGYSQETVPKDHLLHGPETSSDKDLRSNSERDLETHMMHLSGNDSGVRLGQKQLENALTVRLSKKFEEINEGRMPGTVHSSWHSVKQTMSLPEKSHSQIKHRNLVTLVSEDHCVDTSQEISFLSSNKQKMLEAHIKTFRMRMLWGLPLKVLESIEIFKSKADLSTSFSHFDLPSSATFISQGDSKDGVSKSRSRSTFQGEKLGTTSSVPILDRPHPVSSPVVQEGQGTLRRQFSDTDHDLIETDSKDGASTSLRRGTTDFQSEKLDSTSSFPILGHSYLVTSPVNQEKQGTLRREFSDTDNDLTESVRTTEDGRQTFLPPPHSIVDEVSQKQTVLASRCSAELPIMQAGAGCESWDKRKSSFHNVDRLQGSRKTFPVTNALQSQTRNNLTTSKSGSCSLTNVKASTSNETEIFPPRISVPQDPKSSYLKNQMLSQLKLVQRKHSQPQSHFTDMSFALDNLSSKDLLTNSQGISSGDMGTSQVVHVHLEDSGIRVAQKQEPRVPTCVLQKCQVTNFPPAVNRVSPVRPKGGELDGGDAGLGTSQRRRKSLPVHNKTSGEVLGSKSSPTLKTQPPPENLFRKWMKTSLQWFNKPSISYEEQESSWEKGSSLSSCVQNIGRVIRAAFTGTTEAQKIRKDTREFLEEKLGHRHGIDITCPQEPLSFPVGLGKAQHNPEVHVRAEPVQGCPCNYRAPSCKVTRTKSCSQQAIFVGQNYPTRIRQIIDKDRQPQKVEAFKGKILCQSHPQSMPHRKPVPHPNPTCRRQVSLVCPAVPTSAKSPVFSDVPFLTGQKMLPKHLQGGKFPPTK

SEQ ID NO: 62787 - protein, 561 aa, Homo sapiens
MANMNSDSRHLGTSEVDHERDPGPMNIQFEPSDLRSKRPFCIEPTNIVNVNHVIQRVSDHASAMNKRIHYYSRLTTPADKALIAPDHVVPAPEECYVYSPLGSAYKLQSYTEGYGKNTSLVTIFMIWNTMMGTSILSIPWGIKQAGFTTGMCVIILMGLLTLYCCYRVVKSRTMMFSLDTTTWEYPDVCRHYFGSFGQWSSLLFSLVSLIGAMIVYWVLMSNFLFNTGKFIFNFIHHINDTDTILSTNNSNPVICPSAGSGGHPDNSSMIFYANDTGAQQFEKWWDKSRTVPFYLVGLLLPLLNFKSPSFFSKFNILGTVSVLYLIFLVTFKAVRLGFHLEFHWFIPTEFFVPEIRFQFPQLTGVLTLAFFIHNCIITLLKNNKKQENNVRDLCIAYMLVTLTYLYIGVLVFASFPSPPLSKDCIEQNFLDNFPSSDTLSFIARIFLLFQMMTVYPLLGYLARVQLLGHIFGDIYPSIFHVLILNLIIVGAGVIMACFYPNIGGIIRYSGAACGLAFVFIYPSLIYIISLHQEERLTWPKLIFHVFIIILGVANLIVQFFM

SEQ ID NO: 62788 - protein, 324 aa, Homo sapiens
MASEALHQVGDGEEAVLKKENFNMMNALDQLPKPFSNPKSMNRTVTTKGLPLASKGNLVNFLEDDTINLLKPLPVEDSDCSSDETSISAFSSTLLNPIKLAVTQPNSSFFAGMLEGELNKLSFSPMAKNAENEDLALGPCPCPSKSQMATRGLLDLDNPELETETSSTHSESSVVVDLPDTPFIFEHTVNNSTAVISWTYALGKQPVSFYQLLLQEVAKTQENELPEAKNRPWIFNKILGTTVKLMELKPNTCYCLSVRAANTAGVGKWCKPYKFATLATDFSSFPENYPIQITVRRKEPRQKIVSIGPEEMRRLEDLEYLFPC

SEQ ID NO: 62789 - protein, 733 aa, Homo sapiens
MAEVGEDSGARALLALRSAPCSPVLCAAAAAAAFPAAAPPPAPAQPQPPPGPPPPPPPPLPPGAIAGAGSSGGSSGVSGDSAVAGAAPALVAAAAASVRQSPGPALARLEGREFEFLMRQPSVTIGRNSSQGSVDLSMGLSSFISRRHLQLSFQEPHFYLRCLGKNGVFVDGAFQRRGAPALQLPKQCTFRFPSTAIKIQFTSLYHKEEAPASPLRPLYPQISPLKIHIPEPDLRSMVSPVPSPTGTISVPNSCPASPRGAGSSSYRFVQNVTSDLQLAAEFAAKAASEQQADTSGGDSPKDESKPPFSYAQLIVQAISSAQDRQLTLSGIYAHITKHYPYYRTADKGWQNSIRHNLSLNRYFIKVPRSQEEPGKGSFWRIDPASEAKLVEQAFRKRRQRGVSCFRTPFGPLSSRSAPASPTHPGLMSPRSGGLQTPECLSREGSPIPHDPEFGSKLASVPEYRYSQSAPGSPVSAQPVIMAVPPRPSSLVAKPVAYMPASIVTSQQPAGHAIHVVQQAPTVTMVRVVTTSANSANGYILTSQGAAGGSHDAAGAAVLDLGSEARGLEEKPTIAFATIPAAGGVIQTVASQMAPGVPGHTVTILQPATPVTLGQHHLPVRAVTQNGKHAVPTNSLAGNAYALTSPLQLLATQASSSAPVVVTRVCEVGPKEPAAAVAATATTTPATATTASASASSTGEPEVKRSRVEEPSGAVTTPAGVIAAAGPQGPGTGE

SEQ ID NO: 62790 - protein, 337 aa, Homo sapiens
MPGLPCPALPCPAPPPAPSCLIAMALKNSKTGSLPVSEIYSFMKEHFPYFKTAPDGWKNSVRHNLSLNKCFEKVENKMSGSSRKGCLWALNLARIDKMEEEMHKWKRKDLAAIHRSMANPEELDKLISDRPESCRRPGKPGEPEAPVLTHATTVAVAHGCLAVSQLPPQPLMTLSLQSVPLHHQVQPQAHLAPDSPAPAQTPPLHALPDLSPSPLPHPAMGRAPVDFINISTDMNTEVDALDPSIMDFALQGNLWEEMKDEGFSLDTLGAFADSPLGCDLGASGLTPASGGSDQSFPDLQVTGLYTAYSTPDSVAASGTSSSSQYLGAQGNKPIALL

SEQ ID NO: 62791 - protein, 279 aa, Homo sapiens
MPCRREEEEEAGEEAEGEEEEEDSFLLLQQSVALGSSGEVDRLVAQIGETLQLDAAQHSPASPCGPPGAPLRAPGPLAAAVPADKARSPAVPLLLPPALAETVGPAPPGVLRCALGDRGRVRGRAAPYCVAELATGPSALSPLPPQADLDGPPGAGKQGIPQPLSGPCRRGWLRGAAASRRLQQRRGSQPETRTGDDDPHRLLQQLVLSGNLIKEAVRRLHSRRLQLRAKLPQRPLLGPLSAPVHEPPSPRSPRAACSDPGASGRAQLRTGDGVLVPGS

SEQ ID NO: 62792 - protein, 279 aa, Homo sapiens; identical to SEQ ID NO: 62791

SEQ ID NO: 62793 - protein, 145 aa, Homo sapiens
MDSQKEALQRIISTLANKNDEIQNFIDTLHHTLKGVQENSSNILSELDEEFDSLYSILDEVKESMINCIKQEQARKSQELQSQISQCNNALENSEELLEFATRSLDIKEPEEFSKVHKNCINTLNKGSCIFKKAFLFFFSFGFLY

SEQ ID NO: 62794 - protein, 574 aa, Homo sapiens
MSLPSPSPSRELCPPDPAFAPLSSWPGSGPAGGSTRSGHVLYSGWLRKSPPEKKLRLFAWRKRWFILRRGQTSSDPDVLEYYKNDGSKKPLRTINLNLCEQLDVDVTLNFNKKEIQKGYMFDIKTSERTFYLVAETREDMNEWVQSICQICGFRQEESTGFLGNISSASHGLCSSPAEPSCSHQHLPQEQEPTSEPPVSHCVPPTWPIPAPPGCLRSHQHASQRAEHARSASFSQGSEAPFIMRRNTAMQNLAQHSGYSVDGVSGHIHGFHSLSKPSQHNAEFRGSTHRIPWSLASHGHTRGSLTGSEADNEASSGKYTQHGGGNASRPAESMHEGVCSFLPGRTLVGLSDSIASEGSCVPMNPGSPTLPAVKQAGDDSQGVCIPVGSCLVRFDLLGSPLTELSMHQDLSQGHEVQLPPVNRSLKPNQKANPTPPNLRNNRVINELSFKPPVTEPWSGTSHTFDSSSSQHPISTQSITNTDSEDSGERYLFPNPASAFPVSGGTSSSAPPRSTGNIHYAALDFQPSKPSIGSVTSGKKVDYVQVDLEKTQALQKTMHEQMCLRQSSEPPRGAKL

SEQ ID NO: 62795 - protein, 138 aa, Homo sapiens
MSWRGRSTYRPRPRRYVEPPEMIGPMRPEQFSDEVEPATPEEGEPATQRQDPAAAQEGEDEGASAGQGPKPEADSQEQGHPQTGCECEDGPDGQEMDPPNPEEVKTPEEEMRSHYVAQTGILWLLMNNCFLNLSPRKP

SEQ ID NO: 62796 - protein, 116 aa, Homo sapiens
MSWRGRSTYRPRPRRYVEPPEMIGPMRPEQFSDEVEPATPEEGEPATQRQDPAAAQEGEDEGASAGQGPKPEAHSQEQGHPQTGCECEDGPDGQEMDPPNPEEVKTPEEGEKQSQC

SEQ ID NO: 62797 - protein, 117 aa, Homo sapiens
MSWRGRSTYYWPRPRRYVQPPEMIGPMRPEQFSDEVEPATPEEGEPATQRQDPAAAQEGEDEGASAGQGPKPEADSQEQGHPQTGCECEDGPDGQEMDPPNPEEVKTPEEGEKQSQC

SEQ ID NO: 62798 - protein, 117 aa, Homo sapiens
MSWRGRSTYYWPRPRRYVQPPEVIGPMRPEQFSDEVEPATPEEGEPATQRQDPAAAQEGEDEGASAGQGPKPEADSQEQGHPQTGCECEDGPDGQEMDPPNPEEVKTPEEGEKQSQC

SEQ ID NO: 62799 - protein, 117 aa, Homo sapiens
MSWRGRSTYYWPRPRRYVQPPEVIGPMRPEQFSDEVEPATPEEGEPATQRQDPAAAQEGEDEGASAGQGPKPEADSQEQGHPQTGCECEDGPDGQEVDPPNPEEVKTPEEGEKQSQC

SEQ ID NO: 62800 - protein, 117 aa, Homo sapiens
MSWRGRSTYYWPRPRRYVQPPEMIGPMRPEQFSDEVEPATPEEGEPATQRQDPAAAQEGEDEGASAGQGPKPEAHSQEQGHPQTGCECEDGPDGQEMDPPNPEEVKTPEEGEKQSQC

SEQ ID NO: 62801 - protein, 117 aa, Homo sapiens; identical to SEQ ID NO: 62800

SEQ ID NO: 62802 - protein, 116 aa, Homo sapiens
MSWRGRSTYRPRPRRYVEPPEMIGPMRPEQFSDEVEPATPEEGEPATQRQDPAAAQEGEDEGASAGQGPKPEADSQEQGHPQTGCECEDGPDGQEMDPPNPEEVKTPEEGEKQSQC

SEQ ID NO: 62803 - protein, 408 aa, Homo sapiens
MSKRDIVLTNVTVVQLLRQPCPVTRAPPPPEPKAEVEPQPQPEPTPVREEIKPPPPPLPPHPATPPPKMVSVARELTVGINGFGRIGRLVLRACMEKGVKVVAVNDPFIDPEYMVYMFKYDSTHGRYKGSVEFRNGQLVVDNHEISVYQCKEPKQIPWRAVGSPYVVESTGVYLSIQAASDHISAGAQRVVISAPSPDAPMFVMGVNENDYNPGSMNIVSNASCTTNCLAPLAKVIHERFGIVEGLMTTVHSYTATQKTVDGPSRKAWRDGRGAHQNIIPASTGAAKAVTKVIPELKGKLTGMAFRVPTPDVSVVDLTCRLAQPAPYSAIKEAVKAAAKGPMAGILAYTEDEVVSTDFLGDTHSSIFDAKAGIALNDNFVKLISWYDNEYGYSHRVVDLLRYMFSRDK

SEQ ID NO: 62804 - protein, 520 aa, Homo sapiens
MLLFLWIETSSEYFNFDWVTFLGTGYWFFWSIFILSLARILTAYSSLLLLLGFLLLWERIELYLHLCHKILILLVILLCVILMFIICKFWKERWLVAGLSMQIFAPYVHLVSITVMVILFWPVAFYVACLEREVRMRRYRMTHSEKKRLKQCNVITRLRGLQVPVGLPFLLILLGLYLMPLGIYSPCIQEKENLGPKPTIFGHRGAPMLGPENTMMSFEKAVEHGAHGLETDIHLSYDHVPFLMHDFDLKRTTNIGEVQPESACENPAFFNWDFLSTLNAGKWFVKPELRPFYNMKPLSEADKERARNQSIPTLADLLTLAEKERKFVIFDLHRPPPKHPLRHTFVRQVVSVILASKIEQHLIFWLPAHDRQYVRSVAPGFQHVGRLVSIETLAKNNISIINVDYKKLFPNGLRDYKAANIHINVYTVNEPWLFSLAWCSRINSVTTDNIGLLSQLDHPHFFMTPKFYVFMWLLADIISVLFIVAIFCFHWRRETEKEKLFETSSTRTDTQSGSKNEEDR

SEQ ID NO: 62805 - protein, 652 aa, Homo sapiens
MGNLQSEPSAGGGSRKVQPSDRAPDSRRTSLVEPEMTSQAMRLTRGLGVWFPGSATPPGLMVPREPQASPSTLPLTLERPSPVMPPPEEAAAVSAPPPAPAGTLLPGPSKWQKPAGTPVPRIRRLLEASHRGQGDPPSLRPLKPPPPPRQLSVKDTVPRAPSQFPPPLETWKPPPPLPSERQPADRRITPALATPASPPTESQAGPRNQGQTAGRARGGAPPHAGEGEMAQPADSESGLSLLCKITFKSRPSLAPPAASSSLAAKASLGGGGGGGLFAASGAISYAEVLKQGPLPPGAARPLGEVSRGAQEAEGGDGDGEGCSGPPSAPASQARALPPPPYTTFPGSKPKFDWVSAPDGPERHFRFNGAGGGIGAPRRRAAALSGPWGSPPPPPEQIHSAPGPRRPAPALLAPPTFIFPAPTNGEPMRPGPPGLQELPPLPPPTPPPTLQPPALQPTPLPVAPPLTPGLGHKESALAPTAAPALPPALAADQAPAPSPAPAPTVAEPSPPVSAPAPAAAPIKTRTRRNKGSRAARGATRKDGLHGDGPRERATATVPDSSGGGGGGSGASQTGAANTRAARHWLPFQVLNSCPCKCYCHHQPRHRRLPRNVSAWLSTSTNHLGEPPWVATIKLSGSLVAKLEHYDLQATHSN

SEQ ID NO: 62806 - protein, 225 aa, Homo sapiens
MGNLQSEPSAGGGSRKVQPSDRAPDSRRTSLVEPEMTSQAMRLTRGLGVWFPGSATPPGLMVPREPQASPSTLPLTLERPSPVMPPPEEAAAVSAPPPAPAGTLLPGPSKWQKPAGTPVPRIRRLLEASHRGQGDPPSLRPLKPPPPPRQLSVKDTVPRAPSQFPPPLETWKPPPPLPSERQPADRRITPALATPACVRARTRGCAHQDPHAQEQGFPCSPGRDP

SEQ ID NO: 62807 - protein, 165 aa, Homo sapiens
MNPRDKQVSRFSPLKDVYTWVALAGIQRSGSPGRTRSAARRMESNTSSSLENLATAPVNQIQETISDNCVVIFSKTSCSYCTMAKKLFHDMNVNYKVVELDLLEYGNQFQDALYKMTGERTVPRIFVNGTFIGGATDTHRLHKEGKLLPLVHQCYLKKSKRKEFQ

SEQ ID NO: 62808 - protein, 164 aa, Homo sapiens
MIWRRAALAGTRLVWSRSGSAGWLDRAAGAAGAAAAAASGMESNTSSSLENLATAPVNQIQETISDNCVVIFSKTSCSYCTMAKKLFHDMNVNYKVVELDLLEYGNQFQDALYKMTGERTVPRIFVNGTFIGGATDTHRLHKEGKLLPLVHQCYLKKSKRKEFQ

SEQ ID NO: 62809 - protein, 284 aa, Homo sapiens
MEWKLEQSMREQALLKAQLTQLKESLKEVQLERDEYAEHLKGERARWQQRMRKMSQEVCSLKKEKKHDKYRVETLERSLSKLKHQMAEPLPPEPPAVPSEVELQHLRKELERVAGALQAQLVEKEELGFFQYYRERCHQKVYHPITKPGGSAKDAAPGGGHHQAGPGQGGDEGEAAGAAGDGVAAGGDYKGHSKFLVTAQNPAHEPSPGAPAPQELGAAHKHGDLCEVSLTDSVEPVQGETREGSPHDKPTAQPIVQDHQEHPGLGSNCCVPFFCWAWPPRRRR

SEQ ID NO: 62810 - protein, 284 aa, Homo sapiens
MEWKLEQSMREQALLKAQLTQLKESLKEVQLERDEYAEHLKGERARWQQRMRKMSQEVCSLKKEKKHDKYRVEKLERSLSKLKNQMAEPLPPEPPAVPSEVELQHLRKELERVAGALQAQLVEKEELGFFQYYREGCHQKVYHPITKPGGSAKDAAPGGGHHQAGPGQGGDEGEAAGAAGDGVAAGGDYKGHSKFLVTAQNPAHEPSPGAPAPQELGAAHKHGDLCEVSLTDSVEPVQGEAREGSPHDNPTAQPIVQDHQEHPGLGSNCCVPFFCWAWLPRRRR

SEQ ID NO: 62811 - protein, 421 aa, Homo sapiens
MPTLSVFMDVPLAHKLEGSLLKTYKQDDYPNKIFLAYRVCMTNEGHPWVSLVVQKTRLQISQDPSLNYEYLPTMGLKSFIQASLALLFGKHSQAIVENRVGGVHTVGDSGAFQLGVQFLRAWHKDARIVYIISSQKELHGLVFQDMGFTVYEYSVWDPKKLCMDPDILLNVVEQIPHGCVLVMGNIIDCKLTPSGWAKLMSMIKSKQIFPFFDIPCQGLYTSGLEEDTRILQYFVSQGFEFFCSQSLSKNFGIYDEGVGMLVVVAVNNQQLLCVLSQLEGLAQALWLNPPNTGARVITSILCNPALLGEWKQSLKEVVENIMLTKEKVKEKLQLLGTPGSWGHITEQSGTHGYLGLNSQQVEYLVRKKHIYIPKNGQINFSCINANNINYITEGINEAVLLTESSEMCLPKEKKTLIGIKL

SEQ ID NO: 62812 - protein, 494 aa, Homo sapiens
MEEPQPPRPPASMALLGSQHSGAPSAAGPPGGTSSAATAAVLSFSTVATAALGNLSDASGGGTAAAPGGGGLGGSGAAREAGAAVRRPLGPEAAPLLSHGAAVAAQALVLLLIFLLSSLGNCAVMGVIVKHRQLRTVTNAFILSLSLSDLLTALLCLPAAFLDLFTPPGGSAPAAAAGPWRGFCAASRFFSSCFGIVSTLSVALISLDRYCAIVRPPREKIGRRRALQLLAGAWLTALGFSLPWELLGAPRELAAAQSFHGCLYRTSPDPAQLGAAFSVGLVVACYLLPFLLMCFCHYHICKTVRLSDVRVRPVNTYARVLRFFSEVRTATTVLIMIVFVICCWGPYCFLVLLAAARQAQTMQAPSLLSVVAVWLTWANGAINPVIYAIRNPNISMLLGRNREEGYRTRNVDAFLPSQGPGLQARSRSRLRNRYANRLGACNRMSSSNPASGVAGDVAMWARKNPVVLFCREGPPEPVTAVTKQPKSEAGDTSL

SEQ ID NO: 62813 - protein, 546 aa, Homo sapiens
MELENIVANSLLLKARQEKDYSSLCDKQPIGRRLFRQFCDTKPTLKRHIEFLDAVAEYEVADDEDRSDCGLSILDRFFNDKLAAPLPEIPPDVVTECRLGLKEENPSKKAFEECTRVAHNYLRGEPFEEYQESSYFSQFLQWKWLERQPVTKNTFRHYRVLGKGGFGEVCACQVRATGKMYACKKLQKKRIKKRKGEAMALNEKRILEKVQSRFVVSLAYAYETKDALCLVLTIMNGGDLKFHIYNLGNPGFDEQRAVFYAAELCCGLEDLQRERIVYRDLKPENILLDDRGHIRISDLGLATEIPEGQRVRGRVGTVGYMAPEVVNNEKYTFSPDWWGLGCLIYEMIQGHSPFKKYKEKVKWEEVDQRIKNDTEEYSEKFSEDAKSICRMLLTKNPSKRLGCRGEGAAGVKQHPVFKDINFRRLEANMLEPPFCPDPHAVYCKDVLDIEQFSVVKGIYLDTADEDFYARFATGCVSIPWQNEMIESGCFKDINKSESEEALPLDLDKNIHTPVSRPNRGFFYRLFRRGGCLTMVPSEKEVEPKQC

SEQ ID NO: 62814 - protein, 532 aa, Homo sapiens
MELENIVANSLLLKARQGGYGKKSGRSKKWKEILTLPPVSQCSELRHSIEKDYSSLCDKQPIGRRLFRQFCDTKPTLKRHIEFLDAVAEYEVADDEDRSDCGLSILDRFFNDKLAAPLPEIPPDVVTECRLGLKEENPSKKAFEECTRVAHNYLRGEPFEEYQESSYFSQFLQWKWLERQPVTKNTFRHYRVLGKGGFGEVCACQVRATGKMYACKKLQKKRIKKRKGEAMALNEKRILEKVQSRFVVSLAYAYETKDALCLVLTIMNGGDLKFHIYNLGNPGFDEQRAVFYAAELCCGLEDLQRERIVYRDLKPENILLDDRGHIRISDLGLATEIPEGQRVRGRVGTVGYMAPEVVNNEKYTFSPDWWGLGCLIYEMIQGHSPFKKYKEKVKWEEVDQRIKNDTEEYSEKFSEDAKSICRMLLTKNPSKRLGCRGEGAAGVKQHPVFKDINFRRLEANMLEPPFCPDPHAVYCKDVLDIEQFSVVKGIYLDTADEDFYARFATGCVSIPWQNEGCLTMVPSEKEVEPKQC

SEQ ID NO: 62815 - protein, 578 aa, Homo sapiens [sequence omitted]

SEQ ID NO: 62816 - protein, 282 aa, Homo sapiens
MELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPGERCRSFIELTPPAKRGEKGLLEFATLQGPCHPTLRFGGKRLMEKASLPSPPLGLCGKNPMVIPGNADHLHRTSIHQLPPATNRLATHWEPCLWAQTERLCCCFLCPVRSPGDGGPHDVFTSLPSDCQLGSRRLETTCLELWLGLLHGLALLHLLHGVGCHHLQHVHQDGAGVQVQA

SEQ ID NO: 62817 - protein, 326 aa, Homo sapiens
MAKMELSKAFSGQRTLLSAILSMLSLSFSTTPLLSNYWFVGTQKVPKPLCEKGLAAKCFDMPVSLDGDTNTSTQEVVQYNWETGDDRFSFRSFRSGMWLSCEETVEEPGERCRSFIELTPPAKREILWLSLGTQITYIGLQFISFLLLLTDLLLTGNPACGLKLSAFAAVSSVLSGLLGMVAHMMYSQVFQATVNLGPEDWRPHVWNYGWAFYMAWLSFTCCMASAVTTFNTYTRMVLEFKCKHSKSFKENPNCLPHHHQCFPRRLSSAAPTVGPLTSYHQYHNQPIHSVSEGVDFYSELRNKGFQRGASQELKEAVRSSVEEEQC

SEQ ID NO: 62818 - protein, 225 aa, Homo sapiens
MSCESSMVLGYWDIRGLAHAIRLLLEFTDTSYEEKRYTCGEAPDYDRSQWLDVKFKLDLDFPNLPYLLDGKNKITQSNAILRYIARKHNMCGETEEEKIRVDIIENQVMDFRTQLIRLCYSSDHEKLKPQYLEELPGQLKQFSMFLGKFSWFAGEKLTFVDFLTYDILDQNRIFDPKCLDEFPNLKAFMCRFEALEKIAAYLQSDQFCKMPINNKMAQWGNKPVC

SEQ ID NO: 62819 - protein, 450 aa, Homo sapiens
MRECISIHVGQAGVQIGNACWELYCLEHGIQPDGQMPSDKTIGGGDDSFNTFFSETGAGKHVPRAVFVDLEPTVVDEVRTGTYRQLFHPEQLITGKEDAANNYARGHYTIGKEIVDLVLDRIRKLADLCTGLQGFLIFHSFGGGTGSGFASLLMERLSVDYGKKSKLEFAIYPAPQVSTAVVEPYNSILTTHTTLEHSDCAFMVDNEAIYDICRRNLDIERPTYTNLNRLIGQIVSSITASLRFDGALNVDLTEFQTNLVPYPRIHFPLATYAPVISAEKAYHEQLSVAEITNACFEPANQMVKYDPRHGKYMACCMLYRGDVVPKDVNAAIATIKTKRTIQFVDWCPTGFKVGINYQPPTVVPGGDLAKVQRAVCMLSNTTAIAEAWARLDHKFDLMYAKRAFVHWYVGEGMEEGEFSEAREDLAALEKDYEEVGVDSVEAEAEEGEEY

SEQ ID NO: 62820 - protein, 1203 aa, Homo sapiens
MDKLPPSMRKRLYSLPQQVGAKAWIMDEEEDAEEEGAGGRQDPSRRSIRLRPLPSPSPSAAAGGTESRSSALGAADSEGPARGAGKSSTNGDCRRFRGSLASLGSRGGGSGGTGSGSSHGHLHDSAEERRLIAEGDASPGEDRTPPGLAAEPERPGASAQPAASPPPPQQPPQPASASCEQPSVDTAIKVEGGAAAGDQILPEAEVRLGQAGFMQRQFGAMLQPGVNKFSLRMFGSQKAVEREQERVKSAGFWIIHPYSDFRFYWDLTMLLLMVGNLIIIPVGITFFKDENTTPWIVFNVVSDTFFLIDLVLNFRTGIVVEDNTEIILDPQRIKMKYLKSWFMVDFISSIPVDYIFLIVETRIDSEVYKTARALRIVRFTKILSLLRLLRLSRLIRYIHQWEEIFHMTYDLASAVVRIVNLIGMMLLLCHWDGCLQFLVPMLQDFPDDCWVSINNMVNNSWGKQYSYALFKAMSHMLCIGYGRQAPVGMSDVWLTMLSMIVGATCYAMFIGHATALIQSLDSSRRQYQEKYKQVEQYMSFHKLPPDTRQRIHDYYEHRYQGKMFDEESILGELSEPLREEIINFNCRKLVASMPLFANADPNFVTSMLTKLRFEVFQPGDYIIREGTIGKKMYFIQHGVVSVLTKGNKETKLADGSYFGEICLLTRGRRTASVRADTYCRLYSLSVDNFNEVLEEYPMMRRAFETVALDRLDRIGKKNSILLHKVQHDLNSGVFNYQENEIIQQIVQHDREMAHCAHRVQAAASATPTPTPVIWTPLIQAPLQAAAATTSVAIALTHHPRLPAAIFRPPPGSGLGNLGAGQTPRHLKRLQSLIPSALGSASPASSPSQVDTPSSSSFHIQQLAGFSAPAGLSPLLPSSSSSPPPGACGSPSAPTPSAGVAATTIAGFGHFHKALGGSLSSSDSPLLTPLQPGARSPQAAQPSPAPPGARGGLGLPEHFLPPPPSSRSPSSSPGQLGQPPGELSLGLATGPLSTPETPPRQPEPPSLVAGASGGASPVGFTPRGGLSPPGHSPGPPRTFPSAPPRASGSHGSLLLPPASSPPPPQVPQRRGTPPLTPGRLTQDLKLISASQPALPQDGAQTLRRASPHSSGESMAAFPLFPRAGGGSGGSGSSGGLGPPGRPYGAIPGQHVTLPRKTSSGSLPPPLSLFGARATSSGGPPLTAGPQREPGARPEPVRSKLPSNL

SEQ ID NO: 62821 - protein, 616 aa, Homo sapiens
MSTIQSETDCYDIIEVLGKGTFGEVAKGWRRSTGEMVAIKILKNDAYRNRIIKNELKLLHCMRGLDPEEAHVIRFLEFFHDALKFYLVFELLEQNLFEFQKENNFAPLPARHIRTVTLQVLTALARLKELAIIHADLKPENIMLVDQTRCPFRVKVIDFGSASIFSEVRYVKEPYIQSRFYRAPEILLGLPFCEKVDVWSLGCVMAELHLGWPLYPGNNEYDQVRYICETQGLPKPHLLHAACKAHHFFKRNPHPDAANPWQLKSSADYLAETKVRPLERRKYMLKSLDQIETVNGGSVASRLTFPDREALAEHADLKSMVELIKRMLTWESHERISPSAALRHPFVSMQQLRSAHETTHYYQLSLRSYRLSLQVEGKPPTPVVAAEDGTPYYCLAEEKEAAGMGSVAGSSPFFREEKAPGMQRAIDQLDDLSLQEAGHGLWGETCTNAVSDMMVPLKAAITGHHVPDSGPEPILAFYSSRLAGRHKARKPPAGSKSDSNFSNLIRLSQVSPEDDRPCRGSSWEEGEHLGASAEPLAILQRDEDGPNIDNMTMEAERPDPELFDPSSCPGEWLSEPDCTLESVRGPRAQGLPPRRSHQHGPPRGATSFLQHVTGHH

SEQ ID NO: 62822 - protein, 917 aa, Homo sapiens
MIASHLLAYFFTELNHDQVQKVDQYLYHMRLSDETLLEISKRFRKEMEKGLGATTHPTAAVKMLPTFVRSTPDGTEHGEFLALDLGGTNFRVLWVKVTDNGLQKVEMENQIYAIPEDIMRGSGTQLFDHIAECLANFMDKLQIKDKKLPLGFTFSFPCHQTKLDESFLVSWTKGFKSSGVEGRDVVALIRKAIQRRGDFDIDIVAVVNDTVGTMMTCGYDDHNCEIGLIVGTGSNACYMEEMRHIDMVEGDEGRMCINMEWGAFGDDGSLNDIRTEFDQEIDMGSLNPGKQLFEKMISGMYMGELVRLILVKMAKEELLFGGKLSPELLNTGRFETKDISDIEGEKDGIRKAREVLMRLGLDPTQEDCVATHRICQIVSTRSASLCAATLAAVLQRIKENKGEERLRSTIGVDGSVYKKHPHFAKRLHKTVRRLVPGCDVRFLRSEDGSGKGAAMVTAVAYRLADQHRARQKTLEHLQLSHDQLLEVKRRMKVEMERGLSKETHASAPVKMLPTYVCATPDGTEKGDFLALDLGGTNFRVLLVRVRNGKWGGVEMHNKIYAIPQEVMHGTGDELFDHIVQCIADFLEYMGMKGVSLPLGFTFSFPCQQNSLDESILLKWTKGFKASGCEGEDVVTLLKEAIHRREEFDLDVVAVVNDTVGTMMTCGFEDPHCEVGLIVGTGSNACYMEEMRNVELVEGEEGRMCVNMEWGAFGDNGCLDDFRTEFDVAVDELSLNPGKQRFEKMISGMYLGEIVRNILIDFTKRGLLFRGRISERLKTRGIFETKFLSQIESDCLALLQVRAILQHLGLESTCDDSIIVKEVCTVVARRAAQLCGAGMAAVVDRIRENRGLDALKVTVGVDGTLYKLHPHFAKVMHETVKDLAPKCDVSFLQSEDGSGKGAALITAVACRIREAGQR

SEQ ID NO: 62823 - protein, 724 aa, Homo sapiens
MSFPKAPLKRFNDPSGCAPSPGAYDVKTLEVLKGPVSFQKSQRFKQQKESKQNLNVDKDTTLPASARKVKSSESKESQKNDKDLKILEKEIRVLLQERGAQDSRIQDLETELEKMEARLNAALREKTSLSANNATLEKQLIELTRTNELLKSKFSENGNQKNLRILSLELMKLRNKRETKMRGMMAKQEGMEMKLQVTQRSLEESQGKIAQLEGKLVSIEKEKIDEKSETEKLLEYIEEISCASDQVEKYKLDIAQLEENLKEKNDEILSLKQSLEENIVILSKQVEDLNVKCQLLEKEKEDHVNRNREHNENLNAEMQNLKQKFILEQQEREKLQQKELQIDSLLQQEKELSSSLHQKLCSFQEEMVKEKNLFEEELKQTLDELDKLQQKEEQAERLVKQLEEEAKSRAEELKLLEEKLKGKEAELEKSSAAHTQATLLLQEKYDSMVQSLEDVTAQFESYKALTASEIEDLKLENSSLQEKAAKAGKNAEDVQHQILATESSNQEYVRMLLDLQTKSALKETEIKEITVSFLQKITDLQNQLKQQEEDFRKQLEDEEGRKAEKENTTAELTEEINKWRLLYEELYNKTKPFQLQLDAFEVEKQALLNEHGAAQEQLNKIRDSYAKLLGHQNLKQKIKHVVKLKDENSQLKSEVSKLRCQLAKKKQSETKLQEELNKVLGIKHFDPSKAFHHESKENFALKTPLKEGNTNCYRAPMECQESWK

SEQ ID NO: 62824 - protein, 709 aa, Homo sapiens
MSFPKAPLKRFNDPSGCAPSPGAYDVKTLEVLKGPVSFQKSQRFKQQKESKQNLNVDKDTTLPASARKVKSSESKIRVLLQERGAQDSRIQDLETELEKMEARLNAALREKTSLSANNATLEKQLIELTRTNELLKSKFSENGNQKNLRILSLELMKLRNKRETKMRGMMAKQEGMEMKLQVTQRSLEESQGKIAQLEGKLVSIEKEKIDEKSETEKLLEYIEEISCASDQVEKYKLDIAQLEENLKEKNDEILSLKQSLEENIVILSKQVEDLNVKCQLLEKEKEDHVNRNREHNENLNAEMQNLKQKFILEQQEREKLQQKELQIDSLLQQEKELSSSLHQKLCSFQEEMVKEKNLFEEELKQTLDELDKLQQKEEQAERLVKQLEEEAKSRAEELKLLEEKLKGKEAELEKSSAAHTQATLLLQEKYDSMVQSLEDVTAQFESYKALTASEIEDLKLENSSLQEKAAKAGKNAEDVQHQILATESSNQEYVRMLLDLQTKSALKETEIKEITVSFLQKITDLQNQLKQQEEDFRKQLEDEEGRKAEKENTTAELTEEINKWRLLYEELYNKTKPFQLQLDAFEVEKQALLNEHGAAQEQLNKIRDSYAKLLGHQNLKQKIKHVVKLKDENSQLKSEVSKLRCQLAKKKQSETKLQEELNKVLGIKHFDPSKAFHHESKENFALKTPLKEGNTNCYRAPMECQESWK

SEQ ID NO: 62825 - protein, 307 aa, Homo sapiens
MATAQLSHCITIHKASKETVFPSQITNEHESLKMVKKLFATSISCITYLRGLFPESSYGERHLDDLSLKILREDKKCPGSLHIIRWIQGCFDALEKRYLRMAVLTLYTDPMGSEKVTEMYQFKFKYTKEGATMDFDSHSSSTSFESGTNNEDIKKASVLLIRKLYILMQDLEPLPNNVVLTMKLHYYNAVTPHDYQPLGFKEGVNSHFLLFDKEPINVQVGFVSTGFHSMKVKVMTEATKVIDLENNLFRENSTTEIAHQGLDCDEEEECNDHIQRMNFVCSQQSSECSRKKRKVSEPVKVFIPNRK

SEQ ID NO: 62826 - protein, 290 aa, Homo sapiens
MHPINVRRDPSIPIYGLRQSILLNTRLQDCYVDSPALTNIWMARTCAKQNINAPAPATTSSWEVVRNPLIASSFSLVKLVLRRQLKNKCCPPPCKFGEGKLSKRLKHKDDSVMKATQQARKRNFISSKSKQPAGHRRPAGGIRESKESSKEKKLTVRQDLEDRYAEHVAATQALPQDSGTAAWKGRVLLPETQKRQQLSEDTLTIHGLPTEGYQALYHAVVEPMLWNPSGTPKRYSLELGKAIKQKLWEALCSQGAISEGAQRDRFPGRKQPGVHEEPVLKKWPKLKSKK

SEQ ID NO: 62827 - protein, 401 aa, Homo sapiens; identical to SEQ ID NO: 28816

SEQ ID NO: 62828 - protein, 641 aa, Homo sapiens
MATAKGIAIGIDLGTTYSCVGVFQHGKVEIIANDQGNRTTPSYVAFTDTERLIGDAAKNQVAMNPQNTVFDAKRLIGRKFNDPVVQADMKLWPFQVINEGGKPKVLVSYKGENKAFYPEEISSMVLTKLKETAEAFLGHPVTNAVITVPAYFNDSQRQATKDAGVIAGLNVLRIINEPTAAAIAYGLDKGGQGERHVLIFDLGGGTFDVSILTIDDGIFEVKATAGDTHLGGEDFDNRLVSHFVEEFKRKHKKDISQNKRAVRRLRTACERAKRTLSSSTQANLEIDSLYEGIDFYTSITRARFEELCADLFRGTLEPVEKALRDAKMDKAKIHDIVLVGGSTRIPKVQRLLQDYFNGRDLNKSINPDEAVAYGAAVQAAILMGDKSEKVQDLLLLDVAPLSLGLETAGGVMTALIKRNSTIPTKQTQIFTTYSDNQPGVLIQVYEGERAMTKDNNLLGRFDLTGIPPAPRGVPQIEVTFDIDANGILNVTAMDKSTGKVNKITITNDKGRLSKEEIERMVLDAEKYKAEDEVQREKIAAKNALESYAFNMKSVVSDEGLKGKISESDKNKILDKCNELLSWLEVNQLAEKDEFDHKRKELEQMCNPIITKLYQGGCTGPACGTGYVPGRPATGPTIEEVD

SEQ ID NO: 62829 - protein, 377 aa, Homo sapiens
MTDDESESVLSDSHEGSELELPVIQLCGLVEELSYVNSALKTETEMFEKYYAKLEPRDQRPPRLSEIKISAADYAQFRGRRRSKSRTGMDRGVGLTADQKLELVQKEVADMKDDLRHTRANAERDLQHHEAIIEEAEIRWSEVSREVHEFEKDILKAISKKKGSILATQKVMKYIEDMNRRRDNMKEKLRLKNVSLKVQRKKMLLQLRQKEEVSEALHDVDFQQLKIENAQFLETIEARNQELTQLKLSSGNTLQVLNAYKSKLHKAMEIYLNLDKEILLRKELLEKIEKETLQVEEDRAKAEAVNKRLRKQLAEFRAPQVMTYVREKILNADLEKSIRMWERKVEIAEMSLKGHRKAWNRMKITNEQLQADYLAGK

SEQ ID NO: 62830 - protein, 146 aa, Homo sapiens
MHPLLNPLLLALGLMALLLTTVIALTCLGGFASPGPVPPSTALRELIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGQFN

SEQ ID NO: 62831 - protein, 595 aa, Homo sapiens
MESQPFLNMKFETDYFVKVVPFPSIKNESNYHPFFFRTRACDLLLQPDNLACKPFWKPRNLNISQHGSDMQVSFDHAPHNFGFRFFYLHYKLKHEGPFKRKTCKQEQTTEMTSCLLQNVSPGDYIIELVDDTNTTRKVMHYALKPVHSPWAGPIRAVAITVPLVVISAFATLFTVMCRKKQQENIYSHLDEESSESSTYTAALPRERLRPRPKVFLCYSSKDGQNHMNVVQCFAYFLQDFCGCEVALDLWEDFSLCREGQREWVIQKIHESQFIIVVCSKGMKYFVDKKNYKHKGGGRGSGKGELFLVAVSAIAEKLRQAKQSSSAALSKFIAVYFDYSCEGDVPGILDLSTKYRLMDNLPQLCSHLHSRDHGLQEPGQHTRQGSRRNYFRSKSGRSLYVAICNMHQFIDEEPDWFEKQFVPFHPPPLRYREPVLEKFDSGLVLNDVMCKPGPESDFCLKVEAAVLGATGPADSQHESQHGGLDQDGEARPALDGSAALQPLLHTVKAGSPSDMPRDSGIYDSSVPSSELSLPLMEGLSTDQTETSSLTESVSSSSGLGEEEPPALPSKLLSSGSCKADLGCRSYTDELHAVAPL

SEQ ID NO: 62832 - protein, 684 aa, Homo sapiens
MACLGFLLPVGFLLLISTVAGGKYGVAHVVSENWSKDYCILFSSDYITLPRDLHHAPLLPLYDGTKAPWCPGEDSPHQAQLRSPSQRPLRQTTAMVMRGNCSFHTKGWLAQGQGAHGLLIVSRVSDQQCSDTTLAPQDPRQPLADLTIPVAMLHYADMLDILSHTRGEAVVRVAMYAPPEPIIDYNMLVIFILAVGTVAAGGYWAGLTEANRLQRRRARRGGGSGGHHQLQEAAAAEGAQKEDNEDIPVDFTPAMTGVVVTLSCSLMLLLYFFYDHFVYVTIGIFGLGAGIGLYSCLSPLVCHLSLRQYQRPPHSLWASLPLPLLLLASLCATVIIFWVAYRNEDRWAWLLQDTLGISYCLFVLHRVRLPTLKNCSSFLLALLAFDVFFVFVTPFFTKTGESIMAQVALGPAESSSHERLPMVLKVPRLRVSALTLCSQPFSILGFGDIVVPGFLVAYCCRFDVQVCSRQIYFVACTVAYAVGLLVTFMAMVLMQMGQPALLYLVSSTLLTSLAVAACRQELSLFWTGQGRAKMCGLGCAPSAGSRQKQEGAADAHTASTLERGTSRGAGDLDSNPGEDTTEIVTISENEATNPEDRSDSSEGWSDAHLDPNELPFIPPGASEELMPLMPMAMLIPLMPLMPPPSELGHVHAQAQAHETGLPWAGLHKRKGLKVRKSMSTQAPL

SEQ ID NO: 62833 - protein, 235 aa, Homo sapiens
MEILKELDECYERFSRETDGAQKRRMLHCVQRALIRSQELGDEKIQIVSQMVELVENRTRQVDSHVELFEAQQELGDTAGNSGKAGADRPKGEAAAQADKPNSKRSRRQRNNENRENASSNHDHDDGASGTPKEKKAKTSKKKKRSKAKAEREASPADLPIDPNEPTYCLCNQVSYGEMIGCDNDECPIEWFHFSCVGLNHKPKGKWYCPKCRGENEKTMDKALEKSKKERAYNR

SEQ ID NO: 62834 - protein, 210 aa, Homo sapiens
MLHCVQRALIRSQELGDEKIQIVSQMVELVENRTRQVDSHVELFEAQQELGDTAGNSGKAGADRPKGEAAAQADKPNSKRSRRQRNNENRENASSNHDHDDGASGTPKEKKAKTSKKKKRSKAKAEREASPADLPIDPNEPTYCLCNQVSYGEMIGCDNDECPIEWFHFSCVGLNHKPKGKWYCPKCRGENEKTMDKALEKSKKERAYNR

SEQ ID NO: 62835 - protein, 279 aa, Homo sapiens
MLSPANGEQLHLVNYVEDYLDSIESLPFDLQRNVSLMREIDAKYQEILKELDECYERFSRETDGAQKRRMLHCVQRALIRSQELGDEKIQIVSQMVELVENRTRQVDSHVELFEAQQELGDTAGNSGKAGADRPKGEAAAQADKPNSKRSRRQRNNENRENASSNHDHDDGASGTPKEKKAKTSKKKKRSKAKAEREASPADLPIDPNEPTYCLCNQVSYGEMIGCDNDECPIEWFHFSCVGLNHKPKGKWYCPKCRGENEKTMDKALEKSKKERAYNR

SEQ ID NO: 62836 - protein, 213 aa, Homo sapiens
MPRLLRLSLLWLGLLLVRFSRELSDISSARKLCGRYLVKEIEKLCGHANWSQFRFEEETPFSRLIAQASEKVEAYSPYQFESPQTASPARGRGTNPVSTSWEEAVNSWEMQSLPEYKDKKGYSPLGKTREFSSSHNINVYIHENAKFQKKRRNKIKTLSNLFWGHHPQRKRRGYSEKCCLTGCTKEELSIACLPYIDFKRLKEKRSSLVTKIY

SEQ ID NO: 62837 - protein, 695 aa, Homo sapiens
MFLGTGEPALDTGDDSLSAVTFDSDVETKAKRKAFHKPPPTSPKSPYLSKPRKVASWRSLRTAGSMPLGGRASLTPQKLWLGTAKPGSLTQALNSPLTWEHAWTGVPGGTPDCLTDTFRVKRPHLRRSASNGHVPGTPVYREKEDMYDEIIELKKSLHVQKSDVDLMRTKLRRLEEENSRKDRQIEQLLDPSRGTDFVRTLAEKRPDASWVINGLKQRILKLEQQCKEKDGTIRKLQTDMKTTNLEEMRIAMETYYEEVHRLQTLLASSETTGKKPLGEKKTGAKRQKKMGSALLSLSRSVQELTEENQSLKEDLDRVLSTSPTISKTQGYVEWSKPRLLRRIVELEKKLSVMESSKSHAAEPVRSHPPACLASSSALHRQPRGDRNKDHERLRGAVRDLKEERTALQEQLLQRDLEVKQLLQAKADLEKELECAREGEEERREREEVLREEIQTLTSKLQELQEMKKEEKEDCPEVPHKAQELPAPTPSSRHCEQDWPPDSSEEGLPRPRSPCSDGRRDAAARVLQAQWKVYKHKKKKAVLDEAAVVLQAAFRGHLTRTKLLASKAHGSEPPSVPGLSDQSSPVPRVPSPIAQATGSPVQEEAIVIIQSALRAHLARARHSATGKRTTTAASTRRRSASATHGDASSPPFLAALPDPSPSGPQALAPLPGDDVNSDDSDDIVIAPSLPTKNFPV

SEQ ID NO: 62838 - protein, 949 aa, Homo sapiens
MEPPGRSSRSTASHTLHQYCCPTQVLDSMKLTPSGRLAESSVEGDAPGSDLSTAVDSPGSQPPYRLSQLPPSSSHMGGPPAGVGLPWAQRARLQPASVALRKQEEEEIKRSKALSDSYELSTDLQDKKVEMLERKYGGSFLSRRAARTIQTAFRQYRMNKNFERLRSSASESRMSRRIILSNMRMQFSFEEYEKAQNPAYFEGKPASLDEGAMAGARSHRLERGLPYGGSCGGGIDGGGSSVTTSGEFSNDITELEDSFSKQVKSLAESIDEALNCHPSGPMSEEPGSAQLEKRESKEQQEDSSATSFSDLPLYLDDTVPQQSPERLPSTEPPPQGRPEFWAPAPLPPVPPPVPSGTREDGSREEGTRRGPGCLECRDFRLRAAHLPLLTIEPPSDSSVDLSDRSDRGSVHRQLVYEADGCSPHGTLKHKGPPGRAPIPHRHYPAPEGPAPAPPGPLPPAPNSGTGPSGVAGGRRLGKCEAAGENSDGGDNESLESSSNSNETINCSSGSSSRDSLREPPATGLCKQTYQRETRHSWDSPAFNNDVVQRRHYRIGLNLFNKKPEKGIQYLIERGFLSDTPVGVAHFILERKGLSRQMIGEFLGNRQKQFNRDVLDCVVDEMDFSSMDLDDALRKFQSHIRVQGEAQKVERLIEAFSQRYCVCNPALVRQFRNPDTIFILAFAIILLNTDMYSPSVKAERKMKLDDFIKNLRGVDNGEDIPRDLLVGIYQRIQGRELRTNDDHVSQVQAVERMIVGKKPVLSLPHRRLVCCCQLYEVPDPNRPQRLGLHQREVFLFNDLLVVTKIFQKKKILVTYSFRQSFPLVEMHMQLFQNSYYQFGIKLLSAVPGGERKVLIIFNAPSLQDRLRFTSDLRESIAEVQEMEKYRVESELEKQKGMMRPNASQPGGAKDSVNGTMARSSLEDTYGAGDGLKRGALSSSLRDLSDAGVCY

SEQ ID NO: 62839 - protein, 463 aa, Homo sapiens
MATSKLPVVPGEEENTILMAKERLEALRTAFESGDLPQAASHLQELLASTESIRLEVGVTGESGAGKSSLINALRGLEAEDPGAALTGVMETTMQPSPYPHPQFPDVTLWDLPGAGSPGCPADKYLKQVDFSRYDFFLLVSPRRCGAVETRLAAEILCQGKKFYFVRTKVDEDLAATRTQRPSGFREAAVLQEIRDHCAERLREAGVADPRIFLVSNLSPARYDFPTLVSTWEHDLPSHRRHAGLLSLPDISLEALQKKKAMLQEQVLKTALVLGVIQALPVPGLAAAYDDALLIHSLRGYHRSFGLDDDSLAKLAEQVGKQAGDLRSVIRSPLANEVSPETVLRLYSQSSDGAMRVARAFERGIPVFGTLVAGGISFGAVYTMLQGCLNEMAEDAQRVRIKALEDDEPQPEVSLEVASDNGVEKGGSGEGGGEEAPLSTCRKLGLLLKYILDSWKKHDSEEK

SEQ ID NO: 62840 - protein, 278 aa, Homo sapiens
MNCLKGPPIPQNQNGTFSTRDKKLLKSRKVRFQEPFYGPYLFLSSPNSSYCSHSPGETFWSSVSGPFGLFHSLRRLNSQRGDEDKADEIQNLDNMEEEKWVSGAGRSLRKRKGTRTTSDWAAEDEEEEEEAEQQDGPCCRSSLSSSRWEAGGGAGGGGGSRGPAAWDRIRVNGGLGGGGGCRGGGDGRGDSELRGAAARTSAVSERRAATWGAGLPRPGPQSGTIGSCGREGFVLARPLLLRGSGSPAGPRLLRAPAGCSGACQWPASFRPQASACRL

SEQ ID NO: 62841 - protein, 278 aa, Homo sapiens; identical to SEQ ID NO: 62840

SEQ ID NO: 62842 - protein, 469 aa, Homo sapiens
MLESIRVTEKLHWPEQELAKKSILNAEDSLIIDNKRSISHLSSGVLKDIFTTGTSSYNVLLQSKEKKKYHSQKQSSSTYSKRCRKPSKSPNTSRSKDPRRMKALVPVTSSGTWYCLERRPAVFVTSSVSSPVKFTHDISVTGNGIVLPPKPKSKVKWCHFSTLPKPKPQLSRSFEKGDDFSGKKFCILTAIKPTNLEKEKLRFFKSDYTYNPQFEYANPALPSVLAKHSHASDRFLKQIVVHLTEDLLSRASMTVVNGCPTLTINVSTAREHWLEGMLRHEIGTHYFRGINNLQQPWNSWTGRKKHELKPNNPTEEGLASIHSVLFRKDPFLWRAALLYYTVYQASQMSFCELFKDIGRFVKDPNTRWDYCVRAKRGWTDTSQPGCFSKDQVYLDGILQILRYRDTIDFHLLTALGKVSYEDVDRLKGLAVTENMRVPHFLQDHGRYMEHLEKIMEVNELTDRELKDLI

SEQ ID NO: 62843 - protein, 485 aa, Homo sapiens [sequence omitted]

SEQ ID NO: 62844 - protein, 390 aa, Homo sapiens
MATGDLKRSLRNLEQVLRLLNYPEEVDCVGLIKGDPAASLPIISYSFTSYSPYVTELIMESNVELIAKNDLRFIDAVYKLLRDQFNYKPILTKKQFIQCGFAEWKIQIVCDILNCVMKKHKELSSLQKIPSQQRKKISSGKSEPPLGNEKISAEAVGVDISGRFMTSGKKKAVVIRHLYNEDNVDISEDTLSPITDVNEAVDVSDLNATEIKMPEVKVPEIKAEQQDVNVNPEITALQTMLAECQENLKKLTSIEKRLDCLEQKMKGKVMVDENTWTNLLSRVTLLETEMLLSKKNDEFIEFNEVSEDYASCSDMDLLNPHRKSEVERPASIPLSSGYSTASSDSTPRASTVNYCGLNEISEETTIQKMERMKKMFEETAELLKCPNHYL

SEQ ID NO: 62845 - protein, 725 aa, Homo sapiens
MGTRKKVHAFVRVKPTDDFAHEMIRYGDDKRSIDIHLKKDIRRGVVNNQQTDWSFKLDGVLHDASQDLVYETVAKDVVSQALDGYNGTIMCYGQTGAGKTYTMMGATENYKHRGILPRALQQVFRMIEERPTHAITVRVSYLEIYNESLFDLLSTLPYVGPSVTPMTIVENPQGVFIKGLSVHLTSQEEDAFSLLFEGETNRIIASHTMNKNSSRSHCIFTIYLEAHSRTLSEEKYITSKINLVDLAGSERLGKSGSEGQVLKEATYINKSLSFLEQAIIALGDQKRDHIPFRQCKLTHALKDSLGGNCNMVLVTNIYGEAAQLEETLSSLRFASRMKLVTTEPAINEKYDAERMVKNLEKELALLKQELAIHDSLTNRTFVTYDPMDEIQIAEINSQVRRYLEGTLDEIDIISLRQIKEVFNQFRVVLSQQEQEVESTLRRKYTLIDRNDFAAISAIQKAGLVDVDGHLVGEPEGQNFGLGVAPFSTKPGKKAKSKKTFKEPLRPDTPPSKPVAFEEFKNEQGSEINRIFKENKSILNERRKRASETTQHINAIKREIDVTKEALNFQKSLREKQGKYENKGLMIIDEEEFLLILKLKDLKKQYRSEYQDLRDLRAEIQYCQHLVDQCRHRLLMEFDIWYNESFVIPEDMQMALKPGGSIRPGMVPVNRIVSLGEDDQDKFSQLQQRVLPEGPDSISFYNAKVKIEQKHNYLKTMMGLQQAHRK

SEQ ID NO: 62846 - protein, 790 aa, Homo sapiens
MGTRKKVHAFVRVKPTDDFAHEMIRYGDDKRSIDIHLKKDIRRGVVNNQQTDWSFKLDGVLHDASQDLVYETVAKDVVSQALDGYNGTIMCYGQTGAGKTYTMMGATENYKHRGILPRALQQVFRMIEERPTHAITVRVSYLEIYNESLFDLLSTLPYVGPSVTPMTIVENPQGVFIKGLSVHLTSQEEDAFSLLFEGETNRIIASHTMNKNSSRSHCIFTIYLEAHSRTLSEEKYITSKINLVDLAGSERLGKSGSEGQVLKEATYINKSLSFLEQAIIALGDQKRDHIPFRQCKLTHALKDSLGGNCNMVLVTNIYGEAAQLEETLSSLRFASRMKLVTTEPAINEKYDAERMVKNLEKELALLKQELAIHDSLTNRTFVTYDPMDEIQIAEINSQVRRYLEGTLDEIDIISLRQIKEVFNQFRVVLSQQEQEVESTLRRKYTLIDRNDFAAISAIQKAGLVDVDGHLVGEPEGQNFGLGVAPFSTKPGKKAKSKKTFKEPLSSLARKEGASSPVNGKDLDYVSTSKTQLVPSSKDGDVKDMLSRDRETSSIEPLPSDSPKEELRPIRPDTPPSKPVAFEEFKNEQGSEINRIFKENKSILNERRKRASETTQHINAIKREIDVTKEALNFQKSLWEKQGKYENKGLMIIDEEEFLLILKLKDLKKQYRSEYQDLRDLRAEIQYCQHLVDQCRHRLLMEFDIWYNESFVIPEDMQMALKPGGSIRPGMVPVNRIVSLGEDDQDKFSQLQQRVLPEGPDSISFYNAKVKIEQKHNYLKTMMGLQQAHRK

SEQ ID NO: 62847 - protein, 389 aa, Homo sapiens
MYGRPQAEMEQEAGELSRWQAAHQAAQDNENSAPILNMSSSSGSSGVHTSWNQGLPTIQHFPHSAEMLGSPLVSVEAPGQNVNEGGPQFSMPLPERGMSYCPQATLTPSRMIYCQRMSPPQQEMTIFSGPQLMPVGEPNIPRVARPFGGNLRMPPSGLPVSASTGIPIMSHTGNPPVPYPGLSTVPSDETLLGPTVPSTEAQAVLPSMAQMLPPQDAHDLGMPPAESQSLLVLGSQDSLVSQPDSQEGPFLPEQPGPAPQTVEKNSRPQEGTGRRGSSEARPYCCNYENCGKAYTKRSHLVSHQRKHTGERPYSCNWESCSWSFFRSDELRRHMRVHTRYRPYKCDQCSREFMRSDHLKQHQKTHRPGPSDPQANNNNGEQDSPPAAGP

SEQ ID NO: 62848 - protein, 614 aa, Homo sapiens
MEMESAAASTRFHQPHMERKMSAMACEIFNELRLEGKLCDVVIKVNGFEFSAHKNILCSCSSYFRALFTSGWNNTEKKVYNIPGISPDMMKLIIEYAYTRTVPITPDNVEKLLAAADQFNIMGIVRGCCEFLKSELCLDNCIGICKFTDYYYCPELRQKAYMFILHNFEEMVKVSAEFLELSVTELKDIIEKDELNVKQEDAVFEAILKWISHDPQNRKQHISILLPKVRLALMHAEYFMNNVKMNDYVKDSEECKPVIINALKAMYDLNMNGPSNSDFTNPLTRPRLPYAILFAIGGWSGGSPTNAIEAYDARADRWVNVTCEEESPRAYHGAAYLKGYVYIIGGFDSVDYFNSVKRFDPVKKTWHQVAPMHSRRCYVSVTVLGNFIYAMGGFDGYVRLNTAERYEPETNQWTLIAPMHEQRSDASATTLYGKVYICGGFNGNECLFTAEVYNTESNQWTVIAPMRSRRSGIGVIAYGEHVYAVGGFDGANRLRSAEAYSPVANTWRTIPTMFNPRSNFGIEVVDDLLFVVGGFNGFTTTFNVECYDEKTDEWYDAHGMSIYRSALSCCVVPGLANVEEYAARRDNFPGLALRDEVKYSASTSTLPVRASSFS

SEQ ID NO: 62849 - protein, 833 aa, Homo sapiens
MSPEKQHREEDEVDSVLLSASKILNSSEGVKESGCSDTEYGCIAESENQIQPQSALKVLQQQLESFQALRMQTLQNVSMVQSEISEILNKSIIEVENPQFSSEKNLVFGTRIEKDLPTENQEENLSMEKSHHFEDSKTLHSVEEKLSGDSVNSLPQSVNVPSQIHSEDTLTLRTSTDNLSSNIIIHPSENSDILKNYNNFYRFLPTAPPNVMSQADTVILDKSKITVPFLKHGFCENLDDICHSIKQMKEELQKSHDGEVALTNELQTLQTDPDVHRNGKYDMSPIHQDKMNFIKEENLDGNLNEDIKSKRISELEALVKKLLPFRETVSKFHVHFCRKCKKLSKSEMHRGKKNEKNNKEIPITGKNITDLKFHSRVPRYTLSFLDQTKHEMKDKERQPFLVKQGSIISENEKTSKVNSVTEQCVAKIQYLQNYLKESVQIQKKVMELESENLNLKSKMKPLIFTTQSLIQKVETYEKQLKNLVEEKSTIQSKLSKTEEYSKECLKEFKKIISKYNVLQGQNKTLEEKNIQLSLEKQQMMEALDQLKSKEHKTQSDMAIVNNENNRMSIEMEAMKTNILLIQDEKEMLEKKTHQLLKEKSSLGNELKESQLEIIQLKEKERLAKTEQETLLQIIETVKDEKLNLETTLQESTAARQIMEREIENIQTYQSTAEENFLQEIKNAKSEASIYKNSLSEIGKECEMLSKMVMETKTDNQILKEELKKHSQENIKFENSISRLTEDKILLENYVRSIENERDTLEFEMRHLQREYLSLSDKICNQHNDPSKTTYISRREKFHFDNYTHEDTSSPQSRPLASDLKGYFKVKDRTLKHH

SEQ ID NO: 62850 - protein, 261 aa, Homo sapiens
MNPNCARCGKIVYPTEKVNCLDKFWHKACFHCETCKMTLNMKNYKGYEKKPYCNAHYPKQSFTMVADTPENLRLKQQSELQSQVRYKEEFEKNKGKGFSVVADTPELQRIKKTQDQISNIKYHEEFEKSRMGPSGGEGMEPERRDSQDGSSYRRPLEQQQPHHIPTSAPVYQQPQQQPVAQSYGGYKEPAAPVSIQRSAPGGGGKRYRAVYDYSAADEDEVSFQDGDTIVNVQQIDDGWMYGTVERTGDTGMLPANYVEAI

SEQ ID NO: 62851 - protein, 194 aa, Homo sapiens
MGKRTSLEVSLGELGGEKCRGGRRSFPPLAASRPARPGGWRWARRDLCKTASRAENNSQACRPQRRAGPDALGPGPFGRKRRKSRTAFTAQQVLELERRFVFQKYLAPSERDGLATRLGLANAQVVTWFQNRRAKLKRDVEEMRADVASLRALSPEVLCSLALPEGAPDPGLCLGPAGPDSRPHLSDEEIQVDD

SEQ ID NO: 62852 - protein, 332 aa, Homo sapiens
MSTVKEQLIEKLIEDDENSQCKITIVGTGAVGMACAISILLKDLADELALVDVALDKLKGEMMDLQHGSLFFSTSKITSGKDYSVSANSRIVIVTAGARQQEGETRLALVQRNVAIMKSIIPAIVHYSPDCKILVVSNPVDILTYIVWKISGLPVTRVIGSGCNLDSARFRYLIGEKLGVHPTSCHGWIIGEHGDSSVPLWSGVNVAGVALKTLDPKLGTDSDKEHWKNIHKQVIQSAYEIIKLKGYTSWAIGLSVMDLVGSILKNLRRVHPVSTMVKGLYGIKEELFLSIPCVLGRNGVSDVVKINLNSEEEALFKKSAETLWNIQKDLIF

SEQ ID NO: 62853 - protein, 332 aa, Homo sapiens; identical to SEQ ID NO: 62852

SEQ ID NO: 62854 - protein, 98 aa, Homo sapiens
MSSDDKSKSNDPKTEPKNCDPKCEQKCESKCQPSCLKKLLQRCFEKCPWEKCPAPPKCLPCPSQSPSSCPPQPCTKPCPPKCPSSCPHACPPPCPPPE

SEQ ID NO: 62855 - protein, 708 aa, Homo sapiens
MRERIWAPPLLLLLPLLLPPPLWGGPPDSPRRELELEPGPLQPFDLLYASGAAAYYSGDYERAVRDLEAALRSHRRLREIRTRCARHCAARHPLPPPPPGEGPGAELPLFRSLLGRARCYRSCETQRLGGPASRHRVSEDVRSDFQRRVPYNYLQRAYIKLNQLEKAVEAAHTFFVANPEHMEMQQNIENYRATAGVEALQLVDREAKPHMESYNAGVKHYEADDFEMAIRHFEQALREYFVEDTECRTLCEGPQRFEEYEYLGYKAGLYEAIADHYMQVLVCQHECVRELATRPGRLSPIENFLPLHYDYLQFAYYRVGEYVKALECAKAYLLCHPDDEDVLDNVDYYESLLDDSIDPASIEAREDLTMFVKRHKLESELIKSAAEGLGFSYTEPNYWIRYGGRQDENRVPSGVNVEGAEVHGFSMGKKLSPKIDRDLREGGPLLYENITFVYNSEQLNGTQRVLLDNVLSEEQCRELHSVASGIMLVGDGYRGKTSPHTPNEKFEGATVLKALKSGYEGRVPLKSARLFYDISEKARRIVESYFMLNSTLYFSYTHMVCRTALSGQQDRRNDLSHPIHADNCLLDPEANECWKEPPAYTFRDYSALLYMNDDFEGGEFIFTEMDAKTVTASIKPKCGRMISFSSGGENPHGVKAVTKGKRCAVALWFTLDPLYRELERIQADEVIAILDQEQQGKHELNINPKDEL

SEQ ID NO: 62856 - protein, 250 aa, Homo sapiens
MAEGGASKGGGEEPGKLPEPAEEESQVLRGTGHCKWFNVRMGFGFISMINREGSPLDIPVDVFVHQSKLFMEGFRSLKEGEPVEFTFKKSSKGLESIRVTGPGGSPCLGSERRPKGKTLQKRKPKGDRCYNCGGLDHHAKECSLPPQPKKCHYCQSIMHMVANCPHKNVAQPPASSQGRQEAESQPCTSTLPREVGGGHGCTSPPFPQEARAEISERSGRSPQEASSTKSSIAPEEQSKKGPSVQKRKKT

SEQ ID NO: 62857 - protein, 366 aa, Homo sapiens
MNISQIISYWGYPDEEYDIVTEDGYILGLYRIPYWRTDNNKNLAQRVVVYLQHGLLTSASSWISNLPNNSLGFILADAGYDVWMGNSRGNTWSRKHLYLETSSKEFWAFSFDEMAKYDLPASIDFTVKQTRQEEIFYVGHSQGTTIGFITFSTISKIAERIKIFFALAPVFSTKYLKSPLIRMTYKWKSIVMAFSGNKDFLPKTSFKKFVGSKLCPLQIFDKICLNILFMMFGYDPKNLNMSRLDVYFSHNPAGTSVQNMLHWSQLLNSTHLKAYDWGSPDLNLVHYNQTTSPLYNMTNMNVATAIWNGKSDLLADPEDVNILHSEITNHIYYKTISYYNHIDSLFGLDVYDQVYHEIIDIIQDNL

SEQ ID NO: 62858 - protein, 450 aa, Homo sapiens
MRECISIHVGQAGVQIGNACWELYCLEHGIQPDGQMPSDKTIGGGDDSFNTFFSETGAGKHVPRAVFVDLEPTVVDEVRTGTYRQLFHPEQLITGKEDAASNYARGHYTIGKEIVDLVLDRIRKLADLCTGLQGFLIFHSFGGGTGSGFASLLMERLSVDYSKKSKLEFAIYPAPQVSTAVVEPYNSILTTHTTLEHSDCAFMVDNEAIYDICRRNLDIERPTYTNLNRLIGQIVSSITASLRFDGALNVDLTEFQTNLVPYPRIHFPLATYAPVISAEKAYHEQLSVAEITNACFEPANQMVKCDPRHGKYMACCMLYRGDVVPKDVNAAIATIKTKRTIQFVDWCPTGFKVGINYQPPTVVPGGDLAKVQRAVCMLSNTTAIAEAWARLVHKFDLMYAKWAFVHWYVGEGMEEGEFSEAREDLAALEKDCEEVGVDSVEAEAEEGEEY

SEQ ID NO: 62859 - protein, 472 aa, Homo sapiens
MASPPRCSPTAHDRECKLPPPSAPASEYCPGKLSWGTMARALGRFKLSIPHTHLLATLDPLALDREPPPHLLPEKHQVPEKLIWGDQDPLSKIPFKILSGHEHAVSTCHFCVDDTKLLSGSYDCTVKLWDPVDGSVVRDFEHRPKAPVVECSITGDSSRVIAASYDKTVRAWDLETGKLLWKVRYDTFIVSCKFSPDGKYVVSGFDVDHGICIMDAENITTVSVIKDHHTRSITSCCFDPDSQRVASVSLDRCIKIWDVTSQATLLTITKAHSNAISNCCFTFSGHFLCTSSWDKNLKIWNVHTGEFRNRGACVTLMQGHEGSVSSCHFARDSSFLISGGFDRTVAIWDVAEGYRKLSLKGHNDWVMDVAISNNKKWILSASKDRTMRLWNIEEIDEIPLVIKYKKAVGLKLKQCERCDRPFSIFKSDTSSEMFTQCVFCRIDTRGLPADTSSSSSSSERENSPPPRGSKDD

SEQ ID NO: 62860 - protein, 294 aa, Homo sapiens [sequence omitted]

SEQ ID NO: 62861 - protein, 294 aa, Homo sapiens [sequence omitted]

SEQ ID NO: 62862 - protein, 235 aa, Homo sapiens
MKYVFYLGVLAGTFFFADSSVQKEDPAPYLVYLKSHFNPCVGVLIKPSWVLAPAHCYLPNLKVMLGNFKSRVRDGTEQTINPIQIVRYWNYSHSAPQDDLMLIKLAKPAMLNPKVQPLPLATTNVRPGTVCLLSGLDWSQENSGRHPDLRQNLEAPVMSDRECQKTEQGKSHRNSLCVKFVKVFSRIFGEVAVATVICKDKLQGIEVGHFMGGDVGIYTNVYKYVSWIENTAKDK

SEQ ID NO: 62863 - protein, 238 aa, Homo sapiens
MNQLILTTGGRINTFHGTKKKHILACWQVTCRFQLIFIALRVKCLGRGGGGGGGGGLGGSGWARGERTGSSQCRLRQLESKPLKMADDLDFETGDAGASATFPMQCSALRKNGFVVLKGWPCKIVEMSASKTGKHGHAKVHLVGIDIFTGKKYEDICPSTHNMDVPNIKRNDFQLIGIQDGYLSLLQDSGEVPEDLRLPEGDLGKEIEQKYDCGEEILITVLSAMTEEAAVAIKAMAK

SEQ ID NO: 62864 - protein, 520 aa, Homo sapiens
MASNDKGMAPSLGSPWASQMGPWDAILKAVKDQLPSLDSDSPLSDYGEEELFIFQRNQTSLIPDLSEELAEDPADGDKSRAWVAAAEESLPEPVLVPAELATEPGCRQNTRTKDASSQEGRDPGRPFESSGEVSALLGMAEEPPRWLEGDLGSLSFNTKGSQGPPWDPQAEATLSCHEGDPKAEPLSTASQESVNRRALRQERRKMIETDILQKVTRDACGPTSSDKGGVKEAPCHAAESAPRSKMPLVEPPEGPPVLSLQQLEAWDLDDILQSLAGQEDNQGNRAPGTVWWAADHRQVQDRMVPSAHNRLMEQLALLCTTQSKASACARKVPADTPQDTKEADSGSRCASRKQGSQAGPGPQLAQGMRLNAESPTIFIDLRQMELPDHLSPESSSHSSSDSEEEEEEEMAALGDAEGASPSSLGLRTCTGKSQLLQQLRAFQKGTAQPELPASKGPAGGRAQAPEDTAGSRTGRKQHMKLCAKGQSAQARLPRGRPRALGDVPEPGAAREALMPPLEQL

SEQ ID NO: 62865 - protein, 98 aa, Homo sapiens
MASINRTIEIMKKHGVSKQHLLEEINKKRESNCLVERSNQVSLLRVQKRHFPDAYQSFTDTTTKEPVPNSGRSSWIKLSLLAHMERKHFPPKNNAIFG

SEQ ID NO: 62866 - protein, 98 aa, Homo sapiens
MTAFALSMLSAHHLLPLPLQWLTLETKTKTPQPFSSTSQISTDKDKGLNPQLLKMDPGHMGWSDTPAQLSAGEEAQKRFRGLKDILLPCPYEQAISAP

SEQ ID NO: 62867 - protein, 98 aa, Homo sapiens; identical to SEQ ID NO: 62866

SEQ ID NO: 62868 - protein, 1639 aa, Homo sapiens
MAKDSPSPLGASPKKPGCSSPAAAVLENQRRELEKLRAELEAERAGWRAERRRFAARERQLREEAERERRQLADRLRSKWEAQRSRELRQLQEEMQREREAEIRQLLRWKEAEQRQLQQLLHRERDGVVRQARELQRQLAEELVNRGHCSRPGASEVSAAQCRCRLQEVLAQLRWQTDGEQAARIRYLQAALEVERQLFLKYILAHFRGHPALSGSPDPQAVHSLEEPLPQTSSGSCHAPKPACQLGSLDSLSAEVGVRSRSLGLVSSACSSSPDGLLSTHASSLDCFAPACSRSLDSTRSLPKASKSEERPSSPDTSTPGSRRLSPPPSPLPPPPPPSAHRKLSNPRGGEGSESQPCEVLTPSPPGLGHHELIKLNWLLAKALWVLARRCYTLQEENKQLRRAGCPYQADEKVKRLKVKRAELTGLARRLADRARELQETNLRAVSAPIPGESCAGLELCQVFARQRARDLSEQASAPLAKDKQIEELRQECHLLQARVASGPCSDLHTGRGGPCTQWLNVRDLDRLQRESQREVLRLQRQLMLQQGNGGAWPEAGGQSATCEEVRRQMLALERELDQRRRECQELGTQAAPARRRGEEAETQLQAALLKNAWLAEENGRLQAKTDWVRKVEAENSEVRGHLGRACQERDASGLIAEQLLQQAARGQDRQQQLQRDPQKALCDLHPSWKEIQALQCRPGHPPEQPWETSQMPESQVKGSRRPKFHARPEDYAVSQPNRDIQEKREASLEESPVALGESASVPQVSETVPASQPLSKKTSSQSNSSSEGSMWATVPSSPTLDRDTASEVDDLEPDSVSLALEMGGSAAPAAPKLKIFMAQYNYNPFEGPNDHPEGELPLTAGDYIYIFGDMDEDGFYEGELDDGRRGLVPSNFVEQIPDSYIPGCLPAKSPDLGPSQLPAGQDEALEEDSLLSGKAQGMVDRGLCQMVRVGSKTEVATEILDTKTEACQLGLLQSMGKQGLSRPLLGTKGVLRMAPMQLHLQNVTATSANITWVYSSHRHPHVVYLDDREHALTPAGVSCYTFQGLCPGTHYRVRVEVRLPWDLLQVYWGTMSSTVTFDTLLAGPPYPPLDVLVERHASPGVLVVSWLPVTIDSAGSSNGVQVTGYAVYADGLKVCEVADATAGSTVLEFSQLQVPLTWQKVSVRTMSLCGESLDSVPAQIPEDFFMCHRWPETPPFSYTCGDPSTYRVTFPVCPQKLSLAPPSAKASPHNPGSCGEPQAKFLEAFFEEPPRRQSPVSNLGSEGECPSSGAGSQAQELAEAWEGCRKDLLFQKSPQNHRPPSVSDQPGEKENCYQHMGTSKSPAPGFIHLRTECGPRKEPCQEKAALERVLRQKQDAQGFTPPQLGASQQYASDFHNVLKEEQEALCLDLRGTERREERREPEPHSRQGQALGVKRGCQLHEPSSALCPAPSAKVIKMPRGGPQQLGTGANTPARVFVALSDYNPLVMSANLKAAEEELVFQKRQLLRVWGSQDTHDFYLSECNRQVGNIPGRLVAEMEVGTEQTDRRWRSPAQGHLPSVAHLEDFQGLIIPQGSSLVLQGNSKRLPLWTPKIMIAALDYDPGDGQMGGQGKGRLALRAGDVVMVYGPMDDQGFYYGELGGHRGLVPAHLLDHMSLHGH

SEQ ID NO: 62869 - protein, 199 aa, Homo sapiens
MLPVQRRKLDPLLKKYRHHKKATRTKRRRKEKMEAQCSPVPPTPSTPPQSEEDEAVDKKPTLLSAQEDTPDLLHEDRLQYLQEEGSGVMHQECQIQSCELSVAQKPRPSSPAVTSLASPPLCFGSFLSCVCQTFSRSRKQKPPRRKGNNQAEAGGDAEVLRPGPAKPELSLSKTCSHLKSIELSFVFSFIVLSVCHCSS

SEQ ID NO: 62870 - protein, 199 aa, Homo sapiens; identical to SEQ ID NO: 62869

SEQ ID NO: 62871 - protein, 181 aa, Homo sapiens
  VARIANT 17,38,43,49,54,61,66,86,105,121,157,158,160,161,162,163,164,166,167,168,168,171: Xaa = Any Amino Acid
MDTSPLWLQNYLLVVNXRPMKMIGFGWIMMKMSTSYLXARSGXGLCKRXIAHCXSRGNELXRQSYXSNTGNFENVSTVNGFPWGLXNNISRGITVEVWIKANAYXWAALSSCGGRGRVRRXRAGGCETLRYLIYLEGNLPLEVAASFHRKKSKTCCXXRXXXXXFXXXRNXRKSSSEEIYI

SEQ ID NO: 62872 - protein, 181 aa, Homo sapiens; identical to SEQ ID NO: 62871
  VARIANT 17,38,43,49,54,61,66,86,105,121,157,158,160,161,162,163,164,166,167,168,171: Xaa = Any Amino Acid

SEQ ID NO: 62873 - protein, 557 aa, Homo sapiens
MDSTVPSALELPQRLALNPRESPRSPEEEEPHLLSSLAAVQTLANVIRPCYGPHGRQKFLVTMKGETVCTGCATAILRALELEHPAAWLLREAAQTQAENSGDGTAFVVLLTEALLEQAEQLLKFGLPRPQLREAYATATAEVLATLPSLAIQSLGPLEDPSWALHSVMNTHTLPPMNHLTKLVAHACWAIKELDGSFKPERVGVCTLHGGTLEDSCLLQGLAISGKLCGQMAAVLSGARVALFACPFGPAHPNAPATACLSSPADLAQFSKGSDQLLEKQVGQLAAAGINVAVVLGEVDEETLTLADKYGIVVIQARSRMEIIYLSEVLDTPLLPRLLPPQRPGKCQRVYRQELGDGLAVVFEWECTGTPALTVVLRGATTQGLRSAEQAVYHSIDAYFQPCQDPRLIPGAGATEMALAKMLSDKGSRLEGPNGPAFLAFARALKYLPKTLAENAGLAVSDVVAEMSGVHQGGNLLMGVGAEGIINVAQEGVWDTLIVKAQGFRAVAEVVLQLVTVDEIVVAKKSPTHQQIWNPDSKKTKKRPPPVEKKKILGMNN

SEQ ID NO: 62874 - protein, 151 aa, Homo sapiens
MTVLWYFLHPQSPRPFQGGATQDQAFDEPRLFGVPSWESHVSPSEIPNGRQRTPRDHIQASGTCQDAIDGPGPNPAREGKAEREAGPGSRAAASAASAAAATAAGAVMAELVQGQSAPVGMKAEGFVDALHRVRQKATGVIVLEEGLHSGA

SEQ ID NO: 62875 - protein, 174 aa, Homo sapiens
MTVLWYFLHPQSPRPFQGGATQDQAFDEPRLFGVPSWESHVSPSEIPNGRQRTPRDHIQASGTCQDAIDGPGPNPAREGKGRDRTLETHGCLGDFPFPATGPQAEREAGPGSRAAASAASAAAATAAGAVMAELVQGQSAPVGMKAEGFVDALHRVRQKATGVIVLEEGLHSGA

SEQ ID NO: 62876 - protein, 665 aa, Homo sapiens
MASASQGADDDGSRRKPRLAASLQISPQPRPWRPLPAQAQSAWEPAPAPATYRAEGGWPQVSVLRDSGPGAGAGVGELGAARAWENLGEQMGKAPRVPVPPAGLSLPLKDPPASQAVSLLTEYAASLGIFLLFREDQPPGKVFKYRAPGGEELKAMCLWQVEVLRAFLLRTGWRGLWRGDLDLGPDSSWANRLPFLLICEMESRIPAVEELGPCFPFSVSAELDGVVCPAGTANSKTEAKQQAALSALCYIRSQLENPESPQTSSRPPLAPLSVENILTHEQRCAALVSAGFDLLLDERSPYWACKGTVAGVILERGWAVSAPSCTEIPRARGHVKEIYKLVALGTGSSCCAGWLEFSGQQLHDCHGLVIARRALLRFLFRQLLLATQGGPKGKEQSVLAPQPGPGPPFTLKPRVFLHLYISNTPKGAARDIYLPPTSEGGLPHSPPMRLQAHVLGQLKPVCYVAPSLCDTHVGCLSASDKLARWAVLGLGGALLAHLVSPLYSTSLILADSCHDPPTLSRAIHTRPCLDSVLGPCLPPPYVRTALHLFAGPPVAPSEPTPDTCRGLSLNWSLGDPGIEVVDVATGRVKANAALGPPSRLCKASFLRAFHQAARAVGKPYLLALKTYEAAKAGPYQEARRQLSLLLDQQGLGAWPSKPLVGKFRN

SEQ ID NO: 62877 - protein, 240 aa, Homo sapiens
MPPPAKEGGRKGPRERSGKSAPGTAQGEERAKGAPATEPPKPGWALTPQGLAAMLPAQRHRHLLFGDLLEDVGAAASTFPCGSVEPGYRMPDPRPWTQSLELPAERQNRLLGVLKAAEARGRVRALRLRYTRMRAEEIALLIQRQKSARAAIRLELFLPPQLKPARIPDPLDRQEVQTSPGRGGERGGALPASAHAGPQPLSPAAEARGDHPGGERGWHHLPAVTATESVRRAPASHIKL

SEQ ID NO: 62878 - protein, 174 aa, Homo sapiens
MEGQRGAPRRSRGRPVSRGGAGHKAKRVTGGRGGRQGPSPAFHCALCQLQVNSETQLKQHMSSRRHKDRLAGKTPKPSSQHSKLQKHAALAVSILKSKLALQKQLTKTLAARFLPSPLPTAATAICALPGPLALRPAPTAATTLFPAPILGPALFRTPAGAVRPATGPIVLAPY

SEQ ID NO: 62879 - protein, 188 aa, Homo sapiens
MATPLGWSKAGSGSVCLALDQLRDVIESQEELIHQLRNVMVLQDENFVSKEEFQAVEKKLVEEKAAHAKTKVLLAKEEEKLQFALGEVEVLSKQLEKEKLAFEKALSSVKSKVLQESSKKDQLITKCNGRREARALHHGYINGLFPNHPVPVSKAGFHSNTCPQLRIQAGPGGPHLRKGLKGPGRPRK

SEQ ID NO: 62880 - protein, 188 aa, Homo sapiens; identical to SEQ ID NO: 62879

SEQ ID NO: 62881 - protein, 347 aa, Homo sapiens
MTVQDGQSLFQDNPLGKWGDLGSQGSWAAAHQPWVPETLSQSGSVSWQPDAGAMALLTPQGVKEVFQLQRPQGRERLRRLLNWEEFDEQRDSRRSILLDTLYESIIFAVGKGFPWVEVAQVVKFTEELLRETKGCSITEAVTILGNKLRDYRGHFNTTHLLALCDYFHHTFIRHYKLYQYVLGQDQQVDLTVAHLEVCMPPHPLPLAEGMDRDLWIHEQQVATLTEAEAQKRADVLLLKEALRLERENSLQKAFAAAAPAQPGQVLERQELESLICQAVHTQMELLQELLQRQIQNTFAILDLKLQKKTLNLNAPTPIPPPITSHAGQEEALKPQRASKGKKAKARK

SEQ ID NO: 62882 - protein, 347 aa, Homo sapiens
MTVQDGQSLFQDNPLGKWGDLGSQGSWAAAHQPWVPETLSQSGSVSWQPDAGAMALLTPQGVKEVFQFQRPQGRERLRRLLNWEEFDEQRDSRRSILLDTLYESIIFAVGKGFPWVEVAQVVKFTEELLRETKGCSITEAVTILGNKLRDYRGHFNTTHLLALCDYFHHTFIRHYKLYQYVLGQDQQVDLTVAHLEVCMPPHPLPLAEGMDRDLWIHEQQVATLTEAEAQKRADVLLLKEALRLERENSLQKAFAAAAPAQPGQVLERQELESLICQAVHTQMELLQELLQRQIQNTFAILDLKLQKKTLNLNAPTPIPPPITSHAGQEEALKPQRASKGKKAKARK

SEQ ID NO: 62883 - protein, 870 aa, Homo sapiens
MVKEKKKADKKGEKSARSPSSLSDNLDFSKQDGNTTRQEMSPAGVPLLGMQLNEVKPKKDRQNVQQNEDASQYEESILTKLIVESYEGEKVRGLYEGEGFAAFQGGCTYRGMFSEGLMHGQGTYIWADGLKYEGDFVKNVPMNHGVYTWPDGSMYEGEVVNGMRNGFGMFKCSTQPVSYIGHWCNGKRHGKGSIYYNQEGTCWYEGDWVQNIKKGWGIRCYKSGNIYEGQWEDNMRHGEGRMRWLTTNEEYTGRWERGIQNGFGTHTWFLKRIRSSQYPLRNEYIGEFVNGYRHGRGKFYYASGAMYDGEWVSNKKHGMGRLTFKNGRVYEGAFSNDHIAGFPDLEVEFISCLDLSSGVAPRLSRSAELIRKLDGSESHSVLGSSIELDLNLLLDMYPETVQPEEKKQVEYAVLRNITELRRIYSFYSSLGCGHSLDNTFLMTKLHFWRFLKDCKFHHHKLTLADMDRILSANNDIPVEEIHSPFTTILLRTFLNYLLHLAYHIYHEEFQKRSPSLFLCFTKLMTENIRPNACQIKGNLFREQQRTLYSISYMNKCWEIYLAYCRPSAAPPHEPTMKMRHFLWMLKDFKMINKELTAATFMEVIAEDNRFIYDGIDSNFEPELVFLEFFEALLSFAFICVTDQMTKSYTNVPADDVSGNKHETIYTILNQDAQNKSPSAVMSHESDAAHSDSARSSSSKLELSPDVNKIRKSEPKIKKSVSHERVSKMNFKLTGKGITFFSSESKKYERPKDDREEEFNTWVNNMYVFFVNTLFHAYKREEAIKEKIRADRLRSTAQAQQRKMEDDELEARLNIFILREEEAKRHDYEVDITVLKKPADVSSSHLILDPPKEDVTVSPSSKTITSKKKKK

SEQ ID NO: 62884 - protein, 286 aa, Homo sapiens
MAALAVLAPEAASWTPGVRGSLRRSVARALAGSGAAASRPRRIRPAPAGLELDPELGKLEKQAQTRKPRYGKSLSKESFPRFTPRLHQGTAWAYGLPNPKRPQPRAGIRPSGREGRRRPQSAGAGGARPQDARGWVGRREGRQQARGCFPSVRTAGPGGHFESAKRGGKMAAWAPGRSPRQGPAEPLLPFVQPRGPQKRNARRERPVRSPQTDARLFITARPRGKSGCRLPAHSPPDPPSRLPGPRSRSRRARLCVSWLLGRKRLPDMLWSQKTAKREAEAPVARV

SEQ ID NO: 62885 - protein, 286 aa, Homo sapiens; identical to SEQ ID NO: 62884

SEQ ID NO: 62886 - protein, 164 aa, Homo sapiens
MNNSLDYLAYPVIVSNHRQSTTFRKKLDFGHYVSHKNRIQIAKPTVDTKPPVAHTNHILKLSKLQGEQKKINKIEYENKQLCQKIANAHRGPAKVDCWNEYFSKSLNRETRNRELVRITMENQGILKRLVDRKPHYDRRASEIDWQNSRRYIRNTTRYLLSQNE

SEQ ID NO: 62887 - protein, 164 aa, Homo sapiens; identical to SEQ ID NO: 62886

SEQ ID NO: 62888 - protein, 226 aa, Homo sapiens
MDTVCTDVKKERWHRSNDPERTAGHQRAPLSSSSASIWEDARCQADPGLAVAAAILYYLCRKYSAPSHWCPPDPHARARVDEFVAWQHTAFQLPMKKIVWLKLLIPKITGEEVSAEKMEHAVEEVKNSLQLFEEKFLQDKMFITGNQISLADLVAVVEMMQPMAANYNVFLNSSKLAEWRMRVELNISSGLFREAHDRLMQLADWDFSTLDSMVKENISELLKKSR

SEQ ID NO: 62889 - protein, 156 aa, Homo sapiens
METVNEPETGEVSKDAVIVKQEKNNEYCLQDIDDKLSESAEDDGEDDTNDEDDDEDSNPKKNTQAPLELMAEFLRAEMAREYQLAKKLCQMILIYEPENPEAKEFFTLIEEMLLMEKTQNHEQDGENSDEDSSGESKGESDEELSDESSDEGEDGS

SEQ ID NO: 62890 - protein, 156 aa, Homo sapiens; identical to SEQ ID NO: 62889

SEQ ID NO: 62891 - protein, 263 aa, Homo sapiens
MDILFPLDSVIGTELCPSPIPQIIHFVLFVVFSLVILIILRLYIPREPSSVPPREEDSENDQAEVGEWLRIGNKYITLKDYRILLKELENLEIYTFLSKKCLKKLSREGSSHHLPRQVRPGPVYKPAPARNHRPRGGRGKASPTSFHVSPRAPLAPLASMPSSVPKTSVESLGSPSSLSSSKPREPLCPLKHPSHQPPASTLSPNPTSSTESLGETPHAGRWRQGSRFPQPGCANAAGRIRHQNPRHSHGHRISDIHEQLGIS

SEQ ID NO: 62892 - protein, 339 aa, Homo sapiens
MDILFPLDSVIGTELCPSPIPQIIHFVLFVVFSLVILIILRLYIPREPSSVPPREEDSENDQAEVGEWLRIGNKYITLKDYRILLKELENLEIYTFLSKKCLKKLSREGSSHHLPRQVRPGPVYKPAPARNHRPRGGRGKASPTSFHVSPRAPLAPLASMPSSVPKTSVESLGSPSSLSSSKPREPLCPLKHPSHQPPASTLSPNPTSSTESLGYLSSLSSSQPPEPLRPLKHPSHKPRGRSLPRRRNPGWVSWSDSMQADSETDTIICPMCKAPERSCPHTWWVPSSPRVIRGVGRCSDPNLGLSWRQEAARAWCHCTSSQFPFKHPNLPTHLPKASF

SEQ ID NO: 62893 - protein, 157 aa, Homo sapiens
MNLDGSAQDPEKREYSSVCVGREDDIKKSERMTAVVHDREVVIFYHKGEYHAMDIRCYHSGGPLHLGDIEDFDGRPCIVCPWHKYKITLATGEGLYQSINPKDPSAKPKWCSKGIKQRIHTVTVDNGNIYVTLSNEPFKCDSDFYATGDFKVIKSSS

SEQ ID NO: 62894 - protein, 114 aa, Homo sapiens; identical to SEQ ID NO: 28914

SEQ ID NO: 62895 - protein, 832 aa, Homo sapiens
MYKEDRGSLLGLMGVLAGCQAPSRECGSGGKEHAQALKLVSDTVRSSPAGSADPEALLSWNDIMTSCLLETQQQIPGTPHSVLPRPCHGNKDSAGASRLIFLLLEKFLPRQLSRAESAGKAAVWTSGWKPIHQPAFLVLAQGWLRGGTCSAGPELCTSWTTVSGMRREVGASGATHRAAPGNLCWQALPQPCKPGPRALNPGARPCPERLSALQHRPPGPSPAASKGSVPSVARPHRTDQAHVADPPSPLTPVGPITQSPKRTLAALQRGGRGLVDPVVPPHSAPSRLPCSTSQTIPSLLDELQCGSPGVRKPILTKLSDPSLPVRKLRSLKTGESSSPPLQQLPPLCQLGAACPHSKANPASPKMRLPSSPPLLERALAPQWATLSPQQQEDHPGTGQHVALSPTRPPHLWALPPLSAVGVQAALALRSDSCPSGSHGNADFSHRLGWESSTLVTRHCHFSSGQVLSRSPPPGHIIRAMVRVQGLVKAIKRALGSFKEREPLSLKQGRSWEHGGVWGVAGESSATERGADVPGQPHELHHGISGTAPEGHPDSDSQGSQESRPCQKEMAQGCAVVTGLSHFSLEQWMGYTESWARRRPALALHDSLGPEGECTLSCQENVVAKGTEHQCSTWNFQAGHWGTVGGTQKMLPLLIICLLPAIEGKNCLRCWPELSALIDYDLQILWVTPGPPTELSQSIHSLFLEDNNFLKPWYLDRDHLEEETAKFFTQVHQAIKTLRDDKTVLLEEIYTHKNLFTERLNKISDGLKEKDIQSTLKVTSCADCRTHFLSCNDPTFCPARNRRTSLWAVSLSSALLLAIAGDVSFTGKGRRRQ

SEQ ID NO: 62896 - protein, 127 aa, Homo sapiens [sequence omitted]

SEQ ID NO: 62897 - protein, 244 aa, Homo sapiens
MKRRQKRKHLENEESQETAEKGGGIQRIHRDSPQPQSPLAQVQERGETPPRSQHVSLSSYSSYKTCVSSLCVNKEERGMKIYYMQVQMNKGVAVSWETEETLESLEKQPRMEEVTLSEVVRVGTPPSDVSTRNLLSDSEPSGEEKEHEERTESDSLPGSPTVEDTPRAKTPDWLVTMENGFRCMACCRVFTTMEALQEHVQFGIREGFSCPKMSRRRKMEMRRRRKRNQKQRRRRGSPQKKTLA

SEQ ID NO: 62898 - protein, 790 aa, Homo sapiens [sequence omitted]

SEQ ID NO: 62899 - protein, 1014 aa, Homo sapiens
MSFSLTFTELANIAIPQCGVLNFKALHLLLHGILEHIHMAELKKVLSGDEDFLQTSQVVIMPREGDAQPILNPMKRLSNVFDHVVSRLDKLENQLALLQDLPSTAQLLEASQGTARPVQDLWHLIKLRKMVEGHDEVMAKSMQTLQDLLTDLHALQVTITALRKEVDMLKNMLDKVHPERMDIFAEDFKIQNWKMVALQREVASLQNKFKTIPKTEDMVLWSGLHDAMFTSEIGSSPLDLWQSVEQLPEAALAQTTKYLEATRAIQVSEPVQNPQLLQTVWHYEVPELLPEGSSAQAVSLSRAQEPAQPPALTPESAPGCTTEFAPGPAPGTEPVPGLELGLELEPVPALGPVPGPSPYQSRQGEALQLAAVQVKGEENDVPSLRGLRERARKDGAPKDRTRKDGVPKDRGGKDVDPKDRAHKDDVPKDRGGKDVDPKDRAHKDDVPKDRGGKDGDPKDRAAKVAAKFVKDAPATKMAAIATDTAAAGPLGVFADVLGAGPSRGATESQILGDDSEIYEILSPSYSAASIGPDPALSQAMVATKQAMSPEDKKRAVKYSMSHIAQIPVKHDSLKEEFAQLSCNLNQRLSYLANMGGPSSLGTTVDILQKKIGSLQKSRLKEEELERIWGNQIEMMKDRYITLDKAVENLQIRMDEFKTLQAQIKRLEMNKVNKSTMEEELREKADRSALAGKASRVDLETVALELNEMIQGILFKVTIHEDSWKKAMEELSKDVNTKLVHSDLDPLKKEMEEVWKIVRKLLIEGLRLDPDSAAGFRRKLFKRVKCISCDRPVEMMTGPQLITIRKAHLLSRLRPASANSCEYLQRQQMREQQWLQLQDLGIQEDCQQDWGDGPQNATSLKCKSCNLLTLYPYGDPHVIDYDSAEVDILGVDGILYKGRVNSQRGAQPLAVAKELAAVKAPSPPSQSLYDRVHSSALFGAICPPLCPRSSACSAASGPHLTMPARPPSLPPLLLLPPLIPSLRDPQQAPGSTRLSRAPHIESRVGRKPPEEPANP

SEQ ID NO: 62900 - protein, 496 aa, Homo sapiens
MAANCTSSWSLGESCNSPGSEPPQSMPSPATQLGNHDSDPETCHVNFRMFSCPKESDPIQALRKLTELCHLWLRPDLHTKEQILDMLVMEQFMISMPQELQVLVMMNGVQSCKDLEDLLRNNRRPKKWSVVSFLGKEYLMQESDVEMAEAPASVRDDPRHVSSQRTSSVNQMCPEEGQASQELQTLPRVPALFRRQEEDFLLPETTVMKGDPKALRPKPTLEKDLEEDREENPGLTSPEPQLPNSPTGVVGAKEGKEPQKRASVENVDADTPSACVVEREASTHSGSRGDALNLRGLKRSKPDATSISQEEPQGEATPVGNRESPGQAEINPVHSPGPAGPVSHPSGQEVKELLPFACEVCGKRFKYRGKLAVHTRSHTGERLFQCNLCGKRFMQRIGLQFHQRTHTGERPYTCDICQKQFTQKSYLKCHKRSHTGEKPFECKDCKKVFTYKANLKEHQRIHSGEKPHKCSKCPRAFGRPATLRRHQKTHREATSQ

SEQ ID NO: 62901 - protein, 309 aa, Homo sapiens
MSKIRGLPPEVREPGPGVELGVENGLLCQLIHSPEFNLFSNSVVFESNFIQTHVPEADFQVTKPGNWRDVCEGSATVILGVTSSVPSLPLPNVLLMANVTWPQGPFTTWSTPGDAPVINLSRLLPLKYVELRIYDRLQRILRVRTVTEKIYYLKLHEKHPEIVFQFWVRLVKILQKGLSITTKDPRIKFTHCLVPKMPTNSTETTPENSLLSSPQPSEPLVLLAAEQTSGSFSQLSGKPQLTADRNNDTAIEIDNCSSYKIPSPVASPINLNIPMRAALSHSLWEQEDWNEHLLQVHIASYLGEHFLGA

SEQ ID NO: 62902 - protein, 298 aa, Homo sapiens [sequence omitted]

SEQ ID NO: 62903 - protein, 298 aa, Homo sapiens [sequence omitted]

SEQ ID NO: 62904 - protein, 446 aa, Homo sapiens
MLHPETSPGRGHLLAVLLALLGTAWAEVWPPQLQEQAPMAGALNRKESFLLLSLHNRLRSWVQPPAADMRRLDWSDSLAQLAQARAALCGTPTPSLASGLWRTLQVGWNMQLLPAGLASFVEVVSLWFAEGQRYSHAAGECARNATCTHYTQLVWATSSQLGCGRHLCSAGQAAIEAFVCAYSPRGNWEVNGKTIVPYKKGAWCSLCTASVSGCFKAWDHAGGLCEVPRNPCRMSCQNHGRLNISTCHCHCPPGYTGRYCQVRCSLQCVHGRFREEECSCVCDIGYGGAQCATKVHFPFHTCDLRIDGDCFMVSSEADTYYRARMKCQRKGGVLAQIKSQKVQDILAFYLGRLETTNEVIDSDFETRNFWIGLTYKTAKDSFRWATGEHQAFTSFAFGQPDNHGFGNCVELQASAAFNWNDQRCKTRNRYICQFAQEHISRWGPGS

SEQ ID NO: 62905 - protein, 140 aa, Homo sapiens
MRKLFSFGRRPGRAVLGSIDHEYPGPAYHTRDAELRKIHRAALKGDAAEVERRLARRCRDVDAQDRTVLHLACAHGRVQVVTLLLSRKCQIDICDRLNRTPLMKAVYCQEETCSIILLEHGTSPNIKDVYSNTALHDGKH

SEQ ID NO: 62906 - protein, 284 aa, Homo sapiens
MEWKLEQSMREQALLKAQLTQLKESLKEVQLERDEYAEHLKGERARWQQRMRKMSQEVCSLKKEKKHDKYRVEKLERSLSKLKNQMAEPLPPEPPAVPSEVELQHLRKELERVAGALQAQLVEKEELGFFQYYREGCHQKVYHPITKPGGSAKDAAPGGGHHQAGPGQGGDEGEAAGAAGDGVAAGGDYKGHSKFLVTAQNPAHEPSPGAPAPQELGAAHKHGDLCEVSLTDSVEPVQVEAREGSPHDNPTAQPIVQDHQEHPGLGSNCCVPFFCWAWLPRRRR

SEQ ID NO: 62907 - protein, 346 aa, Homo sapiens
MRLRFWLLIWLLLGFISHQPTPVSFLKTIFWSRNGHDGSMDVQQRAWRSNRSRQKGLRSICMHTKKRVSSFRGNKIGLKDVITLRRHVETKVRAKIRKRKVTTKINRHDKINGKRKTARKQKMFQRAQELRRRAEDYHKCKIPPSARKPLCNWVRMVAAEHRHSSGLPYWPYLTAETLKNRMGRQPPPPTQQHSITDNSLSLKTPTECLLTPLPPSVDDNIKECPLAPLPPSPLPPSVDDNLKECLFVPLPPSPLPPSVDDNLKTPPLATQEAEVEKPPKPKRWRVDEVEQSPKPKRRRVDEVEQSPKPKRQREAEAQQLPKPKRRRLSKLRTRHCTQAWAIRINP

SEQ ID NO: 62908 - protein, 200 aa, Homo sapiens
MVKLSIVLTPQFLSHDQSQLTKELQQHVKSVTCPCEYLRKVINSLAVYRHRETDFGVGVRDHPGQHGKTPSPQKLDNLIIIIIGFLRRYTFNILFCTSCLCVSFLKTIFWSRNGHDGSMDVQQRAWRSNRSRQKGLRSICMHTKKRVSSFRGNKIGLKDVITLRRHVETKVRAKIRKRKVTTKINRHDKINGKRKTARKQ

SEQ ID NO: 62909 - protein, 407 aa, Homo sapiens
MRLRFWLLIWLLLGFISHQPTPVINSLAVYRHRETDFGVGVRDHPGQHGKTPSPQKLDNLIIIIIGFLRRYTFNILFCTSCLCVSFLKTIFWSRNGHDGSMDVQQRAWRSNRSRQKGLRSICMHTKKRVSSFRGNKIGLKDVITLRRHVETKVRAKIRKRKVTTKINRHDKINGKRKTARKQKMFQRAQELRRRAEDYHKCKIPPSARKPLCNWVRMVAAEHRHSSGLPYWPYLTAETLKNRMGRQPPPPTQQHSITDNSLSLKTPTECLLTPLPPSVDDNIKECPLAPLPPSPLPPSVDDNLKECLFVPLPPSPLPPSVDDNLKTPPLATQEAEVEKPPKPKRWRVDEVEQSPKPKRRRVDEVEQSPKPKRQREAEAQQLPKPKRRRLSKLRTRHCTQAWAIRINP

SEQ ID NO: 62910 - protein, 75 aa, Homo sapiens
MVRELWMWNVEEEEHEVGICTWGGQHCGCPAKSLPGPHPGGVSAPQSASQLMVKLLVWQKSVHKLRKLLEKTENY

SEQ ID NO: 62911 - protein, 78 aa, Homo sapiens
MVRELWMWNVEEEEHEVGICTWGGQHCGCPAKSLPGPHPGGVSAPQSASQLMVKLLVWQKSVHKLRKGRGGKVLAPMA

SEQ ID NO: 62912 - protein, 80 aa, Homo sapiens; identical to SEQ ID NO: 10080

SEQ ID NO: 62913 - protein, 81 aa, Homo sapiens
MQEMVRELWMWNVEEEEHEVGICTWGGQHCGCPAKSLPGPHPGGVSAPQSASQLMVKLLVWQKSVHKLRKGRGGKVLAPMA

SEQ ID NO: 62914 - protein, 154 aa, Homo sapiens
MAYLSECRLRLEKGFILDGVAVSTAARAYGRSRPKLWSAIPPYNAQQDYHARSYFQSHVVPPLLRKTDQDHGGTGRDGWIVDYIHIFGQGQRYLNRRNWAGTGHSLQQVTGHDHYNADLKPIDGFNGRFGYRRNTPALRQSTSVFGEVTHFPLF

SEQ ID NO: 62915 - protein, 154 aa, Homo sapiens; identical to SEQ ID NO: 62914

SEQ ID NO: 62916 - protein, 242 aa, Homo sapiens
MERNDIINFKALEKELQAALTADEKYKRENAAKLRAVEQRVASYEEFRGIVLASHLKPLERKDKMGGKRTVPWNCHTIQGRTFQDVATEISPEKAPLQPETSADFYRDWRRHLPSGPERYQALLQLGGPRLGCLFQTDVGFGLLGELLVALADHVGPADRAAVLGILCSLASTGRFTLNLSLLSRAERESCKGLFQKLQAMGNPRSVKEGLSWEEQGLEEQSGGLQEEERLLQELLELYQVD

SEQ ID NO: 62917 - protein, 44 aa, Homo sapiens
MATSQYFDFAQGGGPQYSTLLEDGTLVWLFPAAVTAPMTAAGPH

SEQ ID NO: 62918 - protein, 44 aa, Homo sapiens; identical to SEQ ID NO: 62917

SEQ ID NO: 62919 - protein, 240 aa, Homo sapiens
MGIHFSCIRGDLKKPSKKRVKREPYSTTMLQVTSLSPINEILRRYSLYTNQHWRHHGFWRKKIQPQEASEEPPAHKDRGGGERPVNARVVRVAPLRPGFALCGYAVQDISKEDTVYDICNEDAVDISDEDTVDISNEASVHDISNEAAVCDISNDAVNISNEAAVRDISNDAVDICNEAAVHDISNEDTIEDISYEDTVYDITNEDAVRYLCKKDATKEPLTLENDLIVESMSDDEDFAA

SEQ ID NO: 62920 - protein, 108 aa, Homo sapiens
MQDPEGSKESTVRHKSTVRQLSFRDVVLRCRPHPQVHPGSQPSEGTMEIQLLTLGSRRIPDHSCVHPGREPSEDFRDHLEGSGPERLPRNRLWLFTRCLLCFIWEPLP

SEQ ID NO: 62921 - protein, 148 aa, Homo sapiens
MGPEEKTIMTERSAAVFIQAWWRGMLVRRTLLHAALRAWIIQCWWRQVLEKLLAKRRRMVLEFYVQQEWAAVRLQSWVRMWCVRQRYCRLLNAVRIIQVYWRWHSCHSRVFIEGHYELKENQLNIQLEISLGLQACKVQQCIPLPLKE

SEQ ID NO: 62922 - protein, 148 aa, Homo sapiens; identical to SEQ ID NO: 62921

SEQ ID NO: 62923 - protein, 219 aa, Homo sapiens
MSSRLSLFTKKLSREQPVDPDLKDYRFSRDDEKERALAKEGLLHSSSSSSSLGCCHSHRGTVEERPSAMKIIPGDSWIKIEIARHKEGGKFDHSANLEKLVDNVFQETYGHPTDMNQIIPALMGCQRKTAASRDPLETEQREEDTFPEAQMFQKPAPHSQSHPKNALEFGVLKKREEGLSKGLGTKLDPTSASAHASDGAHRWRAACPSFPWCPQTHLG

SEQ ID NO: 62924 - protein, 219 aa, Homo sapiens; identical to SEQ ID NO: 62923

SEQ ID NO: 62925 - protein, 111 aa, Homo sapiens
MLTPRKAFRTCSKESGLAETESCGQTHTWPRALAVLMGLWWPRDQKAGEEDLRFRERRPGLQATATGSGEHGAFPVHSQGVWASTHWQGTAVCPLQTPPPDAFIRNNKVLS

SEQ ID NO: 62926 - protein, 265 aa, Homo sapiens
MGQILGKIMMSHQPQPQEERSPQRSTSGYPLQEVVDDEVSGPSAPGVDPSPPRRSLGWKRKRECLDESDDEPEKELAPEPEETWVAETLCGLKMKAKRRRVSLVLPEYYEAFNRLLEDPVIKRLLAWDKDLRVSDKYLLAMVIAYFSRAGLPSWQYQRIHFFLALYLANDMEEDDEAPKQNIFYFLYEETRSHIPLLSELWFQLCRYMNPRARKNCSQIALFRKYRFHFFCSMRCRAWVSLEELEEIQAYDPEHWVWARDRAHLS

SEQ ID NO: 62927 - protein, 267 aa, Homo sapiens
MAADDLLTSYTEVLAVGIEKQMVLPEAPGLVPQYTVWWPAWHRAQQNFSLLLAVVVQSKHPSPNIPWFPSSVTSQTAFCLLCQLQCNGVTRDLKFIPTGDNPRALFFGFCFPLEGVTGPGPAGIIGSQKQPSPVNWAQTQDWLIQQGTPADKAGRVEVSTPFHGDCQEPYAINDSKVPSQTQEHKPSTQNLLLQKDELDRQNPKRINAVSHLPSRTPLIQTKKSTSSSSSEFEDLNAYASQRNFYKRNLNRYCQEHWPFQPCLTGRP

SEQ ID NO: 62928 - protein, 374 aa, Homo sapiens
MIEYQIPVSFKDVVVGFTQEEWHRLSPAQRALYRDVMLETYSNLASVGYEGTKPDVILRLEQEEAPWIGEAACPGCHCWEDIWRVNIQRKRRQDMLLRPGAAISKKTLPKEKSCEYNKFGKISLLSTDLFSSIQSPSNWNPCGKNLNHNLDLIGFKRNCAKKQDECYAYGKLLQRINHGRRPNGEKPRGCSHCEKAFTQNPALMYKPAVSDSLLYKRKRVPPTEKPHVCSECGKAFCYKSEFIRHQRSHTGEKPYGCTDCGKAFSHKSTLIKHQRIHTGVRPFECFFCGKAFTQKSHRTEHQRTHTGERPFVCSECGKSFGEKSYLNVHRKMHTGERPYRCRECGKSFSQKSCLNKHWRTHFGESSLRSKSSNT

SEQ ID NO: 62929 - protein, 78 aa, Homo sapiens
MCQKTELETALHDSQDAARKFEEDSKDLAGCLHHSWHFAGELQRALSAMSAEHKRADRYIEELTKEREAMSLELYRNT

SEQ ID NO: 62930 - protein, 453 aa, Homo sapiens
METRGPGLAVRAESRRLVGIGPRAPPGRVGLQPSGRLDRRGGAGTMGYKDNDGEEEEREGGAAGPRGSRLPPITGGASELAKRKVKKKKRKKKTKGSGKGDDKHQSQSLKSQPLSSSFHDILSPCKERGPKPEHRQSKVEKKHLPSDSSTVSLPDFAEIENLANRINESLRWDGILADPEAEKERIRIYKLNRRKRYRCLALKGFHPDPEALKGFHPDPEALKGFHPDPEALKGFHPDPEALKGFHPDPEALKGFHPDPEALKGIHPDPEALKGIHPDPEALKGFHPDPEALKGFHPDPEALKGFHTDPEALKGFHIDPEALKGFHPDPKALKGFHPDPKALKGFHTDPEALKGFHPDPKALKGFHPDPEALKGFHPDPEALKGFHPDPEALKGFHTDPNAEEAPENLPYLSDKDGSSSHRQPTSKAECPNLCFEGNLTPKLLHSDLAPTLLE

SEQ ID NO: 62931 - protein, 161 aa, Homo sapiens
MARTQGACARAPPPPAPRSSRQPAPLAPRPWSSRARLPRSRPSAIPPGWGRAGGKDSAGWCAGGPAPRATHAPSQQLGADGPEAVAQDTRRRLGPPTALWPRAERPGRGDASPGTQCPPWPSPDPACASPRVVDRAAGIPEGFAGRTWSTGPAKRAAVART

SEQ ID NO: 62932 - protein, 148 aa, Homo sapiens [sequence omitted]

SEQ ID NO: 62933 - protein, 148 aa, Homo sapiens [sequence omitted]

SEQ ID NO: 62934 - protein, 215 aa, Homo sapiens
MASGRWASPGPAWASRRPLQAQVVLKSASPGPAPASQQASSFGSAPAQLPPAFVDPELSPAMLLSPTCLPVACTGPGLAGEQPLQAPLLPPRGISRPSSGLTAASRDQVPACLPAACVRPSSSVTVACSGPTHASGTLSRGVSPCLTLASLTLREFSVGPCLTLASLTLREVSMSPCLTLVSLTLRAILPHAGLLRPSSCLCWPFQAQPLPVGGL

SEQ ID NO: 62935 - protein, 206 aa, Homo sapiens
MVVVMKFFRWVRRAWQRIISWVFFWRQKIKPTISGHPDSKKHSLKKMEKTLQVVETLRLVELPKEAKPKLGESPELADPCVLAKTTEETEVELGQQGQSLLQLPRTAVKSVSTLMVSALQSGWQMCSWKSSVSSASVSSQVRTQSPLKTPEAELLWEVYLVLWAVRKHLRRLYRRQERHRRHHVRCHAAPRPNPAQSLKLDAQSPL

SEQ ID NO: 62936 - protein, 87 aa, Homo sapiens
MVVIDVKMLSGFTPTMSSIEELENKGQVMKTEVKNDHVLFYLENGFGRADSFPFSVEQSNLVFNIQPAPAMVYDYYEKVGEAFLVTN

SEQ ID NO: 62937 - protein, 776 aa, Homo sapiens
MTPEAHWTGPPNPGALGYPHQSFVSQPHPFRKQPSPCPRQSPQGDFGWVTPGASRSITGLSSPAAPSLISVGSLGSHLQGARPHPRQSSLGDFGLVTPGTPCCRLCPPLLLPQGRPPWVLCAGVSKELGPNPVLPSPIVEQRLGHGADMVPPPDQEEWNVLKEYWQKNRPRVPAGVNRNRKTNGSIPETATSGGCQPPGDSATGFHREGPTSSATLKDLESPCQERAVVLDSTSVKISRLKNTIKSLKQQKKQVEHQLEEEKKANNERQKAERELEVQIQTLIIQKEELNTDLYHMERSLRYFEEESKDLAVRLQHSLQCKGELESALSAVIATEKKKANQLSSCSKAHTEWELEQSLQDQALLKAQLTQLKESFQQLQLERDECAEHIEGERARWHQRMSKMSQEICTLKKEKQQDMRRVEELERSLSKLKNQMAEPLPPEPPAVPSEVELQHLRKELERVAGELQSQVKNNQHISLLNRRQEERIREQEERLRKQEERLQEQHEKLRQLAKPQSVFEELNNENKSTLQLEQQVKELQEKLGEEHLEAASQQNQQLTAQLSLMALPGEGHGGEHLDSEGEEAPRPMPSVPEDPESREAMSSFMDHLKEKADLSELVKKQELRFIQYWQERCHQKIHHLLSEPGGRAKDAALGGGHHQAGAQGGDEGEAAGAAADGIAAYSNYNNGHRKFLAAAHNSADEPGPGAPAPQELGAADKHGDLREVTLTSSAQGEAREDPLLDKPTAQPIVQDHQEHPGLGSNCCVPLFCWAWLPRRRR

SEQ ID NO: 62938 - protein, 367 aa, Homo sapiens
  VARIANT 51,94: Xaa = Any Amino Acid
MRLRFWLLIWLLLGFISHQPTPVSFLKTIFWSRNGHDGSMDVQQRAWRSNXSRQKGLRSICMHTKKRVSSFRGNKIGLKDVITLRRHVETKVRXKIRKRKVTTKINRHDKINGKRKTARKQKMFQRAQELRRRAEDYHKCKIPPSARKPLCNWVRMAAAEHRHSSGLPYWLYLTAETLKNRMGRQPPPPTQQHSITDNSLSLKTPPECLLTPLPPSVDDNIKECPLAPLPPSPLPPSVDDNLKECLFVPLPPSPLPPSVDDNLKECLFVPLPPSPLPPSVDDNLKTPPLATQEAEVEKPPKPKRWRVDEVEQSPKPKRRRVDEVEQSPKPKRQREAEAQQLPKPKRRRLSKLRTRHCTQAWAIRINP

SEQ ID NO: 62939 - protein, 182 aa, Homo sapiens
MGKEDEQSASQRSLWNSMEEISEELFNRSNSTSLDNRQLRHITNHGHCWASLRAPAVAAAAAPQDPATKSRVGSGAPQAAAPAPAALVAGNPGGDGAPAATGTAAAASLATAADSEDAEKKVLATKVLGTVKWFNVRNGYGFINRNDTKEDLFIHQTAIKKNNPQKYLRSVGDGETVEFDVV

SEQ ID NO: 62940 - protein, 82 aa, Homo sapiens
MRPPGPEICVIVGKRRKTNKGTVNGVTWLEYGSNYKACSALARRKGYMKTEQEGSYLQARKRVLTKTQPCWYPDLQLPVLSC

SEQ ID NO: 62941 - protein, 82 aa, Homo sapiens [sequence omitted]

SEQ ID NO: 62942 - protein, 1639 aa, Homo sapiens
MAKDSPSPLGASPKKPGCSSPAAAVLENQRRELEKLRAELEAERAGWRAERRRFAARERQLREEAERERRQLADRLRSKWEAQRSRELRQLQEEMQREREAEIRQLLRWKEAEQRQLQQLLHRERDGVVRQARELQRQLAEELVNRGHCSRPGASEVSAAQCRCRLQEVLAQLRWQTDGEQAARIRYLQAALEVERQLFLKYILAHFRGHPALSGSPDPQAVHSLEEPLPQTSSGSCHAPKPACQLGSLDSLSAEVGVRSRSLGLVSSACSSSPDGLLSTHASSLDCFAPACSRSLDSTRSLPKASKSEERPSSPDTSTPGSRRLSPPPSPLPPPPPPSAHRKLSNPRGGEGSESQPCEVLTPSPPGLGHHELIKLNWLLAKALWVLARRCYTLQEENKQLRRAGCPYQADEKVKRLKVKRAELTGLARRLADRARELQETNLRAVSAPIPGESCAGLELCQVFARQRARDLSEQASAPLAKDKQIEELRQECHLLQARVASGPCSDLHTGRGGPCTQWLNVRDLDRLQRESQREVLRLQRQLMLQQGNGGAWPEAGGQSATCEEVRRQMLALERELDQRRRECQELGTQAAPARRRGEEAETQLQAALLKNAWLAEENGRLQAKTDWVRKVEAENSEVRGHLGRACQERDASGLIAEQLLQQAARGQDRQQQLQRDPQKALCDLHPSWKEIQALQCRPGHPPEQPWETSQMPESQVKGSRRPKFHARPEDYAVSQPNRDIQEKREASLEESPVALGESASVPQVSETVPASQPLSKKTSSQSNSSSEGSMWATVPSSPTLDRDTASEVDDLEPDSVSLALEMGGSAAPAAPKLKIFMAQYNYNPFEGPNDHPEGELPLTAGDYIYIFGDMDEDGFYEGELDDGRRGLVPSNFVEQIPDSYIPGCLPAKSPDLGPSQLPAGQDEALEEDSLLSGKAQGMVDRGLCQMVRVGSKTEVATEILDTKTEACQLGLLQSMGKQGLSRPLLGTKGVLRMAPMQLHLQNVTATSANITWVYSSHRHPHVVYLDDREHALTPAGVSCYTFQGLCPGTHYRVRVEVRLPWDLLQVYWGTMSSTVTFDTLLAGPPYPPLEVLVERHASPGVLVVSWLPVTIDSAGSSNGVQVTGYAVYADGLKVCEVADATAGSTVLEFSQLQVPLTWQKVSVRTMSLCGESLDSVPAQIPEDFFMCHRWPETPPFSYTCGDPSTYRVTFPVCPQKLSLAPPSAKASPHNPGSCGEPQAKFLEAFFEEPPRRQSPVSNLGSEGECPSSGAGSQAQELAEAWEGCRKDLLFQKSPQNHRPPSVSDQPGEKENCYQHMGTSKSPAPGFIHLRTECGPRKEPCQEKAALERVLRQKQDAQGFTPPQLGASQQYASDFHNVLKEEQEALCLDLRGTERREERREPEPHSRQGQALGVKRGCQLHEPSSALCPAPSAKVIKMPRGGPQQLGTGANTPARVFVALSDYNPLVMSANLKAAEEELVFQKRQLLRVWGSQDTHDFYLSECNRQVGNIPGRLVAEMEVGTEQTDRRWRSPAQGHLPSVAHLEDFQGLTIPQGSSLVLQGNSKRLPLWTPKIMIAALDYDPGDGQMGGQGKGRLALRAGDVVMVYGPMDDQGFYYGELGGHRGLVPAHLLDHMSLHGH

SEQ ID NO: 62943 - protein, 160 aa, Homo sapiens [sequence omitted]

SEQ ID NO: 62944 - protein, 619 aa, Homo sapiens
MYLVYSKDASVAEMSSKEVGRCALLLMAVSGHRRTALSDVCVSISLPLGCQQLRGIHPFCIPLFYNFMTEDVAKTESVTSVKIRIDTLPHINPVLYDLTLHGFGNYCMCTILSLVPCRLSRIPESALEGSKRGERGPGSGGYSPGSRALSRSTAQPVRARPGHPPRAPLSPRGSRLRLSRPTRPAPHPTGPSSNGFWTRGLSPAPYFPAHESRSAAPFGEGSSAPEPTQSPARQPGRQEGGGGTTMSFEGGHGGKPAPVPAAPRYLPPLPASPETPERAAGPSEPLGEVAPRCRGADELPPPPLPLQPAGQEVAAAGDSGEGPRRLPEAAAAKGGPGESEAGAGGERERRGAGDQPETRSVCSSRSSSSGGGDQRAGHQHQHHQPICKICFQGAEQGELLNPCRCDGSVRYTHQLCLLKWISERGSWTCELCCYRYHVIAIKMKQPCQWQSISITLVEKVQMIAVILGSLFLIASVTWLLWSAFSPYAVWQRKDILFQICYGMYGFMDLVCIGLIVHEGAAVYRVFKRWRAVNLHWDVLNYDKATDIEESSRGESSTSRTLWLPLTALRNRNLVHPTQLTSPRFQCGYVLLHLFNRMRPHEDLSEDNSSGEVVMRVTSV

SEQ ID NO: 62945 - protein, 619 aa, Homo sapiens; identical to SEQ ID NO: 62944

SEQ ID NO: 62946 - protein, 141 aa, Homo sapiens
MASSLLSYSVTDSYAEYKSFEESFPSPELFRKSDYLDWECPNLEEHMQWKNSTLLDTSKAVAIEKAPQFSNVSAIFSTSSEDYQKCHRKTVMTVADQNVSPKAKCASNSESDNAACEILLAEKTCPSTPEKTKKKASIEAE

SEQ ID NO: 62947 - protein, 141 aa, Homo sapiens; identical to SEQ ID NO: 62946

SEQ ID NO: 62948 - protein, 125 aa, Homo sapiens
MVIAYFSRAGLPSWQYQRIHFFLALYLANDMEEDDEAPKQNIFYFLYEETRSHIPLLSELWFQLCRYMNPRARKNCSQIALFRKYRFHFFCSMRCRAWVSLEELEEIQAYDPEHWVWARDRAHLS

SEQ ID NO: 62949 - protein, 265 aa, Homo sapiens; identical to SEQ ID NO: 62926

SEQ ID NO: 62950 - protein, 172 aa, Homo sapiens
MKAKRRRVSLVLPEYYEAFNRLLEDPVIKRLLAWDKDLRVSDKYLLAMVIAYFSRAGLPSWQYQRIHFFLALYLANDMEEDDEAPKQNIFYFLYEETRSHIPLLSELWFQLCRYMNPRARKNCSQIALFRKYRFHFFCSMRCRAWVSLEELEEIQAYDPEHWVWARDRAHLS

SEQ ID NO: 62951 - protein, 125 aa, Homo sapiens; identical to SEQ ID NO: 62948

SEQ ID NO: 62952 - protein, 95 aa, Homo sapiens
MEEDDEAPKQNIFYFLYEETRSHIPLLSELWFQLCRYMNPRARKNCSQIALFRKYRFHFFCSMRCRAWVSLEELEEIQAYDPEHWVWARDRAHLS

SEQ ID NO: 62953 - protein, 265 aa, Homo sapiens; identical to SEQ ID NO: 62926

SEQ ID NO: 62954 - protein, 265 aa, Homo sapiens; identical to SEQ ID NO: 62926

SEQ ID NO: 62955 - protein, 172 aa, Homo sapiens; identical to SEQ ID NO: 62950

SEQ ID NO: 62956 - protein, 95 aa, Homo sapiens; identical to SEQ ID NO: 62952

SEQ ID NO: 62957 - protein, 125 aa, Homo sapiens; identical to SEQ ID NO: 62948

SEQ ID NO: 62958 - protein, 265 aa, Homo sapiens; identical to SEQ ID NO: 62926

SEQ ID NO: 62959 - protein, 298 aa, Homo sapiens [sequence omitted]

SEQ ID NO: 62960 - protein, 155 aa, Homo sapiens
MGPGDFRRCRERISQGLQGLPGRAELWFPPRPACDFFGDGRSTDIQEEALAASPLLEDLRRRLTRAFQWAVQRAISRRVQEAAAAAAAREEQSWTGVEATLARLRAELVEMHFQNHQLARTLLDLNMKVQQLKKEYELEITSDSQSPKDDAANPE

SEQ ID NO: 62961 - protein, 94 aa, Homo sapiens
MRHHSDVLTALHWACANGHAEVVTLLVDRKRQVDVLDGENRTPLMKALQCQREACANILIDSGADPNIVDVYGNTAVHYAVYSENLSVVAKLLS

SEQ ID NO: 62962 - protein, 389 aa, Homo sapiens
MMNSDQKAVKFLANFYINGGKHWTHGHLRQTQPEPTQPKASVLLLGPEPGMAWDETQPPKMKEIPVGLRLQTGTPQESLPTYTQTLRELLLEQRPLITADLEVPSPTRYQVPSPSVRESSPHPHYSIGCKHQGREGGGRRAWQTLWFQSESPFTQKADFDQEQKWPSPAHYQLLSRPAFPAFSFRGCHSASKTPEGHTHLGLPGARGLGLRVQPQSLLQASLQAPGKRCPGPNTYNILPGSRLQSPRSPAFSMSRSPAFTSWLSTWLPAFSFGSPNPWPSRLPRGGLQLTLPFGAWRGHPGCTQTQAPRHRPLLHALEPAGHNLLGPATEWNHGLPRGFPRPPLGLGAPAWPSDPLGTPMHPSGWPTLLWAVDKAGPAWIPHLPISPLH

SEQ ID NO: 62963 - protein, 75 aa, Homo sapiens
MIFTPFLPPADLNVKGLQNDPEEWVAVSDATEDPSGGTGLPREPALLRGSWRSRFQRALACFTKCFRGGYRALGI

SEQ ID NO: 62964 - protein, 75 aa, Homo sapiens; identical to SEQ ID NO: 62963

SEQ ID NO: 62965 - protein, 157 aa, Homo sapiens
MWRQEEELRDQEKLRKHEEKTWRQEQRLRDQEKELRKQEKQMLKQKEQMAEQEEQMQKQEEQVRKQEEQVRKQEEQMWKQEEQMRKQEEQMRKQEKQMGEQEEQMRKREEQMRKREEQITQLPPGMKNTQEHPGLGSTSCILFFYRGDKKKIKIINI

SEQ ID NO: 62966 - protein, 336 aa, Homo sapiens
MSVCESWNCDGYVVMRKEQRAVHQAKSLFGATGGRGRINHRCFGRPCVLMSWDPNPVPRTLRCWRLRRASETALQSSRRAVEDQLKICGHRRDADVFELFLSKKELTEVIDLSRFKKLKYLWLHHNKLHGITFLTRNYCLTELYLNNNAIFEIEGLHYLPSLHILLLHHNELTNIDATVKELKGMLNLKILSLYQNPLCQYNLYRLYIIYHLPGVELLDRNQVTEKERRSMITIFNHKKAHIVQSIAFGGKVDASWDPKSPFKQKPAQRVPSDFAFANNVDKTVLDDPEDAVFVRSMKRSVMTLTSMNWDTVPTREERYLEEEGTETAQMLTVTLR

SEQ ID NO: 62967 - protein, 336 aa, Homo sapiens; identical to SEQ ID NO: 62966

SEQ ID NO: 62968 - protein, 336 aa, Homo sapiens; identical to SEQ ID NO: 62966

SEQ ID NO: 62969 - protein, 283 aa, Homo sapiens
MAWFLYSAPGVDPSPPHRSFCWKRKMEWWDESEESLEEEPRKVLAPEPEEIWVAEMLCGLKMKLKRRRVSLVLPEHHEAFNRLLEDPVIKRFLAWDKDLRVSDKYLLAMVIAYFSRAGFPSWQYQRIHFFLALYLANDMEEDDEDSKQNIFHFLYGKNRSRIPLLRKRWFQLGRSMNPRARKNRSRIPLLRKRRFQLGRSMNPRARKNRSRIPLLRKRRFQLGRSMNLRARKNRSQIVLFQKRRFQFFCSMSGRAWVSPEELEEIQAYDPEHWVWARDRARLS

SEQ ID NO: 62970 - protein, 218 aa, Homo sapiens
MAWFLYSAPGVDPSPPHRSFCWKRKMEWWDESEESLEEEPRKVLAPEPEEIWVAEMLCGLKMKLKRRRVSLVLPEHHEAFNRLLEDPVIKRFLAWDKDLRVSDKYLLAMVIAYFSRAGFPSWQYQRIHFFLALYLANDMEEDDEDSKQNIFHFLYGKNRSRIPLLRKPSVPVRPFHEPEGQEEPLSDSPVPETSVPVLLFHERQGLGFPGGVGGDPGL

SEQ ID NO: 62971 - protein, 286 aa, Homo sapiens
MQKHYTVAWFLYSAPGVDPSPPCRSLGWKRKREWSDESAEEPEKELAPEPEETWVVEMLCGLKMKLKQQRVSPILPEHHKGFNSQLEDPVIKRFLAWDKDLRVSDKYLLAMVIAYFSRAGFPSWQYQRIHFFLALYLANDMEEDDEDSKQNIFHFLYGKNRSRIPLLRKRWFQLGRSMNPRARKNRSRIPLLRKRRFQLGRSMNPRARKNRSRIPLLRKRRFQLGRSMNLRARKNRSQIVLFQKRRFQFFCSMSGRAWVSPEELEEVGGAWGGGGGGEESGGLEAG

SEQ ID NO: 62972 - protein, 284 aa, Homo sapiens
MAWFLYSAPGVDPSPPHRSFCWKRKMEWWDESEESLEEEPRKVLAPEPEEIWVAEMLCGLKMKLKRRRVSLVLPEHHEAFNRLLEDPVIKRFLAWDKDLRVSDKYLLAMVIAYFSRAGFPSWQYQRIHFFLALYLANDMEEDDEDSKQNIFHFLYGKNRSRIPLLRKRWFQLGRSMNPRARKNRSRIPLLRKRRFQLGRSMNPRARKNRSRIPLLRKRRFQLGRSMNLRARKNRSQIVLFQKRRFQFFCSMSGRAWVSPEELEEVGGAWGGGGGGEESGGLEAG

SEQ ID NO: 62973 - protein, 283 aa, Homo sapiens; identical to SEQ ID NO: 62969

SEQ ID NO: 62974 - protein, 218 aa, Homo sapiens; identical to SEQ ID NO: 62970

SEQ ID NO: 62975 - protein, 286 aa, Homo sapiens; identical to SEQ ID NO: 62971

SEQ ID NO: 62976 - protein, 284 aa, Homo sapiens; identical to SEQ ID NO: 62972

SEQ ID NO: 62977 - protein, 455 aa, Homo sapiens
MLHPETSPGRGHLLAVLLALLGTTWAEVWPPQLQEQAPMAGALNRKESFLLLSLHNRLRSWVQPPAADMRRLDWSDSLAQLAQARAALCGIPTPSLASGLWRTLQVGWNMQLLPAGLASFVEVVSLWFAEGQRYSHAAGECARNATCTHYTQLVWATSSQLGCGRHLCSAGQTAIEAFVCAYSPGGNWEVNGKTIIPYKKGAWCSLCTASVSGCFKAWDHAGGLCEVPRNPCRMSCQNHGRLNISTCHCHCPPGYTGRYCQVRCSLQCVHGRFREEECSCVCDIGYGGAQCATKVHFPFHTCDLRIDGDCFMVSSEADTYYRARMKCQRKGGVLAQIKSQKVQDILAFYLGRLETTNEVTDSDFETRNFWIGLTYKTAKDSFRWATGEHQAFTSFAFGQPDNHGLVWLSAAMGFGNCVELQASAAFNWNDQRCKTRNRYICQFAQEHISRWGPGS

SEQ ID NO: 62978 - protein, 229 aa, Homo sapiens
MGNILTCCINSHCGWPRGKDAPCYESDTDIYETVAAATSESTTVEPGKLDVGATEGQDLQHISNQKMPTGPPEDRLSLKFLPSSEEDNDDAKILPSPVQGSSEDNLSLVCLPRSEDDDCDDDDDDDAQILPSRVQGGCYRFDSSSCSSEDNLSLVCLPRSEDDDCDDDDDDAQILPSPVQACSEDSLFLRCSLRHKDEEEEDDDDIHITARIESDLTLESLSDEEIHPG

SEQ ID NO: 62979 - protein, 701 aa, Homo sapiens
MVALLEHYDHVPGDPEFTQLSHAVLLELVIDRLLLLLQSCMSYLENLGSEQMMPPAQAAGPCMSVGLTVRRFWDSLLRLGTLHQQPLPQKGANQRETPTSKPTTKGEPARSPEYLTTKLIKPSSPVLGLPQTCQEPESIPVRASLQFPATTFKNTRSVHSQTIETALVPCDACASVQGSLQKVGKVVISLCQSQNLPSSLGQFQQLVQDSMGLRPLPAATVGRWAAEQRKDLTRLSKHVEALRAQLEEAEGQKDGLRKQAGKLEQALKQEQGARRRQAEEDEQCLSEWEHDKQQLLTETSDLKTKMATLERELKQQRESTQAVEAKAQQLQEEGERRAAAERQVQQLEEQVQQLEAQVQLLVGRLEGAGQQVCWASTELDKEKARVDSMVRHQESLQAKQRALLKQLDSLDQEREELRGSLDEAEAQRARVEEQLQSEREQGQCQLRAQQELLQSLQREKQGLEQATTDLRLTILELERELEELKERERLLVAFPDLHRPTETQIHGGRSSSVESQITCPTDSGNVTDHMERQVQANDIRIRVLQEENGRLQSMLSKIREVAQQGGLKLIPQDRLWSPSSKGTQGATPPVQAKSTSPGPLGRQHLPSSRTGRTLLGQPCTSPPRQPCTSPPRQPCTSPPRQPCTSPSRQPCSQPSKSLLEGVTHLDTCTQNPIKVLVRLRKRLSPGRGQASSAHQPQERPM

SEQ ID NO: 62980 - protein, 80 aa, Homo sapiens
MPFQFGTQPRRFPVEGGDSSIELEPGLSSSAACNGKEMSPTRQLRRCPGSHCLTITDVPVTVYATTRKPPAQSSKEMHPK

SEQ ID NO: 62981 - protein, 265 aa, Homo sapiens; identical to SEQ ID NO: 62926

SEQ ID NO: 62982 - protein, 172 aa, Homo sapiens; identical to SEQ ID NO: 62950

SEQ ID NO: 62983 - protein, 125 aa, Homo sapiens; identical to SEQ ID NO: 62948

SEQ ID NO: 62984 - protein, 95 aa, Homo sapiens; identical to SEQ ID NO: 62952

SEQ ID NO: 62985 - protein, 265 aa, Homo sapiens; identical to SEQ ID NO: 62926

SEQ ID NO: 62986 - protein, 172 aa, Homo sapiens; identical to SEQ ID NO: 62950

SEQ ID NO: 62987 - protein, 95 aa, Homo sapiens; identical to SEQ ID NO: 62952

SEQ ID NO: 62988 - protein, 125 aa, Homo sapiens; identical to SEQ ID NO: 62948

SEQ ID NO: 62989 - protein, 265 aa, Homo sapiens; identical to SEQ ID NO: 62926

SEQ ID NO: 62990 - protein, 265 aa, Homo sapiens
MGQILGKIMMSHQPQPQEERSPQQSTSGYPLQEVVDDEVSGPSAPGVDPSPPRRSLGWKRKRECLDESDDEPEKELAPEPEETWVAETLCGLKMKAKRRRVSLVLPEYYEAFNRLLEDPVIKRLLAWDKDLRVSDKYLLAMVIAYFSRAGLPSWQYQRIHFFLALYLANDMEEDDEAPKQNIFYFLYEETRSHIPLLSELWFQLCRYMNPRARKNCSQIALFRKYRFHFFCSMRCRAWVSLEELEEIQAYDPEHWVWARDRAHLS

SEQ ID NO: 62991 - protein, 172 aa, Homo sapiens; identical to SEQ ID NO: 62950

SEQ ID NO: 62992 - protein, 125 aa, Homo sapiens; identical to SEQ ID NO: 62948

SEQ ID NO: 62993 - protein, 95 aa, Homo sapiens; identical to SEQ ID NO: 62952

SEQ ID NO: 62994 - protein, 298 aa, Homo sapiens [sequence omitted]

SEQ ID NO: 62995 - protein, 427 aa, Homo sapiens
MDFLWDKRTGLAARKMPHPRRYHSSERGSRGSYCEHYRSRKQATKKPFLVKRCSRTFSRSSSQHSSRKAKSVEDDTEGHLIYHVGDWLQERYEIVSTLGKGTFGRVVQCVDHRRRGARVALKIIKNVEKYKEAARLEIKVLEKINEKDPGKNLCVQMFDWFDYHGHMCISLELLGLSTFDFLKDNNHLPYPIHQVHHMASQLCQAVKFLHDNKLTHTDLKPENILFVNSDYELTYNLEKKRHERSVKSTAVRVGDFGSATFDHEHHSTIVSTRHYRAPEVILELGWSQPCDVWSIGCIIFEYYVGFTLFQTHDNRQHLATMERILGPIPSRMIRKTRKQKYFYRGRLDWDENTSAGRYVRENCKPLRQYLTSEAEEDHQLFDLIESMLEYEPAQRLTLGEALQHPFFSRLWAEPPNKLWDSSQDISP

SEQ ID NO: 62996 - protein, 417 aa, Homo sapiens; identical to SEQ ID NO: 62776

SEQ ID NO: 62997 - protein, 200 aa, Homo sapiens
MHCGKRQGPLPWKAGTALHWVCANGHAEVVTPLVDRKCQLDILDGENRTPLMKAAQCQREVCANILIDSGADPNIVDVYGNTAVHYALYGENLSVVAKLLSCGADIEVKNKAGHTPLLLAIRKRSEQIVEFLLTKNTNANAVDKFKCIHQQLLEYKQKISKNSQNSNPEGTSEGTPDEAAPLVERTPDMAESLVERTPDE

SEQ ID NO: 62998 - protein, 1359 aa, Homo sapiens
MPRAQLLESNAPIHMENLPFPLKLLSASSLNAPSSTPWVLDIFLTLVFALGFFFLLLPYLSYFRCDDPPSPSPGKRKENWAIRVWGGGGAVARAPTLPSGPTGSWLQLVPPVSCSLLGPHLDKGDFGQLSGPDPPGEVGERAPDGASQSSHEPMEDAAPILSPLASPDPQAKHPQDLASTPSPGPMTTSVSSLSASQPPEPSLPLEHPSPEPPALFPHPPHTPDPLACSPPPPKGFTAPPLRDSTLITPSHCDSVALPLGTVPQSLSPHEDLVASVPAISGLGGSNSHVSASSRWQETARTSCAFNSSVQQDHLSRHPPETYQMEAGSLFLLSSDGQNAVGIQVTETAKVNIWEEKENVGSFTDRMTPEKHLNSLRNLAKSLDAEQDTTNPKPFWNMGENSKQLPGPQKFSDPRLWQESFWKNYSQLFWGLPSLHSESLVANAWVTDRSYTLQSPPFLFNEMSNVCPIQRETTMSPLLFQAQPPSHLGPECQPFISSTPQFRPTPMAQAEAQAHLQSSFPVLSPAFPSLIKNTGVACPASQNKVQALSLPETQHPEWPLLRRQLEGRLALPSRVQKSQDVFSVSTPNLPQESLTSILPENFPVSPELRRQLEQHIKKWIIQHWGNLGRIQESLDLMQLRDESPGTSQAKGKPSPWQSSMSTGESSKEAQKVKFQLERDPCPHLGQILGETPQNLSRDMKSFPRKVLGVTSEESERNLRKPLRSDSGSDLLRCTERTHIENILKAHMGRNLGQTNEGLIPVRVRRSWLAVNQALPVSNTHVKTSNLAAPKSGKACVNTAQVLSFLEPCTQQGLGAHIVRFWAKHRWGLPLRVLKPIQCFKLEKVSSLSLTQLAGPSSATCESGAGSEVEVDMFLRKPPMASLRKQVLTKASDHMPESLLASSPAWKQFQRAPRGIPSWNDHGPLKPPPAGQEGRWPSKPLTYSLTGSTQQSRSLGAQSSKAGETREAVPQCRVPLETCMLANLQATSEDMHGFEAPGTSKSSLHPRVSVSQDPRKLCLMEEVVNEFEPGMATKSETQPQVCAAVVLLPDGQASVVPHASENLVSQVPQGHLQSMPTGNMRASQELHDLMAARRSKLVHEEPRNPNCQGSCKSQRPMFPPIHKSEKSRKPNLEKHEERLEGLRTPQLTPVRKTEDTHQDEGVQLLPSKKQPPSVSHFGGNIKQFFQWIFSKKKSKPAPVTAESQKTVKNRSCVYSSSAEAQGLMTAVGQMLDEKMSLCHARHASKVNQHKQKFQAPVCGFPCNHRHLFYSEHGRILSYAASSQQATLKSQGCPNRDRQIRNQQPLKSVRCNNEQWGLRHPQILHPKKAVSPVSPLQHWPKTSGASSHHHHCPRHCLLWEGI

SEQ ID NO: 62999 - protein, 185 aa, Homo sapiens
MSHLFFKLSTSKPKLIIFPICSQLFTPLIPLYTFSYIPGLFLSKLPYKNPTHLAQQQEPWSRLNSTPTITSMRQDAYYFDPEIPKDDLDFRLAALYNHHTGTFENKSEILLNQKTTQDTYRTKIQFPGEFLTPPTPPITFLANIRHWINPKKESIHSIQGSIVSPHTAATNGGYSRKKDGGFFST

SEQ ID NO: 63000 - protein, 1206 aa, Homo sapiens
MEDAAPILSLLASPDPQAKHPQDLASTPSPGPMTTSVSSLSASQPPEPSLPLEHPSPEPPALFPHPPHTPDPLACSLPPPKGFTAPPLRDSTLITPSHCDSVALPLGTVPQSLSPHEDLVASVPAISGLGGSNSHVSASSRWQETARTSCAFNSSVQQDHLSRHPPETCQMEAGSLFLLSSDGQNVVGIQVTETAKVNIWEEKENVGSFTNRMTPEKHLNSLRNLAKSLDAEQDTTNPKPFWNMGENSKQLPGPQKLSDPRLWQESFWKNYSQLFWGLPSLHSESLVANAWVTDRSYTLQSPPFLFNEMSNVCPIQRETTMSPLLFQAQPLSHLGPECQPFISSTPQFRPTPMAQAEAQAHLQSSFPVLSPAFPSLIQNTGVACPASQNKVQALSLPETQHPEWPLLRRQLEGRLALPSRVQKSQDVFSVSTPNLPQESLTSILPENFPVSPELRRQLEQHIKKWIIQHWGNLGRIQESLDLMQLQDESPGTSQAKGKPSPWQSSMSTGESSKEAQKVKFQLERDPCPHLGQILGETPQNLSRDMKSFPRKVLGVTSEELERNLRKPLRSDSGSDLLRCTERTHIENILKAHMGRNLGQTNEGLIPVRVRRSWLAVNQALPVSNTHVKTSNLAAPKSGKACVNTAQVLSFLEPCTQQGLGAHIVRFWAKHRWGLPLRVLKPIQCFKLEKVSSLSLTQLAGPSSATCESGAGSEVEVDMFLRKPPMASLRKQVLTKASDHMPESLLASSPAWKQFQRAPRGIPSWNDHEPLKPPPAGQEGRWPSKPLTYSLTGSTQQSRSLGAQSSKAGETREAVPQCRVPLETCMLANLQATSEDVHGFEAPGTSKSSLHPRVSVSQDPRKLCLMEEVVSEFEPGMATKSETQPQVCAAVVLLPDGQASVVPHASENLVSQVPQGHLQSMPTGNMRASQELHDLMAARRSKLVHEEPRKPNCQGSCKSQRPMFPPIHKSEKFRKPNLEKHEERLEGLRTPQLTPVRKTEDTHQDEGVQLLPSKKQPPSVSPFGENIKQIFQWIFSKKKSKPAPVTAESQKTVKNRSCVYSSSAEAQGLMTAVGQMLDEKMSLCHARHASKVNQHKQKFQAPVCGFPCNHRHLFYSEHGRILSYAASSQQATLKSQGCPNRDRQIRNQQPLKSVRCNNEQWGLRHPQILHPKKAVSPVSPPQHWPKTSGASSHHHHCPRHCLLWEGI

SEQ ID NO: 63001 - protein, 146 aa, Homo sapiens
MQIMLSPEDQGPLDIEWLISPADNQKMDQVMILYSGNKIYDDYYPELKGRVHFKRNDLKSGDASINVTNLQLSDIGTDQCKVKKAPGVANKIQLVVLVKPSENAHFMVSRNDFICYICKKNASSEYSGTYSCTSETEWALISACCV

SEQ ID NO: 63002 - protein, 237 aa, Homo sapiens
MNQLILTTGERINTFHGTKKKHILACWQVTCRFQLIFIALRVKCLGRGGGGGGGGLGGSGWARGERTGSSQCRLRQLESKPLKMADDLDFETGDAGASATFPMQCSALRKNGFVVLKGWPCKIVEMSASKTGKHGHAKVHLVGIDIFTGKKYEDICPSTHNMDVPNIRRNDFQLIGIQDGYLSLLQDSGEVPEDLRLPEGDLGKETEQKYDCGEEILITVLSAMTEEAAVAIKAMAK

SEQ ID NO: 63003 - protein, 71 aa, Homo sapiens
MTMGSEAEKKTSTTVSSIIVVAKWIIPRVDDVVKSVYHLLSTKLLDAPSAESREEKQLDIQEKQLDFKETT

SEQ ID NO: 63004 - protein, 348 aa, Homo sapiens
MASRPRPRTPSRGPSDLRFRGEAGLRRVFLKKAGGSVSFSDVAVGFTQEEWQHLDSAQRTPYRDMMLENYSLLLSVGYCITKPEVVCKLEHGQVLWILEEESPSQSHLDCCIDDDLMEKRQENQDQHLQKVDFVNNKTLTMDRNGVLGKTFSLDTNPILSRKIRGNCDSSGMNLNNISELIISNRSSFVRNPAECNVRGKFLLCMKRENPYARGKPLEYDGNGKAVSQNEDLFRHHRGYTEERNPMNALNVGKLLDIGHALQYIKEHTRDKTYECNECGKNFCEKSNLHVHQRTHTGEKPYGCNECQKAFGDRSALKVHQRIHTGEKPYECKECGKTFSQKPNFINHQ

SEQ ID NO: 63005 - protein, 435 aa, Homo sapiens; identical to SEQ ID NO: 10110

SEQ ID NO: 63006 - protein, 398 aa, Homo sapiens
MKDSPFQVTKLYWLNEKWDFIASASDMAAEQGQILVIATAAVGGFTLLVILTLFFLITGRCQWYIKAKMKSEEKRRNHLQNGHLRFPGIKTYIDPDTYEDPSLAVHEFAKEIDPSRIRIERVIGAGEFGEVCSGRLKTPGKREIPVAIKTLKGGHMDRQRRDFLREASIMGQFDHPNIIRLEGVVTKRSFPAIGVEAFCPSFLRAGFLNSIQAPHPVPGGGSLPPRIPAGRPVMIVVEYMENGSLDSFLRKHDGHFTVIQLVGMLRGIASGMKYLSDMGYVHRDLAARNILVNSNLVCKVSDFGLSRVLEDDPEAAYTTTRPTNHNKEQSELVKEDGLESLCEQCESSSGYGTGLVLMWKRNRRAMGASGQTRKQCDKRDNPPTDLFQTLTLNLCYSA

SEQ ID NO: 63007 - protein, 334 aa, Homo sapiens
MKDSPFQVTKLYWLNEKWDFIASASDMAAEQGQILVIATAAVGGFTLLVILTLFFLITGRCQWYIKAKMKSEEKRRNHLQNGHLRFPGIKTYIDPDTYEDPSLAVHEFAKEIDPSRIRIERVIGAGEFGEVCSGRLKTPGKREIPVAIKTLKGGHMDRQRRDFLREASIMGQFDHPNIIRLEGVVTKRSFPAIGVEAFCPSFLRAGFLNSIQAPHPVPGGGSLPPRIPAGRPVMIVVEYMENGSLDSFLRKHDGHFTVIQLVGMLRGIASGMKYLSDMGYVHRDLAARNILVNSNLVCKVSDFGLSRVLEDDPEAAYTTTDLFQTLTLNLCYSA

SEQ ID NO: 63008 - protein, 74 aa, Homo sapiens
MQSPCETRCCSQRRKHCPPVVFNEEMEIVSGGNQASWKTSNYAKWSDFTIENVILLIANLHMCAAAVLALNSIR

SEQ ID NO: 63009 - protein, 90 aa, Homo sapiens
MGGSLCCCGEGEGFFYRQNWRFLSLDSWDLIQAAHSTHSAIQLYSMHSGISHLLRKDLSFEKGDTFLPTFAGELPWFELPAGNEWQEIPS

SEQ ID NO: 63010 - protein, 104 aa, Homo sapiens
MGGSLCCCGEGEGFFYRQNWRFLSLDSWDLIQAAHSTHSAIQLYSMHSGISHLLRKDLSFEKGVKPVAAELPGESSEQVIAIVEVSSRLYFGAITSSTVSCLVS

SEQ ID NO: 63011 - protein, 362 aa, Homo sapiens
MSEVSDTSEETQILRDTFAIESFRTFQSHFTKYRTPVYQTPYTDERALLTLMKPTTSPSSLTTLLRTSQISPLEWYQKSRFPPIDKPWILSSVSDTKKPKVMVPPSSPQELEEKRYFVDVEAQKKNLILLNQAIKTCGLPSQLHTMARTLIIEILHMDTVQLGYLFRKYIAYRLIQHARNNIMKRLKAIQNTGKGYEARNLHMMLSRLDDYGKKVMQVWTEKQKSLGQKRNQCLKKMIHVFNQLKKIHELNLSQPIPLIIEEKQIPASTTFVQKPFLKLLMEEDRTSDICKKFRQQEDQTEAIWNVDLSTSSYPIAEKTSMHSLWAQLGGYPDIPRLLQLEVQSTFRKSLASLQSRVKKIPK

SEQ ID NO: 63012 - protein, 44 aa, Homo sapiens
MGSPRNKKIMGEAAAQKQMSFNNYPQAWVIHPLRRQQKNIRFVI

SEQ ID NO: 63013 - protein, 90 aa, Homo sapiens
MTFGRLHRIFPKIMPEKPAEEGNDSKEVLEASGPQNDGKQLCPPGKASSSEKIHERSGTKRGKHAWIHRLRERKQLVIYEEISDPEEDDK

SEQ ID NO: 63014 - protein, 57 aa, Homo sapiens [sequence omitted]

SEQ ID NO: 63015 - protein, 775 aa, Homo sapiens
MTPEAHWTGPPNPGALGYPHQSFVSQPHPFSKQPSPCPRQSPQGDFGWVTPGASRSITGPSSPAAPSLISVGSLGSHLQGARPHPRQSSLGDFGLVTPGTPCCRLCPPLLLPQGRPPWVLCAGVSKELGPNPVLPSPIVEQRLGHGADMVPPPDQEEWNVLKEYWQKNRPRVPAGVNRNRKTNGSIPETATSGGCQPPGDSATGFHREGPTSSATLKDLESPCQERAVVLDSTSVKISRLKNTIKSLKQQKKQVEHQLEEEKKANNERQKAERVLEVQIQTLIIQKEELNTDLYHMERSLRYFEEESKDLAVRLQHSLQCKGELERALSAVIATEKKKANQLSSCSKAHTEWELEQSLQDQALLKAQLTQLKESFQQLQLERDECAEHIEGERARWHQRMSKMSQEICTLKKEKQDMRWVEQLEWSLSKLKNQTAEPLPPEPPAVPSEVELQHLRKELERVAGELQSQVKNNQHISLLNRRQEERIREQEERLRKQEERLQEQHEKLRQLAKPQSVFEELNNENKSTLQLEQQVKELQEKLGEEHLEVASQQNQQLTAQLSLMALPGEGHGGEHLDSEGEEAPQPMPSVPEDPESREAMSSFMDHLKEKADLSELLKKQELRFIQYWQERCHQKIHHLLSEPGGRAKDAALGGGHHQAGAQGGDEGEAAGAAADGIAAYSNYNNGHRKFLAAAHNSADEPGPGAPAPQELGAADKHGDLREVTLTSSAQGEAREDPLLDKPTAQPIVQDHQEHPGLGSNCCVPLFCWAWLPRRRR

SEQ ID NO: 63016 - protein, 55 aa, Homo sapiens
MREMRECGERFCKSGLEVVIVQNPATWVHGTVRLFQHGKLKSGISLRKKLSLSEE

SEQ ID NO: 63017 - protein, 116 aa, Homo sapiens [sequence omitted]

SEQ ID NO: 63018 - protein, 265 aa, Homo sapiens; identical to SEQ ID NO: 62926

SEQ ID NO: 63019 - protein, 172 aa, Homo sapiens; identical to SEQ ID NO: 62950

SEQ ID NO: 63020 - protein, 125 aa, Homo sapiens; identical to SEQ ID NO: 62948

SEQ ID NO: 63021 - protein, 95 aa, Homo sapiens; identical to SEQ ID NO: 62952

SEQ ID NO: 63022 - protein, 125 aa, Homo sapiens; identical to SEQ ID NO: 62948

SEQ ID NO: 63023 - protein, 265 aa, Homo sapiens; identical to SEQ ID NO: 62926

SEQ ID NO: 63024 - protein, 172 aa, Homo sapiens; identical to SEQ ID NO: 62950

SEQ ID NO: 63025 - protein, 95 aa, Homo sapiens; identical to SEQ ID NO: 62952

SEQ ID NO: 63026 - protein, 265 aa, Homo sapiens; identical to SEQ ID NO: 62926

SEQ ID NO: 63027 - protein, 265 aa, Homo sapiens; identical to SEQ ID NO: 62990

SEQ ID NO: 63028 - protein, 172 aa, Homo sapiens; identical to SEQ ID NO: 62950

SEQ ID NO: 63029 - protein, 125 aa, Homo sapiens; identical to SEQ ID NO: 62948

SEQ ID NO: 63030 - protein, 95 aa, Homo sapiens; identical to SEQ ID NO: 62952

SEQ ID NO: 63031 - protein, 64 aa, Homo sapiens
MYRDLGEPRTKKLQKPLISDQELRDVRIITTDKRCSRILLSSFRFLVSRLLTLSRMFSLFKILF

SEQ ID NO: 63032 - protein, 64 aa, Homo sapiens; identical to SEQ ID NO: 63031

SEQ ID NO: 63033 - protein, 685 aa, Homo sapiens
MNDSRQQSLFFITLPDLNKLCAVRIILSNKVADTEIRTIQMKMCRQLLFLHQDILTSPVSGILNQIWVVMAIPFYKARKLNAYVEKYGAKMEAPQRVIPVILQNCLSYSFMARLAPAWNRTGHLLIQGRDFLSQMGKQSAVVLNINVTETQVCLSIEACTIRLPAPELKEFEISQSIIKDFHANKHAVIERHSILSNWCYVLPSMKMGQIINIFHAIPAACPFHSYGDFQRHWDALYGYKLPGDCGKIKIYCNIYFKMLGERTFTYPLSCIRSQPMQFFPRVDSEVVLKSFLSDLKSKLPHICGFPIKMTSKPCYYTQELTKPNIQEHKVKPPNLTTKKMLRASLTQATSRKPACAQSLLPCSVAVDHKVELSVSQPTSGIFSALHLQPESVQGRKKSLSIRAPQVHSEVLMPNRGNTQVQHTNLSSQSNITPKFVPVFKNRLLQMNKNTSVLGSPKRKQHDVTQSKLFSLKTSMIQHDKLNLGPAIKNRYSSNIQMQAANNLNQENSRPLQEKNTESSENMTKFPSSRGKSTVSLNKNKQLSNSAVFVVSNNNLGVVKSAVDFQMKGKENLTGKGITQILGKSHGSLKLKRQPHIFESDGETEDPRLLQQQSENQAKEVGTSDHRLIVSKIAHRSKRKLCPESSKTSKKHHSDTVHYGQSSSSKKQILDSDKSKLKKSLIIHNA

SEQ ID NO: 63034 - protein, 84 aa, Homo sapiens
MSVMMSETDMNAIAGTLKLYFRELPEPLFTDEFYPSFAEGIGWQRRKQSIRCPCTTSPLSLAPRCSGPPRRRASSLPTPASPSP

SEQ ID NO: 63035 - protein, 84 aa, Homo sapiens; identical to SEQ ID NO: 63034

SEQ ID NO: 63036 - protein, 109 aa, Homo sapiens [sequence omitted]

SEQ ID NO: 63037 - protein, 109 aa, Homo sapiens [sequence omitted]

SEQ ID NO: 63038 - protein, 95 aa, Homo sapiens
MRSFTTSRSSGPGAARARLCASRRCAPTGRHLSQKVQPIALSRRSSSMASTSCSPGRPLASLEPVRIWTGKVDINQLIIPHRFVFSRVSRSFSEN

SEQ ID NO: 63039 - protein, 117 aa, Homo sapiens
MRSFTTSRSSGPGAARARLCASRRCAPTGRHLSQKVQPIALSRRSSSMASTSCSPGRPLASLEPVWQPAINYIDSKFEDYLNAESRVNRCQMPGNRVQCCLYFIAPSGHGARPKGSM

SEQ ID NO: 63040 - protein, 118 aa, Homo sapiens
MRSFTTSRSSGPGAARARLCASRRCAPTGRHLSQKVQPIALSRRSSSMASTSCSPGRPLASLEPVWQPAINYIDSKFEDYLNAESRVNRCQMPGNRVQCCLYFIAPSGHGLPPSGRIG

SEQ ID NO: 63041 - protein, 95 aa, Homo sapiens; identical to SEQ ID NO: 63038

SEQ ID NO: 63042 - protein, 24 aa, Homo sapiens
MARINQTDERKHCNMYSSSTKSVC

SEQ ID NO: 63043 - protein, 159 aa, Homo sapiens
MAVSAFWSFLLPCEEGACFFFAFCHDCHVNRTPGTVQGPPVWPHAVTLSKGVTTEVHGKAERCDVLEDAGGKHAQRTGAITRLRAAAENLAWATVVSSVEVTDDLGQEVGWQRGGHAQRACRTTVGPLPPCGVVRGAEEHGHRLLLPAGTVRVHLDNPG

SEQ ID NO: 63044 - protein, 52 aa, Homo sapiens
MSSSSLAGLFLGASGVKESRFIKNHQLQIIWMETLPNHRDVCYHPHTKQLGN

SEQ ID NO: 63045 - protein, 242 aa, Homo sapiens
MIDDHNVPTLREMVAFSKEVLEWMAQDSENIVVIHCKGGKGRTGTMVCACLIASEIFLTAEERLYYFGERRTDKTNGTKYQGVETPSQNRYVGYFAQVKHSYNWNLPPRKTLFIKRFVIYSIHGVGTGDGYDLKVQIVMKKKIVFSCTSLKNCRVFHDTETDRVITDVFNCPPLYDDVKVQASSSDFPKYYHNYPFFFWFNTSLIQNNGLYLQRNELDNLHKQKTWKIYQPEYAVEIYFNEK

SEQ ID NO: 63046 - protein, 53 aa, Homo sapiens
MKKKIVFSCTSLKNCRVFHDTETDRVITDVFNCPPLYDDVKVQASSSALSTKK

SEQ ID NO: 63047 - protein, 97 aa, Homo sapiens
MDLNIRDAKKRTALHWACANGHAEVVTLLVDRKRQVDVLDGENRTPLMKALQCQREACANILIDSGADPNIVDVYGNTAVHYAVYSENLSVVAKLLS

SEQ ID NO: 63048 - protein, 195 aa, Homo sapiens [sequence omitted]

SEQ ID NO: 63049 - protein, 97 aa, Homo sapiens [sequence omitted]

SEQ ID NO: 63050 - protein, 412 aa, Homo sapiens [sequence omitted]

SEQ ID NO: 63051 - protein, 139 aa, Homo sapiens [sequence omitted]

SEQ ID NO: 63052 - protein, 75 aa, Homo sapiens
MSWRGRSTYYWPRPRPYVQPPEMIGPMRPEQFSDEVEPATPEEGEPATQRQDPAAAQEGEDEGASAGQGKKQSQC

SEQ ID NO: 63053 - protein, 117 aa, Homo sapiens
MSWRGRSTYYWPRPRPYVQPPEMIGPMRPEQFSDEVEPATPEEGEPATQRQDPAAAQEGEDEGASAGQGPKPEADSQEQGHPQTGCECEDGPDGQEMDPPNPEEVKTPEEGKKQSQC

SEQ ID NO: 63054 - protein, 71 aa, Homo sapiens
MKWNQQHLKKGNQQLNVRILQLLRRERMREHLQVKGRSLKLIARNRVTHRLGVSVKMVLMGRRWTRQIQRR

SEQ ID NO: 63055 - protein, 138 aa, Homo sapiens
MSWRGRSTYRPRPRRYVEPPEMIGPMRPEQFSDEVEPATPEEGEPATQRQDPAAAQEGEDEGASAGQGPKPEADSQEQGHPQTGCECEDGPDGQEMDPPNPEEVKTPEEEMRSHCVAQAGFLWLLMNNCFLNLSPRKP

SEQ ID NO: 63056 - protein, 49 aa, Homo sapiens
MRPEQFSDEVEPATPEEGEPATQRQDPAAAQEGEDEGASAGQGEKQSQC

SEQ ID NO: 63057 - protein, 116 aa, Homo sapiens; identical to SEQ ID NO: 62802

SEQ ID NO: 63058 - protein, 71 aa, Homo sapiens; identical to SEQ ID NO: 63054

SEQ ID NO: 63059 - protein, 116 aa, Homo sapiens; identical to SEQ ID NO: 62796

SEQ ID NO: 63060 - protein, 71 aa, Homo sapiens; identical to SEQ ID NO: 63054

SEQ ID NO: 63061 - protein, 139 aa, Homo sapiens
MSWRGRSTYYWPRPRRYVQPPEMIGPMRPEQFSDEVEPATPEEGEPATQCQDPAAAQEGEDEGASAGQGPKPEAHSQEQGHPQTGCECEDGPDGQEMDPPNPEEVKTPEEEMRSHCVAQAGFLWLLMNNCFLKLSPRKP

SEQ ID NO: 63062 - protein, 75 aa, Homo sapiens
MSWRGRSTYYWPRPRRYVQPPEMIGPMRPEQFSDEVEPATPEEGEPATQCQDPAAAQEGEDEGASAGQGEKQSQC

SEQ ID NO: 63063 - protein, 117 aa, Homo sapiens
MSWRGRSTYYWPRPRRYVQPPEMIGPMRPEQFSDEVEPATPEEGEPATQCQDPAAAQEGEDEGASAGQGPKPEAHSQEQGHPQTGCECEDGPDGQEMDPPNPEEVKTPEEGEKQSQC

SEQ ID NO: 63064 - protein, 71 aa, Homo sapiens; identical to SEQ ID NO: 63054

SEQ ID NO: 63065 - protein, 139 aa, Homo sapiens; identical to SEQ ID NO: 63061

SEQ ID NO: 63066 - protein, 75 aa, Homo sapiens; identical to SEQ ID NO: 63062

SEQ ID NO: 63067 - protein, 117 aa, Homo sapiens; identical to SEQ ID NO: 63063

SEQ ID NO: 63068 - protein, 71 aa, Homo sapiens; identical to SEQ ID NO: 63054

SEQ ID NO: 63069 - protein, 139 aa, Homo sapiens; identical to SEQ ID NO: 63061

SEQ ID NO: 63070 - protein, 75 aa, Homo sapiens; identical to SEQ ID NO: 63062

SEQ ID NO: 63071 - protein, 117 aa, Homo sapiens; identical to SEQ ID NO: 63063

SEQ ID NO: 63072 - protein, 71 aa, Homo sapiens; identical to SEQ ID NO: 63054

SEQ ID NO: 63073 - protein, 139 aa, Homo sapiens
MSWRGRSTYYWPRPRRYVQPPEMIGPMRPEQFSDEVEPATPEEGEPATQRQDPAAAQEGEDEGASAGQGPKPEAHSQEQGHPQTGCECEDGPDGQEMDPPNPEEVKTPEEEMRSHCVAQAGFLWLLMNNCFLKLSPRKP

SEQ ID NO: 63074 - protein, 75 aa, Homo sapiens
MSWRGRSTYYWPRPRRYVQPPEMIGPMRPEQFSDEVEPATPEEGEPATQRQDPAAAQEGEDEGASAGQGEKQSQC

SEQ ID NO: 63075 - protein, 117 aa, Homo sapiens; identical to SEQ ID NO: 62800

SEQ ID NO: 63076 - protein, 71 aa, Homo sapiens; identical to SEQ ID NO: 63054

SEQ ID NO: 63077 - protein, 139 aa, Homo sapiens
MSWRGRSTYYWPRPRRYVQPPEMIGPMRPEQFSDEVEPATPEEGEPATQCQDPAAAQKGEDEGASAGQGPKPEAHSQEQGHPQTGCECEDGPDGQEMDPPNPEEVKTPEEEMRSHCVAQAGFLWLLMNNCFLKLSPRKP

SEQ ID NO: 63078 - protein, 75 aa, Homo sapiens
MSWRGRSTYYWPRPRRYVQPPEMIGPMRPEQFSDEVEPATPEEGEPATQCQDPAAAQKGEDEGASAGQGEKQSQC

SEQ ID NO: 63079 - protein, 117 aa, Homo sapiens
MSWRGRSTYYWPRPRRYVQPPEMIGPMRPEQFSDEVEPATPEEGEPATQCQDPAAAQKGEDEGASAGQGPKPEAHSQEQGHPQTGCECEDGPDGQEMDPPNPEEVKTPEEGEKQSQC

SEQ ID NO: 63080 - protein, 71 aa, Homo sapiens; identical to SEQ ID NO: 63054

SEQ ID NO: 63081 - protein, 271 aa, Homo sapiens [sequence omitted]

SEQ ID NO: 63082 - protein, 138 aa, Homo sapiens
MSWRGRSTYRPRPRRYVEPPEMIGPMRPEQFSDEVEPATPEEGEPATQRQDPAAAQEGQDEGASAGQGPKPEAHSQEQGHPQTGCECEDGPDGQEMDPPNPEEVKTPEEEMRSHCVAQAGFLWLLMNNCFLNLSPRKP

SEQ ID NO: 63083 - protein, 74 aa, Homo sapiens
MSWRGRSTYRPRPRRYVEPPEMIGPMRPEQFSDEVEPATPEEGEPATQRQDPAAAQEGQDEGASAGQGEKQSQC

SEQ ID NO: 63084 - protein, 116 aa, Homo sapiens
MSWRGRSTYRPRPRRYVEPPEMIGPMRPEQFSDEVEPATPEEGEPATQRQDPAAAQEGQDEGASAGQGPKPEAHSQEQGHPQTGCECEDGPDGQEMDPPNPEEVKTPEEGEKQSQC

SEQ ID NO: 63085 - protein, 71 aa, Homo sapiens
MKWNQQHLKKGNQQLNVRILQLLRRDRMREHLQVKGRSLKLIARNRVTHRLGVSVKMVLMGRRWTRQIQRR

SEQ ID NO: 63086 - protein, 271 aa, Homo sapiens [sequence omitted]

SEQ ID NO: 63087 - protein, 139 aa, Homo sapiens
MFLQFALGKVAILAHFTYFGKNLSFAKGSSFRRADNKLWELTSSWGKTSRRAKRRAHPAAPQAVHRHPRTLPRSRPGCSSRRIRRCGRLLSAAEPQRVWILQCCTETYCSLRPTAAAAAAAAAAAAAALAAAASLNAEY

SEQ ID NO: 63088 - protein, 136 aa, Homo sapiens
METRPVPPPSQPGRWGAGTGDADEAGGATGSLCQRGAASANHCSGSEGAGTGQGLSGFCAWLPTGSLTWTSPSLAPEIHHFCRLFCDATTRSHLGSADPSGFAASCDVSAKISSLVCKQLHSQGGSSGLSAGAGEE

SEQ ID NO: 63089 - protein, 132 aa, Homo sapiens
MALTLRQPLLGGCHSPEDKQQNRAQLKEEKKASHQHQQALRRQLEAQDHTIRILKCQKTELETVLHDSQDAARKFEEDSKDLAGRLHHSWYFAGELQRALSAMSAEHKRVDRYIEELTKEREALSLELHRNM

SEQ ID NO: 63090 - protein, 139 aa, Homo sapiens
MEARVDLIDLDLCNSTQWYNEHVQPTNVCAGYPVGKIDTCQGDSGGPLMCKDSKESACVVVGITSWGVGCARAKRPGIYTATWPYLNWIASKIGSNALRLSFAKRLQQLIEVLKGKTYSDGKNHYDMETTELPELTSTS

SEQ ID NO: 63091 - protein, 340 aa, Homo sapiens
MAAAEDEFLPPPRLPELFDSSKQLLDEVEGATEPTGSRIVQEKVFKGLDLLDKVAKMLSQLDLFSRNEDLEEITSTDLKYLMVPAFQGALTMKQVNPRKRLDHLQQAREHFIKYLTQCHYYRVAEFELPQTKTNSAENHGAITSTAYPSLVAMASQRQAKIERYKQKKVLEHKLSTMKSAVESGQADNERVREYYLLHLQRWIDISLEEIESIDQEIKILGEKDSSREASTSNSCHQKRPPMKPFILTRNMAQAKVFGAGYPSLASMTVSDWYDQHQKHGVLPDQGIAKATPEEFRKATQQQEDQEKEEEDDEQTLQRAREWDDWKDTHPRGYGNRQNMG

SEQ ID NO: 63092 - protein, 81 aa, Homo sapiens [sequence omitted]

SEQ ID NO: 63093 - protein, 693 aa, Homo sapiens
MWPQPYLPPDPMMPEETRWNKLAAVKKKLKEYQQRKSPGVPAGAKTKKKKTGSSPETTTSGGCHSPGDSQYQELAVALESSSVTINQLNENIESLKQQKKQVEHQLEEAKKANNEIHKAQTEQLETINILTLEKADLKTTLYHTKRAARHFEEESKDLAGRLQYALQRIQELERALCAVSTQQQEEDRSSSCREAVLQWRLQQTIKEQALLNAHVTQVTESLKQVQLEQDEYAKHIKGERARWQERMWKMSVEARTLKEEKKRDIHRIQELKRSLSELKNQMAEPLSLAPPAVTSVVEQLQDEAKHLRQEVEGLEGKLQSQVENNQALSVLSKEQKQRLQEQEEMLREQEAQRVRELERLCEQNERLREQQKMLQEQGERLQKQEQRLRKQEERLQKEEERLQKQEKRLWDQEERLWKKEDRLQKQEERLVLFQNHKLDKQLAEPQCSFEDLNNEKKSALQLEQQVKELQEKLDEEHLEAASQRNQQLETRLSLVALPGEGDGGEHLDSEEEEAPRPTPNIPEDLESREATSSFTDLPKEKADGTEQVERRELGFVQPSGVTDGMRESFTVYESQGAVPNTWHQEMEDVIRLAQKEEEMKVNLLELQELVLPLVGNHEGHGKFLTAAQNPADEPTPGPPAPQELGAAGEQDDFYEVSLDNNVEPAPGAAREGSPHDNPTAQQIVQLSPVMQDT

SEQ ID NO: 63094 - protein, 543 aa, Homo sapiens
MEANQEPVSRLVKAQAPRPTKGVLVGRRGPMRRLGAGVKGARKPLAVPDICWAWLGSALRSRRYQDDRLPAAQAARTGAMSSPDKVSVCGAGFDLEGGKKAGSRTASPGAPGAHSHGLDLGVPGSGDGKSESGFTDPEGFSFESESELIEQGRVVLWGREGRPGTPVDDQGDVVDYSFYLADEPAAIVPPPSVQGHPFPEGAAAEGSAENWADAEVGPSGRDVLGHSPGKWQQASAGRLHLCGPGPVRAWKNPERGSKSRWSLRVDPQQPSAKGPTRLPTHDSDSADESSDLPLMKVGICRNEGSQAKPGSPKKRADTSRQASFHCKESYLPVPGRFLTSAPRGLTPVAERPAVGELEDSPQKKMQSRAWGKVEGMSKKPQKPKHSSPGKKPAGRKTRESQAAAREDNDPNRDEVPRAQVSQDCLACLCVVENSAVATPTSELPNFRELQSPRPTAREASCPDAMHPPTPLGPFHLTGRLGSWILCSLSGNQQPPVHPPRPERQQQPPGAQGCPRCIWLQREIEDLTQQLAAMQFLTDKFQDL

SEQ ID NO: 63095 - protein, 551 aa, Homo sapiens
MEANQEPVSRLVKAQAPRPTKGVLVGRRGPMRRLGAGVKGARKPLAVPDIWYFRLGRGRWAWLGSALRSRRYQDDRLPAAQAARTGAMSSPDKVSVCGAGFDLEGGKKAGSRTASPGAPGAHSHGLDLGVPGSGDGKSESGFTDPEGFSFESESELIEQGRVVLWGREGRPGTPVDDQGDVVDYSFYLADEPAAIVPPPSVQGHPFPEGAAAEGSAENWADAEVGPSGRDVLGHSPGKWQQASAGRLHLCGPGPVRAWKNPERGSKSRWSLRVDPQQPSAKGPTRLPTHDSDSADESSDLPLMKVGICRNEGSQAKPGSPKKRADTSRQASFHCKESYLPVPGRFLTSAPRGLTPVAERPAVGELEDSPQKKMQSRAWGKVEGMSKKPQKPKHSSPGKKPAGRKTRESQAAAREDNDPNRDEVPRAQVSQDCLACLCVVENSAVATPTSELPNFRELQSPRPTAREASCPDAMHPPTPLGPFHLTGRLGSWILCSLSGNQQPPVHPPRPERQQQPPGAQGCPRCIWLQREIEDLTQQLAAMQFLTDKFQDL

SEQ ID NO: 63096 - protein, 75 aa, Homo sapiens; identical to SEQ ID NO: 62963

SEQ ID NO: 63097 - protein, 1053 aa, Homo sapiens
MKNHSLRACRECPRGLEETWDLLSQLQSLLGPHLEKGDFGQLSGPDPPGEVGKRTPDGASRSSHEPTEDAAPIVSPLASPDPRTKHPQDLASTPPPGPMTTSVSSLSASQPPEPSLLLEHPSPEPPALFPHPPRTPDPLACSPPPPKGFTPPPLRDSTLLTPSHCDSVALPLDTVPQSLSPREDLAASVPGISGLGGSNSQVSALSWSQETTKTWCVFNSSVQQDHLSRQRDTTMSPLLFQAQPLSHLEPESQPFISSTPQFWPTPMAQAEAQAHLQSSFPVLSPAFLSPMKNTGVACPASQNKVQALSLPETQHPERPLLKKQLEGGLALPSRVQKSQDVFSVSTPNLPQERLTSILPENFPVSPELWRQLEQHMGQRGRIQESLDLMQLQDELPGTSQAKGKPRPWQSSTSTGESSKEAQTVKFQLERDPCPHLGQILGETPQNLSRGMESFPGKVLGATSEESERNLRKPLRSDSGSDLLRRTERNHIENILKAHMSRKLGQTNEGLIPVSVRRSWLAVNQAFPVSNTHVKTSNLAAPKSRKACVNTAQVLSFLEPCTQQVLGAHIVRFWAKHRWGLPLRVLKPIQCFQLEKVSSLSLIQLAGPSSDTCESGAGSKVEVATFLGEPPMASLRKQVLTKPSVHMPERLQASSPACKQFQRAPRGIPSSNDHGSLKAPTAGQEGRWPSKPLTYSLTGSTQQSRSLGAQSSRAGETREAVPQPTVPLGTCMRANLQATSEDVRGFKAPGASKSSLLPRMSVSQDPRKLCLMEEAVSEFEPGKATKSETQPQVSATVVLLPDGQASVVPHASENLASQVPQGHLQSMPTGNMQASQELCDLMSARRSNMGHKEPRNPNCQGSCKSQSPMFPPTHKRENSRKPNLEKHEEMFQGLRTPQLTPGRKTEDTRQNEGVQLLPSKKQPPSISHFGENIKQFFQTIFSKKERKPAPVTAESQKTVKNRSCVYGSSAEAERLMTAVGQILEENMSLCHARHASKVNQQRQQFQAPVCGFPCNHRHPFYSEHSRMLSYAASSQQATLKNQSRPNRDRQIRDQ

SEQ ID NO: 63098 - protein, 353 aa, Homo sapiens
MPRAQLPEDSSAVDMDILFPLHSVIETELCPSPIPQIIHFVLFIVFSLVILIILCPYIPREPSSVPPREEDSENDQAEVGEWLRIGNKYITLKDCRILLKELENLEVYTFLLEKRLKKLSREGSSHHLPRQVRPGPVYKPAPARNHRPRGGRGKASPTSFHVSPRAPPAPLASMPSSVPKTSIESLGSPSSLSSSQASEPLCPLKHPSHRPPASTLSPNPTSSTESLGYLSSLSSSQPPEPLRPLKHPSHKPHGRSPPRRRNPGWVSWSDSMQADSETDAIICPMCKAPERSCPHTWWVPSSPRVIRGVGRCSDPNLGLSWRQEAARAWCHCTSSQYPFEHPNLPTHLPKASF

SEQ ID NO: 63099 - protein, 80 aa, Homo sapiens
MTALNRSQGQVLELPSLHNDTSDETENATREKQLNFKDHRGPSAGVRGWRADSGQGHWREGPVITGPRKELQTAYFQRAC

SEQ ID NO: 63100 - protein, 270 aa, Homo sapiens [sequence omitted]

SEQ ID NO: 63101 - protein, 144 aa, Homo sapiens
MPKGRRGSHSPTMSQRSAPPLYFPSLYDRGISSSPLSDFNIWKKLFVPLKAGGAPPLRFFYSPPPGPEVVASPLVPCPSTPRLASASHPEELCELEIRIKELELLTITGDGFDSQSYTFLKALKDEKLQGLKTKQPGKKSASLS

SEQ ID NO: 63102 - protein, 404 aa, Homo sapiens
MAQLRACEVRQLLHNKFVVVMGDSVQLAVYKDLVLLLQKDCLLSSSQLKAKGELSFERDMLLVGCSSGRMHYDRHYREVRQFRSGHHLVRFYFLTRVYSHYAERVVEELRRAEPAPDVVVMNSCLWDLARDGRGFPRSYRRDVESLFVRLDWALPTSCLLLWNTAMPVAETISGSCLPCARQLRRARLREDVMEANFYSSAEAARRGFDVLDLHFHFRHATRHRLPDGVHWDERAHRHLSQLLLAHLADAWGVDLPRREAVDGWLRHDHANRRAAPAGRRQPRDDRPDPHGRGDRAGRGDLRAPRSLASFFWARPPFPPRRQVAFLSSDRHFSSDSSTRHIRHSGEENARVGRESRPFPIRTSSALRRERRHSPYLPWRPSEPPLSQRSRTRTHRGVPRTPRTQ

SEQ ID NO: 63103 - protein, 113 aa, Homo sapiens
MDSHSSDYSATLKADPETKIHLQVIHLQGKLSSVGGKQKTVESTEPWTVTQRMSTRSSLLCHSAQHDVNSTADRCSQEDRSPSTNSHQRKLFPRTQYVGPLTLHTAHDAEVQC

SEQ ID NO: 63104 - protein, 266 aa, Homo sapiens
MSEVEAAAVATAVPAATVPATVAGVVAVVVPVPAGEPQKAGGGAGGCGGDAAALDPAAGTPSSCLGTAKRFNVRSGYGFTNRNDAKEDVFVHWTAVKRNNPRKFLRSVRDGETVEFDVVEGEKGAEATNVPLIHPRPPSVAPPPMVAEIPSRGTEPGGEGERAEDSGQRPRRWRPPPFYLRRFVRGPRPPNQQQPIEGTDGVEPNRQPHWRGTNSREMSGSPRPDSGPDRPLILLQELPITITPTSKASLGIVVAPSEALLNRPQS

SEQ ID NO: 63105 - protein, 171 aa, Homo sapiens
MRTDAGCVRAVLGARPREGTDAGLPVPARAAAASFPHRLRTRRPCPACIPAAPKPPRRERRREEGPPLTGLSYPVDGEAREAEQRDGDQGDQQVHLLGPHGPGQAAGGRRVEAADNARDGVERAEPPPRGAAWVPSTPALGSRLATELLHLLLPALGFSACYKPLARATGR

SEQ ID NO: 63106 - protein, 140 aa, Homo sapiens
MIDQLQGTWKSISCENSEDYMKELGIGRASRKLGRLAKPTVTISTDGDVITIKTKSIFKNNEISFKLGEEFEEITPGGHKTKSKVTLDKESLIQVQDWDGKETTITRKLVDGKMVVESTVNSVICTRTYEKVSSNSVSNS

SEQ ID NO: 63107 - protein, 184 aa, Homo sapiens
MGISGRSTKLPPGPSLEAGEDDEEDDNGPEHKRCEEEALQCQREACANILIDSGADPNIVGVYGNTAVHYAVNSENLSVVAKLLSCGADIELKNKAGHTPLLLAIRKRSEQIVEFLLTKNANAIAVDKFKCIHQQLLEYKQKISKNSQNSNPEGTSEGTLDEAAPLAERTPDTAESLVERTPDE

SEQ ID NO: 63108 - protein, 427 aa, Homo sapiens; identical to SEQ ID NO: 62995

SEQ ID NO: 63109 - protein, 118 aa, Homo sapiens
MISYVLTRKWELSYEDCKGLFPDITRPFKKSFDVKHGVAHQIWDFGDCFPTPPNYGKYCVRPKKPAQEALINYSRRGKGVLKHLHGRCDSESKVCSSEDSEADRYSDYGWGGPSSPFN

SEQ ID NO: 63110 - protein, 120 aa, Homo sapiens
MGKKERRRSGASGPASEVDGDANLRDATRSSEQRSFPLVEAQAQAPPHGEARRLAEPALSLRQPIDASPRADPVPAPDRSLSGGSAHSGRFLKPRLRRSSGETDEETTIPRPYFNYYGAV

SEQ ID NO: 63111 - protein, 172 aa, Homo sapiens
MQVRERAKETLFLRHLPAQNSACVSSRLLYLLVFYTQNSGVFIYQGKLLDVCQNLESKLKELLKNFSEIVVVEGPILDCWTCLRMTNRCFKGEYCGDEDPRKAENREIALFLILLATAVILGSAVLLFHFCIFHRRKMKAIRRSLKEYVEKKLEELMGKIDEKEEKDFRLRK

SEQ ID NO: 63112 - protein, 59 aa, Homo sapiens
MWPKILSLKTQIIETSEEKFKLSYTRISLREEPSCHPSQTLPCTIFACLMMYLLRSSRG

SEQ ID NO: 63113 - protein, 149 aa, Homo sapiens
MTVNKIMVHADYNELHRMGSDITLLQLHHHVEFSSHILPACLPEPTTWLAPDSSCWISGWGMVTEDVFLPEPFQLQEAEVGVMDNTVCGSFFQPQYPGQPSSSDYTIHEDMLCAGDLITGKAICRCGELRPREEVYHPSETPGVPSSAH

SEQ ID NO: 63114 - protein, 149 aa, Homo sapiens
MTVNKIMVHADYNELHRMGSDITLLQLHRHVEFSSHILPACLPEPTTWLAPDSSCWISGWGMVTEDVFLPEPFQLQEAEVGVMDNTVCGSFFQPQYPGQPSSSDYTIHEDMLCAGDLITGKAICRCGELRPREEVYHPSETPGVPSSAH

SEQ ID NO: 63115 - protein, 73 aa, Homo sapiens
MRRGLVESAREACRRLRTCFHNCRASWGHTLTKVTLVSSPVQTPQVKWAKEHLMEPPSPLMSLWKMLLPFSPR

SEQ ID NO: 63116 - protein, 1174 aa, Homo sapiens
MTTSVSSLSASQPPEPSLPLEHPSPEPPALFPHPPHTPDPLACSPPPPKGFTAPPLRDSTLITPSHCDSVALPLGTVPQSLSPHEDLVASVPAISGLGGSNSHVSASSRWQETARTSCAFNSSVQQDHLSRHPPETYQMEAGSLFLLSSDGQNAVGIQVTETAKVNIWEEKENVGSFTDRMTPEKHLNSLRNLAKSLDAEQDTTNPKPFWNMGENSKQLPGPQKLSDPRLWQESFWKNYSQLFWGLPSLHSESLVANAWVTDRSYTLQSPPFLFNEMSNVCPIQRETTMSPLLFQAQPPSHLGPECQPFISSTPQFRPTPMAQAEAQAHLQSSFPVLSPAFPSLIKNTGVACPASQNKVQALSLPETQHPEWPLLRRQLEGRLALPSRVQKSQDVFSVSTPNLPQESLTSILPENFPVSPELRRQLEQHIKKWIIQHWGNLGRIQESLDLMQLRDESPGTSQAKGKPSPWQSSMSTGESSKEAQKVKFQLERDPCPHLGQILGETPQNLSRDMKSFPRKVLGVTSEESERNLRKPLRSDSGSDLLRCTERTHIENILKAHMGRNLGQTNEGLIPVRVRRSWLAVNQALPVSNTHVKTSNLAAPKSGKACVNTAQVLSFLEPCTQQGLGAHIVRFWAKHRWGLPLRVLKPIQCFKLEKVSSLSLTQLAGPSSATCESGAGSEVEVDMFLRKPPMASLRKQVLTKASDHMPESLLASSPAWKQFQRAPRGIPSWNDHGPLKPPPAGQEGRWPSKPLTYSLTGSTQQSRSLGAQSSKAGETREAVPQCRVPLETCMLANLQATSEDMHGFEAPGTSKSSLHPRVSVSQDPRKLCLMEEVVNEFEPGMATKSETQPQVCAAVVLLPDGQASVVPHASENLVSQVPQGHLQSMPAGNMRASQELHDLMAARRSKLVHEEPRNPNCQGSCKNQRPMFPPIHKSEKSRKPNLEKHEERLEGLRTPQLTPVRKTEDTHQDEGVQLLPSKKQPPSVSHFGGNIKQFFQWIFSKKKSKPAPVTAESQKTVKNRSCVYSSSAEAQGLMTAVGQMLDEKMSLCHARHASKVNQHKQKFQAPVCGFPCNHRHLFYSEHGRILSYAASSQQATLKSQGCPNRDRQIRNQQPLKSVRCNNEQWGLRHPQILHPKKAVSPVSPLQHWPKTSGASSHHHHCPRHCLLWEGI

SEQ ID NO: 63117 - protein, 72 aa, Homo sapiens
MDCTWGIHFLVAAATGVHSQVQLLQPGAEVKKPGSSVKVSCQASRYTFTKYFTRLTWKRLASSQMRPWTVDF

SEQ ID NO: 63118 - protein, 120 aa, Homo sapiens
MGKKERRRSGASGPASEVDGDANLRDATRSSEQRSFPLVEAQAQAPPHGEARPLAEPALSLRQPIDASPRADPVPAPDRSLSGGSAHSGRFLKPRLRRSSGETDEETTIPRPYFNYYGAV

SEQ ID NO: 63119 - protein, 267 aa, Homo sapiens
MAADDLLTSYTEVLAVGIEKQMVLPEAPGLVPQYTVWWPAWHRAQQNFSLLLAVVVQSKHPSPNIPWFPSSVTSQTAFCLLCQLQCNGVTRDLKFIPTGDNPRALFFGFCFPLEGVTGPGPAGIIGSQKQPSPVNWAQTQDWLIQQGTPADKAGRVEVSTPFHGDCQEPYAINDSKVPSQTQEHKPSTQNLQLQKDELDRQNPKRINAVSHLPSRTPLIQTKKSTSSSSSEFEDLNAYASQRNFYKRNLNRYCQEHWPFQPCLTGRP

SEQ ID NO: 63120 - protein, 71 aa, Homo sapiens; identical to SEQ ID NO: 63003

SEQ ID NO: 63121 - protein, 398 aa, Homo sapiens; identical to SEQ ID NO: 63006

SEQ ID NO: 63122 - protein, 334 aa, Homo sapiens; identical to SEQ ID NO: 63007

SEQ ID NO: 63123 - protein, 348 aa, Homo sapiens; identical to SEQ ID NO: 63004

SEQ ID NO: 63124 - protein, 108 aa, Homo sapiens
MQDPEGSKESTVRRKSTVRQLSFRDVVLRCRPHPQVHPGSQPSEGTMEIQLLTLGSRRIPDHSCVHPGREPSEDFRDHLEGSGPERLPRNRLWLFTRCLLCFIWEPLP

SEQ ID NO: 63125 - protein, 685 aa, Homo sapiens [sequence omitted]

SEQ ID NO: 63126 - protein, 156 aa, Homo sapiens
MAVSAFRSFLLPCEEGACFFFAFCHDCHVNRTPGTVQGPPVWPHAVTLSKGVTTEVHGKAERCDVLEDAGGKHAQRTGAITRLRAAAENLAWATVVSSVEVTDDLGQEVGWQRGGHAQRACRTAVGPLPPCGGGPGSRGAWTPSSPSSRHSQSPSG

SEQ ID NO: 63127 - protein, 362 aa, Homo sapiens
MSEVSDTSEETQILRDTFAIESFRTFQSHFTKYRTPVYQTPYTDERALLTLMKPTTSPSSLTTLLRTSQISPLEWYQKSRFPPIDKPWILSSVSDTKKPKVMVPPSSPQELEEKRYFVDVEAQKKNLILLNQAIKTCGLPSQLHTMARTLIIEILHMDTVQLGYLFRKYIAYRLIQYARNNIMKRLKAIQNTGKGYEARNLHMMLSRLDDYGKKVMQVWTEKQKSLGQKRNQCLKKMIHVFNQLKKIHELNLSQPIPLIIEEKQIPASTTFVQKPFLKLLMEEDRTSDICKKFRQQEDQTEAIWNVDLSTSSYPIAEKTSMHSLWAELGGYPDIPRLLQLEVQSTFRKSLASLQSRVKKIPK

SEQ ID NO: 63128 - protein, 118 aa, Homo sapiens [sequence omitted]

SEQ ID NO: 63129 - protein, 199 aa, Homo sapiens
MLPVQRRKLDPLLKKYRHHKKATRTKRRRKEKMEAQCSPVPPTPSTPPQSEEDEAVDKKPTLLSAQEDTPDLLHEDRLQYLQEEGSGVMHQECQIQSCELSVAQKPRPSSPAVTSLASPPLCFGSFLSCVCQTFSRSRKQKPPRRKGNNQAEAGGDAEVLRPGPAKPELSLSKTCSHLKLIELSFVFSFIVLSVCHCSS

SEQ ID NO: 63130 - protein, 199 aa, Homo sapiens; identical to SEQ ID NO: 63129

SEQ ID NO: 63131 - protein, 731 aa, Homo sapiens; identical to SEQ ID NO: 62534

SEQ ID NO: 63132 - protein, 208 aa, Homo sapiens
MEKENQQMLTLILEESKESERAYSVEKSRERESQSMRIKAYLVPEEDGEPAIAAGFLPKPNPADATEEVGSGWSSEQFLGLITSAAECPHATEVSLEFGNLHQQRKILMYSLSVEHPQMTFGRLHRIFPKIMPEKPAEEGNDSKEVLEASGPQNDGKQLCPPGKASSSEKIHERSGTKRGKHAWIHRLRERKQLVIYEEISDPEEDDK

SEQ ID NO: 63133 - protein, 65 aa, Homo sapiens
MAAGRPRCVITSGIGGFLVSPTSRMKPWILVLTESSFKDPVKCLAINLPRADPDGSHHPKSQTTH

SEQ ID NO: 63134 - protein, 427 aa, Homo sapiens; identical to SEQ ID NO: 62995

SEQ ID NO: 63135 - protein, 235 aa, Homo sapiens [sequence omitted]

SEQ ID NO: 63136 - protein, 171 aa, Homo sapiens; identical to SEQ ID NO: 63105

SEQ ID NO: 63137 - protein, 404 aa, Homo sapiens; identical to SEQ ID NO: 63102

SEQ ID NO: 63138 - protein, 540 aa, Homo sapiens [sequence omitted]

SEQ ID NO: 63139 - protein, 84 aa, Homo sapiens
MSVMMSETDMNAIAGTLKLYFRELPEPLFTDEFYPSFAEGIGWQRRRQSIRCPCTTSPLSLAPRCSGPPRRRASSLPTPASPSP

SEQ ID NO: 63140 - protein, 84 aa, Homo sapiens; identical to SEQ ID NO: 63139

SEQ ID NO: 63141 - protein, 118 aa, Homo sapiens; identical to SEQ ID NO: 63109

SEQ ID NO: 63142 - protein, 44 aa, Homo sapiens; identical to SEQ ID NO: 63012

SEQ ID NO: 63143 - protein, 358 aa, Homo sapiens
MFSCPKESDPIQALRKLTELCHLWLRPDLHTKEQILDMLVMEQFMISMPQELQVLVMMNGVQSCKDLEDLLRNNRRPKKWSVVSFLGKEYLMQESDVEMAEAPASVRDDPRHVSSQRTSSVNQMCPEEGQASQELQTLPRVPALFRRQEEDFLLPETTVMKGDPKALRPKPTLEKDLEEDREENPGLTSPEPQLPNSPSPAGPVSHPSGQEVKELLPFACEVCGKRFKYRGKLAVHTRSHTGERLFQCNLCGKRFMQRIGLQFHQRTHTGERPYTCDICQKQFTQKSYLKCHKRSHTGEKPFECKDCKKVFTYKANLKEHQRIHSGEKPHKCSKCPRAFGRPATLRRHQKTHREATSQ

SEQ ID NO: 63144 - protein, 57 aa, Homo sapiens [sequence omitted]

SEQ ID NO: 63145 - protein, 90 aa, Homo sapiens; identical to SEQ ID NO: 63009

SEQ ID NO: 63146 - protein, 104 aa, Homo sapiens; identical to SEQ ID NO: 63010

SEQ ID NO: 63147 - protein, 59 aa, Homo sapiens; identical to SEQ ID NO: 63112

SEQ ID NO: 63148 - protein, 64 aa, Homo sapiens; identical to SEQ ID NO: 63031

SEQ ID NO: 63149 - protein, 64 aa, Homo sapiens; identical to SEQ ID NO: 63031

SEQ ID NO: 63150 - protein, 538 aa, Homo sapiens
MDVDKELGMESVKAGASGKPEMRLGTQEETSEGDANESSLLVLSSNVPLLALEFLEIAQAKEKAFLPMVSHTFHMRTEESDASQEGDDLPKSSANTSHPKQDDSPKSSEETIQPKEGDIPKAPEETIQSKKEDLPKSSEKAIQPKESNIPKSSAKPIQPKLGNIPKASVKPSQPKEGDIPKAPEETIQSKKEDLPKSSEEAIQPKEGDIPKSSAKPIQPKLGNIAKTSVKPSQPKESDIPKSPEETIQPKEGDIPKSSAKPIQPKLGNIPKASVKPSQPKEGDISKSPEEAIQPKEGDLPKSLEEAIQPKEGDIPKSLEEAIQPKEGDIPKSPEETIQPKKGDIPKSPEEAIQPKEGDIPKSPKQAIQPKEGDIPKSLEEAIPPKEIDIPKSPEETIQPKEDDSPKSLEEATPSKEGDILKPEEETMEFPEGDKVKVILSKEDFEASLKEAGERLVAVDFSATWCGPCRTIRPFFHALSVKHEDVVFLEVDADNCEEVVRECAIMCVPTFQFYKKEEKVDELCGALKEKLEAVIAELK

SEQ ID NO: 63151 - protein, 471 aa, Homo sapiens [sequence omitted]

SEQ ID NO: 63152 - protein, 471 aa, Homo sapiens [sequence omitted]

SEQ ID NO: 63153 - protein, 74 aa, Homo sapiens; identical to SEQ ID NO: 63008

SEQ ID NO: 63154 - protein, 24 aa, Homo sapiens
MARINQTDERKHCNMYSSSTKSVC

SEQ ID NO: 63155 - protein, 172 aa, Homo sapiens; identical to SEQ ID NO: 63111

SEQ ID NO: 63156 - protein, 367 aa, Homo sapiens
MGSAQVGMGVAGRAGAHGLLTDPVPPSAAAPAPVTLLRVHPTANCSTSLVPRRRLASLPAALPSNRVVRVTTPPAGVRGAWRHSHFSRSRSTMDTSSEMLVRFGRRCGRAKESTEIRNSEEDQVLYLPLLPSKVDLQQVTIIPHDEWKRIQDSLDRLTREAACLRAERKAKKEMHLRSQEVVKHWTNTYAGMKEQKLEAKKKRDEEIEAERQILDLEEEIYKQGKRKKAIENAKQYQFYQTERVKNFHSGLLLSRVMKERDAQIEFRKSKIKSDKKWEEQLKLNIEKAFKEEQEKAEKRHRERVALAKDHLKQIKEHEEEEERRKKYEEKDAEEIKRQNALYEIEMRKKLEKKREEMHESRRRFLVS

SEQ ID NO: 63157 - protein, 195 aa, Homo sapiens [sequence omitted]

SEQ ID NO: 63158 - protein, 55 aa, Homo sapiens; identical to SEQ ID NO: 63016

SEQ ID NO: 63159 - protein, 139 aa, Homo sapiens; identical to SEQ ID NO: 63087

SEQ ID NO: 63160 - protein, 340 aa, Homo sapiens; identical to SEQ ID NO: 63091

SEQ ID NO: 63161 - protein, 94 aa, Homo sapiens
MMVAIDSEMVGTGPKGHVSFLAQCSIVNYNGDVLYDEYILPPCHTVDYWTRWSGIQKQHMVNATPFKIARGQILKILTGKIVVGHAIHDDLKAL

SEQ ID NO: 63162 - protein, 80 aa, Homo sapiens; identical to SEQ ID NO: 63099

SEQ ID NO: 63163 - protein, 318 aa, Homo sapiens [sequence omitted]

SEQ ID NO: 63164 - protein, 611 aa, Homo sapiens [sequence omitted]

SEQ ID NO: 63165 - protein, 252 aa, Homo sapiens
MKPCKENFTGSETLKHLVLQFLQQYYSIYDSGDRQGLLGAYHDEACFSLAIPFDPKDSAPSSLCKYFEDSRNMKTLKDPYLKGELLRRTKRDIVDSLSALPKTQHDLSSILVDVWCQTERMLCFSVNGVFKEVEGQSQGSVLAFTRTFIATPGSSSSLCIVNDELFVRDASPQETQSAFSIPVSTLSSSSEPSLSQEQQEMVQAFSAQSGMKLEWSQKCLQDNEWNYTRAGQAFTMLQTEGKIPAEAFKQIS

SEQ ID NO: 63166 - protein, 140 aa, Homo sapiens; identical to SEQ ID NO: 63106

SEQ ID NO: 63167 - protein, 97 aa, Homo sapiens [sequence omitted]

SEQ ID NO: 63168 - protein, 271 aa, Homo sapiens [sequence omitted]

SEQ ID NO: 63169 - protein, 99 aa, Homo sapiens [sequence omitted]

SEQ ID NO: 63170 - protein, 99 aa, Homo sapiens [sequence omitted]

SEQ ID NO: 63171 - protein, 1014 aa, Homo sapiens
MSFSLTFTELANIAIPQCGVLNFKALHLLLHGILEHIHMAELKKVLSGDEDFLQTSQVVIMPREGDAQPILNPMKRLSNVFDHVVSRLDKLENQLALLQDLPSTAQLLEASQGTARPVQDLWHLIKLRKMVEGHDEVMAKSMQTLQDLLTDLHALQVTITALRKEVDMLKNMLDKVHPERMDIFAEDFKIQNWKMVALQREVASLQNKFKTIPKTEDMVLWSGLHDAMFTSEIGSSPLDLWQSVEQLPEAALAQTTKYLEATRAVQVSEPVQNPQLLQTVWHYEVPELLPEGSSAQAVSLSRAQEPAQPPALTPESAPGCTTEFAPGPAPGTEPVPGLELGLELEPVPALGPVPGPSPYQSRQGEALQLAAVQVKGEENDVPSLRGLRERARKDGAPKDRTRKDGVPKDRGGKDVDPKDRAHKDDVPKDRGGKDVDPKDRAHKDDVPKDRGGKDGDPKDRAAKVAAKFVKDAPATKMAAIATDTAAAGPLGVFADVLGAGPSRGATESQILGDDSEIYEILSPSYSAASIGPDPALSQAMVATKQAMSPEDKKRAVKYSMSHIAQIPVKHDSLKEEFAQLSCNLNQRLSYLANMGGPSSLGTTVDILQKKIGSLQKSRLKEEELERIWGNQIEMMKDRYITLDKAVENLQIRMDEFKTLQAQIKRLEMNKVNKSTMEEELREKADRSALAGKASRVDLETVALELNEMIQGILFKVTIHEDSWKKAMEELSKDVNTKLVHSDLDPLKKEMEEVWKIVRKLLIEGLRLDPDSAAGFRRKLFKRVKCISCDRPVEMMTGPQLITIRKAHLLSRLRPASANSCEYLQRQQMREQQWLQLQDLGIQEDCQQDWGDGPQNATSLKCKSCNLLTLYPYGDPHVIDYDSAEVDILGVDGILYKGRVNSQRGAQPLAVAKELAAVKAPSPPSQSLYDRVHSSALFGAICPPLCPRSSACSAASGPHLTMPARPPSLPPLLLLPPLIPSLRDPQQAPGSTRLSRAPHIESRVGRKPPEEPANP

SEQ ID NO: 63172 - protein, 293 aa, Homo sapiens
MLEGQLEAREPKEGTHPEDPCPGAGAAMEKTPAAAEVPREDSNAGEMPSLQQQITSLHQELGRQQSLWADIHRKLQSHMDALRKQNRELREELRGLQRQQWEAGKKPAASPHAGRESHTLALEPAFGKISPLSADEETTPKYAGRKSQSATLLGQRWSSNHLAPPKPMSLKTERINSGKTPPQEDREKSPPGRRQDRSPAPTGRPTPGAERREVSEDGKIMHPSSRSPQNSGGRKSPVQASQATTLQEQTAAARGADRSSSVLGSSEGGFLSRVQADEFASSSPDSAERQVGG

SEQ ID NO: 63173 - protein, 81 aa, Homo sapiens [sequence omitted]

SEQ ID NO: 63174 - protein, 579 aa, Homo sapiens
MRLPSSPPLLERALAPQWATLSPQQQEDHPGTGQHVALSPTRPPHLWALPPLSAVGVQAALALRSDSCPSGSHGNADFSHRLGWESSTLVTRHCHFSSGQVLSRSPPPGHIISNCGSDGGEKVPGAESGKEWEEAWRPVELKADAQDQTDHLPHHFAGKLPSENASHSSAESQNTVEGMGIFTHEFMAQMCAQGPSHMAGGPKGGSPSTAAWDLIFSTDAKRLLWAMVRVQGLVKAIKRALGSFKEREPLSLKQGRSWEHGGVWGVAGESSATERGADVPGQPHELHHGISGTAPEGHPDSDSQGSQESRPCQKEMAQGCAVVTGLSHFSLEQWMGYTESWARRWPALALHDSLGPEGECTLSCQENVVAKGTEHQCSTWNFQAGHWGTVGGTQKMLPLLIICLLPAIEGKNCLRCWPELSALIDYDLQILWVTPGPPTELSQSIHSLFLEDNNFLKPWYLDRDHLEEETAKFFTQVHQAIKTLRDDKTVLLEEIYTHKNLFTERLNKISDGLKEKDIQSTLKVTSCADCRTHFLSCNDPTFCPARNRRTSLWAVSLSSALLLAIAGDVSFTGKGRRRQ

SEQ ID NO: 63175 - protein, 483 aa, Homo sapiens
MLKCKDPRLTKSHNTSKVYKTLVPIKETLQSSGKIRPGTVVHEYETGRAVVQDGTEVILHIPGVQINNTSLLINSPRTGGTARTDADAYLPLSCSRDAPVPVAQGSARDPWEGGRWGRGRVSEEEQAASARGLGSGASGPQGRGDGCDAIAPQPLRQGAAPGCGHCGRARPAPAARRPPPASAAKPADNRRDDHPEPPEPPDTRPEAPVTHGTRPGACHEVGRELARGRGGRRAKSKSRRRKGAMVVSVEPHRHEGVFIYRGAEDALVTLNMVPGQSVYGERRVTVTEGGVKQEYRTWNPFRSKLAAAILGGVDQIHIKPKSKVLYLGAASGTTVSHVSDIIGPDGLVYAVEFSHRAGRDLVNVAKKRTNIIPVLEDARHPLKYRMLIGMVDVIFADVAQPDQSRIVALNAHTFLRNGGHFLISIKANCIDSTASAEAVFASEVRKLQQENLKPQEQLTLEPYERDHAVVVGVYRPLPKSSSK

SEQ ID NO: 63176 - protein, 412 aa, Homo sapiens [sequence omitted]

SEQ ID NO: 63177 - protein, 144 aa, Homo sapiens; identical to SEQ ID NO: 63101

SEQ ID NO: 63178 - protein, 161 aa, Homo sapiens; identical to SEQ ID NO: 62931

SEQ ID NO: 63179 - protein, 73 aa, Homo sapiens
MGVCGNLPTYYDNCSFYFWLHTSFIENNRLYLPKNELDNLHKQKARRIYPSDFAVEILFGEKMTSSDVVAGSD

SEQ ID NO: 63180 - protein, 775 aa, Homo sapiens
MEEPGATPQPYWGLVLEEPRRVVAALPEGRRPDSNPYGFPWELVICAAVLGFVAVPFFLWRSFRSVRSRLYVGREKELAVALSGLIEEKCRLLEKFSLVQKEYEGYEAESPLEDASFEKEATEAQSLEANCEKLNRSNSELEHEILCLEKELKEDKSKHSEQDEVMADISKRIQSLEDESKSLKSLLAEAKMTFKRFQMNEEQMKIAIQDALNENSQLQESQKQLLQEAEVWKEQVSELNKQKITFEDSKVHAEQVLNDKENHIETLTERLLKIKDRAAMLEEDITDDENLELEMNSESEDGAYLDNPPKGALKKLIHTAKLNASLTTLEGVRNQIYIQLSEVDKTKEELREHIKNLQTEQASLQSENTYFESENQKLQQKLKVMTELYQENEMKLYRKLIVEENNRLEKEKFSKVDEMISHATEELETYRKRAKYLEEELERTIHFYQGKIIYHEKKAHDNCLAAQTAERNLNDLRKENAHNRQKLIETDFKIKFLEKDPYALDVPNTAFGREHSSYGPSPLGRPSSETRAFLYPPTLSEGPLRLSPFPPGGGGRGPRGPGNPLDHQITSERGESSCNRFTDPHKAPSDTGPLSPPWEQDRRMMFPPPGQSYPDSALPPQRQDRFYSNCARRSGPAELRSFNMPSLDKMDGSVHSEMEFSGNDTKDNLGNLNVPDSSLPAESEATGPGFVPPPLAPIRGPLFPVDTRGPFMRRGPPFPPPPPGTMFGASPDYFPPRDVPGPPRAPFAMRNVCPLRGFPPYLPPRPGFSPPTRTF

SEQ ID NO: 63181 - protein, 136 aa, Homo sapiens; identical to SEQ ID NO: 63088

SEQ ID NO: 63182 - protein, 52 aa, Homo sapiens; identical to SEQ ID NO: 63044

SEQ ID NO: 63183 - protein, 168 aa, Homo sapiens
MAPKSSDAGNLNMPKGSYTRKIVSEGELDQLAQIRPLIFNFHEQTAIKDCLKILEEKTAAYDIMQEFMALELKNLPGEFNSGNQPSNREKNRYRDILPFIEELADQGHADTATAQKTLELQPKAPVEGELTDMNDQSACEEKDKGNLGEAMMVENLTLKKLWSYFTTI

SEQ ID NO: 63184 - protein, 1639 aa, Homo sapiens [sequence omitted]

SEQ ID NO: 63185 - protein, 102 aa, Homo sapiens
MLTPRLHQELVSEGHSLSQEKSSSMSSLNIAKHMPHRAYWAEQQSRLPLPLMELMENEALEILTKALRSYQLGIGRDHFLTKELQRYIEGLKKRRSKRLYVN

SEQ ID NO: 63186 - protein, 217 aa, Homo sapiens [sequence omitted]

SEQ ID NO: 63187 - protein, 400 aa, Homo sapiens
MEEFRRKHGKDLSGNKRALRRLRTACERAKRTLSSSTQATLEIDSLFEGVDFYTSITRARFEELCSDLFRSTLEPVEKALRDAKLDKAQIHDVVLVGGSTRIPKVQKLLQDFFNGKELNKSINPDEAVAYGAAVQAAVLMGDKCEKVQDLLLLDVAPLSLGLETAGGVMTTLIQRNATIPTKQTQTFTTYSDNQPGVFIQVYEGERAMTKDNNLLGRFELSGIPPAPRGVPQIEVTFDIDANGILSVTATDRSTGKANKITITNDKGRLSKEEVERMVHEAEQYKAEDEAQRDRVAAKNSLEAHVFHVKGSLQEESLRDKIPEEDRRKMQDKCREVLAWLEHNQLAEKEEYEHQKRELEQICRPIFSRLYGGPGVPGGSSCGTQARQGDPSTGPIIEEVD

SEQ ID NO: 63188 - protein, 219 aa, Homo sapiens
MALLLRFVLLCRAADFIRGWSITTPEQMIEKAKGETAYLPCKFTLSPEDQGPLDIEWLISPADNQKVDQVIILYSGDKIYDDYYPDLKGRVHFKSNDLKSGDASINVTNFQLSDIGTDQCKVKRAPGVANRKIQLVVLGKPSGTRCYVDGSEEIGSDFKLKCEPKEGSLPLQYEWQKLSDSQKMPTSWLAEMTSSVISIKMLLLSTLGHTAVHQKQSGL

SEQ ID NO: 63189 - protein, 160 aa, Homo sapiens
MRCHAHGPSCLVTAITREEGGPRSGGAQAKLGCCWGYPSPRSTWNPDRRFWTPQTGPGEGRHERHTQTQNHTASPRSPVMESPKKKNQQLKVGILHLGSRQKKIRIQLRSQCATWKVICKSCISQTPGINLDLGSGVKVKIIPKEEHCKMPEAGEEQPQV

SEQ ID NO: 63190 - protein, 146 aa, Homo sapiens
MLLWCPPQCACSLGVFPSAPSPVWGTRRSCEPATRVPEVWILSPLLRHGGHTQTQNHTASPRSPVMESPKKKNQQLKVGILHLGSRQKKIRIQLRSQCATWKVICKSCISQTPGINLDLGSGVKVKIIPKEEHCKMPEAGEEQPQV

SEQ ID NO: 63191 - protein, 160 aa, Homo sapiens; identical to SEQ ID NO: 63189

SEQ ID NO: 63192 - protein, 146 aa, Homo sapiens; identical to SEQ ID NO: 63190

SEQ ID NO: 63193 - protein, 90 aa, Homo sapiens
MTFGRLQGISPKIMPKKPAEEGNDSEEVPEASGPQNDGKELCPPGKPTTSEKIHERSGPKRGEHAWTHRLRERKQLVIYEEISDPEEDDE

SEQ ID NO: 63194 - protein, 206 aa, Homo sapiens
MAATKTASYDEHFRPEKLREWPEPESVSLMEVLAREDIDEAVCAILFKENSIVKVTVPPFVDPLFQRQQEVDEERRTGLQCETGKRHSIKELEEIEKARLHASSPYFTFTSHCVIPKEWHKASARARSKTYKYSPEKLIYADKKQKRKEKKTADLSQAAFERQFLSSKLSQKNKVGERKGLVSRGLGRGWHAGLCSTHEQHILVPE

SEQ ID NO: 63195 - protein, 182 aa, Homo sapiens
MVTVPPFVDPLFQRQQEVDEERRTGLQCETGKRHSIKELEEIEKARLHASSPYFTFTSHCVIPKEWHKASARARSKTYKYSPEKLIYADKKQKRKEKKTADLSQAAFERQFLSSKLSQKNKVGERKGLVLGTRQQRPRSWAAGDSQQHRGPQPVGKRVMTAEVLGQHLASLQKVARQGHPWY

SEQ ID NO: 63196 - protein, 235 aa, Homo sapiens
MAATKTASYDEHFRPEKLREWPEPESVSLMEVLAREDIDEAVCAILFKENSIVKVTVPPFVDPLFQRQQEVDEERRTGLQCETGKRHSIKELEEIEKARLHASSPYFTFTSHCVIPKEWHKASARARSKTYKYSPEKLIYADKKQKRKEKKTADLSQAAFERQFLSSKLSQKNKVGERKGLVLGTRQQRPRSWAAGDSQQHRGPQPVGKRVMTAEVLGQHLASLQKVARQGHPWY

SEQ ID NO: 63197 - protein, 314 aa, Homo sapiens
MRPEGSLTYRVPERLRQGFCGVGRAAQALVCASAKEGTAFRMEAVQEGAAGVESEQAALGEEAVLLLDDIMAEVEVVAEVEVVAEEEGLVERREEAQRAQQAVPGPGPMTPESALEELLAVQVELEPVNAQARKAFSRQREKMERRRKPQLDRRGAVIQSVPGFWANVIANHPQMSALITDEDEDMLSYMVSLEVEEEKHPVHLCKIMLFFRSNPYFQNKVITKEYLVNITEYRASHSTPIEWYPDYEVEAYRRRHHNSSLNFFNWFSDHNFAGSNKIAEILCKDLWRNPLQYYKRMKPPEEGTETSGDSQLLS

SEQ ID NO: 63198 - protein, 264 aa, Homo sapiens
MRPEGSLTYRVPERLRQGFCGVGRAAQALVCASAKEGTAFRMEAVQEGAAGVESEQAALGEEAVLLLDDIMAEVEVVAEVEVVAEEEGLVERREEAQRAQQAVPGPGPMTPESALEELLAVQVELEPVNAQARKAFSRQREKMERRRKPQLDRRGAVIQSVPGFWANVIANHPQMSALITDEDEDMLSYMVSLEVEEEKHPVHLCKIMLFFRSNPYFQNKVITKEYLVNITGDRWLPGWVVEGRWWVDHCQRDPAPFPQKLLSL

SEQ ID NO: 63199 - protein, 104 aa, Homo sapiens
MVGGSLPTGSSPLPTKTPVSVEYRASHSTPIEWYPDYEVEAYRRRHHNSSLNFFNWFSDHNFAGSNKIAEILCKDLWRNPLQYYKRMKPPEEGTETSGDSQLLS

SEQ ID NO: 63200 - protein, 308 aa, Homo sapiens
MRPEGSLTYRVPERLRQGFCGVGRAAQALVCASAKEGTAFRMEAVQEGAAGVESEQAALGEEAVLLLDDIMAEVEVVAEEEGLVERREEAQRAQQAVPGPGPMTPESALEELLAVQVELEPVNAQARKAFSRQREKMERRRKPHLDRRGAVIQSVPGFWANVIANHPQMSALITDEDEDMLSYMVSLEVEEEKHPVHLCKIMLFFRSNPYFQNKVITKEYLVNITEYRASHSTPIEWYPDYEVEAYRRRHHNSSLNFFNWFSDHNFAGSNKIAEILCKDLWRNPLQYYKRMKPPEEGTETSGDSQLLS

SEQ ID NO: 63201 - protein, 258 aa, Homo sapiens
MRPEGSLTYRVPERLRQGFCGVGRAAQALVCASAKEGTAFRMEAVQEGAAGVESEQAALGEEAVLLLDDIMAEVEVVAEEEGLVERREEAQRAQQAVPGPGPMTPESALEELLAVQVELEPVNAQARKAFSRQREKMERRRKPHLDRRGAVIQSVPGFWANVIANHPQMSALITDEDEDMLSYMVSLEVEEEKHPVHLCKIMLFFRSNPYFQNKVITKEYLVNITGDRWLPGWVVEGRWWVDHCQRDPAPFPQKLLSL

SEQ ID NO: 63202 - protein, 104 aa, Homo sapiens; identical to SEQ ID NO: 63199

SEQ ID NO: 63203 - protein, 157 aa, Homo sapiens
MSWRGRSTYRPRPRRSLQPPELIGAMLEPTDEEPKEEKPPTKSRNPTPDQKREDDQGAAEIQVPDLEADLQELCQTKTGDGCEGGTDVKGKILPKAEHFKMPEAVETRFRHVGQAVLELLTSGDPLALASQSAGITDVSHHAQLKVNTFLNSNIFGI

SEQ ID NO: 63204 - protein, 160 aa, Homo sapiens; identical to SEQ ID NO: 63189

SEQ ID NO: 63205 - protein, 146 aa, Homo sapiens; identical to SEQ ID NO: 63190

SEQ ID NO: 63206 - protein, 160 aa, Homo sapiens; identical to SEQ ID NO: 63189

SEQ ID NO: 63207 - protein, 146 aa, Homo sapiens; identical to SEQ ID NO: 63190

SEQ ID NO: 63208 - protein, 163 aa, Homo sapiens
MTTKTMSQYCQQLNGLKAENTRLNSKLEKEEHHTDGLEAEVEFFHSRLAAAINEHNESLETKDLELVLQRAHNFSVHKKISSTVSQLKDKNELLTEQFSKAQMKFNTLKGKLHEIRDALREKTLALESVQMDQRQAQHRIKEMEQIHPNEETKGVDPPESTTV

SEQ ID NO: 63209 - protein, 315 aa, Homo sapiens
MSLEQRSPHCKPDEDLEAQGEDLGLMGAQEPTGEEEETTSSSDSKEEEVSAAGSSSPPQSPQGGASSSISVYYTLWSQFDEGSSSQEEEEPSSSVDPAQLEFMFQEALKLKVAELVHFLLHKYRVKEPVTKAEMLESVIKNYKRYFPVIFGKASEFMQVIFGTDVKEVDPAGHSYILVTALGLSCDSMLGDGHSMPKAALLIIVLGVILTKDNCAPEEVIWEALSVMGVYVGKEHMFYGEPRKLLTQDWVQENYLEYRQVPGSDPAHYEFLWGSKAHAETSYEKVINYLVMLNAREPICYPSLYEEVLGEEQEGV

SEQ ID NO: 63210 - protein, 315 aa, Homo sapiens; identical to SEQ ID NO: 63209

SEQ ID NO: 63211 - protein, 315 aa, Homo sapiens; identical to SEQ ID NO: 63209

SEQ ID NO: 63212 - protein, 315 aa, Homo sapiens; identical to SEQ ID NO: 63209

SEQ ID NO: 63213 - protein, 626 aa, Homo sapiens
MCSTLKKCGTYRTEVAECHDHGSTFQGRKKGGSSFRDNFDKRSCHYEHGGYERPPSHCQENDGSVEMRDVHKDQQLRHTPYSIRCERRMKWHSEDEIRITTWRNRKPPERKMSQNTQDGYTRNWFKVTIPYGIKYDKAWLMNSIQSHCSDRFTPVDFHYVRNRACFFVQDASAASALKDVSYKIYDDENQKICIFVNHSTAPYSVKNKLKPGQMEMLKLTMNKRYNVSQQALDLQNLRFDPDLMGRDIDIILNRRNCMAATLKIIERNFPELLSLNLCNNKLYQLDGLSDITEKAPKVKTLNLSKNKLESAWELGKVKGLKLEELWLEGNPLCSTFSDQSAYVSAIRDCFPKLLRLDGRELSAPVIVDIDSSETMKPCKENFTGSETLKHLVLQFLQQYYSIYDSGDRQGLLGAYHDEACFSLAIPFDPKDSAPSSLCKYFEDSRNMKTLKDPYLKGELLRRTKRDIVDSLSALPKTQHDLSSILVDVWCQTERMLCFSVNGVFKEVEGQSQGSVLAFTRTFIATPGSSSSLCIVNDELFVRDASPQETQSAFSIPVSTLSSSSEPSLSQEQQEMVQAFSAQSGMKLEWSQKCLQDNEWNYTRAGQAFTMLQTEGKIPAEAFKQIS

SEQ ID NO: 63214 - protein, 52 aa, Homo sapiens
MVQAFSAQSGMKLEWSQKCLQDNEWNYTRAGQAFTMLQTEGKIPAEAFKQIS

SEQ ID NO: 63215 - protein, 409 aa, Homo sapiens
MKWHSEDEIRITTWRNRKPPERKMSQNTQDGYTRNWFKVTIPYGIKYDKAWLMNSIQSHCSDRFTPVDFHYVRNRACFFVQDASAASALKDVSYKIYDDENQKICIFVNHSTAPYSVKNKLKPGQMEMLKLTMNKRYNVSQQALDLQNLRFDPDLMGRDIDIILNRRNCMAATLKIIERNFPELLSLNLCNNKLYQLDGLSDITEKAPKVKTLNLSKNKLESAWELGKVKGLKLEELWLEGNPLCSTFSDQSAYVSAIRDCFPKLLRLDGRELSAPVIVDIDSSETMKPCKENFTGSETLKHLVLQFLQQYYSIYDSGDRQGLLGAYHDEACFSLAIPFDPKDSAPSSLCKYFEDSRNMKTLKDPYLKGELLRRTKRDIVDSLSALPKTQHDLSSILVDVWCQTVPSGQ

SEQ ID NO: 63216 - protein, 626 aa, Homo sapiens; identical to SEQ ID NO: 63213

SEQ ID NO: 63217 - protein, 626 aa, Homo sapiens; identical to SEQ ID NO: 63213

SEQ ID NO: 63218 - protein, 288 aa, Homo sapiens
MSATGDRHPTQGDQEAPVSQEGAQAEAAGAGNQEGGDSGPDSSDVVPAAEVVGVAGPVEGLGEEEGEQAAGLAAVPRGGSAEEDSDIGPATEEEEEEEGNEAANFDLAVVARRYPASGIHFVLLDMVHSLLHRLSHNDHILIENRQLSRLMVGPHAAARNLWGNLPPLLLPQRLGAGAAARAGEGLGLIQEAASVPEPAVPADLAEMAREPAEEAAEEKLSEEATEEPDAEEPATEEPTAQEATAPEEVTKSQPEKWDEEAQDAAGEEEKEQEKEKDAENKVKNSKGT

SEQ ID NO: 63219 - protein, 314 aa, Homo sapiens
MRPEGSLTYRVPERLRQGFCGVGRAAQALVCASAKEGTAFRMEAVQEGAAGVESEQAALGEEAVLLLDDIMAEVEVVAEVEVVAEEEGLVERREEAQRAQQAVPGPGPMTPESALEELLAVQVELEPVNAQARKAFSRQREKMERRRKPHLDRRGAVIQSVPGFWANVIANHPQMSALITDEDEDMLSYMVSLEVEEEKHPVHLCKIMLFFRSNPYFQNKVITKEYLVNITEYRASHSTPIEWYPDYEVEAYRRRHHNSSLNFFNWFSDHNFAGSNKIAEILCKDLWRNPLQYYKRMKPPEEGTETSGDSQLLS

SEQ ID NO: 63220 - protein, 264 aa, Homo sapiens
MRPEGSLTYRVPERLRQGFCGVGRAAQALVCASAKEGTAFRMEAVQEGAAGVESEQAALGEEAVLLLDDIMAEVEVVAEVEVVAEEEGLVERREEAQRAQQAVPGPGPMTPESALEELLAVQVELEPVNAQARKAFSRQREKMERRRKPHLDRRGAVIQSVPGFWANVIANHPQMSALITDEDEDMLSYMVSLEVEEEKHPVHLCKIMLFFRSNPYFQNKVITKEYLVNITGDRWLPGWVVEGRWWVDHCQRDPAPFPQKLLSL

SEQ ID NO: 63221 - protein, 104 aa, Homo sapiens; identical to SEQ ID NO: 63199

SEQ ID NO: 63222 - protein, 288 aa, Homo sapiens; identical to SEQ ID NO: 63218

SEQ ID NO: 63223 - protein, 288 aa, Homo sapiens; identical to SEQ ID NO: 63218

SEQ ID NO: 63224 - protein, 308 aa, Homo sapiens
MRPEGSLTYWVPERLRQGFCGVGRAAQALVCASAKEGTAFRMEAVQEGAAGVESEQAALGEEAVLLLDDIMAEVEVVAEEEGLVERREEAQRAQQAVPGPGPMTPESALEELLAVQVELEPVNAQARKAFSRQREKMERRRKPHLDRRGAVIQSVPGFWANVIANHPQMSALITDEDEDMLSYMVSLEVEEEKHPVHLCKIMLFFRSNPYFQNKVITKEYLVNITEYRASHSTPIEWYLDYEVEAYRRRHHNSSLNFFNWFSDHNFAGSNKIAEILCKDLWRNPLQYYKRMKPPEEGTETSGDSQLLS

SEQ ID NO: 63225 - protein, 258 aa, Homo sapiens
MRPEGSLTYWVPERLRQGFCGVGRAAQALVCASAKEGTAFRMEAVQEGAAGVESEQAALGEEAVLLLDDIMAEVEVVAEEEGLVERREEAQRAQQAVPGPGPMTPESALEELLAVQVELEPVNAQARKAFSRQREKMERRRKPHLDRRGAVIQSVPGFWANVIANHPQMSALITDEDEDMLSYMVSLEVEEEKHPVHLCKIMLFFRSNPYFQNKVITKEYLVNITGDRWLPGWVVEGRWWVDHCQRDPAPFPQKLLSL

SEQ ID NO: 63226 - protein, 104 aa, Homo sapiens
MVGGSLPTGSSPLPTKTPVSVEYRASHSTPIEWYLDYEVEAYRRRHHNSSLNFFNWFSDHNFAGSNKIAEILCKDLWRNPLQYYKRMKPPEEGTETSGDSQLLS

SEQ ID NO: 63227 - protein, 288 aa, Homo sapiens; identical to SEQ ID NO: 63218

SEQ ID NO: 63228 - protein, 288 aa, Homo sapiens; identical to SEQ ID NO: 63218

SEQ ID NO: 63229 - protein, 288 aa, Homo sapiens; identical to SEQ ID NO: 63218

SEQ ID NO: 63230 - protein, 288 aa, Homo sapiens; identical to SEQ ID NO: 63218

SEQ ID NO: 63231 - protein, 308 aa, Homo sapiens; identical to SEQ ID NO: 63200

SEQ ID NO: 63232 - protein, 258 aa, Homo sapiens; identical to SEQ ID NO: 63201

SEQ ID NO: 63233 - protein, 104 aa, Homo sapiens; identical to SEQ ID NO: 63199

SEQ ID NO: 63234 - protein, 288 aa, Homo sapiens; identical to SEQ ID NO: 63218

SEQ ID NO: 63235 - protein, 288 aa, Homo sapiens; identical to SEQ ID NO: 63218

SEQ ID NO: 63236 - protein, 288 aa, Homo sapiens; identical to SEQ ID NO: 63218

SEQ ID NO: 63237 - protein, 159 aa, Homo sapiens
MKAWGTVVVTLATLMVVTVDAKIYERCELAARLERAGLNGYKGYGVGDWLCMAHYESGFDTAFVDHNPDGSSEYGIFQLNSAWWCDNGITPTKNLCHMDCHDLLNRHILDDIRCAKQIVSSQNGLSAWTSWRLHCSGHDLSEWLKGCDMHVKIDPKIHP

SEQ ID NO: 63238 - protein, 460 aa, Homo sapiens
MEETFLLAKEERQLGEVTEQTEGTAACIPQKAKNVASERELYIPSVDLLTAQDLLSFELLDINIVQELERVPHNTPVDVTPCMSPLPHDSPLIEKPGLGQIEEENEGAGFKALPDSMVSVKRKAENIASVEEAEEDLSGTQFVCETVIRSLTLDAAPDHNPPCRQKSLQMTFALPEGPLGNEKEEIIHIAEEEAVMEEEEDEEDEEEEDELKDEVQSQSSASSEDYIIILPECFDTSRPLGDSMYSSALSQPGLERGAEGKPGVEAGQEPAEAGERLPGGENQPQEHSISDILTTSQTLETVPLIPEVVELPPSLPRSSPCVHHHGSPGVDLPVTIPEVSSVPDQIRGEPRGSSGLVNSRQKSYDHSRHHHGSSIAGGLVKGALSVAASAYKALFAGPPVTAQPIISEDQTAALMAHLFEMGFCDRQLNLRLLKKHNYNILQVVTELLQLNNNDWYSQRY

SEQ ID NO: 63239 - protein, 200 aa, Homo sapiens
MEEKPSKVSLKSSDRQGSDEESVHSDTRDLWTTTTLSQAQLNMPLSEVCEGFDEEGRNISKTRGWHSPGRGSLDEGYKASHKPEELDEHALVELELHRGSSMEINLGEKDTASQIEAEKSSSMSSLNIAKHMPHRAYWAEQQSRLPLPLMELMENEALEILTKALRSYQLGIGRDHFLTKELQRYIEGLKKRRSKRLYVN

SEQ ID NO: 63240 - protein, 52 aa, Homo sapiens
MSYAAQCLIPNQLYFRDIAGPKRGKHAWTHRLRERKQLVIYEEISDPEEDDE

SEQ ID NO: 63241 - protein, 243 aa, Homo sapiens
MSPDQFLLTVSALQHARNSGEFAYPCRPQTEITDVWGPSISYPRKVLNFKGKSIQRAVDRLRLSNPPIDVKRTSIPLEIQKLQPNLKISLHSPRAQSTIPEPMIIRSRFSGSLKGGDQVTSSIERAVCSTGPLTSMQVIKPNRMLAPQVGTATLSLKKERPRIYTALDPFRVNAEFVLLTVKEEKEHQEAKMKEYQARESTGVVDPGKASKAAWIRKIKGLPIDNFTKQGKTAAPELGQNVFI

SEQ ID NO: 63242 - protein, 188 aa, Homo sapiens
MNGDDAFARRPRDDAQISEKLRKAFDDIAKYFSKKEWEKMKSSEKIVYVYMKLNYEVMTKLGFKVTLPPFMRSKRAADFHGNDFGNDRNHRNQVERPQMTFGSLQRIFPKIMPKKPAEEENGLKEVPEASGPQNDGKQLCPPGNPSTLEKINKTSGPKRGKHAWTHRLRERKQLVVYEEISDPEEDDE

SEQ ID NO: 63243 - protein, 153 aa, Homo sapiens
MNGDDAFARRPRDDAQISEKLRKAFDDIAKYFSKKEWEKMKSSEKIVYVYMKLNYEVMTKLGFKVTLPPFMRSKRAADFHGNDFGNDRNHRNQVERPQMTFGSLQRIFPKDPKGGNMPGPTDCVRESSWWFMKRSATLRKMTSNSPRGYDTCP

SEQ ID NO: 63244 - protein, 90 aa, Homo sapiens
MTFGSLQRIFPKIMPKKPAEEENGLKEVPEASGPQNDGKQLCPPGNPSTLEKINKTSGPKRGKHAWTHRLRERKQLVVYEEISDPEEDDE

SEQ ID NO: 63245 - protein, 132 aa, Homo sapiens
MRASPCISQPAASWHPRPSALRPTAGSGPDTRTPGTVEDGSAPCPAFRSPAVSPCGEEPCCFQISPAEETLELGRLVSPGNCDTLSPRAAGFYACHVRSLIPCRSTKGRWPLTASAAGLSRHAQCGPSLGLG

SEQ ID NO: 63246 - protein, 102 aa, Homo sapiens
MRASPCISQPAASWHPRPSALRPTAGSGPDTRTPGTVEDGSAPCPAFRSPAVSPCGEEPCCFQISPAEETLELGRLVSPGCHKSSAPQERRLDPRARCVVHI

SEQ ID NO: 63247 - protein, 132 aa, Homo sapiens; identical to SEQ ID NO: 63245

SEQ ID NO: 63248 - protein, 102 aa, Homo sapiens; identical to SEQ ID NO: 63246

SEQ ID NO: 63249 - protein, 132 aa, Homo sapiens; identical to SEQ ID NO: 63245

SEQ ID NO: 63250 - protein, 102 aa, Homo sapiens; identical to SEQ ID NO: 63246

SEQ ID NO: 63251 - protein, 159 aa, Homo sapiens
MDLPKEKADGTEQVERRELGFVQPSGVTDGMRESFTVYESQGAVPNTRHQEMEDVIRLAQKEEEMKVKLLELQELVLPLVGNHEGHGKFLIAAQNPADEPTPGAPAPQELGAAGEQDVFYEVSLDNNVEPAPGAAREGSPHDNPTVQQIVQLSPVMQDT

SEQ ID NO: 63252 - protein, 159 aa, Homo sapiens
MDLPKEKADGTEQVERRELGFVQPSGVTDGMRESFTVYESQGAVPNTRHQEMEDVIRLAQKEEEMKVKLLELQELVLPLVGNHEGHGKFLIAAQNPADEPTPGAPAPQELGAAGEQDDFYEVSLDNNVEPAPGAAREGSPHDNPPVQQIVQLSPVMQDT

SEQ ID NO: 63253 - protein, 159 aa, Homo sapiens
MDLPKEKADGTEQVERRELGFVQPSGVTDGMRESFTVYESQGAVPNTRHQEMEDVIRLAQKEEEMKVKLLELQELVLPLVGNHEGHGKFLIAAQNPADEPTPGAPAPQELGAAGEQDVFYEVSLDNNVEPAPGVAREGSPHNNPTVQQIVQLSPVMQDT

SEQ ID NO: 63254 - protein, 163 aa, Homo sapiens; identical to SEQ ID NO: 63208

SEQ ID NO: 63255 - protein, 206 aa, Homo sapiens; identical to SEQ ID NO: 63194

SEQ ID NO: 63256 - protein, 199 aa, Homo sapiens
MAATKTASYDEHFRPEKLREWPEPESVSLMEVLAREDIDEAVCAILFKENSIVKRLDMYFQHVDTFKERRKEMLHKKWVENVAEPLQQRIMEKVISYKELKMKQENVEYYLQHRHKMVTVPPFVDPLFQRQQEVDEERRTGLQCETGKRHSIKELEEIEKARLHASSPYFTFTSHCVIPKEWHKASARARSKTYKYRYR

SEQ ID NO: 63257 - protein, 235 aa, Homo sapiens; identical to SEQ ID NO: 63196

SEQ ID NO: 63258 - protein, 298 aa, Homo sapiens
MAATKTASYDEHFRPEKLREWPEPESVSLMEVLAREDIDEAVCAILFKENSIVKRLDMYFQHVDTFKERRKEMLHKKWVENVAEPLQQRIMEKVISYKELKMKQENVEYYLQHRHKMVTVPPFVDPLFQRQQEVDEERRTGLQCETGKRHSIKELEEIEKARLHASSPYFTFTSHCVIPKEWHKASARARSKTYKYSPEKLIYADKKQKRKEKKTADLSQAAFERQFLSSKLSQKNKVGERKGLVLGTRQQRPRSWAAGDSQQHRGPQPVGKRVMTAEVLGQHLASLQKVARQGHPWY

SEQ ID NO: 63259 - protein, 70 aa, Homo sapiens
MAEGSWIPQARALLQQCLHARLQIRPADGDVAAQWVEVQRGLVIYVCFFKGADKELLPKMAEAGLCFPSD

SEQ ID NO: 63260 - protein, 205 aa, Homo sapiens
MERLSVDYGKKSKLEFAIYPAPQVSTAVVEPYNSILTTHTTLEHSDCAFMVDNEAIYDICRRNLDIERPTYTNLNRLIGQIVSSITASLRFDGALNVDLTEFQTNLVPYPRIHFPLATYAPVISAEKAYHEQLSVAEITNACFEPANQMVKCDPRHGKYMACCMLYRGDVVPKDVNAAIATIKTKRTIQFVDWCPTGFKQHSYDP

SEQ ID NO: 63261 - protein, 774 aa, Homo sapiens
MEPEREGTERHPRKVREGRQAPNKLVGAAEAMKAGWDLEESQPEAKKARLSTILFTDNCEVTHDQLCELLKYAVLGKSNVPKPSWCQLFHQNHLNNVVVFVLQGMSQLHFYRFYLEFGCLRKAFRHKFRLPPPSSDFLADVVGLQTEQRAGDLPKTMEGPLPSNAKAAINLQDDPIIQKYGSKKVGLTRCLLTKEEMRTFHFPLQGFPDCENFLLTKCNGSIADNSPLFGLDCEMCLTSKGRELTRISLVAEGGCCVMDELVKPENKILDYLTSFSGITKKILNPVTTKLKDVQRQLKALLPPDAVLVGHSLDLDLRALKMIHPYVIDTSLLYVREQGRRFKLKFLAKVILGKDIQCPDRLGHDATEDARTILELARYFLKHGPKKIAELNLEALANHQEIQAAGQEPKNTAEVLQHPNTSVLECLDSVGQKLLFLTRETDAGELPSSRNCQTIKCLSNKEVLEQARVEIPLFPFSIVQFSFKAFSPVLTEEMNKRMRIKWTEISTVYAGPFSKNCNLRALKRLFKSFGPVQSMTFVLETRQPHLCIQYEVLEAAQLAIESLDGILVDGICIKVQRPVTELTLDCDTLVNELEGDSENQGSIYLSGVSETFKEQLLQEPRLFLGLEAVILPKDLKSGKQKKYCFLKFKSFGSAQQALNILTGKDWKLKGRHALTPRHLHAWLRGLPPESTRLPGLRVVPPPFEQEALQTLKLDHPKIAAWRWSRKIGKLYNSLCPGTLCLILLPGTKSTHGSLSGLGLMGIKEEEESAGPGLCS

SEQ ID NO: 63262 - protein, 140 aa, Homo sapiens
MFFTISRKNMSQKLSLLLLVFGLIWGLMLLHYTFQQPRHQSSVKLREQILDLSKRYVKALAEENKNTVDVENGASMAGYADLKRTIAVLLDDILQRLVKLENKVDYIVVNGSAANTTNGTSGNLVPVTTNKRTNVSGSIR

SEQ ID NO: 63263 - protein, 890 aa, Homo sapiens
MNYVGQLAGQVFVTVKELYKGLNPATLSGCIDIIVIRQPNGNLQCSPFHVRFGKMGVLRSREKVVDIEINGESVDLHMKLGDNGEAFFVQETDNDQEVIPMHLATSPILSEGASRMECQLKRGSVDRMRGLDPSTPAQVIAPSETPSSSSVVKKRRKRRRKSQLDSLKRDDNMNTSEDEDMFPIEMSSDEAMELLESSRTLPNDIPPFQDDIPEENLSLAVIYPQSASYPNSDREWSPTPSPSGSRPSTPKSDSELVSKSTERTGQKNPEMLWLWGELPQAAKSSSPHKMKESSPLSSRKICDKSHFQAIHSESSDTFSDQSPTLVGGALLDQNKPQTEMQFVNEEDLETLGAAAPLLPMIEELKPPSASVVQTANKTDSPSRKRDKRSRHLGADGVYLDDLTDMDPEVAALYFPKNGDPSGLAKHASDNGARSANQSPQSVGSSGVDSGVESTSDGLRDLPSIAISLCGGLSDHREITKDAFLEQAVSYQQFVDNPAIIDDPNLVVKIGSKYYNWTTAAPLLLAMQAFQKPLPKATVESIMRDKMPKKGGRWWFSWRGRNTTIKEESKPEQCLAGKAHSTGEQPPQLSLATRVKHESSSSDEERAAAKPSNAGHLPLLPNVSYKKTLRLTSEQLKSLKLKNGPNDVVFSVTTQYQGTCRCEGTIYLWNWDDKVIISDIDGTITRSDTLGHILPTLGKDWTHQGIAKLYHKVSQNGYKFLYCSARAIGMADMTRGYLHWVNERGTVLPQGPLLLSPSSLFSALHREVIEKKPEKFKVQCLTDIKNLFFPNTEPFYAAFGNRPADVYSYKQVGVSLNRIFTVNPKGELVQEHAKTNISSYVRLCEVVDHVFPLLKRSHSSDFPCSDTFSNFTFWREPLPPFENQDIHSASA

SEQ ID NO: 63264 - protein, 261 aa, Homo sapiens
MVKGEKGPKGKKITLKVARNCIKITFDGKKRLDLSKMGITTFPKCILRLSDMDELDLSRNLIRKIPDSISKFQNLRWLDLHSNYIDKLPESIGQMTSLLYLNVSNNRLTSNGLPVELKQLKNIRAVNLGLNHLDSVSTTLGALKELHEVGLHDNLLNNIPVSISKLPKLKKLNIKRNPFPKPGESEIFIDSIRRLENLYVVEEKDLCAACLRKCQNARDNLNRIKNMATTTPRKTIFPNLISPNSMAKDSWEDWRIRLTSS

SEQ ID NO: 63265 - protein, 623 aa, Homo sapiens
MRVALGMLWLLALAWPPQARGFCPSQCSCSLHIMGDGSKARTVVCNDPDMTLPPASIPPDTSRLRLERTAIRRVPGEAFRPLGRLEQLWLPYNALSELNALMLRGLRRLRELRLPGNRLAAFPWAALRDAPKLRLLDLQANRLSAVPAEAARFLENLTFLDLSSNQLMRLPQELIVSWAHLETGIFPPGHHPRRVLGLQDNPWACDCRLYDLVHLLDGWAPNLAFIETELRCASPRSLAGVAFSQLELRKCQGPELHPGVASIRSLLGGTALLRCGATGVPGPEMSWRRANGRPLNGTVHQEVSSDGTSWTLLGLPAVSHLDSGDYICQAKNFLGASETVISLIVTEPPTSTEHSGSPGALWARTGGGGEAAAYNNKLVARHVPQIPKPAVLATGPSVPSTKEELTLEHFQMDALGELSDGRAGPSEARMVRSVKVVGDTYHSVSLVWKAPQAKNTTAFSVLYAVFGQHSMRRVIVQPGKTRVTITGLLPKTKYVACVCVQGLVPRKEQCVIFSTNEVVDAENTQQLINVVVISVAIVIALPLTLLVCCSALQKRCRKCFNKDSTEATVTYVNLERLGYSEDGLEELSRHSVSEADRLLSARSSVDFQAFGVKGGRRINEYFC

SEQ ID NO: 63266 - protein, 530 aa, Homo sapiens
MEGSSSYEVPSVAAADLEEGAGQTRSLPATPSKDVHKGVGGIIFSSSPILDLSESGLCRLEEVFRIPSLQQLHLQRNALCVIPQDFFQLLPNLTWLDLRYNRIKALPSGIGAHQHLKTLLLERNPIKMLPVELGSVTTLKALNLRHCPLEFPPQLVVQKGLVAIQRFLRMWAVEHSLPRNPTSQEAPPVREMTLRDLPSPGLELSGDHASNQGAVNAQDPEGAVMKEKASFLPPVEKPDLSELRKSADSSENWPSEEEIRRFWKLRQEIVEHVKADVLGDQLLTRELPPNLKAALNIEKELPKPRHVFRRKTASSRSILPDLLSPYQMAIRAKRLEESRAAALRELQEKQALMEQQRREKRALQEWRERAQRMRKRKEELSKLLPPRRSMVASKIPSATDLIDNRKVPLNPPGKMKPSKEKSPQASKEMSALQERNLEEKIKQHVLQMREQRRFHGQAPLEEMRKAAEDLEIATELQDEVLKLKLGLTLNKDRRRAALTGNLSLGLPAAQPQNTFFNTKYGESGNVRRYQ

SEQ ID NO: 63267 - protein, 313 aa, Homo sapiens
MSLASGPGPGWLLFSFGMGLVSGSKCPNNCLCQAQEVICTGKQLTEYPLDIPLNTRRLFLNENRITSLPAMHLGLLSDLVYLDCQNNRIREVMDYTFIGVFKLIYLDLSSNNLTSISPFTFSVLSNLVQLNIANNPHLLSLHKFTFANTTSLRYLDLRNTGLQTLDSAALYHLTTLETLFLSGNPWKCNCSFLDFAIFLIVFHMDPSDDLNATCVEPTELTGWPITRVGNPLRYMCITHLDHKDYIFLLLIGFCIFAAGTVAAWLTGVCAVLYQNTRHKSSEEDEDEAGTRVEVSRRIFQTQTSSVQESPQLI

SEQ ID NO: 63268 - protein, 194 aa, Homo sapiens
MQDAPLSCLSPTKWSSVSSADSTEKSASAAGTRNLPFQFCLRQALRMKAAGILTLIGCLVTGAESKIYTRCKLAKIFSRAGLDNYWGFSLGNWICMAYYESGYNTTAQTVLDDGSIDYGIFQINSFAWCRRGKLKENNHCHVACSALVTDDLTDAIICAKKIVKETQGMNYWQGWKKHCEGRDLSDWKKDCEVS

SEQ ID NO: 63269 - protein, 146 aa, Homo sapiens
MKASVVLSLLGYLVVPSGAYILGRCTVAKKLHDGGLDYFEGYSLENWVCLAYFESKFNPMAIYENTREGYTGFGLFQMRGSDWCGDHGRNRCHMSCSALLNPNLEKTIKCAKTIVKGKEGMGAWPTWSRYCQYSDTLARWLDGCKL

SEQ ID NO: 63270 - protein, 314 aa, Homo sapiens
MPLEQRSQHCKPEEGLEAQGEALGLVGAQAPATEEQETASSSSTLVEVTLREVPAAESPSPPHSPQGASTLPTTINYTLWSQSDEGSSNEEQEGPSTFPDLETSFQVALSRKMAELVHFLLLKYRAREPFTKAEMLGSVIRNFQDFFPVIFSKASEYLQLVFGIEVVEVVRIGHLYILVTCLGLSYDGLLGDNQIVPKTGLLIIVLAIIAKEGDCAPEEKIWEELSVLEASDGREDSVFAHPRKLLTQDLVQENYLEYRQVPGSDPACYEFLWGPRALVETSYVKVLHHLLKISGGPHISYPPLHEWAFREGEE

SEQ ID NO: 63271 - protein, 314 aa, Homo sapiens
MPLEQRSQHCKPEEGLEARGEALGLVGAQAPATEEQEAASSSSTLVEVTLGEVPAAESPDPPQSPQGASSLPTTMNYPLWSQSYEDSSNQEEEGPSTFPDLESEFQAALSRKVAELVHFLLLKYRAREPVTKAEMLGSVVGNWQYFFPVIFSKASSSLQLVFGIELMEVDPIGHLYIFATCLGLSYDGLLGDNQIMPKAGLLIIVLAIIAREGDCAPEEKIWEELSVLEVFEGREDSILGDPKKLLTQHFVQENYLEYRQVPGSDPACYEFLWGPRALVETSYVKVLHHMVKISGGPHISYPPLHEWVLREGEE

SEQ ID NO: 63272 - protein, 317 aa, Homo sapiens
MSSEQKSQHCKPEEGVEAQEEALGLVGAQAPTTEEQEAAVSSSSPLVPGTLEEVPAAESAGPPQSPQGASALPTTISFTCWRQPNEGSSSQEEEGPSTSPDAESLFREALSNKVDELAHFLLRKYRAKELVTKAEMLERVIKNYKRCFPVIFGKASESLKMIFGIDVKEVDPASNTYTLVTCLGLSYDGLLGNNQIFPKTGLLIIVLGTIAMEGDSASEEEIWEELGVMGVYDGREHTVYGEPRKLLTQDWVQENYLEYRQVPGSNPARYEFLWGPRALAETSYVKVLEHVVRVNARVRIAYPSLREAALLEEEEGV

SEQ ID NO: 63273 - protein, 317 aa, Homo sapiens; identical to SEQ ID NO: 63272

SEQ ID NO: 63274 - protein, 317 aa, Homo sapiens; identical to SEQ ID NO: 63272

SEQ ID NO: 63275 - protein, 317 aa, Homo sapiens; identical to SEQ ID NO: 63272

SEQ ID NO: 63276 - protein, 315 aa, Homo sapiens; identical to SEQ ID NO: 63209

SEQ ID NO: 63277 - protein, 319 aa, Homo sapiens
MPRGQKSKLRAREKRRKARDETRGLNVPQVTEAEEEEAPCCSSSVSGGAASSSPAAGIPQKPQRAPTTAAAAAAGVSSTKSKKGAKSHQGEKNASSSQASTSTKSPSEDPLTRKSGSLVQFLLYKYKIKKSVTKGEMLKIVGKRFREHFPEILKKASEGLSVVFGLELNKVNPNGHTYTFIDKVDLTDEESLLSSWDFPRRKLLMPLLGVIFLNGNSATEEEIWEFLNMLGVYDGEEHSVFGEPWKLITKDLVQEKYLEYKQVPSSDPPRFQFLWGPRAYAETSKMKVLEFLAKVNGTTPCAFPTHYEEALKDEEKAGV

SEQ ID NO: 63278 - protein, 346 aa, Homo sapiens
MPRGQKSTLHAREKRQQTRGQTQDHQGAQITATNKKKVSFSSPLILGATIQKKSAGRSRSALKKPQRALSTTTSVDVSYKKSYKGANSKIEKKQSFSQGLSSTVQSRTDPLIMKTNMLVQFLMEMYKMKKPIMKADMLKIVQKSHKNCFPEILKKASFNMEVVFGVDLKKVDSTKDSYVLVSKMDLPNNGTVTRGRGFPKTGLLLNLLGVIFMKGNCATEEKIWEFLNKMRIYDGKKHFIFGEPRKLITQDLVKLKYLEYRQVPNSNPARYEFLWGPRAHAETSKMKVLEFWAKVNKTVPSAFQFWYEEALRDEEERVQAAAMLNDGSSAMGRKCSKAKASSSSHA

SEQ ID NO: 63279 - protein, 346 aa, Homo sapiens
MPRGQKSKLRAREKRQRTRGQTQDLKVGQPTAAEKEESPSSSSSVLRDTASSSLAFGIPQEPQREPPTTSAAAAMSCTGSDKGDESQDEENASSSQASTSTERSLKDSLTRKTKMLVQFLLYKYKMKEPTTKAEMLKIISKKYKEHFPEIFRKVSQRTELVFGLALKEVNPTTHSYILVSMLGPNDGNQSSAWTLPRNGLLMPLLSVIFLNGNCAREEEIWEFLNMLGIYDGKRHLIFGEPRKLITQDLVQEKYLEYQQVPNSDPPRYQFLWGPRAHAETSKMKVLEFLAKVNDTTPNNFPLLYEEALRDEEERAGARPRVAARRGTTAMTSAYSRATSSSSSQPM

SEQ ID NO: 63280 - protein, 407 aa, Homo sapiens
MPRGHKSKLRTCEKRQETNGQPQGLTGPQATAEKQEESHSSSSSSRACLGDCRRSSDASIPQESQGVSPTGSPDAVVSYSKSDVAANGQDEKSPSTSRDASVPQESQGASPTGSPDAGVSGSKYDVAANGQDEKSPSTSHDVSVPQESQGASPTGSPDAGVSGSKYDVAAEGEDEESVSASQKAIIFKRLSKDAVKKKACTLAQFLQKKFEKKESILKADMLKCVRREYKPYFPQILNRTSQHLVVAFGVELKEMDSSGESYTLVSKLGLPSEGILSGDNALPKSGLLMSLLVVIFMNGNCATEEEVWEFLGLLGIYDGILHSIYGDARKIITEDLVQDKYVVYRQVCNSDPPCYEFLWGPRAYAETTKMRVLRVLADSSNTSPGLYPHLYEDALIDEVERALRLRA

SEQ ID NO: 63281 - protein, 813 aa, Homo sapiens
MAWPCITRACCIARFWNQLDKADIAVPLVFTKYSEATEHPGAPPQPPPPQQQAQPALAPPSARAVAIETQPAQGELDAVARATGPAPGPTGEREPAAGPGRSGPGPGLGSGSTSGPADSVMRQDYRAWKVQRPEPSCRPRSEYQPSDAPFERETQYQKDFRAWPLPRRGDHPWIPKPVQISAASQASAPILGAPKRRPQSQERWPVQAAAEAREQEAAPGGAGGLAAGKASGADERDTRRKAGPAWIVRRAEGLGHEQTPLPAAQAQVQATGPEAGRGRAAADALNRQIREEVASAVSSSYRNEFRAWTDIKPVKPIKAKPQYKPPDDKMVHETSYSAQFKGEASKPTTADNKVIDRRRIRSLYSEPFKEPPKVEKPSVQSSKPKKTSASHKPTRKAKDKQAVSGQAAKKKSAEGPSTTKPDDKEQSKEMNNKLAEAKESLAQPVSDSSKTQGPVATEPDKDQGSVVPGLLKGQGPMVQEPLKKQGSVVPGPPKDLGPMIPLPVKDQDHTVPEPLKNESPVISAPVKDQGPSVPVPPKNQSPMVPAKVKDQGSVVPESLKDQGPRIPEPVKNQAPMVPAPVKDEGPMVSASVKDQGPMVSAPVKDQGPIVPAPVKGEGPIVPAPVKDEGPMVSAPIKDQDPMVPEHPKDESAMATAPIKNQGSMVSEPVKNQGLVVSGPVKDQDVVVPEHAKVHDSAVVAPVKNQGPVVPESVKNQDPILPVLVKDQGPTVLQPPKNQGRIVPEPLKNQVPIVPVPLKDQDPLVPVPAKDQGPAVPEPLKTQGPRDPQLPTVSPLPRVMIPTAPHTEYIESSP

SEQ ID NO: 63282 - protein, 439 aa, Homo sapiens
MAWPCITRACCIARFWNQLDKADIAVPLVFTKYSEATEHPGAPPQPPPPQQQAQPALAPPSARAVAIETQPAQGELDAVARATGPAPGPTGEREPAAGPGRSGPGPGLGSGSTSGPADSVMRQDYRAWKVQRPEPSCRPRSEYQPSDAPFERETQYQKDFRAWPLPRRGDHPWIPKPVQISAASQASAPILGAPKRRPQSQERWPVQAAAEAREQEAAPGGAGGLAAGKASGADERDTRRKAGPAWIVRRAEGLGHEQTPLPAAQAQVQATGPEAGRGRAAADALNRQIREEVASAVSSSYRNEFRAWTDIKPVKPIKAKPQYKPPDDKMVHETSYSAQFKGEASKPTTADNKVIDRRRIRSLYSEPFKEPPKVEKPSVQSSKPKKTSASHKPTRKAKDKQAVSGQAAKKKSAEGPSTTKPDDKEQSKEMNNKLAEAKE

SEQ ID NO: 63283 - protein, 302 aa, Homo sapiens
MRAHPGGGRCCPEQEEGESAAGGSGAGGDSAIEQGGQGSALAPSPVSGVRREGARGGGRGRGRWKQAGRGGGVCGRGRGRGRGRGRGRGRGRGRGRPPSGGSGLGGDGGGCGGGGSGGGGAPRREPVPFPSGSAGPGPRGPRATESGKRMDCPALPPGWKKEEVIRKSGLSAGKSDVYYFSPSGKKFRSKPQLARYLGNTVDLSSFDFRTGKMMPSKLQKNKQRLRNDPLNQNKLRWNTHRPAPWHALSRLCLLIRCLLCLECAYPLPLHLVNSYSSKTQLHCLHLWEACPAYSRQNQSFPP

SEQ ID NO: 63284 - protein, 194 aa, Homo sapiens
MAKSSQRKQRDCVNQCKSKPGLSTSIPLRMSSYTFKRPVTRITPHPGNEVRYHQWEESLEKPQQVCWQRRLQGLQAYSSAGELSSTLDLANTLQKLVPSYTGGSLLEDLASGLEHSCPMPHLACSSDAVEIIPAEGVGISQLLCKQFLVTEEDIRKQEGKVKTVRERLAIALIADGLANEAEKVRDQEGCPEKR

SEQ ID NO: 63285 - protein, 354 aa, Homo sapiens
MTAVNVALIRDTKWLTLEVCREFQRGTCSRADADCKFAHPPRVCHVENGRVVACFDSLKGRCTRENCKYLHPPPHLKTQLEINGRNNLIQQKTAAAMFAQQMQLMLQNAQMSSLGSFPMTPSIPANPPMAFNPYIPHPGMGLVPAELVPNTPVLIPGNPPLAMPGAVGPKLMRSDKLEVCREFQRGNCTRGENDCRYAHPTDASMIEASDNTVTICMDYIKGRCSREKCKYFHPPAHLQARLKAAHHQMNHSAASAMALQPGTLQLIPKRSALEKPNGATPVFNPTVFHCQQALTNLQLPQPAFIPAGPILCMAPASNIVPMMHGATPTTVSAATTPATSVPFAAPTTGNQLKF

SEQ ID NO: 63286 - protein, 297 aa, Homo sapiens
MIDSEAHEKRPPILTSSKQDISPHITNVGEMKHYLCGCCAAFNNVAITYPIQKVLFRQQLYGIKTRDAVLQLRRDGFRNLYRGILPPLMQKTTTLALMFGLYEDLSCLLRKHVRAPEFATHGVAAVLAGTAEAIFTPLERVQTLLQNHKHHDKFTNTYQAFKALKCHGIGEYYRGLVPILFRNGLSNVLFFGLRGPIKEHLPTATTHSAHLVNDFIGGGLLGAMLGFLCFPINVVKTRIQSQIGGEFQSFPKVFQKIWLERDRKLINLFRGAHLNYHRSLISWGIINATYEFLLKFI

SEQ ID NO: 63287 - protein, 409 aa, Homo sapiens
MDRLKSHLTVCFLPSVPFLILVSTLATAKSVTNSTLNGTNVVLGSVPVIIARTDHIIVKEGNSALINCSVYGIPDPQFKWYNSIGKLLKEEEDEKERGGGKWQMHDSGLLNITKVSFSDRGKYTCVASNIYGTVNNTVTLRVIFTSGDMGVYYMVVCLVAFTIVMVLNITRLCMMSSHLKKTEKAINEFFRTEGAEKLQKAFEIAKRIPIITSAKTLELAKVTQFKTMEFARYIEELARSVPLPPLIMNCRTIMEEIMEVVGLEEQGQNFVRHTPEGQEAADRDEVYTIPNSLKRSDSPAADSDASSLHEQPQQIAIKVSVHPQSKKEHADDQEGGQFEVKDVEETELSAEHSPETAEPSTNVTSTELTSEEPTPVEVPDKVLPPAYLEATEPAVTHDKNTCIIYESHV

SEQ ID NO: 63288 - protein, 258 aa, Homo sapiens
MEWWDESEESLEEEPRKVLAPEPEEIWVAEMLCGLKMKLKRRRVSLVLPEHHEAFNRLLEDPVIKRFLAWDKDLRVSDKYLLAMVIAYFSRAGFPSWQYQRIHFFLALYLANDMEEDDEDSKQNIFHFLYRKNRSRIPLLRKRWFQLGHSMNPRARKNRSRIPLLRKRRFQLYRSTNPRARKNRSRIPLLRKRRFQLYRSMNSRARKNRSQIVLFQKRRFHFFCSMSCRAWVSPEELEEIQAYDPEHWVWARDRAHLS

SEQ ID NO: 63289 - protein, 229 aa, Homo sapiens
MLGRIKAQAFGFDQTFQSYRKDDFVMAFFKDPNVIPNLKLLSDSSGQWIILGTEVKKIEAINVPCTQLSMSFFHRLYDEDIVRDSGHIVKCLDSFCDPFLISDELRRVLLVEDSEKYEIFSQPDREEFLFCLFKHLCLGGALCQYEDVISPYLETTKLIYKDLVSVRKNPQTKKIQITSSVFKVSAYDSAGMCYPSAKNHEQTFSYFIVDPIRRHLHVLYHCYGVGDMS

SEQ ID NO: 63290 - protein, 236 aa, Homo sapiens
MATWDEKAVTRRAKVAPAERMSKFLRHFTVVGDDYHAWNINYKKWENEEEEEEEEQPPPTPVSGEVIIICLVVLDALLVLAELILDLKIIQPDKNNYAAMVFHYMSITILVFFMMEIIFKLFVFRLEFFHHKFEILDAVVVVVSFILDIVLLFQEHQFEALGLLILLRLWRVARIINGIIISVKTRSERQLLRLKQMNVQLAAKIQHLEFSCSEKEQEIERLNKLLRQHGLLGEVN

SEQ ID NO: 63291 - protein, 154 aa, Homo sapiens
MQLSGNGLEEQAAQHLDELLLAHTDLKSLDLSYNQLNDQADLCMGLQGFLIFHSFGGGTGSGFVSLLMKRLSVDYGKKSKLEFAICPAPQVSMAMTEPYNSILTTYTTLEHSDCAFIVNSKATYDMSAQPGHRVSHVHQPQSSGQIVSSITASL

SEQ ID NO: 63292 - protein, 1060 aa, Homo sapiens
MEKSGPSSTISEQQLQRQEGWINTKTDLAEQSLISSEKWLQLHGLKSNKLTLKQILSQIGFPHCEDYVASLGRPVASRYADGLFPQLYRAEDGRVYNLTAKSELIYQFVEHLTQAVESYKQRMDWLTSKSRQIFGVILEQCVTIVLDFGGILEGELDLCREALTMVLQEQVAHITEFNIIRVSQEPVKWQENATPVTEQSIATAISWVEKLTVELTVSEAGRLDALLEAGRDKTIESIYYFVVGDVPEESKELLLQRALEIPCPVYTVSFNARGEGTIAFLKDLSAKTHSRFHAFAERTECVEFPAFSTKDGDNVMTWNSRKLKGKLPPGAGVREDVFLVWQEMEEARSTLAQIQRLVAEPPKPDVATVDCESETTSVEIASNPEDTWDSKTWLQKYGLKAQKLSLYDVLADCSFCHADGVVDIKAKPENESVQTSAETNKKTVHAKYCSRFVHAPWKDGSLVHVNITKEKCKWYSERIHTALARIRRRIKWLQDGSQSLFGRLHNDCIYILIDTSHSMKSKLDLVKDKIIQFIQEQLKYKSKFNFVKFDGQAVAWREQLAEVNEDNLEQAQSWIRDIKIGSSTNTLSALKTAFADKETQAIYLLTDGRPDQPPETVIDQVKRFQEIPIYTISFNYNDEIANRFLKEVAALTGGEFHFYNFGCKDPTPPEAVQNEDVTLLVKEMEQGHSDLEKMQDLYSESLIMDWWYNAEKDGDSKHQKEICSMISTPERCAKPQSDVDSTQTSSLNMLKGPWGLSDQKVQKKKVLHAESTKTSLLRSQMSSLRSSACSERKDGLSNASSRRTALSDKEMSILLAEEWLDDKSSEKVTREGSQVYDHDSSDVSSENWLKTYGLVAKKLTLMDALSVAAVPHSSTYVPVLDKHVMSKVLDEVFPLAHVCNDTNKMTLINPQGAKLNIYKRKVEQAIQSYEKRLNKIVWRALSQEEKEKLDANKPIQYLENKTVLNQALERLNWPISLKELSMLESEILAGKMYIQQAMELQEAAKKNYANKAPGEQQKLQGNPTKKTKSKRPDPLKGQKVIARCDENGFYFPGSFFFLIS

SEQ ID NO: 63293 - protein, 233 aa, Homo sapiens
MALKNKFSCLWILGLCLVATTSSKIPSITDPHFIDNCIEAHNEWRGKVNPPAADMKYMIWDKGLAKMAKAWANQCKFEHNDCLDKSYKCYAAFEYVGENIWLGGIKSFTPRHAITAWYNETQFYDFDSLSCSRVCGHYTQLVWANSFYVGCAVAMCPNLGGASTAIFVCNYGPAGNFANMPPYVRGESCSLCSKEEKCVKNLCKNPFLKPTGRAPQQTAFNPFSLGFLLLRIF

SEQ ID NO: 63294 - protein, 446 aa, Homo sapiens
MLHPETSPGRGHLLAVLLALLGTAWAEVWPPQLQEQAPMAGALNRKESFLLLSLHNRLRSWVQPPAADMRRLDWSDSLAQLAQARAALCGIPTPSLASGLWRTLQVGWNMQLLPAGLASFVEVVSLWFAEGQRYSHAAGECARNATCTHYTQLVWATSSQLGCGRHLCSAGQAAIEAFVCAYSPRGNWEVNGKTIVPYKKGAWCSLCTASVSGCFKAWDHAGGLCEVPRNPCRMSCQNHGRLNISTCHCHCPPGYTGRYCQVRCSLQCVHGRFREEECSCVCDIGYGGAQCATKVHFPFHTCDLRIDGDCFMVSSEADTYYRARMKCQRKGGVLAQIKSQKVQDILAFYLGRLETTNEVIDSDFETRNFWIGLTYKTAKDSFRWATGEHQAFTSFAFGQPDNHGFGNCVELQASAAFNWNNQRCKTRNRYICQFAQEHISRWGPGS

SEQ ID NO: 63295 - protein, 233 aa, Homo sapiens
MDQEEGLKALDNIVTQFNAYEDFLDSQITTVDLYYLEDETLARQLVELGYRGTGERVKREDFEARKAAIEIARLAERAQQKTLTSAGKDLQDNFLTALAMREEDNRSGKLSSVIFIRDRNSHGQEISGYIDYAHRLKTEDFEVYFTGKKRLLPRPTDISFYNWDADIAVSNSSPNYQVIADNPEGLLFRYKRDRKILNVDPKAQPGDNSTRITILTELYIQAVIFDHISRRKT

SEQ ID NO: 63296 - protein, 724 aa, Homo sapiens
MDNFETSLLPFTIPTSMQVGVPEVTSAHFAGSLLLLVVDQKVYIYDYENNSWSMSLGIKHPVTHVSGDNCCYTGSLFCVHVSNLVFAYFRGDQISQTYIYYSNTGGFSFWKYHYDRQAEIIGSLGGIFHFFSLSQVAMLVVNQGKGMFKYSDHPLNRSFGLSFDYNGTLDILIAPGQRGILLLWFENSLLFSHNAGQLVDTVRVKKGDQTLFSSIFEAKITIHNIAVTENELAVITREDNLYYGNLGIVPSSIIKFADQYIWSEDVALMFRSPGTLEILTPLRDTAFPAFDFQKCLVNIQALLMDPELHVGKCKIEFLTGEFIYRMYTIDMHSQLELTASLIPQPGTSLIPLVMVSNPHSLGFQATFYENGYTSDGNTKYKLDIFLKQQQHWGRTDSNFTSSLKKATMSTLTVDIANKEISCVDIKPLSALISVGCDLDKKIVIQNKVSACSMGILDPLTLQDNYSFIIEKEFYDPGFQGQQSSEDLHVFYSYQQLGCPLLVYYDTLWKPVVELWRKDSFQEVIDAEYVLLEVNGQFSYSYSLTAQSAMCTSQPQNWTTMIKEFGGPFFWNRENYVSCHDPNNNAPLRWPDVQYQILGGRTANQIIFGHNGFYVFYISIVDPYYSYCQLETIFSIYVYGAFPVQLVSAGVVILLIISSILGSVWLAYKTPKLLRTARGRRIKKCATQLCRRCKTVCQFRASATARAGTEPPGRHRTPHGGRSDH

SEQ ID NO: 63297 - protein, 95 aa, Homo sapiens
MPSSHIVLKEETRMLGLMYAIWMNLNSFGLAIIGILLIACEIILFLTKDETIQWPHVPSNRGSKANLILKELQLLVRSTWWFHRETAQRTCLYLA

SEQ ID NO: 63298 - protein, 1065 aa, Homo sapiens
MGLLWGQLTHALACRHCGSSCFQSPGNLVTLFLFVVWQIQRWWQLGRLRQLHPWCSGNMVQGKELPLLHRVAFLDHLCKQKSEVEEEGEEEEEGEDEASLDPLKPCSPTKEAPTGEQATPAPPQPSCGSEGLLKAIGIPEQTVMQPVSPSRSFPIFQILTSFPVRHKIASGNRQQQRKSQLFWGLPSLHSESLEAIFLSSGGPYPLKLSVCSSVFFNKLAFLPRSNLLLPQYHSSAQFSTHGAHTMEDLEGMAPDPQLLPPPSSPSVSSLLLHLRPFPVDHKGVLSGAEAPTQSPGTSPLEVLPGYETHLETTGHKKMPQAFEPPMPPPCQSPASLSEPRKVSPEGGLAISKDFWGTVGYREKPQASESSMPVPCPPLDSLPELQRESSLEDPSRYKPQWECRENSGNLWAFESPVLDLNPELSGTSPECVPPASETPWKGMQSRENIWVPADPVSPPSLPSVPLLESLVMGPQGVLSESKALWETMGQKENLWASDSPDPVHSTPPTTLMEPHRINPGECLATSEATWKDTEHSRNSSASRSPSLALSPPPALAPELLRVRSMGVLSDSEARCGDIQKTKNSWASKHPACNLPQDLHGASPLGVLSDSQSIVGEMEQKENCVPVFPGRGSSPSSNSVSKSHVSEPIADQSNYKPDGEAVEQRKNHWATELPAPSSLSTPLPEPHIDLELVWRNVQQREVPQGPSPLAVDPLHPVPQPPTLAEAVKIERTHPGLPKGVTCPGVKAEAPLSQRWTVPELLTHPGIHAWQWSRELKLRLKKLRQSPASRAPGPSQSFCSSPILSSTIPDFWGLPSCPPQQIYPPNPCPHSSSCHPQEVQRTVPQPVQSSHCHHFQSSSQLQPQESGRAEQGSQRGEKMKGKMVSQVPSQGPCVHMEAGVDYLSPGPGEPSNSKVLVSGKRKDKASASSSAKKREHPRKPKAGDHRRGTARLGLSTVTGKNHPAQARSLVEAPVSTFPQRSQHRGQSSQHTALPQLLLPKASGPQDQPEAGRRASDILTPRHCKHCPWAHMEKYLSFPTLKASLTRGLQKVLAKCLDNHRPLPTKSSQ

SEQ ID NO: 63299 - protein, 75 aa, Homo sapiens
MALKLIHKEFLELARDPQPHCSAGPVWDDMLHWQATITRPNDSSYLGGVFFLKFPSDYLFKPPKIKFTNGIYHQR

SEQ ID NO: 63300 - protein, 75 aa, Homo sapiens; identical to SEQ ID NO: 63299

SEQ ID NO: 63301 - protein, 165 aa, Homo sapiens
MSAWELTHLSGKEGMASQPTEAHWGHRTSPQSRDSPSRKSDQALRGHGLRTRSREDTVTNPWLIWQVWEAARPVASPAPPDLCLQLSCSLGQAPRQLYGRRRCTTHILFPGRACCPGCSECGSRWPPAISNFRELPCLRSRPFWGSSHLPGGYKSTVDTMMGNSG

SEQ ID NO: 63302 - protein, 953 aa, Homo sapiens
MPTLVVGTPPTCLGDTPQPCHKNSQRQGPFSHGAPGRAADWKAVAKPRLCAPAAEDDVAALRWPGPSQQPDPPWAAPHVVGSDDLKEPGPWGKACSLPMWSTGPEARDGDSSVSSGRLSCSSGGHDVCVSWKERPPQVLGPQQRPRKSDARLEQLRDKIRAQAWQQGSCASLGTSAPSSASRLHKASTLTLRRKGQEAKNPPPAPECSGFSILSAAERRVEAKASHGQGRELSRVSQHQVPVLREKPKRVKSSSCKREKTPKLPSPRRAAKDKHKDEDSELVGVYAWRKGQALVRSLLGPPPVLRRHHSKDPSRDPALTVDLGDSEKVIAAKCSPVCAQLPDATSAHSDQQVSGNTPSLASFDQPATIQTAMAILQDLRQQIQAGLELAQARKGGQELGPSKRRLQDVAGRGRCRDPNAQSSFSKSPWAMTERKHSSLERARSVHTWEPWSSSTARESCPQRAWGAQGQDRSFQRPESPHERLGHFSQRPWSALAGQACSPQRAWGAQRQGPSSQRPGSPPEKRSPFPQQPWSAVATQPCPRRAWTACETWEDPGPRLRNPLERPSPPAQRPWSSSGVQRAGPQGKGRGIGSPVSAAKHALPRPTGSFPQNPLGKEKDTLRPCPRSRGLLGPSHSSESLREFMRQKAQARRRQALEEKASALRTRELRSRRLQEVYRQQREAVLGRAVPVVSRTTPGIVTFVPSSAQSGGLEASGSLESPVLEWSKVTSGMVLGGQEAPGSFCLCLNRAWNHAETLDPPGMGGPQDGRDAPVLLSASPSLGSLELQDLTTRYLPRGMCIYLDPKEAEHLGTSSSLHLRHKQAQLQALETTAKVLKQRVDSLTAKLQGAEAPDTVRDPAVGLLRSCPHSLPAAPTLATPTLATPACPGALGPNWGRGAPGEWVSMQPQPLLPPTYFLEGETLSWGPSWEQQQSVSPRAHCESKPRGVSQAPLLL

SEQ ID NO: 63303 - protein, 171 aa, Homo sapiens
MEPGPALAWLLLLSLLADCLKAAQSRDFTVKDIIYLHPSTTPYPGGFKCFTCEKAADNYECNRWAPDIYCPRETRYCYTQHTMEVTGNSISVTKRCVPLEECLSTGCRDSEHEGHKVCTSCCEGNICNLPLPRNETDATFATTSPINQTNGHPRCMSVIVSCLWLWLGLML

SEQ ID NO: 63304 - protein, 549 aa, Homo sapiens
MTSHQPQPQEEQSPQRSTSGYPLQEVVDDEVSGPSAPGVDPSPPRRSLGCKRKRECLDESDDEPEKELAPEPEETWVAETLCGLKMKAKRRRVSLVLPEYYEAFNRLLAPGVDPSPPRRSLGCKRKRECLDESDDEPEKELAPEPEETWVAETLCGLKMKAKRRRVSLVLPEYYEAFNRLLAPGVDPSPPRRSLGCKRKRECLDESDDEPEKELAPEPEETWVAETLCGLKMKAKRRRVSLVLPEYYEAFNRLLAPGVDPSPPRRSLGCKRKRECLDESDDEPEKELAPEPEETWVAETLCGLKMKAKRRRVSLVLPEYYEAFNRLLAPGVDPSPPRRSLGCKRKRECLDESDDEPEKELAPEPEETWVAETLCGLKMKAKRRRVSLVLPEYYEAFNRLLEDPVIKRFLAWDKGLRVSDKYLLAMVIAYFSRAGLPSWQYQRIHFFLALYLANDMEEDDEAPKQKIFYFLYGKTHSHIPLRPKHWFQLCRPMNPRARKNCSQIALFQKRRFQFFCSMRCRAWVSPEELEEIQAYDPEHWVWARDRAHLS

SEQ ID NO: 63305 - protein, 416 aa, Homo sapiens
MSTKQITCRYFMHGVCREGSQCLFSHDLANSKPSTICKYYQKGYCAYGTRCRYDHTRPSAAAGGAVGTMAHSVPSPAFHSPHPPSEVTASIVKTNSHEPGKREKRTLVLRDRNLSGMAERKTQPSMVSNPGSCSDPQPSPEMKPHSYLDAIRSGLDDVEASSSYSNEQQLCPYAAAGECRFGDACVYLHGEVCEICRLQVLHPFDPEQRKAHEKICMLTFEHEMEKAFAFQASQDKVCSICMEVILEKASASERRFGILSNCNHTYCLSCIRQWRCAKQFENPIIKSCPECRVISEFVIPSVYWVEDQNKKNELIEAFKQGMGKKACKYFEQGKGTCPFGSKCLYRHAYPDGRLAEPEKPRKQLSSQGTVRFFNSVRLWDFIENRESRHVPNNEDVDMTELGDLFMHLSGVESSEP

SEQ ID NO: 63306 - protein, 418 aa, Homo sapiens
MAPRGRRRPRPHRSEGARRSKNTLERTHSMKDKAGQKCKPIDVFDFPDNSDVSSIGRLGENEKDEETYETFDPPLHSTAIYADEEEFSKHCGLSLSSTPPGKEAKRSSDTSGNEASEIESVKISAKKPGRKLRPISDDSESIEESDTRRKVKSAEKISTQRHEVIRTTASSELSEKPAESVTSKKTGPLSAQPSVEKENLAIESQSKTQKKGKISHDKRKKSRSKAIGSDTSDIVHIWCPEGMKTSDIKELNIVLPEFEKTHLEHQQRIESKVCKAAIATFYVNVKEQFIKMLKESQMLTNLKRKNAKMISDIEKKRQRMIEVQDELLRLEPQLKQLQTKYDELKERKSSLRNAAYFLSNLKQLYQDYSDVQAQEPNVKETYDSSSLPALLFKARTLLGAESHLRNINHQLEKLLDQG

SEQ ID NO: 63307 - protein, 483 aa, Homo sapiens
MKVLPASGLAVFLIMALKFSTAAPSLVAASPRTWRNNYRLAQAYLDKYYTNKEGHQIGEMVARGSNSMIRKIKELQAFFGLQVTGKLDQTTMNVIKKPRCGVPDVANYRLFPGEPKWKKNTLTYRISKYTPSMSSVEVDKAVEMALQAWSSAVPLSFVRINSGEADIMISFENGDHGDSYPFDGPRGTLAHAFAPGEGLGGDTHFDNAEKWTMGTNGFNLFTVAAHEFGHALGLAHSTDPSALMYPTYKYKNPYGFHLPKDDVKGIQALYGPRKVFLGKPTLPHAPHHKPSIPDLCDSSSSFDAVTMLGKELLLFKDRIFWRRQVHLRTGIRPSTITSSFPQLMSNVDAAYEVAERGTAYFFKGPHYWITRGFQMQGPPRTIYDFGFPRHVQQIDAAVYLREPQKTLFFVGDEYYSYDERKRKMEKDYPKNTEEEFSGVNGQIDAAVELNGYIYFFSGPKTYKYDTEKEDVVSVVKSSSWIGC

SEQ ID NO: 63308 - protein, 1211 aa, Homo sapiens
MLSLAAKLVAFFWRTADTPREEAGQLEPELAEGDTKLKTVRGVVTRYCSDYGMIDDMIYFSSDAVTSRVLLNVGQEVIAVVEENKVSNGLKAIRVEAVSDKWEDDSRNHGSPSDCGPRVLIGCVTSLVEGAGCISQTTYFSLESVCEGFEPCKGDWVEAEYRIRPGTWSSEATSVKPLRYKRVDKVCISSLCGRNGVLEESIFFTLDSLKLPDGYTPRRGDVVNAVVVESSQSCYVWRALCMTLVKRRDAAPVHEATHFYGTILLKNKGDIEVTQVTHFGTLKEGRSKTMVIWIENKGDIPQNLVSCKLAGWDKSKQFRFQMLDKDQMCPVVSFVSVPEKENSSDENINSLNSHTKNKTSQMSESSLVNNRGISPGDCTCKGENGEKDNILSRKQMTEPEPGGLVPPGGKTFIVVICDGKNPGRCKELLLLCFSDFLIGRYLEVNVISGEESLIAAREPFSWKKLKSSQALTSAKTTVVVTAQKRNSRRQLPSFLPQYPIPDRLRKCVEQKIDILTFQPLLAELLNMSNYKEKFSTLLWLEEIYAEMELKEYNMSGIILRRNGDLLVLEVPGLAEGRPSLYAGDKLILKTQEYNGHAIEYISYVTEIHEEDVTLKINPEFEQAYNFEPMDVEFTYNRTTSRRCHFALEHVIHLGVKVLFPEEIILQSPQVTGNWNHAQDTKSSGQSTSKKNRKTMTDQAEHGTEERRVGDKDLPVLAPFTAEMSDWVDEIQTPKARKMEFFNPVLNENQKLAVKRILSGDCRPLPYILFGPPGTGKTVTIIEAVLQVHFALPDSRILVCAPSNSAADLVCLRLHESKVLQPATMVRVNATCRFEEIVIDAVKPYCRDGEDIWKASRFRIIITTCSSSGLFYQIGVRVGHFTHVFVDEAGQASEPECLIPLGLMSDISGQIVLAGDPMQLGPVIKSRLAMAYGLNVSFLERLMSRPAYQRDENAFGACGAHNPLLVTKLVKNYRSHEALLMLPSRLFYHRELEVCADPTVVTSLLGWEKLPKKGFPLIFHGVRGSEAREGKSPSWFNPAEAVQVLRYCCLLAHSISSQVSASDIGVITPYRKQVEKIRILLRNVDLMDIKVGSVEEFQGQEYLVIIISTVRSNEDRFEDDRYFLGFLSNSKRFNVAITRPKALLIVLGNPHVLVRDPCFGALLEYSITNGVYMGCDLPPALQSLQNCGEGVADPSYPVVPESTGPEKHQEPS

SEQ ID NO: 63309 - protein, 326 aa, Homo sapiens
MAAPASVMGPLGPSALGLLLLLLVVAPPRVAALVHRQPENQGISLTGSVACGRPSMEGKILGGVPAPERKWPWQVSVHYAGLHVCGGSILNEYWVLSAAHCFHRDKNIKIYDMYVGLVNLRVAGNHTQWYEVNRVILHPTYEMYHPIGGDVALVQLKTRIVFSESVLPVCLATPEVNLTSANCWATGWGLVSKQGETSDELQEMQLPLILEPWCHLLYGHMSYIMPDMLCAGDILNAKTVCEGDSGGPLVCEFNRSWLQIGIVSWGRGCSNPLYPGVYASVSYFSKWICDNIEITPTPAQPAPALSPALGPTLSVLMAMLAGWSVL

SEQ ID NO: 63310 - protein, 598 aa, Homo sapiens
MTTALGSQLSSSQTVIPGSSGTISHTTVAPGSSVTGTTTGASDDQVTGSKTGTTGVALSTTVAPGSSSTEATTSTGVHRTTVVGQKTGATTRGSAKQGTRSTIEATTSFRGTGTTGSGMNTGTTGVVSGNTISPSSFNTEATSGTSERPNPGSEIGTTGIVSGTTVAPGSSNTEATTSLGNGGTTEAGSKIVTTGITTGTTIVPGSFNTKATTSTDVGVATGVGMATGITNIISGRSQPTGSKTGYTVTGSGTTALPGGFRTGNTPGSTGVTSSQEGTTVVSSGITGIPETSISGPSKEASDKTTAPGPPTTVTASTGVKETSETGVQTGSTLVTAGVPTRPQVSQPETTVVATREVETENKTECLASLPPAPVCHGPLGEEKSPGDIWTANCHRGTCTDAKTIDCKPEECPSPPTCKTGEKLVKFQSNDTCCEIGYCEPRTCLFNNTDYEIGASFDDPSNPCVSYSCKDTGFAAVVQDCPKQTWCAEANRIYDSKKCCYTCKNNCRSSLVNVTVIYSGCKKRVQMAKCTGECEKTAKYNYDILLLEHSCLCCREENYELRDIVLDCPDGSTIPYQYKHITTCSCLDICQLYTTFMYS

SEQ ID NO: 63311 - protein, 598 aa, Homo sapiens; identical to SEQ ID NO: 63310

SEQ ID NO: 63312 - protein, 1278 aa, Homo sapiens
MKHLYGLFHYNPMMLGLESLPDPTDTWEIIETIGKGTYGKVYKVTNKRDGSLAAVKILDPVSDMDEEIEAEYNILQFLPNHPNVVKFYGMFYKADHCVGGQLWLVLELCNGGSVTELVKGLLRCGQRLDEAMISYILYGALLGLQHLHNNRIIHRDVKGNNILLTTEGGVKLVDFGVSAQLTSTRLRRNTSVGTPFWMAPEVIACEQQYDSSYDARCDVWSLGITAIELGDGDPPLFDMHPVKTLFKIPRNPPPTLLHPEKWCEEFNHFISQCLIKDFERRPSVTHLLDHPFIKGVHGKVLFLQKQLAKVLQDQKHQNPVAKTRHERMHTRRPYHVEDAEKYCLEDDLVNLEVLDEDTIIHQLQKRYADLLIYTYVGDILIALNPFQNLSIYSPQFSRLYHGVKRASNPPHIFASADAAYQCMVTLSKDQCIVISGESGSGKTESAHLIVQHLTFLGKANNQTLREKILQVNSLVEAFGNSCTAINDNSSRFGKYLEMMFTPTGVVMGARISEYLLEKSRVIKQAAREKNFHIFYYIYAGLHHQKKLSDFRLPEEKPPRYIADETGRVMHDITSKESYRRQFEAIQHCFRIIGFTDKEVHSVYRILAGILNIGNIEFAAISSQHQTDKSEVPNAEALQNAASVLCISPEELQEALTSHCVVTRGETIIRANTVDRAADVRDAMSKALYGRLFSWIVNRINTLLQPDENICSAGGGMNVGILDIFGFENFQRNSFEQLCINIANEQIQYYFNQHVFALEQMEYQNEGIDAVPVEYEDNRPLLDMFLQKPLGLLALLDEESRFPQATDQTLVDKFEDNLRCKYFWRPKGVELCFGIQHYAGKVLYDASGVLEKNRDTLPADVVVVLRTSENMLLQQLFSIPLTKTGNLAQTRARITVASSSLPPHFSAGKAKVDTLEVIRHPEETTNMKRQTVASYFRYSLMDLLSKMVVGQPHFVRCIKPNDDREALQFSRERVLAQLRSTGILETVSIRRQGYSHRILFEEFVKRYYYLAFTAHQTPLASKESCVAILEKSRLDHWVLGKTKVFLKYYHVEQLNLLLREVIGRVVVLQAYTKGWLGARRYKKVREKREKGAIAIQSAWRGYDARRKFKKISNRRNESAAHNQAGDTSNQSSGPHSPVAAGTRGSAEVQDCSEPGDHKVLRGSVHRRSHSQAESNNGRTQTSSNSPAVTEKNGHSQAQSSPKGCDIFAGHANKHSVSGTDLLSSRICHPAPDQQGLSLWGAPQKPAFPHYGCNFYGFRKWSCTEASNTSPTMSAAQNAE

SEQ ID NO: 63313 - protein, 2548 aa, Homo sapiens
MNINDGGRRRFEDNEHTLRIYPGAISEGTIYCPIPARKNSTAAEVIESLINKLHLDKTKCYVLAEVKEFGGEEWILNPTDCPVQQMMLWPRMALENRLSGEDYRFLLREKNLDGSIHYGSLQSWLRVTEERRRMMERGFLPQPQQKDFDDLCSLPDLNEKTLLENLRDRFKHEKIYTYVGSILIVINPFKFLPIYNPKYVKMYDNHQLGKPEPHIYAVADVAYHAMLQRKKNQCIVISGESGSGKTQSTNFLIHHLTALSQKGFASGVEQIILGAGPVLEAFGNAKTAHNNNSSRFGKFIQVNYQETGTVLGAYVEKYLLEKSRLVYQEHNERNYHVFYYLLAGASEDERSAFHLKQPEEYHYLNQITKKPLRQSWDDYCYDSEPDCFTVEGEDLRHDFERLQLAMEMVGFLPKTRRQIFSLLSAILHLGNICYKKKTYRDDSIDICNPEVLPIVSELLEVKEEMLFEALVTRKTVTVGEKLILPYKLAEAVTVRNSMAKSLYSALFDWIVFRINHALLNSKDLEHNTKTLSIGVLDIFGFEDYENNSFEQFCINFANERLQHYFNQHIFKLEQEEYRTEGISWHNIDYIDNTCCINLISKKPTGLLHLLDEESNFPQATNQTLLDKFKHQHEDNSYIEFPAVMEPAFIIKHYAGKVKYGVKDFREKNTDHMRPDIVALLRSSKNAFISGMIGIDPVAVFRWAILRAFFRAMVAFREAGKRNIHRKTGHDDTAPCAILKSMDSFSFLQHPVHQRSLEILQRCKEEKYSITRKNPRTPLSDLQGMNALNEKNQHDTFDIAWNGRTGIRQSRLSSGTSLLDKDGIFANSTSSKLLERAHGILTRNKNFKSKPALPKHLLEVNSLKHLTRLTLQDRITKSLLHLHKKKKPPSISAQFQASLSKLMETLGQAEPYFVKCIRSNAEKLPLRFSDVLVLRQLRYTGMLETVQIRQSGYSSKYSFQDFVSHFHVLLPRNIIPSKFNIQDFFRKINLNPDNYQVGKTMVFLKEQERQHLQDLLHQEVLRRIILLQRWFRVLLCRQHFLHLRQASVIIQRFWRNYLNQKQVRDAAVQKDAFVMASAAALLQASWRAHLERQRYLELRAAAIVIQQKWRDYYRRRHMAAICIQARWKAYRESKRYQEQRKKIILLQSTCRGFRARQRFKALKEQRLRETKPEVGLVNIKGYGSLEIQGSDPSEWEDCSFDNRIKAIEECKSVIESNRISRESSVDCLKESPNKQQERAQSQSGVDLQEDVLVRERPRSLEDLHQKKVGRAKRESRRMRELEQAIFSLELLKVRSLGGISPSEDRRWSTELVPEGLQSPRGTPDSESSQGSLELLSYEESQKSKLESVISDEGDLQFPSPKISSSPKFDSRDNALSASNETSSAEHLKDGTMKEMVVCSSESITCKPQLKDSFISNSLPTFFYIPQQDPLKTNSQLDTSIQRNKLLENEDTAGEALTLDINRETRRYHCSGKDQIVPSLNTESSNPVLKKLEKLNTEKEERQKQLQQQNEKEMMEQIRQQTDILEKERKAFKTIEKPRIGECLVAPSSYQSKQRVERPSSLLSLNTSNKGELNVLGSLSLKDAALAQKDSSSAHLPPKDRPVTVFFERKGSPCQSSTVKELSKTDRMGTQLNVACKLSNNRISKREHFRPTQSYSHNSDDLSREGNARPIFFTPKDNMSIPLVSKEALNSKNPQLHKEDEPAWKPVKLAGPGQRETSQRFSSVDEQAKLHKTMSQGEITKLAVRQKASDSDIRPQRAKMRFWAKGKQGEKKTTRVKPTTQSEVSPLFAGTDVIPAHQFPDELAAYHPTPPLSPELPGSCRKEFKENKEPSPKAKRKRSVKISNVALDSMHWQNDSVQIIASVSDLKSMDEFLLKKVNDLDNEDSKKDTLVDVVFKKALKEFRQNIFSFYSSALAMDDGKSIRYKDLYALFEQILEKTMRLEQRDSLGESPVRVWVNTFKVFLDEYMNEFKTSDCTATKVPKTERKKRRKKETDLVEEHNGHIFKATQYSIPTYCEYCSSLIWIMDRASVCKLCKYACHKKCCLKTTAKCSKKYDPELSSRQFGVELSRLTSEDRTVPLVVEKLINYIEMHGLYTEGIYRKSGSTNKIKELRQGLDTDAESVNLDDYNIHVIASVFKQWLRDLPNPLMTFELYEEFLRAMGLQERKETIRGVYSVIDQLSRTHLNTLERLIFHLVRIALQEDTNRMSANALAIVFAPCILRCPDTTDPLQSVQDISKTTTCVELIVVEQMNKYKARLKDISSLEFAENKAKTRLSLIRRSMGKGRIRRGNYPGPSSPVVVRLPSVSDVSEETLTSEAAMETDITEQQQAAMQQEERVLTEQIENLQKEKEELTFEMLVLEPRASDDETLESEASIGTADSSENLNMESEYAISEKSERSLALSSLKTAGKSEPSSKLRKQLKKQQDSLDVVDSSVSSLCLSNTASSHGTRKLFQIYSKSPFYRAASGNEALGMEGPLGQTKFLEDKPQFISRGTFNPEKGKQKLKNVKNSPQKTKETPEGTVMSGRRKTVDPDCTSNQQLALFGNNEFMV

SEQ ID NO: 63314 - protein, 474 aa, Homo sapiens
MVPVQPAEPPEVLKSEPYGEKADVWAVGCILYQMATLSPPFYSTNMLSLATKIVEAVYEPVPEGIYSEKVTDTISRCLTPDAEARPDIVEVSSMISDVMMKYLDNLSTSQLSLEKKLERERRRTQRYFMEANRNTVTCHHELAVLSHETFEKASLSSSSSGAASLKSELSESADLPPEGFQASYGKDEDRACDEILSDDNFNLENAEKDTYSEVDDELDISDNSSSSSSSPLKESTFNILKRSFSASGGERQSQTRDFTGGTGSRPRPALLPLDLLLKVPPHMLRAHIKEIEAELVTGWQSHSLPAVILRNLKDHASAGIAVSQRKVRQISDPIQQILIQLHKIIYITQLPPALHHNLKRRVIERFKKSLFSQQSNPCNLKSEIKKLSQGSPEPIEPNFFTADYHLLHRSSGGNSLSPNDPTGLPTSIELEEGITYEQMQTVIEEVLEESGYYNFTSNRYHSYPWGTKNHPTKR

SEQ ID NO: 63315 - protein, 2096 aa, Homo sapiens
MAEVTVPRVYVVFGIHCIMAKASSDVQVSGFHRKIQHVKNELCHMLSLEEVAPVLQQTLLQDNLLGRVHFDQFKEALILILSRTLSNEEHFQEPDCSLEAQPKYVRGGKRYGRRSLPEFQESVEEFPEVTVIEPLDEEARPSHIPAGDCSEHWKTQRSEEYEAEGQLRFWNPDDLNASQSGSSPPQDWIEEKLQEVCEDLGITRDGHLNRKKLVSICEQYGLQNVDGEMLEEVFHNLDPDGTMSVEDFFYGLFKNGKSLTPSASTPYRQLKRHLSMQSFDESGRRTTTSSAMTSTIGFRVFSCLDDGMGHASVERILDTWQEEGIENSQEILKALDFSLDGNINLTELTLALENELLVTKNSIHQAALASFKAEIRHLLERVDQVVREKEKLRSDLDKAEKLKSLMASEVDDHHAAIERRNEYNLRKLDEEYKERIAALKNELRKEREQILQQAGKQRLELEQEIEKAKTEENYIRDRLALSLKENSRLENELLENAEKLAEYENLTNKLQRNLENVLAEKFGDLDPSSAEFFLQEERLTQMRNEYERQCRVLQDQVDELQSELEEYRAQGRVLRLPLKNSPSEEVEANSGGIEPEHGLGSEECNPLNMSIEAELVIEQMKEQHHRDICCLRLELEDKVRHYEKQLDETVVSCKKAQENMKQRHENETHTLEKQISDLKNEIAELQGQAAVLKEAHHEATCRHEEEKKQLQVKLEEEKTHLQEKLRLQHEMELKARLTQAQASFEREREGLQSSAWTEEKVRGLTQELEQFHQEQLTSLVEKHTLEKEELRKELLEKHQRELQEGREKMETECNRRTSQIEAQFQSDCQKVTERCESALQSLEGRYRQELKDLQEQQREEKSQWEFEKDELTQECAEAQELLKETLKREKTTSLVLTQEREMLEKTYKEHLNSMVVERQQLLQDLEDLRNVSETQQSLLSDQILELKSSHKRELREREEVLCQAGASEQLASQRLERLEMEHDQERQEMMSKLLAMENIHKATCETADRERAEMSTEISRLQSKIKEMQQATSPLSMLQSGCQVIGEEEVEGDGALSLLQQGEQLLEENGDVLLSLQRAHEQAVKENVKMATEISRLQQRLQKLEPGLVMSSCLDEPATEFFGNTAEQTEPFLQQNRTKQVEGVTRRHVLSDLEDDEVRDLGSTGTSSVQRQEVKIEESEASVEGFSELENSEETRTESWELKNQISQLQEQLMMLCADCDRASEKKQDLLFDVSVLKKKLKMLERIPEASPKYKLLYEDVSRENDCLQEELRMMETRYDEALENNKELTAEVFRLQDELKKMEEVTETFLSLEKSYDEVKIENEELNVLVLRLQGKIEKLQESVVQRCDCCLWEASLENLEIEPDGNILQLNQTLEECVPRVRSVHHVIEECKQENQYLEGNTQLLEKVKAHEIAWLHGTIQTHQERPRVQNQVILEENTTLLGFQDKHFQHQATIAELELEKTKLQELTRKLKERVTILVKQKDVLSHGEKEEELKAMMHDLQITCSEMQQKVELLRYESEKLQQENSILRNEITTLNEEDSISNLKLGTLNGSQEEMWQKTETVKQENAAVQKMVENLKKQISELKIKNQQLDLENTELSQKNSQNQEKLQELNQRLTEMLCQKEKEPGNSALEEREQEKFNLKEELERCKVQSSTLVSSLEAELSEVKIQTHIVQQENHLLKDELEKMKQLHRCPDLSDFQQKISSVLSYNEKLLKEKEALSEELNSCVDKLAKSSLLEHRIATMKQEQKSWEHQSASLKSQLVASQEKVQNLEDTVQNVNLQMSRMKSDLRVTQQEKEALKQEVMSLHKQLQNAGGKSWAPEIATHPSGLHNQQKRLSWDKLDHLMNEEQQLLWQENERLQTMVQNTKAELTHSREKVRQLESNLLPKHQKHLNPSGTMNPTEQEKLSLKRECDQFQKEQSPANRKVSQMNSLEQELETIHLENEGLKKKQVKLDEQLMEMQHLRSTATPSPSPHAWDLQLLQQQACPMVPREQFLQLQRQLLQAERINQHLQEELENRTSETNTPQGNQEQLVTVMEERMIEVEQKLKLVKRLLQEKVNQLKEQVSLPGHLCSPTSHSSFNSSFTSLYCH

SEQ ID NO: 63316 - protein, 470 aa, Homo sapiens
MGKLHSKPAAVCKRRESPEGDSFAVSAAWARKGIEEWIGRQRCPGGVSGPRQLRLAGTIGRSTRELVGDVLRDTLSEEEEDDFRLEVALPPEKTDGLGSGDEKKMERVSEPCPGSKKQLKFEELQCDVSMEEDSRQEWTFTLYDFDNNGKVTREDITSLLHTIYEVVDSSVNHSPTSSKMLRVKLTVAPDGSQSKRSVLVNQADLQSARPRAETKPTEDLRSWEKKQRAPLRFQGDSRLEQSGCYHHCVDENIERRNHYLDLAGIENYTSQFGPGSPSVAQKSELPPRTSNPTRSRSHEPEAIHIPHRKPQGVDPASFHFLDTPIAKVSELQQRLRGTQDGSKHFVRSPKAQGKSVGVGHVARGARNKPPLGPAIPAVSPSAHLAASPALLPSLAPLGHKKHKHRAKESQQGCRGLQAPLASGGPVLGREHLRELPALVVYESQAGQPVQRHEHHHHHEHHHHYHHFYQT

SEQ ID NO: 63317 - protein, 239 aa, Homo sapiens
MATSGRLSFTVRSLLDLPEQDAQHLPRREPEPRAPQPDPCAAWLDSERGHYPSSDESSLETSPPDSSQRPSARPASPGSDAEKRKKRRVLFSKAQTLELERRFRQQRYLSAPEREQLASLLRLTPTQVKIWFQNHRYKLKRARAPGAAESPDLAASAELHAAPGLLRRVVVPVLVRDGQPCGGGGGGEVGTAAAQEKCGAPPAAACPLPGYPAFGPGSALGLFPAYQHLASPALVSWNW

SEQ ID NO: 63318 - protein, 347 aa, Homo sapiens
MHAHCLPFLLHAWWALLQAGAATVATALLRTRGQPSSPSPLAYMLSLYRDPLPRADIIRSLQAEDVAVDGQNWTFAFDFSFLSQQEDLAWAELRLQLSSPVDLPTEGSLAIEIFHQPKPDTEQASDSCLERFQMDLFTVTLSQVTFSLGSMVLEVTRPLSKWLKRPGALEKQMSRVAGECWPRPPTPPATNVLLMLYSNLSQEQRQLGGSTLLWEAESSWRAQEGQLSWEWGKRHRRHHLPDRSQLCRKVKFQVDFNLIGWGSWIIYPKQYNAYRCEGECPNPVGEEFHPTNHAYIQSLLKRYQPHRVPSTCCAPVKTKPLSMLYVDNGRVLLDHHKDMIVEECGCL

SEQ ID NO: 63319 - protein, 475 aa, Homo sapiens
MERDEPPPSGGGGGGGSAGFLEPPAALPPPPRNGFCQDELAELDPGTNDRAEQRTCLICGDRATGLHYGIISCEGCKGFFKRSICNKRVYRCSRDKNCVMSRKQRNRCQYCRLLKCLQMGMNRKAIREDGMPGGRNKSIGPVQISEEEIERIMSGQEFEEEANHWSNHGDSDHSSPGNRASESNQPSPGSTLSSRSVELNGFMAFREQYMGMSVPPHYQYIPHLFSYSGHSPLLPQQARSLDPQSYSLIHQLLSAEDLEPLGTPMLIEDGYAVTQAELFALLCRLADELLFRQIAWIKKLPFFCELSIKDYTCLLSSTWQELILLSSLTVYSKQIFGELADVTAKYSPSDEELHRFSDEGMEVIERLIYLYHKFHQLKVSNEEYACMKAINFLNQDIRGLTSASQLEQLNKRYWYICQDFTEYKYTHQPNRFPDLMMCLPEIRYIAGKMVNVPLEQLPLLFKVVLHSCKTSVGKE

SEQ ID NO: 63320 - protein, 480 aa, Homo sapiens
MERDEPPPSGGGGGGGSAGFLEPPAALPPPPRNGFCQDELAELDPGTISVSDDRAEQRTCLICGDRATGLHYGIISCEGCKGFFKRSICNKRVYRCSRDKNCVMSRKQRNRCQYCRLLKCLQMGMNRKAIREDGMPGGRNKSIGPVQISEEEIERIMSGQEFEEEANHWSNHGDSDHSSPGNRASESNQPSPGSTLSSSRSVELNGFMAFREQYMGMSVPPHYQYIPHLFSYSGHSPLLPQQARSLDPQSYSLIHQLLSAEDLEPLGTPMLIEDGYAVTQAELFALLCRLADELLFRQIAWIKKLPFFCELSIKDYTCLLSSTWQELILLSSLTVYSKQIFGELADVTAKYSPSDEELHRFSDEGMEVIERLIYLYHKFHQLKVSNEEYACMKAINFLNQDIRGLTSASQLEQLNKRYWYICQDFTEYKYTHQPNRFPDLMMCLPEIRYIAGKMVNVPLEQLPLLFKVVLHSCKTSVGKE

SEQ ID NO: 63321 - protein, 454 aa, Homo sapiens
MERDEPPPPRNGFCQDELAELDPGTNDRAEQRTCLICGDRATGLHYGIISCEGCKGFFKRSICNKRVYRCSRDKNCVMSRKQRNRCQYCRLLKCLQMGMNRKAIREDGMPGGRNKSIGPVQISEEEIERIMSGQEFEEEANHWSNHGDSDHSSPGNRASESNQPSPGSTLSSSRSVELNGFMAFREQYMGMSVPPHYQYIPHLFSYSGHSPLLPQQARSLDPQSYSLIHQLLSAEDLEPLGTPMLIEDGYAVTQAELFALLCRLADELLFRQIAWIKKLPFFCELSIKDYTCLLSSTWQELILLSSLTVYSKQIFGELADVTAKYSPSDEELHRFSDEGMEVIERLIYLYHKFHQLKVSNEEYACMKAINFLNQDIRGLTSASQLEQLNKRYWYICQDFTEYKYTHQPNRFPDLMMCLPEIRYIAGKMVNVPLEQLPLLFKVVLHSCKTSVGKE

SEQ ID NO: 63322 - protein, 448 aa, Homo sapiens
MSPLECSECFGDQLLHRTYTWQLTLHSRPNYTRKRDTRSESLEIPISVVLPQRGTAEPFPRLHNLYSTPRCAQQAALPRLSRRMASQHSYPLNRFSSVPLDPMERPMSQADLELDYNPPRVQLSDEMFVFQDGRWVNENCRLQSPYFSPSASFHHKLHHKRLAKECMLQEENKSLREENKALREENRMLSKENKILQVFWEEHKASLGREESRAPSPLLHKDSASLEVVKKDHVALQVPRGKEDSTLQLLREENRALQQLLEQKQAYWAQAEDTAAPAEESKPAPSPHEEPCSPGLLQDQGSGLSSRFEEPKGPPARQEDSKELRALRKMVSNMSGPSGEEEAKVGPGLPDGCQPLQLLREMRQALQALLKENRLLQEENRTLQVLRAEHRGFQEENKALWENNKLKLQQKLVIDTVTEVTARMEMLIEELYAFMPARSQDPKKPSRV

SEQ ID NO: 63323 - protein, 1132 aa, Homo sapiens
MASDGASALPGPDMSMKPSAALSPSPALPFLPPTSDPPDHPPREPPPQPIMPSVFSPDNPLMLSAFPSSLLVTGDGGPCLSGAGAGKVIVKVKTEGGSAEPSQTQNFILTQTALNSTAPGTPCGGLEGPAPPFVTASNVKTILPSKAVGVSQEGPPGLPPQPPPPVAQLVPIVPLEKAWPGPHGTTGEGGPVATLSKPSLGDRSKISKDVYENFRQWQRYKALARRHLSQSPDTEALSCFLIPVLRSLARLKPTMTLEEGLPLAVQEWEHTSNFDRMIFYEMAERFMEFEAEEMQIQNTQLMNGSQGLSPATPLKLDPLGPLASEVCQQPVYIPKKAASKTRAPRRRQRKAQRPPAPEAPKEIPPEAVKEYVDIMEWLVGTHLATGESDGKQEEEGQQQEEEGMYPDPGLLSYINELCSQKVFVSKVEAVIHPQFLADLLSPEKQRDPLALIEELEQEEGLTLAQLVQKRLMALEEEEDAEAPPSFSGAQLDSSPSGSVEDEDGDGRLRPSPGLQGAGGAACLGKVSSSGKRAREVHGGQEQALDSPRGMHRDGNTLPSPSSWDLQPELAAPQGTPGPLGVERRGSGKVINQVSLHQDGHLGGAGPPGHCLVADRTSEALPLCWQGGFQPESTPSLDAGLAELAPLQGQGLEKQVLGLQKGQQTGGRGVLPQGKEPLAVPWEGSSGAMWGDDRGTPMAQSYDQNPSPRAAGERDDVCLSPGVWLSSEMDAVGLELPVQIEEVIESFQVEKCVTEYQEGCQGLGSRGNISLGPGETLVPGDTESSVIPCGGTVAAAALEKRNYCSLPGPLRANSPPLRSKENQEQSCETVGHPSDLWAEGCFPLLESGDSTLGSSKETLPPTCQGNLLIMGTEDASSLPEASQEAGSRGNSFSPLLETIEPVNILDVKDDCGLQLRVSEDTCPLNVHSYDPQGEGRVDPDLSKPKNLAPLQESQESYTTGTPKATSSHQGLGSTLPRRGTRNAIVPRETSVSKTHRSADRAKGKEKKKKEAEEEDEELSNFAYLLASKLSLSPREHPLSPHHASGGQGSQRASHLLPAGAKGPSKLPYPVAKSGKRALAGGPAPTEKTPHSGAQLGVPREKPLALGVVRPSQPRKRRCDSFVTGRRKKRRRSQ

SEQ ID NO: 63324 - protein, 626 aa, Homo sapiens; identical to SEQ ID NO: 63213

SEQ ID NO: 63325 - protein, 626 aa, Homo sapiens; identical to SEQ ID NO: 63213

SEQ ID NO: 63326 - protein, 531 aa, Homo sapiens
MSLPSGHTTGHTDQVVQRRARCWDIYQRRFSSRSEPVNPGMHSSSHQQQDGDAAMHGAHMDSPVRYTPYTISPYNRKGSFRKQDQTHVNMEREQKPPERRMEGNMPDGTLGSWFKITVPFGIKYNEKWLLNLIQNECSVPFVPVEFHYENMHASFFVENASIAYALKNVSGKIWDEDNEKISIFVNPAGIPHFVHRELKSEKVEQIKLAMNQQCDVSQEALDIQRLPFYPDMVNRDTKMASNPRKCMAASLDVHEENIPTVMSAGEMDKWKGIEPGEKCADRSPVCTTFSDTSSNINSILELFPKLLCLDGQQSPRATLCGTEAHKRLPTCKGSFFGSEMLKNLVLQFLQQYYLIYDSGDRQGLLSAYHDEACFSLSIPFNPEDSAPSSFCKFFKDSRNIKILKDPYLRGELLKHTKLDIVDSLSALPKTQHDLSSFLVDMWYQTEWMLCFSVNGVFKEVEGQSQGSVLAFTRTFIATPGSSSSLCIVNDKLFVRDTSHQGTQSALFTLVPTAFSSSVPAFSQEQQKMLPS

SEQ ID NO: 63327 - protein, 1379 aa, Homo sapiens
  VARIANT 1328,1332,1336,1342,1365,1367: Xaa = Any Amino Acid
MSSPRLIPLWKDLKLLLNDTINKSKQPSEDPKNCLIVLSDRSQAVAWMKSKTEDMVEKRTFSMTERLPPIQSMVHAGSFHILVVYCGDLILRLFGDHFRAFKPLGKVPCRFNISCLCYDPEMKMLLSGILGAVVTWVIELGGTGLQIAHMVSMPGDELVQDIVLNGPSGSLLALCETVVRVLMHQGKGQLGEVKRFTSTSSGSSITCCFTCFDQGFLYAGNQAGEIQVWSLQQGHPLHSFQAHQSGVICIRSRPEAHTLLTAGSDSLIKEWNLTSGSLLRRLELGEELYRLQFIDSITFFCQTAHSFSLHRLPCFYSLFNVCGSAPQQLRRVCCGNNWFRILCTTEDGLLRFVSPVTGDLLVITWPFSILDQAVDWAYDPGKEELFVATGSSEVLVFDTTRCPCPAKYLLGTSPNSQDFVQCLAYGHFNLGRGLEGLIFSGHQSGVIRVLSQHSCARLEKFMHFGAVLALSTLSGGIFGGQGNSLLCSYGMDDYVHLSEAVLDGVKVQLRPLASILSSCHLTHLILLPKSVGAITETNCLRLWKFHDFLSSGSQNGLKFIETLPLHLCAITSFDVCLSLSLFVTGSADGSVRIWDFHGRLIGILDSSLHFGPVCFANDRGDLLVTFNQSLYLVSCLKLLPPALLTRLSFMSISDEVLEVPKPFIPSFFFSFETMFVPKYIYPGQAQQKLVGLEKLVNNRAIAFDHSVPHVIEEDEEGSPVLLRSSMHYSLQDMEDWMQVSKRYQCHYVLPPQLQLTSWDGLNPYQILRYYFGHGREWLFAPDCYIPNSVIRARLWPEGTPIYLQCNLHAPQRELEWDRSQEFFFWHSRVRAISNTEYPKNKEEDEHFLEMRLSKDVTYSVLTDGANRSWLGRKMSEITINSMIETMLNIMVHASLLKYQCCVGALGQIFASYQVSPALRSETARRLLNDTTNSNPLIRELAWEGLKRLGMITHLFAMPLAQGLMDKDERVRIKTLSLMAEIGIHSRTSLLQLTQKQETFREMQQQMIGEEPLDHLLGMRATDLQILSTQVEQRLNENLTLSHRDEKPAFSLDVSMPSELKSSLKPPTVSEESEVAIKPSKGQRRGQAGVKKHSQKWLRGLKKTKERDSKQMSTEPGLLEDESGTEAAPIEMEEASVYSQWSSSTSVIKLSKDVDSQEKDISKDHIALTLKRLQKIRDKRDKKATAQKLKKKHKKKGKEAKVINEETTPPVMEQPVTKKVKIQGRGASGISGRRSTAGDGSSWRDDLCRLMALRISGSQTKMSENLNAELVTFAQEMLVDRHPSWELFQEICPLLKKESKVLLEDLDWDVVPPEKKPFLSRKEQLERTXYKVXPKRXSDTRKXCQGKKNKHKRKQETCWAWRKPKXFXKRAKKVIFLEPG

SEQ ID NO: 63328 - protein, 395 aa, Homo sapiens
MAEDGLPKIYSHPPTESSKTPTAATIFFGADNAIPKSETTITSEGDHVTSVNEYMLESDFSTTTDNKLTAKKEKLKSEDDMGTDFIKSTTHLQKEITSLTGTTNSITRDSITEHFMPVKIGNISSPVTTVSLIDFSTDIAKEDILLATIDTGDAEISITSEVSGTLKDSSAGVADAPAFPRKKDEADMSNYNSSIKSNVPADEAVQVTDSIIPEAEIPPAPEESFTTIPDITALEEEKITEIDLSVLEDDTSAVATLTDSDEKFITVFELTTSAEKDKDKREDTLLTDEETTEGASIGMERDTANEAETHSVLLTAVESRYDFVVPASIATNLVEESSTEEDLSETDNTETVPKITEPFSGTTSVLDTPDYKEDTSTTETDIFELLKEEPDEFMI

SEQ ID NO: 63329 - protein, 170 aa, Homo sapiens
MKTLFLGVTLGLAAALSFTLEEEDITGTWYVKAMVVDKDFPEDRRPRKVSPVKVTALGGGNLEATFTFMREDRCIQKKILMRKTEEPGKFSAYGGRKLIYLQELPGTDDYVFYCKDQRRGGLRYMGKLVGRNPNTNLEALEEFKKLVQHKGLSEEDIFMPLQTGSCVLEH

SEQ ID NO: 63330 - protein, 170 aa, Homo sapiens
MKTLFLGVTLGLAAALSFTLEEEDITGTWYVKAMVVDKDFPEDRRPRKVSPVKVTALGGGKLEATFTFMREDRCIQKKILMRKTEEPGKYSAYGGRKLMYLQELPRRDHYIFYCKDQHHGGLLHMGKLVGRNSDTNREALEEFKKLVQRKGLSEEDIFTPLQTGSCVPEH

SEQ ID NO: 63331 - protein, 257 aa, Homo sapiens
MDAEYSGNEFPRSEGERDQHQRPGKERKSGEAGWGTGELGQDGRLLSSTLSLSSNRSLGQRQNSPLPFQWRITHSFRWMAQVLASELSLVAFILLLVMAFSKKWLDLSRSLFYQRWPVDVSNRIHTSAHVMSMGLLHFCKSRSCSDLENGKVTFIFSTLMLFPINIWIFELERNVSIPIGWSYFIGWLVLILYFTCAILCYFNHKSFWSLILSHPSGAVSCSSSFGSVEESPRAQTITDTPITQEGVLDPEQKDTHV

SEQ ID NO: 63332 - protein, 189 aa, Homo sapiens
MPLVGLGDYVPEPFGTSCTLDWWLAQASVGGQVFILNILFFCLLLPTAVIVFSYVKIIAKVKSSSKEVAHFDSRIHSSHVLEMKLTKVAMLICAGFLIAWIPYAVVSVWSAFGRPDSIPIQLSVVPTLLAKSAAMYNPIIYQVIDYKFACCQTGGLKATKKKSLEGFRLHTVTTVRKSSAVLEIHEEWE

SEQ ID NO: 63333 - protein, 354 aa, Homo sapiens
MALNHTALPQDERLPHYLRDGDPFASKLSWEADLVAGFYLTIIGILSTFGNGYVLYMSSRRKKKLRPAEIMTINLAVCDLGISVVGKPFTIISCFCHRWVFGWIGCRWYGWAGFFFGCGSLITMTAVSLDRYLKICYLSYGVWLKRKHAYICLAAIWAYASFWTTMPLVGLGDYVPEPFGTSCTLDWWLAQASVGGQVFILNILFFCLLLPTAVIVFSYVKIIAKVKSSSKEVAHFDSRIHSSHVLEMKLTKVAMLICAGFLIAWIPYAVVSVWSAFGRPDSIPIQLSVVPTLLAKSAAMYNPIIYQVIDYKFACCQTGGLKATKKKSLEGFRLHTVTTVRKSSAVLEIHEEWE

SEQ ID NO: 63334 - protein, 316 aa, Homo sapiens
MVNQSSPMGFLLLGFSEHPALERTLFVVVFTSYLLTLVGNTLIILLSVLYPRLHSPMYFFLSDLSFLDLCFTTSCVPQMLVNLWGPKKTISFLGCSVQLFIFLSLGTTECILLTVMAFDRYVAVCQPLHYATIIHPRLCWQLASVAWVMSLVQSIVQTPSTLHLPFCPHQQIDDFLCEVPSLIRLSCGDTSYNEIQLAVSSVIFVVVPLSLILASYGATAQAVLRINSATAWRKAFGTCSSHLTVVTLFYSSVIAVYLQPKNPYAQGRGKFFGLFYAVGTPSLNPLVYTLRNKEIKRALRRLLGKERDSRESWRAA

SEQ ID NO: 63335 - protein, 764 aa, Homo sapiens
MERAVQGTDGGGGSNSSSRSSSRATSAGSSPSCSLAGRGVSSRSAAAGLGGGGSRSSPGSVAASPSGGGGRRREPALEGVLSKYTNLLQGWQNRYFVLDFEAGILQYFVNEQSKHQKPRGVLSLSGAIVSLSDEAPHMLVVYSANGEMFKLRAADAKEKQFWVTQLRACAKYHMEMNSKSAPSSRSRSLTLLPHGTPNSASPCSQRHLSVGAPGVVTITHHKSPAAARRAKSQYSGQLHEVREMMNQVEGQQKNLVHAIESLPGSGPLTALDQDLLLLKATSAATLSCLGECLNLLQQSVHQAGQPSQKPGASENILGWHGSKSHSTEQLKNGTLGSLPSASANITWAILPNSAEDEQTSQPEPEPNSGSELVLSEDEKSDNEDKEETELGVMEDQRSIILHLISQLKLGMDLTKVVLPTFILEKRSLLEMYADFMAHPDLLLAITAGATPEERVICFVEYYLTAFHEGRKGALAKKPYNPIIGETFHCSWEVPKDRVKPKRTASRSPASCHEHPMADDPSKSYKLRFVAEQVSHHPPISCFYCECEEKRLCVNTHVWTKSKFMGMSVGVSMIGEGVLRLLEHGEEYVFTLPSAYARSILTIPWVELGGKVSINCAKTGYSATVIFHTKPFYGGKVHRVTAEVKHNPTNTIVCKAHGEWNGTLEFTYNNGETKVIDTTTLPVYPKKIRPLEKQGPMESRNLWREVTRYLRLGDIDAATEQKRHLEEKQRVEERKRENLRTPWKPKYFIQEGDGWVYFNPLWKAH

SEQ ID NO: 63336 - protein, 1134 aa, Homo sapiens
MGLLASAGLLLLLVIGHPRSLGLKCGIRMVNMKSKEPAVGSRFFSRISSWRNSTVTGHPWQVSLKSDEHHFCGGSLIQEDRVVTAAHCLDSLSEKQLKNITVTSGEYSLFQKDKQEQNIPVSKIITHPEYNSREYMSPDIALLYLKHKVKFGNAVQPICLPDSDDKVEPGILCLSSGWGKISKTSEYSNVLQEMELPIMDDRACNTVLKSMNLPPLGRTMLCAGFPDWGMDACQGDSGGPLVCRRGGGIWILAGITSWVAGCAGGSVPVRNNHVKASLGIFSKVSELMDFITQNLFTGLDRGQPLSKVGSRYITKALSSVQEVNGSQRGKGILDMEKQVGCDHDYVSLRSSSGVLFNQRSLMEDDGKQNKRVCGKILPSPLLAETSEAMVPFVSDTEDSGSGFELTVTAVQKSEAGSGCGSLAILVEEGTNHSAKYPDLYPSNTRCHWFICAPEKHIIKLTFEDFAVKFSPNCIYDAVVIYGDSEEKHKLAKLCGMLTITSIFSSSNMTVIYFKSDGKNRLQGFKARFTILPSESLNKFEPKLPPQNNPVSTVKAILHDVCGIPPFSPQWLSRRIAGGEEACPHCWPWQVGLRFLGDYQCGGAIINPVWILTAAHCVQLKNNPLSWTIIAGDHDRNLKESTEQVRRAKHIIVHEDFNTLSYDSDIALIQLSSPLEYNSVVRPVCLPHSAEPLFSSEICAVTGWGSISADGGLASRLQQIQVHVLEREVCEHTYYSAHPGGITEKMICAGFAASGEKDFCQGDSGGPLVCRHENGPFVLYGIVSWGAGCVQPWKPGVFARVMIFLDWIQSKINGPASLQTNNKCKTLKQQLPPPTPSPDSASWPGCCSEAELEKPRGFFPTPRYLLDYRGRLECSWVLRVSASSMAKFTIEYLSLLGSPVCQDSVLIIYEERHSKRKTAGGLHGRRLYSMTFMSPGPLVRVTFHALVRGAFGISYIDLKVLGPKDSKITRLSQSSNREHLVPCEDVLLTKPEGIMQIPRNSHRTTMGCQWRLVAPLNHIIQLNIINFPMKPTTFVCHGHLRVYEGFGPGKKLIASFAGTLAMILTKDILKREKLNFINTYIMHIWENSVYDNVRSVGKRKQKKFASNLSYSMEAEKSRIQVPADLVPAKGSLSGS

SEQ ID NO: 63337 - protein, 111 aa, Homo sapiens
MSELLRARSQSSERGNDQESSQPVGSVIVQEPTEEKRQEEEPPTDNQGIAPSGEIENQAVPAFQGPDMEAFQQELALLKIEDEPGDGPDVREGIMPTFDLTKVLEAGDAQP

SEQ ID NO: 63338 - protein, 113 aa, Homo sapiens
MSGHQRTRSRSRERRDDQDSNHPVGAVVAQELPSNDQLQQEEPPIESQDYTPGQERDEGALDFQVLGLAAYLWELTRSKTGGERGDGPNVKGEFLPNLEPVKIPEAGEGQPSV

SEQ ID NO: 63339 - protein, 110 aa, Homo sapiens
MSEHVTRSQSSERGNDQESSQPVGPVIVQQPTEEKRQEEEPPTDNQGIAPSGEIKNEGAPAVQGTDVEAFQQELALLKIEDAPGDGPDVREGTLPTFDPTKVLEAGEGQL

SEQ ID NO: 63340 - protein, 130 aa, Homo sapiens
MQAPWAGNRGWAGTREEVRDMSEHVTRSQSSERGNDQESSQPVGPVIVQQPTEEKRQEEEPPTDNQGIAPSGEIKNEGAPAVQGTDVEAFQQELALLKIEDAPGDGPDVREGTLPTFDPTKVLEAGEGQL

SEQ ID NO: 63341 - protein, 798 aa, Homo sapiens
MEAGEGKERVPKQRQVLIFFVLLGIAQASCQPRHYSVAEETESGSFVANLLKDLGLEIGELAVRGARVVSKGKKMHLQFDRQTGDLLLNEKLDREELCGPTEPCVLPFQVLLENPLQFFQAELRIRDVNDHSPVFLDKEILLKIPESITPGTTFLIERAQDLDVGTNSLQNYTISPNFHFHLNLQDSLDGIILPQLVLNRALDREEQPEIRLTLTALDGGSPPRSGTALVRIEVVDINDNVPEFAKLLYEVQIPEDSPVGSQVAIVSARDLDIGTNGEISYAFSQASEDIRKTFRLSAKSGELLLRQKLDFESIQTYTVNIQATDGGGLSGTCVVFVQVMDLNDNPPELTMSTLINQIPENLQDTLIAVFSVSDPDSGDNGRMVCSIQDDLPFFLKPSVENFYTLVISTALDRETRSEYNITITVTDFGTPRLKTEHNITVLVSDVNDNAPAFTQTSYTLFVRENNSPALHIGSVSATDRDSGTNAQVTYSLLPPQDPHLPLASLVSINADNGHLFALQSLDYEALQAFEFRVGAADRGSPALSSEALVRVLVLDANDNSPFVLYPLQNGSAPCTELVPRAAEPGYLVTKVVAVDGDSGQNAWLSYQLLKATEPGLFGVWAHNGEVRTARLLRERDAAKQRLVVLVKDNGEPPRSATATLHVLLVDGFSQPYLLLPEAAPAQAQADLLTVYLVVALASVSSLFLFSVLLFVAVRLCRRSRAASVGRCSVPEGPFPGQMVDVSGTGTLSQSYQYEVCLTGGSGTNEFKFLKPIIPNFVAQGAERVSEANPSFRKSFEFT

SEQ ID NO: 63342 - protein, 755 aa, Homo sapiens
MRPAPIALWLRLVLALALVRPRAVGWAPVRAPIYVSSWAVQVSQGNREVERLARKFGFVNLGPIFPDGQYFHLRHRGVVQQSLTPHWGHRLHLKKNPKVQWFQQQTLQRRVKRSVVVPTDPWFSKQWYMNSEAQPDLSILQAWSQGLSGQGIVVSVLDDGIEKDHPDLWANYDPLASYDFNDYDPDPQPRYTPSKENRHGTRCAGEVAAMANNGFCGVGVAFNARIGGVRMLDGTITDVIEAQSLSLQPQHIHIYSASWGPEDDGRTVDGPGILTREAFRRGVTKGRGGLGTLFIWASGNGGLHYDNCNCDGYTNSIHTLSVGSTTQQGRVPWYSEACASTLTTTYSSGVATDPQIVTTDLHHGCTDQHTGTSASAPLAAGMIALALEANPFLTWRDMQHLVVRASKPAHLQAEDWRTNGVGRQVSHHYGYGLLDAGLLVDTARTWLPTQPQRKCAVRVQSRPTPILPLIYIRENVSACAGLHNSIRSLEHVQAQLTLSYSRRGDLEISLTSPMGTRSTLVAIRPLDVSTEGYNNWVFMSTHFWDENPQGVWTLGLENKGYYFNTGTLYRYTLLLYGTAEDMTARPTGPQVTSSACVQRDTEGLCQACDGPAYILGQLCLAYCPPRFFNHTRLVTAGPGHTAAPALRVCSSCHASCYTCRGGSPRDCTSCPPSSTLDQQQGSCMGPTTPDSRPRLRAAACPHHRCPASAMVLSLLAVTLGGPVLCGMSMDLPLYAWLSRARATPTKPQVWLPAGT

SEQ ID NO: 63343 - protein, 150 aa, Homo sapiens
MSAKDERAREILRGFKLNWMNLRDAETGKILWQGTEDLSVPGVEHEARVPKKILKCKAVSRELNFSSTEQMEKFRLEQKVYFKGQCLEEWFFEFGFVIPNSTNTWQSLIEAAPESQMMPASVLTGNVIIETKFFDDDLLVSTSRVRLFYV

SEQ ID NO: 63344 - protein, 388 aa, Homo sapiens
MLAAFISRVLRRVAQKSARRVLVASRNSSNDATFEIKKCDLYLLEEGPPVTTVLTRAEGLKYYRMMLTVRRMELKADQLYKQKFIRGFCHLCDGQEACCVGLEAGINPSDHVITSYRAHGVCYTRGLSVRSILAELTGRRGGCAKGKGGSMHMYTKNFYGGNGIVGAQGPLGAGIALACKYKGNDEICLTLYGDGAANQGQIAEAFNMAALWKLPCVFICENNLYGMGTSTERAAASPDYYKRGNFIPGLKVDGMDVLCVREATKFAANYCRSGKGPILMELQTYRYHGHSMSDPGVSYRTREEIQEVRSKRDPIIILQDRMVNSKLATVEELKEIGAEVRKEIDDAAQFATTDPEPHLEELGHHIYSSDSSFEVRGANPWIKFKSVS

SEQ ID NO: 63345 - protein, 471 aa, Homo sapiens
MSGASSSEQNNNSYETKTPNLRMSEKKCSWASYMTNSPTLIVMIGLPARGKTYVSKKLTRYLNWIGVPTKVFNLGVYRREAVKSYKSYDFFRHDNEEAMKIRKQCALVALEDVKAYLTEENGQIAVFDATNTTRERRDMILNFAEQNSFKVFFVESVCDDPDVIAANILEVKVSSPDYPERNRENVMEDFLKRIECYKVTYRPLDPDNYDKDLSFIKVINVGQRFLVNRVQDYIQSKIVYYLMNIHVQPRTIYLCRHGESEFNLLGKIGGDSGLSVRGKQFAQALRKFLEEQEITDLKVWTSQLKRTIQTAESLGVPYEQWKILNEIDAGVCEEMTYAEIEKRYPEEFALRDQEKYLYRYPGGESYQDLVQRLEPVIMELERQGNVLVISHQAVMRCLLAYFLDKGADELPYLRCPLHTIFKLTPVAYGCKVETIKLNVEAVNTHRDKPTAAETTLAVRRRPSAASLMLPC

SEQ ID NO: 63346 - protein, 585 aa, Homo sapiens
MSNPRKRSIPMRDSNTGLEQLLAEDSFDESDFSEIDDSDNFSDSALEADKIRPLSHLESDGKSSTSSDSGRSMKWSARAMIPRQRYDFTGTPGRKVDVSDITDPLQYFELFFTEELVSKITRETNAQAALLASKPPGPKGFSRMDKWKDTDNDELKVFFAVMLLQGIVQKPELEMFWSTRPLLDTPYLRQIMTGERFLLLFRCLHFVNNSSISAGQSKAQISLQKIKPVFDFLVNKFSTVYTPNRNIAVDESLMLFKGPLAMKQYLPTKRVRFGLKLYVLCESQSGYVWNALVHTGPGMNLKDSADGLKSSRIVLTLVNDLLGQGYCVFLDNFNISPMLFRELHQNRTDAVGTARLNRKQIPNDLKKRIAKGTTVARFCGELMALKWCDGKEVTMLSTFHNDTVIEVNNRNGKKTKRPRVIVDYNENMGAVDSADQMLTSYPSERKRHKVWYKKFFHHLLHITVLNSYILFKKDNPEHTMSHINFRLALIERMLEKHHKPGQQHLRGRPCSDDVTPLRLSGRHFPKSIPATSGKQNPTGRCKICCSQYDKDGKKIRKETRYFCAECDVPLCVVPCFEIYHTKKNY

SEQ ID NO: 63347 - protein, 1101 aa, Homo sapiens
MATVPVYCVCRLPYDVTRFMIECDACKDWFHGSCVGVEEEEAPDIDIYHCPNCEKTHGKSTLKKKRTWHKHGPGQAPDVKPVQNGSQLFIKELRSRTFPSAEDVVARVPGSQLTLGYMEEHGFTEPILVPKKDGLGLAVPAPTFYVSDVENYVGPERSVDVTDVTKQKDCKMKLKEFVDYYYSTNRKRVLNVTNLEFSDTRMSSFVEPPDIVKKLSWVENYWPDDALLAKPKVTKYCLICVKDSYTDFHIDSGGASAWYHVLKGEKTFYLIRPASANISLYERWRSASNHSEMFFADQVDKCYKCIVKQGQTLFIPSGWIYATLTPVDCLAFAGHFLHSLSVEMQMRAYEVERRLKLGSLTQFPNFETACWYMGKHLLEAFKGSHKSGKQLPPHLVQGAKILNGAFRSWTKKQALAEHEDELPEHFKPSQLIKDLAKEIRLSENASKAVRPEVNTVASSDEVCDGDREKEEPPSPIEATPPQSLLEKVSKKKTPKTVKMPKPSKIPKPPKPPKPPRPPKTLKLKDGGKKKGKKSRESASPTIPNLDLLEAHTKEALTKMEPPKKGKATKSVLSVPNKDVVHMQNDVERLEIREQTKSKSEAKWKYKNSKPDSLLKMEEEQKLEKSPLAGNKDNKFSFSFSNKKLLGSKALRPPTSPGVFGALQNFKEDKPKPVRDEYEYVSDDGELKIDEFPIRRKKNAPKRDLSFLLDKKAVLPTPVTKPKLDSAAYKSDDSSDEGSLHIDTDTKPGRNARVKKESGSSAAGILDLLQASEEVGALEYNPSSQPPASPSTQEAIQGMLSMANLQASDSCLQTTWGAGQAKGSSLAAHGARKNGGGSGKSAGKRLLKRAAKNSVDLDDYEEEQDHLDACFKDSDYVYPSLESDEDNPIFKSRSKKRKGSDDAPYSPTARVGPSVPRQDRPVREGTRVASIETGLAAAAAKLSQQEEQKSKKKKSAKRKLTPNTTSPSTSTSISAGTTSTSTTPASTTPASTTPASTTPASTSTASSQASQEGSSPEPPPESHSSSLADHEYTAAGTFTGAQAGRTSQPMAPGVFLTQRRPSASSPNNNTAAKGKRTKKGMATAKQRLGKILKIHRNGKLLL

SEQ ID NO: 63348 - protein, 1101 aa, Homo sapiens
MATVPVYCVCRLPYDVTRPRAARPPARPGPTRAAQRRGRAAAPDIDIYHCPNCEKTHGKSTVKKKRTWHKHGPGQAPDVKPVQNGSQLFIKELRSRTFPSAEDVVARVPGSQLTLGYMEEHGFTEPILVPKKDGLGLAVPAPTFYVSDVENYVGPERSVDVTDVTKQKDCKMKLKEFVDYYYSTNRKRVLNVTNLEFSDTRMSSFVEPPDIVKKLSWVENYWPDDALLAKPKVTKYCLICVKDSYTDFHIDSGGASAWYHVLKGEKTFYLIRPASANISLYERWRSASNHSEMFFADQVDKCYKCIVKQGQTLFIPSGWIYATLTPVDCLAFAGHFLHSLSVEMQMRAYEVERRLKLGSLTQFPNFETACWYMGKHLLEAFKGSHKSGKQLPPHLVQGAKILNGAFRSWTKKQALAEHEDELPEHFKPSQLIKDLAKEIRLSENASKAVRPEVNTVASSDEVCDGDREKEEPPSPIEATPPQSLLEKVSKKKTPKTVKMPKPSKIPKPPKPPKPPRPPKTLKLKDGGKKKGKKSRESASPTIPNLDLLEAHTKEALTKMEPPKKGKATKSVLSVPNKDVVHMQNDVERLEIREQTKSKSEAKWKYKNSKPDSLLKMEEEQKLEKSPLAGNKDNKFSFSFSNKKLLGSKALRPPTSPGVFGALQNFKEDKPKPVRDEYEYVSDDGELKIDEFPIRRKKNAPKRDLSFLLDKKAVLPTPVTKPKLDSAAYKSDDSSDEGSLHIDTDTKPGRNARVKKESGSSAAGILDLLQASEEVGALEYNPSSQPPASPSTQEAIQGMLSMANLQASDSCLQTTWGAGQAKGSSLAAHGARKNGGGSGKSAGKRLLKRAAKNSVDLDDYEEEQDHLDACFKDSDYVYPSLESDEDNPIFKSRSKKRKGSDDAPYSPTARVGPSVPRQDRPVREGTRVASIETGLAAAAAKLSQQEEQKSKKKKSAKRKLTPNTTSPSTSTSISAGTTSTSTTPASTTPASTTPASTTPASTSTASSQASQEGSSPEPPPESHSSSLADHEYTAAGTFTGAQAGRTSQPMAPGVFLTQRRPSASSPNNNTAAKGKRTKKGMATAKQRLGKILKIHRNGKLLL

SEQ ID NO: 63349 - protein, 267 aa, Homo sapiens
MSGCFPVSGLRCLSRDGRMAAQGAPRFLLTFDFDETIVDENSDDSIVRAAPGQRLPESLRATYREGFYNEYMQRVFKYLGEQGVRPRDLSAIYEAIPLSPGMSDLLQFVAKQGACFEVILISDANTFGVESSLRAAGHHSLFRRILSNPSGPDARGLLALRPFHTHSCARCPANMCKHKVLSDYLRERAHDGVHFERLFYVGDGANDFCPMGLLAGGDVAFPRRGYPMHRLIQEAQKAEPSSFRASVVPWETAADVRLHLQQVLKSC

SEQ ID NO: 63350 - protein, 2253 aa, Homo sapiens
MRPGPALLLLGVGLSLSVGRLPLPPVPRGAQAAVSGAPGGLLRGAPGLGVRGGRALLSLRPSAVRAGGAVLSGRGSLCFPHGGTGRRWYCLDLRVLLSAQRLPWPAAPALALVDLQLSARGGRLSLTWSVRLPRSPGRLAWAFRLRLLGPGAARPASPAARVSPRSAAPGPRPQQGFVARTECPTDGPARVMLQAVNSSSHRAVESSVSCQINACVIQRVRINTDQKGAPVRLSMQAEATINASVQLDCPAARAIAQYWQVFSVPAVGQAPDWTQPLDLPQLEIRNSPLFIHIPNNSLQWGVYVFNFTVSITTGNPKMPEVKDSDAVYVWIVRSSLQAVMLGDANITANFTEQLILDGSTSSDPDADSPLQGLQFFWYCTTDPRNYGGDRIILGSKEVCHPEQANLKWPWASGPVLTLLPETLKGDHVYFFRMVIRKDSRTAFSDKRVHVLQGPKAIAHITCIENCERNFIVSDRFSLFLNCTNCASRDFYKWSILSSSGGEMLFDWMGETVTGRNGAYLSIKAFAFRHFLEAEFSISLYLACWSGVTSVFRHSFIINHGPQIGECKINPAKGIALITKFVVQCSNFRDKHVPLTYKIIVSDLHSVGEISSVKENTLGTILYLGPQSTVPPSFLPVGMLASQYGLKIYAQVYDSLGAFSQVTLHATAQAPTDKNSSKTVLNQLLSFTVGPSSLLSTLIQKKDFLPAGYLLYIVASVLNNMKTELPLRDDRVNLRKHLIDQSFLLPVSTLVEIGQVVMTITKLTQKPSEFTWDAQKRATMRVWQANQALQEYQQKDKRFRSEQIEIVSTGILMSLSNILKMTSPHQVVKDPFYVIESLSDTILANKVPGNKTTSMRTPNFNMYVKKVEKWGINQLFRNEKHCRNCFYPTLNVSSVPGLSANGPISTMFCDFTNDLFPWLNDQENTSVEVSGFRMTGVADNGSVLEITPDVAEVYLVRKNLTFAAFNLTVGPNSEVDGSLKKTTGGFSFQVDSTVLREVLVHIVTEVMVLFTVLVYTGSQITPTALVATFLVPHDIPPFASQSALFDPACTVKKARVVCLPVSLLQLIAQHSHSPHCTVSIVLQAPRFVMKLNDKLVRISIFSVQCLDMYGIQSEWREGYCILGEKTSWYEVHCICKNVVRARRQLGTIGLTGIHLHTHYVMAKVIVIPNPVDLRLNIIKSLHQNPVTLFTVLFIILLYVGLAFWALYRDEMDQHLRGHVIVLPDNDPYDNLCYLVTIFTGSRWGSGTRANVFVQLRGTVSTSDVHCLSHPHFTTLYRGSINTFLLTTKSDLGDIHSIRVWHNNEGRSPSWYLSRIKVENLFSRHIWLFICQKWLSVDTTLDRTFHVTHPDERLTRKDFFFIDVSSNLRKNHMWFSIFASVVAKTFNRLQRLSCCLAMLLSSLLCNIMFFNLNRQEQTESRERKYMRSMMIGIESVLITIPVQLLITFLFTCSQRKPQADLKEVSPQKHPLMSEASEHWEEYLRKWHAYETAKVHPREVAKPASKGKPRLPKASPKATSKPKHRHRKAQIKTPETLGPNTNSNNNIEDDQDVHSEQHPSQKDLQQLKKKPRIVLPWWCVYVAWFLVFATSSISSFFIVFYGLTYGYDKSIEWLFASFCSFCQSVLLVQPSKIILLSGFRTNKPKYCKNLSWSTKYKYTEIRLDGMRMHPEEMQRIHDQIVRIRGTRMYQPLTEDEIRIFKRKKRIKRRALLFLSYILTHFIFLALLLILIVLLRHTDCFYYNQFIRDRFSMDLATVTKLEDIYRWLNSVLLPLLHNDLNPTFLPESSSKILGLPLMRQVRAKSSEKMCLPAEKFVQNSIRREIHCHPKYGIDPEDTKNYSGFWNEVDKQAIDESTNGFTYKPQGTQWLYYSYGLLHTYGSGGYALYFFPEQQRFNSTLRLKELQESNWLDEKTWAVVLELTTFNPDINLFCSISVIFEVSQLGVVNTSISLHSFSLADFDRKASAEIYLYVAILIFFLAYVVDEGCIIMQERASYVRSVYNLLNFALKCIFTVLIVLFLRKHFLATGIIRFYLSNPEDFIPFHAVSQVDHIMRIILGFLLFLTILKTLRYSRFFYDVRLAQRAIQAALPGICHMAFVVSVYFFVYMAFGYLVFGQHEWNYSNLIHSTQTVFSYCVSAFQNTEFSNNRILGVLFLSSFMLVMICVLINLFQAVILSAYEEMKQPVYEEPSDEVEAMTYLCRKLRTMFSFLTSQSKAKDEPEFFIDMLYGQPEKNSHRYLGLKTRNINGKKMVYLVV

SEQ ID NO: 63351 - protein, 1655 aa, Homo sapiens
MSVMQSGTQMIKLKRGTKGLVRLFYLDEHRTRLRWRPSRKSEKAKILIDSIYKVTEGRQSEIFHRQAEGNFDPSCCFTIYHGNHMESLDLITSNPEEARTWITGLKYLMAGISDEDSLAKRQRTHDQWVKQTFEEADKNGDGLLNIEEIHQLMHKLNVNLPRRKVRQMFQEADTDENQGTLTFEEFCVFYKMMSLRRDLYLLLLSYSDKKDHLTVEELAQFLKVEQKMNNVTTDYCLDIIKKFEVSEENKVKNVLGIEGFTNFMRSPACDIFNPLHHEVYQDMDQPLCNYYIASSHNTYLTGDQLLSQSKVDMYARVLQEGCRCVEVDCWDGPDGEPVVHHGYTLTSKILFRDVVETINKHAFVKNEFPVILSIENHCSIQQQRKIAQYLKGIFGDKLDLSSVDTGECKQLPSPQSLKGKILVKGKKLPYHLGDDAEEGEVSDEDSADEIEDECKFKLHYSNGTTEHQVESFIRKKLESLLKESQIRDKEDPDSFTVRALLKATHEGLNAHLKQSPDVKESGKKSHGRSLMTNFGKHKKTTKSRSKSYSTDDEEDTQQSTGKEGGQLYRLGRRRKTMKLCRELSDLVVYTNSVAAQDIVDDGTTGNVLSFSETRAHQVVQQKSEQFMIYNQKQLTRIYPSAYRIDSSNFNPLPYWNAGCQLVALNYQSEGRMMQLNRAKFKANGNCGYVLKPQQMCKGTFNPFSGDPLPANPKKQLILKVISGQQLPKPPDSMFGDRGEIIDPFVEVEIIGLPVDCCKDQTRVVDDNGFNPVWEETLTFTVHMPEIALVRFLVWDHDPIGRDFVGQRTVTFSSLVPGYRHVYLEGLTEASIFVHITINEIYGKNRQLQGLKGLFNKNPRHSSSENNSHYVRKRSIGDRILRRTASAPAKGRKKSKMGFQEMVEIKDSVSEATRDQDGVLRRTTRSLQARPVSMPVDRNLLGALSLPVSETAKDIEGKENSLAEDKDGRRKGKASIKDPHFLNFNKKLSSSSSALLHKDTSQGDTIVSTAHMSVTGEQLGMSSPRGGRTTSNATSNCQENPCPSKSLSPKQHLAPDPVVNPTQDLHGVKIKEKGNPEDFVEGKSILSGSVLSHSNLEIKNLEGNRGKGRAATSFSLSDVSMLCSDIPDLHSTAILQESVISHLIDNVTLTNENEPGSSISALIGQFDETNNQALTVVSHLHNTSVMSGHCPLPSLGLKMPIKHGFCKGKSKSSFLCSSPELIALSSSETTKHATNTVYETTCTPISKTKPDDDLSSKAKTAALESNLPGSPNTSRGWLPKSPTKGEDWETLKSCSPASSPDLTLEDVIADPTLCFNSGESSLVEIDGESENLSLTTCEYRREGTSQLASPLKLKYNQGVVEHFQRGLRNGYCKETLRPSVPEIFNNIQDVKTQSISYLAYQGAGFVHNHFSDSDAKMFQTCVPQQSSAQDMHVPVPKQLAHLPLPALKLPSPCKSKSLGDLTSEDIACNFESKYQCISKSFVTTGIRDKKGVTVKTKSLEPIDALTEQLRKLVSFDQEDNCQVLYSKQDANQLPRALVRKLSSRSQSRVRNIASRAKEKQEANKQKVPNPSNGAGVVLRNKPSAPTPAVNRHSTGSYIAGYLKNTKGGGLEGRGIPEGACTALHYGHVDQFCSDNSVLQTEPSSDDKPEIYFLLRL

SEQ ID NO: 63352 - protein, 224 aa, Homo sapiens
MPAPPPPLNCPPGLEYLSQIDMILIHQQIELLEVLFSFESSNMYEIKNSFGQRIYFAAEDTNFCIRNCCGRSRPFTLRITDNVGREVITLERPLRCNCCCCPCCLQEIEIQAPPGVPVGYVTQTWHPCLTKFTIKNQKREDVLKISGPCIVCSCIAGVDFEITSLDEQIVVGRISKHWSGFLREAFTDADNFGIQFPRDLDVKMKAVMIGACFLIDYMFFERTR

SEQ ID NO: 63353 - protein, 1007 aa, Homo sapiens
MKDEAGERDREVSSLNSKLLSLQLDIKNLHDVCKRQRKTLQDNQLCMEEAMNSSHDKKQAQALAFEESEVEFGSSKQCHLRQLQQLKKKLLVLQQELEFHTEELQTSYYSLRQYQSILEKQTSDLVLLHHHCKLKEDEVILYEEEMGNHNENTGEKLHLAQEQLALAGDKIASLERSLNLYRDKYQSSLSNIELLECQVKMLQGELGGIMGQEPENKGDHSKVRIYTSPCMIQEHQETQKRLSEVWQKVSQQDDLIQELRNKLACSNALVLEREKALIKLQADFASCTATHRYPPSSSEECEDIKKILKHLQEQKDSQCLHVEEYQNLVKDLRVELEAVSEQKRNIMKDMMKLELDLHGLREETSAHIERKDKDITILQCRLQELQLEFTETQKLTLKKDKFLQEKDEMLQELEKKLTQVQNSLLKKEKELEKQQCMATELEMTVKEAKQDKSKEAECKALQAEVQKLKNSLEEAKQQERLAAQQAAQCKEEAALAGCHLEDTQRKLQKGLLLDKQKADTIQELQRELQMLQKESSMAEKEQTSNRKRVEELSLELSEALRKLENSDKEKRQLQKTVAEQDMKMNDMLDRIKHQHREQGSIKCKLEEDLQEATKLLEDKREQLKKSKEHEKLMEGELEALRQEFKKKDKTLKENSRKLEEENENLRAELQCCSTQLESSLNKYNTSQQVIQDLNKEIALQKESLMSLQAQLDKALQKEKHYLQTTITKEAYDALSRKSAACQDDLTQALEKLNHVTSETKSLQQSLTQTQEKKAQLEEEIIAYEERMKKLNTELRKLRGFHQESELEVHAFDKKLEEMSCQVLQWQKQHQNDLKMLAAKEEQLREFQEEMAALKENLLEDDKEPCCLPQWSVPKDTCRLYRGNDQIMTNLEQWAKQQKVANEKLGNQLREQVNYIAKLSGEKDHLHSVMVHLQQENKKLKKEIEEKKMKAENTRLCTKALGPSRTESTQREKVCGTLGWKGLPQDMGQRMDLTKYIGMPHCPGSSYC

SEQ ID NO: 63354 - protein, 225 aa, Homo sapiens
MVHVSNRSIQGMNILFSSWAVVLMVMGITLDKWVELISEDERAKMNHSPWMMCCPALWPEDDLKVVRIMMTSSLGLSFLLNLILGMKFTYLIPQNKYIQLFTTILSFFSGISLLWALILYHNKLKQGQSMHFSNYRITWIMYTAYLNVFFLSVCGVLSLLECKLSTSSCTCLNIHKSDNECKESENSIEDISLPECTAMPRSIVRAHTVNSLNKKVQTRHVTWAL

SEQ ID NO: 63355 - protein, 311 aa, Homo sapiens
MARPQPCGPPHARCGSPSLPERPLQVKVVGLFSCPNFQIAKSAAENLKNNHPSKFEDPILVPLQEFAWHQYLQEKKRELKNETWEYSSSVISFVNGQFLGDALDLQKWAHEVWDIVDIKPSALYDALTEDFSAKFLRDTKHDFVFLDICIDSSPIGRLIFELYCDVCPKTCKNFQVLCTGKAGFSQRGIRLHYKNSIFHRIVQNGWIQGGDIVYGKGDNGESIYGPTFEDENFSVPHNKRGVLGMANKGRHSNGSQFYITLQATPYLDRKFVAFGQLIEGTEVLKQLELVPTQNERPIHMCRITDSGDPYA

SEQ ID NO: 63356 - protein, 109 aa, Homo sapiens; identical to SEQ ID NO: 54951

SEQ ID NO: 63357 - protein, 116 aa, Homo sapiens; identical to SEQ ID NO: 54952

SEQ ID NO: 63358 - protein, 109 aa, Homo sapiens; identical to SEQ ID NO: 54951

SEQ ID NO: 63359 - protein, 116 aa, Homo sapiens; identical to SEQ ID NO: 54952

SEQ ID NO: 63360 - protein, 351 aa, Homo sapiens
MGNAPAKKDTEQEESVNEFLAKARGDFLYRWGNPAQNTASSDQFERLRTLGMGSFGRVMLVRHQETGGHYAMKILNKQKVVKMKQVEHILNEKRILQAIDFPFLVKLQFSFKDNSYLYLVMEYVPGGEMFSRLQRVGRFSEPHACFYAAQVVLAVQYLHSLDLIHRDLKPENLLIDQQGYLQVTDFGFAKRVKGRTWTLCGTPEYLAPEIILSKGYNKAVDWWALGVLIYEMAVGFPPFYADQPIQIYEKIVSGRVRFPSKLSSDLKHLLRSLLQVDLTKRFGNLRNGVGDIKNHKWFATTSWIAIYEKKVEAPFIPKYTGPGDASNFDDYEEEELRISINEKCAKEFSEF

SEQ ID NO: 63361 - protein, 94 aa, Homo sapiens
MQHSLVFFFAVILHLSHLLHLDASIHPFRLPFSSKPFLLIPMSNTTLPHTAWPLSFLHQTVSTLKAVAVTHSLWHLQIPVDCQACNRKSKKIYC

SEQ ID NO: 63362 - protein, 275 aa, Homo sapiens
MEERKEEGEAEIQEHGPEHWFSKWERQCLAEAEQDEQLPPELQEEAAAAAQPEHKQQKLWHLFQNSATAVAQLYKDRVCQQPGLSLWVPFQNAATAVTNLYKESVDTHQRSFDIGIQIGYQRRNKDVLAWVKKRRRTIRREDLISFLCGKVPPPRNSRAPPRLTVVSPNRATSTETSSSVETDLQPFREAIALHGLSGAMASISVRSSTPGSPTHVSSGSNASRRRNGLHDVDLNTFISEEMALHLDNGGTRKRTSAQCGDVITDSPTHKRNRMI

SEQ ID NO: 63363 - protein, 470 aa, Homo sapiens
MSHHPSGLRAGFSSTSYRRTFGPPPSLSPGAFSYSSSSRFSSSRLLGSASPSSSVRLGSFRSPRAGAGALLRLPSERLDFSMAEALNQEFLATRSNEKQELQELNDRFANFIEKVRFLEQQNAALRGELSQARGQEPARADQLCQQELRELRRELELLGRERDRVQVERDGLAEDLAALKQRLEEETRKREDAEHNLVLFRKDVDDATLSRLELERKIESLMDEIEFLKKLHEEELRDLQVSVESQQVQQVEVEATVKPELTAALRDIRAQYESIAAKNLQEAEEWYKSKYADLSDAANRNHEALRQAKQEMNESRRQIQSLTCEVDGLRGTNEALLRQLRELEEQFALEAGGYQAGAARLEEELRQLKEEMARHLREYQELLNVKMALDIEIATYRKLLEGEESRISVPVHSFASLNIKTTVPEVEPPQDSHSRKTVLIKTIETRNGEVVTESQKEQRSELDKSSAHSY

SEQ ID NO: 63364 - protein, 318 aa, Homo sapiens
MPNIKIFSGSSHQDLSQKIADRLGLELGKVVTKKFSNQETCVEIDESVRGEDVYIVQSGCGEINDSLMELLIMINACKIASASRVTAVIPCFPYARQDKKDKSRSPISAKLVANMLSIAGADHIITMDLHASQIQGFFDIPVDNLYAEPTVLKWIRENIPEWKNCIIVSPDAGGAKRVTSIADQLNVDFALIHKERKKANEVDCIVLVGDVNDRVAILVDDMADTCVTICLAADKLLSAGATRVYAILTHGIFSGPAISRINTACFEAVVVTNTIPQDEKMKHCSKIRVIDISMILAEAIRRTHNGESVSYLFSHVPL

SEQ ID NO: 63365 - protein, 314 aa, Homo sapiens
MGARGALLLALLLARAGLRKPESQEAAPLSGPCGRRVITSRIVGGEDAELGRWPWQGSLRLWDSHVCGVSLLSHRWALTAAHCFETYSDLSDPSGWMVQFGQLTSMPSFWSLQAYYTRYFVSNIYLSPRYLGNSPYDIALVKLSAPVTYTKHIQPICLQASTFEFENRTDCWVTGWGYIKEDEALPSPHTLQEVQVAIINNSMCNHLFLKYSFRKDIFGDMVCAGNAQGGKDACFGDSGGPLACNKNGLWYQIGVVSWGVGCGRPNRPGVYTNISHHFEWIQKLMAQSGMSQPDPSWPLLFFPLLWALPLLGPV

SEQ ID NO: 63366 - protein, 312 aa, Homo sapiens
MGARGALLLALLLARAGLRKPESQEAAPLSGPCGRRVITSRIVGGEDAELGRWPWQGSLRLWDSHVCGVSLLSHRWALTAAHCFETDLSDPSGWMVQFGQLTSMPSFWSLQAYYTRYFVSNIYLSPRYLGNSPYDIALVKLSAPVTYTKHIQPICLQASTFEFENRTDCWVTGWGYIKEDEALPSPHTLQEVQVAIINNSMCNHLFLKYSFRKDIFGDMVCAGNAQGGKDACFGDSGGPLACNKNGLWYQIGVVSWGVGCGRPNRPGVYTNISHHFEWIQKLMAQSGMSQPDPSWPLLFFPLLWALPLLGPV

SEQ ID NO: 63367 - protein, 300 aa, Homo sapiens
MGARGALLLALLLARAGLRKPESQEAAPLSGPCGRRVITSRIVGGEDAELGRWPWQGSLRLWDSHVCGVSLLSHRWALTAAHCFETYSDLSDPSGWMVQFGQLTSMPSFWSLQAYYTRYFVSNIYLSPRYLGNSPYDIALVKLSAPVTYTKHIQPICLQASTFEFENRTDCWVTGWGYIKEDEALPSPHTLQEVQVAIINNSMCNHLFLKYSFRKDIFGDMGDSGGPLACNKNGLWYQIGVVSWGVGCGRPNRPGVYTNISHHFEWIQKLMAQSGMSQPDPSWPLLFFPLLWALPLLGPV

SEQ ID NO: 63368 - protein, 220 aa, Homo sapiens [sequence omitted]

SEQ ID NO: 63369 - protein, 220 aa, Homo sapiens [sequence omitted]

SEQ ID NO: 63370 - protein, 653 aa, Homo sapiens
MALVRGAEPAAGPSRWLPTHVQVTVLRARGLRGKSSGAGSTSDAYTVIQVGREKYSTSVVEKTHGCPEWREECSFELPPGALDGLLRAQEADAGPAPWAASSAAACELVLTTMHRSLIGVDKFLGQATVALDEVFGAGRAQHTQWYKLHSKPGKKEKERGEIEVTIQFTRNNLSASMFDLSMKDKPRSPFSKIRDKMKGKKKYDLESASAILPSSAIEDPDLGSLGKMGKAKGFFLRNKLRKSSLTQSNTSLGSDSTLSSASGSLAYQGPGAELLTRSPSRSSWLSTEGGRDSAQSPKLFTHKRTYSDEANQMRVAPPRALLDLQGHLDAASRSSLCVNGSHIYNEEPQGPVRHRSSISGSLPSSGSLQAVSSRFSEEGPRSTDDTWPRGSRSNSSSEAVLGQEELSAQAKVLAPGASHPGEEEGARLPEGKPVQVATPIVASSEAVAEKEGARKEERKPRMGLFHHHHQGLSRSELGRRSSLGEKGGPILGASPHHSSSGEEKAKSSWFGLREAKDPTQKPSPHPVKPLSAAPVEGSPDRKQSRSSLSIALSSGLEKLKTVTSGSIQPVTQAPQAGQMVDTKRLKDSAVLDQSAKYYHLTHDELISLLLQRERELSQRDEHVQELESYIDRLLVRIMETSPTLLQIPPGPPK

SEQ ID NO: 63371 - protein, 259 aa, Homo sapiens
MIQPRLLADAIVLFTSSQEEVTLAVTPLNFCLKSSNEESMDLSNAVHSEMFVGSDEFDFFQIGMDTEITFCFKELKGILTFSEATHAPISIYFDFPGKPLALSIDDMLVEANFILATLADEQSRASSPQSLCLSQKRKRSDLIEKKAGKNVTGQALECISKKAAPRRLYPKETLTNISALENCGSPAMKRVDGDVSEVSESSVSNTEEVPGSLCLRKFSCMFFGAVSSDQQEHFNHPFDSLARASDSEEDMNNGSFSIF

SEQ ID NO: 63372 - protein, 496 aa, Homo sapiens
MVEADHPGKLFIGGLNRETNEKMLKAVFGKHGPISEVLLIKDRTSKSRGFAFITFENPADAKNAAKDMNGTSLHGKAIKVEQAKKPSFQSGGRRRPPASSRNRSPSGSLRSARGSSGGTRGWLPSHEGHLDDGGYTPDLKMSYSRGLIPVKRGPSSRSGGPPPKKSAPSAVARSNSWMGSQGPMSQRRENYGVPPRRATISSWRNDRMSTRHDGYATNDGNHPSCQETRDYAPPSRGYAYRDNGHSNRDEHSSRGYRNHRSSRETRDYAPPSRGHAYRDYGHSRRDESYSRGYRNHRSSRETREYAPPSRGHGYRDYGHSRRHESYSRGYRNHPSSRETRDYAPPHRDYAYRDYGHSSWDEHSSRGYSYHDGYGEALGRDHSEHLSGSSYRDALQRYGTSHGAPPARGPRMSYGGSTCHAYSNTRDRYGRSWESYSSCGDFHYCDREHVCRKDQRNPPSLGRVLPDPREAYGSSSYVASIVDGGESRSEKGDSSRY

SEQ ID NO: 63373 - protein, 496 aa, Homo sapiens; identical to SEQ ID NO: 63372

SEQ ID NO: 63374 - protein, 284 aa, Homo sapiens
MAELVPFAVPIESDKTLLVWELSSGPTAEALHHSLFTAFSQFGLLYSVRVFPNAAVAHPGFYAVIKFYSARAAHRAQKACDRKQLFQKSPVKVRLGTRHKAVQHQALALNSSKCQELANYYFGFNGCSKRIIKLQELSDLEERENEDSMVPLPKQSLKFFCALEVVLPSCDCRSPGIGLVEEPMDKVEEGPLSFLMKRKTAQKLAIQKALSDAFQKLLIVVLESGKIAVEYRPSEDIVGVRCEEELHGLIQVPCSPWKQYGQEEEGYLSDFSLEEEEFRLPELD

SEQ ID NO: 63375 - protein, 236 aa, Homo sapiens
MGQKASQQLALKDSKEVPVVCEVVSEAIVHAAQKLKEYLGFEYPPSKLCPAANTLNEIFLIHFITFCQEKGVDEWLTTTKMTKHQAFLFGADWIWTFWGSNKQIKLQLAVQTLQMSSPPPVESKPCDLSNPESRVEESSWKKSRFDKLEEFCNLIGEDCLGLFIIFGMPGKPKDIRGVVLDSVKSQMVRSHLPGGKAVAQFVLETEDCVFIKELLRNCLSKKDGLREVGKVYISIL

SEQ ID NO: 63376 - protein, 641 aa, Homo sapiens
MNWAAFGGSEFFIPEGIQIDSRCPLSRNITEWYHYYGIAVKESSQYYDVMYSKKGAAWVSETGKKEVSKQTVAYSPRSKLGTLLPEFPNVKDLNLPASLPEEKVSTFIMMYRTHCQRILDTVIRANFDEVQSFLLHFWQGMPPHMLPVLGSSTVVNIVGVCDSILYKAISGVLMPTVLQALPDSLTQVIRKFAKQLDEWLKVALHDLPENLRNIKFELSRRFSQILRRQTSLNHLCQASRTVIHSADITFQMLEDWRNVDLNSITKQTLYTMEDSRDEHRKLITQLYQEFDHLLEEQSPIESYIEWLDTMVDRCVVKVAAKRQGSLKKVAQQFLLMWSCFGTRVIRDMTLHSAPSFGSFHLIHLMFDDYVLYLLESLHCQERANELMRAMKGEGSTAEVREEIILTEAAAPTPSPVPSFSPAKSATSVEVPPPSSPVSNPSPEYTGLSTTGAMQSYTWSLTYTVTTAAGSPAENSQQLPCMRNTHVPSSSVTHRIPVYPHREEHGYTGSYNYGSYGNQHPHPMQSQYPALPHDTAISGPLHYAPYHRSSAQYPFNSPTSRMEPCLMSSTPRLHPTPVTPRWPEVPSANTCYTSPSVHSARYGNSSDMYTPLTTRRNSEYEHMQHFPGFAYINGEASTGWAK

SEQ ID NO: 63377 - protein, 735 aa, Homo sapiens
MHCGLLEEPDMDSTESWIERCLNESENKRYSSHTSLGNVSNDENEEKENNRASKPHSTPATLQWLEENYEIAEGVCIPRSALYMHYLDFCEKNDTQPVNAASFGKIIRQQFPQLTTRRLGTRGQSKYHYYGIAVKESSQYYDVMYSKKGAAWVSETGKKEVSKQTVAYSPRSKLGTLLPEFPNVKDLNLPASLPEEKVSTFIMMYRTHCQRILDTVIRANFDEVQSFLLHFWQGMPPHMLPVLGSSTVVNIVGVCDSILYKAISGVLMPTVLQALPDSLTQVIRKFAKQLDEWLKVALHDLPENLRNIKFELSRRFSQILRRQTSLNHLCQASRTVIHSADITFQMLEDWRNVDLNSITKQTLYTMEDSRDEHRKLITQLYQEFDHLLEEQSPIESYIEWLDTMVDRCVVKVAAKRQGSLKKVAQQFLLMWSCFGTRVIRDMTLHSAPSFGSFHLIHLMFDDYVLYLLESLHCQERANELMRAMKGEGSTAEVREEIILTEAAAPTPSPVPSFSPAKSATSVEVPPPSSPVSNPSPEYTGLSTTGAMQSYTWSLTYTVTTAAGSPAENSQQLPCMRNTHVPSSSVTHRIPVYPHREEHGYTGSYNYGSYGNQHPHPMQSQYPALPHDTAISGPLHYAPYHRSSAQYPFNSPTSRMEPCLMSSTPRLHPTPVTPRWPEVPSANTCYTSPSVHSARYGNSSDMYTPLTTRRNSEYEHMQHFPGFAYINGEASTGWAK

SEQ ID NO: 63378 - protein, 1388 aa, Homo sapiens
MSIPLHSLRFNNTMREENVEPQNKQMAFCRPMTETRADVQILHSHVQLPIVSTSASDPGGTSTQLMTSPVFDTMSAPLMGVPNSGALSPPLMPASDSGALSPLLMPASDSGALSPLLMPALDSGTLSPLLSTSEYGVMSPGMMTIPDFGTMSATLMVAPDSAEISPLAMPAPSSGVVCTPIMSTSSSEAMSTPLMLAPDSGELSPILMQDMNPGVMSTQPVPAPSSEAMSPLQITDEDTEAMSKVLMTALASGEISSLLMSGTDSEAISSLIMSAVASGGTSPQPTSTQNSGGIPTPLMSDLDSGIMSSLLMSSPGSEVMSTPLLSVPDAGEMSTLPKPAPDAEAMSPALMTALPSGVMPTQTMPAPGSGAMSPWSTQNVDSEMMSNPPVRATASGVMSAPPVRALDSGAMSTPLMGAPASGNMSTLQKTVPASGAMTTSLMTVPSSGVMSTEQMSATASRVMSAQLTMAKTSGAMPTGSMKAVAKQYKRATASGKMSTPLRRAPTSGAMSTQPVTATASETMSMPQLTVPASGSMSMLQMRAPVSEAMSMPQMRTMASGLTSAAQMKAMTSGAMSTPLMTAQTSGSTSTLLMRDTASGVMSCPQMRSLASGALSKPLMTPKASGTMFTEKMTTTASEAMPTLLMRDTVSGALSMPQMTDTASGGLSASLMRDTASGAMSTSQMTATVSGGMSMPLMRAQDPGVMPASLMRAKVSGKMLSQPMSTQDPGGMSMSPMKSMTAGGMQMNSPTSDVMSTPTVRAWTSETMSTPLMRTSDPGERPSLLTRASSSGEMSLPLMRAPASGEIATPLRSPAYGAMSAPQMTATASGMMSSMPQVKAPISGAMSMPLTRSTASGGMSMPLMRAPDSRVTSTSQMMPTASGDMCTLPVRAPASGGVSSPLVRAPASGTMSTPLRRPSACETVSTELMRASASGHMSTAQTTAMVSGGMSKPLMRAPASGTMPMPLMSAMASGEMSMPLMETMASGATSTLQTSVANSRSMSLSQTTYTVSGRMATAPIRASASGARSTSFMRASVSGSMPMPLPRATASGCGMGMSMPQMTATDSRGMSTPLMRASGPGTMSTPQTAFGVMSTPEIKATDSGEASTSHINITASGSKPTSHMTATTPETAKPPPKEVPSFGMLTPALCYLLEEQEAARGSCSVEEEMEIDEEKQMKGFLDDSERMAFLVSLHLGAAERWFILQMEVGEPLSHENKSFLRRSQGIYDSLSEIDILSAVLCHPKQGQKSVRQYATDFLLLARHLSWSDAILRTRFLEGLSEAVTTKMGRIFLKVAGSLKELIDRSLYTECQLAEEKDSPGNSSQVLPTACKRNNEEAMGNELSSQQQTEEHQHVSKRCYYLKEHGDPQEGLHDHLGQSTGHHQKAHTNK

SEQ ID NO: 63379 - protein, 488 aa, Homo sapiens
MTECVPVPSSEHVAEIVGRQGCKIKALRAKTNTYIKTPVRGEEPVFIVTGRKEDVEMAKREILSAAEHFSIIRATRSKAGGLPGAAQGPPNLPGQTTIQVRVPYRVVGLVVGPKGATIKRIQQRTHTYIVTPGRDKEPVFAVTGMPENVDRAREEIEAHITLRTGAFTDAGPDSDFHANGTDVCLDLLGAAASLWAKTPNQGRRPPTATAGLRGDTALGAPSAPEAFYAGSRGGPSVPDPGPASPYSGSGNGGFAFGAEGPGAPVGTAAPDDCDFGFDFDFLALDLTVPAAATIWAPFERAAPLPAFSGCSTVNGAPGPPAAGARRSSGAGTPRHSPTLPEPGGLRLELPLSRRGAPDPVGALSWRPPQGPVSFPGGAAFSTATSLPSSPAAAACAPLDSGASENSRKPPSASSAPALARECVVCAEGEVMAALVPCGHNLFCMDCAVRICGKSEPECPACRTPATQAIRVETETPQPGGASALQRQY

SEQ ID NO: 63380 - protein, 227 aa, Homo sapiens
MEGQSGRCKIVVVGDAECGKTALLQVFAKDAYPGSYVPTVFENYTASFEIDKRRIELNMWDTSGSSYYDNVRPLAYPDSDAVLICFDISRPETLDSVLKKWQGETQEFCPNAKVVLVGCKLDMRTDLATLRELSKQRLIPVTHEQGTVLAKQVGAVSYVECSSRSSERSVRDVFHVATVASLGRGHRQLRRTDSRRGMQRSAQLSGRPDRGNEGEIHKDRAKSCNLM

SEQ ID NO: 63381 - protein, 322 aa, Homo sapiens
MAAPPSPGRTADQADQVCTFLFKKPGRKGAAGLRKRPACDPEHGESSSSGDEGDTVAQPPRVAPRPRGLHSWQKAAHGDRRGEEAAPESLDVVYRSTRSAKPVGPEDMGATADFEQDTEKEHHTPTILKCSQRVQEALRGREHDHIYRGIHSYLRYLKPKDTSMGNSSSGMARKGPIRAPGHLRATVRWDYQPDICKDYKETGFCGFGDSCKFLHDRSDYKLGWEIERELEEGRYCICEDENHEVGSEEEEIPFRCFICRQAFQNPVVTKCRHYFCESCALEHFRATPRCYICDQPTGGIFNPAKELMAKLQKLQAAEGKKR

SEQ ID NO: 63382 - protein, 376 aa, Homo sapiens
MHLLKVGTWRNNTASSWLMKFSVLWLVSQNCCRASVVWMAYMNISFHVGNHVLSELGETGVFGRSSTLKRVAGVIVPPEGKIQNACNPNTIFSRSKYSETWLALIERGGCTFTQKIKVATEKGASGVIIYNVPGTGNQVFPMFHQAFEDVVVVMIGNLKGTEIFHLIKKGVLITAVVEVGRKHIIWMNHYLVSFVIVTTATLAYFIFYHIHRLCLARIQNRRWQRLTTDLQNTFGQLQLRVVKEGDEEINPNGDSCVICFERYKPNDIVRILTCKHFFHKNCIDPWILPHGTCPICKCDILKVLGIQVVVENGTEPLQVLMSNELPETLSPSEEETNNEVSPAGTSDKVIHVEENPTSQNNDIQPHSVVEDVHPSP

SEQ ID NO: 63383 - protein, 245 aa, Homo sapiens
MGGGYDLNLFASPPDSNFVCSVCHGVLKRPARLPCSHIFCKKCILRWLARQKTCPCCRKEVKRKKVVHMNKLRKTIGRLEVKCKNADAGCIVTCPLAHRKGHQDSCPFELTACPNEGCTSQVPRGTLAEHRQHCQQGSQQRCPLGCGATLDPAERARHNCYRELHNAWSVRQERRRPLLLSLLRRVRWLDQATSVVRRELAELSNFLEEDTALLEGAPQEEAEAAPEGNVGAEVVGEPRANIPCK

SEQ ID NO: 63384 - protein, 808 aa, Homo sapiens
MLHDARDRQKFFSDVQYLRDMQHKVDSEYQACLRRQEYRRDPNEKKRDQFWGQETSFERSRFSSRSSSKQSSSEEDALTEPRSSIKISAFKCDSKLPAIDQTSVKQKHKSTMTVRKAEKVDPSEPSPADQAPMVLLRKRKPNLRRFTVSPESHSPRASGDRSRQKQQWPAKVPVPRGADQVVQQEGLMCNTKLKRPNQERRNLVPSSQPMTENAPDRAKKGDPSAPSQSELHPALSQAFQGKNSPQVLSEFSGPPLTPTTVGGPRKASFRFRDEDFYSILSLNSRRESDDTEEETQSEECLWVGVRSPCSPSHHKRSRSGGTSTPQAKNKNFEENAENCRGHSSRRSEPSHGSLRISNAMEPATERPSAGQRLSQDPGLPDRESATEKDRGGSENAKKSPLSWDTKSEPRQEVGVNAENVWSDCISVEHRPGTHDSEGYWKDYLNSSQNSLDYFISGRPISPRSSVNSSYNPPASFMHSALRDDIPVDLSMSSTSVHSSDSEGNSGFHVCQPLSPIRNRTPFASAENHNYFPVNSAHEFAVREAEDTTLTSQPQGAPLYTDLLLNPQGNLSLVDSSSSSPSRMNSEGHLHVSGSLQENTPFTFFAVSHFPNQNDNGSRMAASGFTDEKETSKIKADPEKLKKLQESLLEEDSEEEGDLCRICQIAGGSPSNPLLEPCGCVGSLQFVHQECLKKWLKVKITSGADLGAVKTCEMCKQGLLVDLGDFNMIEFYQKHQQSQAQNELMNSGLYLVLLLHLYEQRFAELMRLNHNQVERERLSRNYPQPRTEENENSELGDGNEGSISQSQVV

SEQ ID NO: 63385 - protein, 432 aa, Homo sapiens
MRPWALAVTRWPPSAPVGQRRFSAGPGSTPGQLWGSPGLEGPLASPPARDERLPSQQPPSRPPHLPVEERRASAPAGGSPRMLHPATQQSPFMVDLHEQVHQGPVPLSYTVTTVTTQGFPLPTGQHIPGCSAQQLPACSVMFSGQHYPLCCLPPPLIQACTMQQLPVPYQAYPHLISSDHYILHPPPPAPPPQPTHMAPLGQFVSLQTQHPRMPLQRLDNDVDLRGDQPSLGSFTYSTSAPGPALSPSVPLHYLPHDPLHQELSFGVPYSHMMPRRLSTQRYRLQQPLPPPPPPPPPPPYYPSFLPYFLSMLPMSPTAMGPTISLDLDVDDVEMENYEALLNLAERLGDAKPRGLTKADIEQLPSYRFNPDSHQSEQTLCVVCFSDFEARQLLRVLPCNHEFHTKCVDKWLKANRTCPICRADASEVPREAE

SEQ ID NO: 63386 - protein, 212 aa, Homo sapiens
MAQTDKPTCIPPELPKMLKEFAKAAIRAQPQDLIQWGADYFEALSRGETPPVRERSERVALCNWAELTPELLKILHSQVAGRLIIRAEELAQMWKVVNLPTDLFNSVMNVGRFTEEIEWLKFLALACSALGVTITKTLKIVCEVLSCDHNGGLPRIPFSTFQFLYTYIAEVDGEICASHVSRMLNYIEQEVIGPDGLITVNDFTQNPRVWLE

SEQ ID NO: 63387 - protein, 251 aa, Homo sapiens
MGSKLTCCLGPSGGLNCDCCRPDVGPCHECEIPETVAATAPASTTAKPAKLDLKAKKAQLMQYLSLPKTPKMLKMSKGLDARSKRWLKIIWRRHGIWPLENIGPTEDVQASAHGGVEENMTSDIEIPEAKHDHRPTEDVQVSAHGGVEENITSDIEISEAKHDHHLVEDLSESLSVCLEDFMTSDLSESLSVSLEDFMTSGLSESLSVSLEDLMTPEMAKERYEDYLCWVKMARSRLNEPISSQVLGLLRL

SEQ ID NO: 63388 - protein, 248 aa, Homo sapiens
MGKRDNRVAYMNPIAMARWRGPTQSVGPTIQDYLNRPRPTWEEVKKQLENKKTGSKALAEFEEKMNENWKKELEKSREKLLSGNESSSKKRERKKKRKKKSCRSSSSSSSSDSSSSSSDSEDEEKKQGKRRKKKKNRSYKSSQSSTHESESESKESVKKKKKSKDETEKEKDVRSLSKKRKKSYPDDKPLSSESSSESDYEEDVQAKKKRRCEEREQAKEKVKKKKKKQHKKHSKKKKKKSGSSHKSR

SEQ ID NO: 63389 - protein, 288 aa, Homo sapiens
MDAELAEVRALQAEIAALRRACEDPPAPWEEKSRVQKSFQAIHQFNLEGWKSSKDLKNQLGHLESELSFLSTLTGINIRNHSKQTEDLTSTEMTEKSIRKVLQRHRLSGNCHMVTFQLEFQILEIQNKERLSSAVTDLNIIMEPTECSELSEFVSRAEERKDLFMFFRSLHFFVEWFEYRKRTFKHLKEKYPDAVYLSEGPSSCSMGIRSASRPGFELVIVWRIQIDEDGKVFPKLDLLTKVPQRALELDKNRAIETAPLSFRTLVGLLGIEAALESLIKSLCAEENN

SEQ ID NO: 63390 - protein, 1117 aa, Homo sapiens
MRKLLSFGRRLGQALLSSMDQEYAGRGYHIRDWELRKIHRAAIKGDAAEVEHCLTRRFRDLDVRDRKDRTVLHLACAHGRVQVVTLLLDRKCQINICDRLNRTPLMKAVHCQEEACAIILLKRGANPNIKDIYGNTALHYAVYNEGTSLAERLLSHHANIEALNKEGNTPLLFAINSRRQHMVEFLLKNQANIHAVDNFKRTALILAVQHNLSSIVTLLLQQNIHISSQDMFGQTAEDYAFCCDLRSIQQQILEHKNKMLKNHLRNDNQEAAAMKNESFKTQGASSKVSLYHQSGVQWHDLRLLQPSPPRFKQFSCLSLPRSWDNRHMRPCPETAAMKPENLKKRKKRKKLKKRKEGAKEHNLKVASEEKQERLERSENKQPQDSQSYGKKKDEMFGNFMLKRDIAMLKEELYAIKNDSLRKEKKYIQEIKSITEINANFEKSVRLNEEMITKKVAQYSQQLNDLKAENARLNSKLEKEKHNKERLEAEVESLHSNLATAINEYNEILERKDLELVLWRADDVSRHETMGSNISQLTDKNELLTEQVHKARVKFNTLKGKLRETRDALREKTLALESVQLDLKQAQHRIKEMKQMHPNGEAKESQSIGKQNSSEERIRQRELENLLLERQLEDARKEGDNKEIVINIHRDCLENGKEDLLEERNKELMNEYNYLKEKLLQYEKEKAEREVIVREFQEELVDHLKKFSMSESPLEGTSHCHINLDETWTSKKKLFQVEIQPEEKHEEFRKVFELISLLNYTADQIRKKNRELEEEATGYKKCLEMTINMLNAFANEDFSCHGDLNTDQLKMDILFKKLKQKFDDLMAEKEAVSSKCVNLAKDNEVLHQELLSMGKVQEKCEKLEKDKKMLEEKVLNLKTHMEKDMVELGKVQEYKSELDERAMQAIEKLEEIHLQKQAEYEKQLEQLNKDNTASLKKKELTLKDVECKFSKMKTAYEDVTTELEEYKEAFAVALKANSSMSEKITKSDKKIAVISTKLFMEKERMEYFLSTLPMRPDPELPCVENLNSIELNRKYIPKMAIRIPTSNPQTSNNCKNSLTEMELDCAEQIITETKKIINLCIPSTRKPMILTQNFCCVGPLLLSTFFSRIHCPRMSNFS

SEQ ID NO: 63391 - protein, 407 aa, Homo sapiens
MTPMKRSVQTQVSEPFMESWGEESLPELPAEQSLTEYSDLEEAPSAHTLYVGHLNPQFSVPVLACLLRDTLERLEMPVAREHIEVVRRPRKAYALVQVTVHRDTLASLPWRLQTALEEHLILKELAASGKDLLLSEAQGPFSHREEKEEEEEDSGLSPGPSPGSGVPLPTWPTHTLPDRPQAQQLQSCQGRPSGVCSDSAIVHQQIVGKDQLFQGAFLGSETRNMEFKRGSGEYLSLAFKHHVRRYVCAFLNSEGGSLLVGVEDSGLVQGIRCSHRDEDRARLLVDSILQGFKPQIFPDAYTLTFIPVISTSETSVPLKVIRLTVHTPKAQSQPQLYQTDQGEVFLRRDGSIQGPLSASAIQEWCRQRWLVELGKLEEKMKALMMEKEQLQQQLQQHGPVSCTCCVL

SEQ ID NO: 63392 - protein, 501 aa, Homo sapiens
MQDTVTTSALLDPSHSSVSTQDNSSTGGHTSSTSLQLSKPSITPVPAKSRNPRPRANIRRMRRIIAEDPEWSLAIVPLLTELCIQHIIRNFQKNPILKQMLPEHQQKVLNHLSPDLPLAVTANLIDSENYWLRCCMHRWPVCHVAHHGGSWKRMFFERHLENLLKHFIPGTTDPAVILDLLPLCRNYVRRVHVDQFLPPVQLPAQLRPGDQSDSGSEGEMEEPTVDHYQLGDLVAGLSHLEELDLVYDVKDCGMNFEWNLFLFTYRDCLSLAAAIKACHTLKIFKLTRSKVDDDKARIIIRSLLDHPVLEELDLSQNLIGDRGARGAAKLLSHSRLRVLNLANNQVRAPGAQSLAHALAHNTNLISLNLRLNCIEDEGGQALAHALQTNKCLTTLHLGGNELSEPTATLLSQVLAINTTLTSINLSCNHIGLDGGKQLLEGMSDNKTLLEFDLRLSDVAQESEYLIGQALYANREAARQRALNPSHFMSTITANGPENSVG

SEQ ID NO: 63393 - protein, 1569 aa, Homo sapiens
MAESLSEISDSLDVLEAGDEGKKKCKFKALKSFFVKKKEKEAEDTQEEEMLELSLSSSNINISSLQPVRENQPTKARAKSSMGSKALSHDSIFMLGPEPERSASKMFPSMDPQRGRPQQRSHISRTLPKPRSKVPGVVSGAMSGAVLQNVPTSAVWVAGPKITENPPSRRRRLSIIPPVIQPEIISKNLVEISLDDESPKNPQKKALPHKSLTATQSFSELSSGPDCSQSLTAFATLASTSSTQLPIGFSTPATTQGCLDSSAARHKMTLNPRKQKKNLQVIIRGLPVWFSHFQGILEGSLQCVTQTLETPNLDEPLPVEPKEEEPNLPLVSEEEKSITKPKEINEKKLGMDSADSSSQKQNNKTEMYDKKTTDQAPNTDASRSQGYPMSAAYGRRWRRKGASVSGLSGCEFKGRSLKQSSEGYGLGDRAGSSPTNKTARNVPFSHLSLEKDNMEQPTTSQPETTTPQGLLSDKDDMGRRNAGIDFGSRKASAAQPIPENMDNSMVSDPQPYHEDAASGAEKTEARASLSLMVESLSTTQEEAILSVAAEAQVFMNPSHIQLEDQEAFSFDLQKAQSKMESAQDVQTICKEKPSGNVHQTFTASVLGMTSTTAKGDVYAKTLPPRSLFQSSRKPDAEEVSSDSENIPEEGDGSEELAHGHSSQSLGKFEDEQEVFSESKSFVEDLSSSEEELDLRCLSQALEEPEDAEVFTESSSYVEKYNTSDDCSSSEEDLPLRHPAQALGKPKNQQEVSSASNNTPEEQNDFMQQLPSRCPSQPIMNPTVQQQVPTSSVGTSIKQSDSVEPIPPRHPFQPWVNPKVEQEVSSSPKSMAVEESISMKPLPPKLLCQPLMNPKVQQNMFSGSEDIAVERVISVEPLLPRYSPQSLTDPQIRQISESTAVEEGTYVEPLPPRCLSQPSERPKFLDSMSTSAEWSSPVAPTPSKYTSPPWVTPKFEELYQLSAHPESTTVEEDISKEQLLPRHLSQLTVGNKVQQLSSNFERAAIEADISGSPLPPQYATQFLKRSKVQEMTSRLEKMAVEGTSNKSPIPRRPTQSFVKFMAQQIFSESSALKRGSDVAPLPPNLPSKSLSKPEVKHQVFSDSGSANPKGGISSKMLPMKHPLQSLGRPEDPQKVFSYSERAPGKCSSFKEQLSPRQLSQALRKPEYEQKVSPVSASSPKEWRNSKKQLPPKHSSQASDRSKFQPQMSSKGPVNVPVKQSSGEKHLPSSSPFQQQVHSSSVNAAARRSVFESNSDNWFLGRDEAFAIKTKKFSQGSKNPIKSIPAPATKPGKFTIAPVRQTSTSGGIYSKKEDLESGDGNNNQHANLSNQDDVEKLFGVRLKRAPPSQKYKSEKQDNFTQLASVPSGPISSSVGRGHKIRSTSQGLLDAAGNLTKISYVADKQQSRPKSESMAKKQPACKTPGKPAGQQSDYAVSEPVWITMAKQKQKSFKAHISVKELKTKSNAGADAETKEPKYEGAGSANENQPKKMFTSSVHKQEKTAQMKPPKPTKSVGFEAQKILQVPAMEKETKRSSTLPAKFQNPVEPIEPVWFSLARKKAKAWSHMAEITQ

SEQ ID NO: 63394 - protein, 1569 aa, Homo sapiens
MAESLSEISDSLDVLEAGDEGKKKCKFKALKSFFVKKKEKEAEDTQEEEMLELSLSSSNINISSLQPVRENQPTKARAKSSMGSKALSHDSIFMLGPEPERSASKMFPSMDPQRGRPQQRSHISRTLPKPRSKVPGVVSGAMSGAVLQNVPTSAVWVAGPKITENPPSRRRRLSIIPPVIQPEIISKNLVEISLDDESPKNPQKKALPHKSLTATQSFSELSSGPDCSQSLTAFATLASTSSTQLPIGFSTPATTQGCLDSSAARHKMTLNPRKQKKNFQVIIRGLPVWFSHFQGILEGSLQCVTQTLETPNLDEPLPVEPKEEEPNLPLVSEEEKSITKPKEINEKKLGMDSADSSSQKQNNKTEMYDKKTTDQAPNTDASRSQGYPMSAAYGRRWRRKGASVSGLSGCEFKGRSLKQSSEGYGLGDRAGSSPTNKTARNVPFSHLSLEKDNMEQPTTSQPETTTPQGLLSDKDDMGRRNAGIDFGSRKASAAQPIPENMDNSMVSDPQPYHEDAASGAEKTEARASLSLMVESLSTTQEEAILSVAAEAQVFMNPSHIQLEDQEAFSFDLQKAQSKMESAQDVQTICKEKPSGNVHQTFTASVLGMTSTTAKGDVYAKTLPPRSLFQSSRKPDAEEVSSDSENIPEEGDGSEELAHGHSSQSLGKFEDEQEVFSESKSFVEDLSSSEEELDLRCLSQALEEPEDAEVFTESSSYVEKYNTSDDCSSSEEDLPLRHPAQALGKPKNQQEVSSASNNTPEEQNDFMQQLPSRCPSQPIMNPTVQQQVPTSSVGTSIKQSDSVEPIPPRHPFQPWVNPKVEQEVSSSPKSMAVEESISMKPLPPKLLCQPLMNPKVQQNMFSGSEDIAVERVISVEPLLPRYSPQSLTDPQIRQISESTAVEEGTYVEPLPPRCLSQPSERPKFLDSMSTSAEWSSPVAPTPSKYTSPPWVTPKFEELYQLSAHPESTTVEEDISKEQLLPRHLSQLTVGNKVQQLSSNFERAAIEADISGSPLPPQYATQFLKRSKVQEMTSRLEKMAVEGTSNKSPIPRRPTQSFVKFMAQQIFSESSALKRGSDVAPLPPNLPSKSLSKPEVKHQVFSDSGSANPKGGISSKMLPMKHPLQSLGRPEDPQKVFSYSERAPGKCSSFKEQLSPRQLSQALRKPEYEQKVSPVSASSPKEWRNSKKQLPPKHSSQASDRSKFQPQMSSKGPVNVPVKQSSGEKHLPSSSPFQQQVHSSSVNAAARRSVFESNSDNWFLGRDEAFAIKTKKFSQGSKNPIKSIPAPATKPGKFTIAPVRQTSTSGGIYSKKEDLESGDGNNNQHANLSNQDDVEKLFGVRLKRAPPSQKYKSEKQDNFTQLASVPSGPISSSVGRGHKIRSTSQGLLDAAGNLTKISYVADKQQSRPKSESMAKKQPACKTPGKPAGQQSDYAVSEPVWITMAKQKQKSFKAHISVKELKTKSNAGADAETKEPKYGGAGSANENQPKKMFTSSVHKQEKTAQMKPPKPTKSVGFEAQKILQVPAMEKETKRSSTLPAKFQNPVEPIEPVWFSLARKKAKAWSHMAEITQ

SEQ ID NO: 63395 - protein, 196 aa, Homo sapiens
MFCEKAMELIRELHRAPEGQLPAFNEDGLRQVLEEMKALYEQNQSDVNEAKSGGRSDLIPTIKFRHCSLLRNRRCTVAYLYDRLLRIRALRWEYGSILPNALRFHMAAEEMEWFNNYKRSLATYMRSLGGDEGLDITQDMKPPKSLYIEVRCLKDYGEFEVDDGTSVLLKKNSQHFLPRWKCEQLIRQGVLEHILS

SEQ ID NO: 63396 - protein, 157 aa, Homo sapiens
MERSPSRRRRLEEAPKLPYKNPTHLAQQQEPWSRLNSTPTITSMRRDAYYFDPEIPKDDLDFRLAALYNHHTGTFKNKSEILLNQKTTQDTYRTKIQFPGEFLTPPTPPITFLANIRHWINPKKESIHSIQGSIVSPHTAATNGGYSRKKDGGFFST

SEQ ID NO: 63397 - protein, 157 aa, Homo sapiens; identical to SEQ ID NO: 63396

SEQ ID NO: 63398 - protein, 288 aa, Homo sapiens [sequence omitted]

SEQ ID NO: 63399 - protein, 214 aa, Homo sapiens [sequence omitted]

SEQ ID NO: 63400 - protein, 717 aa, Homo sapiens
MGDLPPYPERPAQQPPGRRTSQASQRRHSRDQAQALAADPEERQQIPPDAQRNAPGWSQRGSLSQQENLLMPQVFQAEEARLGGMEYPSVNTGFPSEFQPQPYSDESRMQVAELTTSLMLQRLQQGQSSLFQQLDPTFQEPPVNPLGQFNLYQTDQFSEGAQHGPYIRDDPALQFLPSELGFPHYSAQVPEPEPLELAVQNAKAYLLQTSINCDLSLYEHLVNLLTKILNQRPEDPLSVLESLNRTTQWEWFHPKLDTLRDDPEMQPTYKMAEKQKALFTRSGGGTEGEQEMEEEVGETPVPNIMETAFYFEQAGVGLSSDESFRIFLAMKQLVEQQPIHTCRFWGKILGIKRSYLVAEVEFREGEEEAEEEEVEEMTEGGEVMEAHGEEEGEEDEEKAVDIVPKSVWKPPPVIPKEESRSGANKYLYFVCNEPGLPWTRLPHVTPAQIVNARKIKKFFTGYLDTPVVSYPPFPGNEANYLRAQIARISAATQVSPLGFYQFSEEEGDEEEEGGAGRDSYEENPDFEGIPVLELVDSMANWVHHTQHILPQGRCTWVNPLQKTEEEEDLGEEEEKADEGPEEVEQEVGPPLLTPLSEDAEIMHLAPWTTRLSCSLCPQYSVAVVRSNLWPGAYAYASGKKFENIYIGWGHKYSPESFNPALPAPIQQEYPSGPEIMEMSDPTVEEEQALKAAQEQALGATEEEEEGEEEEEGEETDD

SEQ ID NO: 63401 - protein, 348 aa, Homo sapiens
MAHSQNSLELPININATQITTAYGHRALPKLKEELQSEDLQTRQKALMALCDLMHDPECIYKAMNIGCMENLKALLKDSNSMVRIKTTEVLHITASHSVGRYAFLEHDIVLALSFLLNDPSPVCRGNLYKAYMQLVQVPRGAQEIISKGLISSLVWKLQVEVEEEEFQEFILDTLVLCLQEDATEALGSNVVLVLKQKLLSANQNIRSKAARALLNVSISREGKKQVCHFDVIPILVHLLKDPVEHVKSNAAGALMFATVITEGKYAALEAQAIGLLLELLHSPMTIARLNATKALTMLAEAPEGRKALQTHVPTFRAMEVETYEKPQVAEALQRAARIAISVIEFKP

SEQ ID NO: 63402 - protein, 1610 aa, Homo sapiens
MNTPKEEFQDWPIVRIAAHLPDLIVYGHFSPERPFMDYFDGVLMFVDISGFTAMTEKFSSAMYMDRGAEQLVEILNYHISAIVEKVLIFGGDILKFAGDALLALWRVERKQLKNIITVVIKCSLEIHGLFETQEWEEGLDIRVKIGLAAGHISMLVFGDETHSHFLVIGQAVDDVRLAQNMAQMNDVILSPNCWQLCDRSMIEIESVPDQRAVKVNFLKPPPNFNFDEFFTKCTTFMHYYPSGEHKNLLRLACTLKPDPELEMSLQKYVMESILKQIDNKQLQGYLSELRPVTIVFVNLMFEDQDKAEEIGPAIQDAYMHITSVLKIFQGQINKVFMFDKGCSFLCVFGFPGEKVPDELTHALECAMDIFDFCSQVHKIQTVSIGVASGIVFCGIVGHTVRHEYTVIGQKVNLAARMMMYYPGIVTCDSVTYNGSNLPAYFFKELPKKVMKGVADSGPLYQYWGRTEKVMFGMACLICNRKEDYPLLGRNKEINYFMYTMKKFLISNSSQVLMYEGLPGYGKSQILMKIEYLAQGKNHRIIAISLNKISFHQTFYTIQMFMANVLGLDTCKHYKERQTNLRNKVMTLLDEKFYCLLNDIFHVQFPISREISRMSTLKKQKQLEILFMKILKLIVKEERIIFIIDEAQFVDSTSWRFMEKLIRTLPIFIIMSLCPFVNIPCAAARAVIKNRNTTYIVVGAVQPNDISNKICLDLNVSCISKELDSYLGEGSCGIPFYCEELLKNLEHHEVLVFQQTESEEKTNRTWNNLFKYSIKLTEKLNMVTLHSDKESEEVCHLTSGVRLKNLSPPTSLKEISLIQLDSMRLSHQMLVRCAAIIGLTFTTELLFEILPCWNMKMMIKTLATLVESNIFYCFRNGKELQKALKQNDPSFEVHYRSLSLKPSEGMDHGEEEQLRELENEVIECHRIRFCNPMMQKTAYELWLKDQRKAMHLKCARFLEEDAHRCDHCRGRDFIPYHHFTVNIRLNALDMDAIKKMAMSHGFKTEEKLILSNSEIPETSAFFPENRSPEEIREKILNFFDHVLTKMKTSDEDIIPLESCQCEEILEIVILPLAHHFLALGENDKALYYFLEIASAYLIFCDNYMAYMYLNEGQKLLKTLKKDKSWSQTFESATFYSLKGEVCFNMGQIVLAKKMLRKALKLLNRIFPYNLISLFLHIHVEKNRHFHYVNRQAQESPPPGKKRLAQLYRQTVCLSLLWRIYSYSYLFHCKYYAHLAVMMQMNTALETQNCFQIIKAYLDYSLYHHLAGYKGVWFKYEVMAMEHIFNLPLKGEGIEIVAYVAETLVFNKLIMGHLDLAIELGSRALQMWALLQNPNRHYQSLCRLSRCLLLNSRYPQLIQVLGRLWELSVTQEHIFSKAFFYFVCLDILLYSGFVYRTFEECLEFIHQYENNRILKFHSGLLLGLYSSVAIWYARLQEWDNFYKFSNRAKNLLPRRTMTLTYYDGISRYMEGQVLHLQKQIKEQSENAQASGEELLKNLENLVAQNTTGPVFCPRLYHLMAYVCILMGDGQKCGLFLNTALRLSETQGNILEKCWLNMNKESWYSTSELKEDQWLQTILSLPSWEKIVAGRVNIQDLQKNKFLMRANTVDNHF

SEQ ID NO: 63403 - protein, 1851 aa, Homo sapiens
MEKVVDIPCQAKGVPPPSITWYKDAAVVEVEKLTRFRQRNDGGLQISGLVPDDTGMFQCFARNAAGEVQTSTYLAVTSIAPNITRGPLDSTVIDGMSVVLACETSGAPRPAITWQKGERILASGSVQLPRFTPLESGSLLISPTHISDAGTYTCLATNSRGVDEASADLVVWARTRITKPPQDQSVIKGTQASMVCGVTHDPRVTIRYIWEKDGATLGTESHPRIRLDRNGSLHISQTWSGDIGTYTCRVISAGGNDSRSAHLRVRQLPHAPEHPVATLSTVERRAINLTWTKPFDGNSPLIRYILEMSENNAPWTVLLASVDPKATSVTVKGLVPARSYQFRLCAVNDVGKGQFSKDTERVSLPEEPPTAPPQNVIASGRTNQSIMIQWQPPPESHQNGILKGYIIRYCLAGLPVGYQFKNITDADVNNLLLEDLIIWTNYEIEVAAYNSAGLGVYSSKVTEWTLQGVPTVPPGNVHAEATNSTTIRFTWNAPSPQFINGINQGYKLIAWEPEQEEEVTMVTARPNFQDSIHVGFVSGLKKFTEYFTSVLCFTTPGDGPRSTPQLVRTHEDVPGPVGHLSFSEILDTSLKVSWQEPGEKNGILTGYRISWEEYNRTNTRVTHYLPNVTLEYRVTGLTALTTYTIEVAAMTSKGQGQVSASTISSGVPPELPGPPTNLGISNIGPRSVTLQFRPGYDGKTSISRWLVEAQVGVVGEGEEWLLIHQLSNEPDARSMEVPDLNPFTCYSFRMRQVNIVGTSPPSQPSRKIQTLQAPPDMAPANVSLRTASETSLWLRWMPLPEMEYNGNPESVGYKIKYSRSDGHGKTLSHVVQDRVERDYTIEDLEEWTEYRVQVQAFNAIGSGPWSQTVVGRTRESVPSSGPTNVSALATTSSSMLVRWSEVPEADRNGLVLGYKVMYKEKDSDTQPRFWLVEGNSSRSAQLTGLGKYVLYEVQVLAFTRIGDGSPSHPPILERTLDDVPGPPMGILFPEVRTTSVRLIWQPPAAPNGIILAYQITHRLNTTTANTATVEVLAPSARQYTATGLKPESVYLFRITAQTRKGWGEAAEALVVTTEKRDRPQPPSRPMVQQEDVRARSVLLSWEPGSDGLSPVRYYTIQTRELPSGRWALHSASVSHNASSFIVDRLKPFTSYKFRVKATNDIGDSEFSEESESLTTLQAAPDEAPTILSVTPHTTTSVLIRWQPPAEDKINGILLGFRIRYRELLYEGLRGFTLRGINNPGATWAELTSMYSMRNLSRPSLTQYELDNLNKHRRYEIRMSVYNAVGEGPSSPPQEVFVGEAVPTAAPRNVVVHGATATQLDVTWEPPPLDSQNGDIQGYKIYFWEAQRGNLTERVKTLFLAENSVKLKNLTGYTAYMVSVAAFNAAGDGPRSTPTQGQTQQAAPSAPSSVKFSELTTTSVNVSWEAPQFPNGILEGYRLVYEPCSPVDGVSKIVTVDVKGNSPLWLKVKDLAEGVTYRFRIRAKTFTYGPEIEANVTTGPGEGAPGPPGVPIIVRYSSAIAIHWSSGDPGKGPITRYVIEARPSDEGLWDILIKDIPKEVSSYTFSMDILKPGVSYDFRVIAVNDYGFGTPSSPSQSVPAQKANPFYEEWWFLVVIALVGLIFILLLVFVLIIRGQSKKYAKKTDSGNSAKSGALGHSEMMSLDESSFPALELNNRRLSVKNSFCRKNGLYTRSPPRPSPGSLHYSDEDVTKYNDLIPAESSSLTEKPSEISDSQGSDSEYEVDSNHQKAHSFVNHYISDPTYYNSWRRQQKGISRAQAYSYTESDSGEPDHTTVTNSTSTQQGSLFRPKASRTPTPQNPPNPPSQQSTLYRPPSSLAPGSRAPIAGFSSFV

SEQ ID NO: 63404 - protein, 654 aa, Homo sapiens
MSLAAYCVICCRRIGTSTSPPKSGTHWRDIRNIIKFTGSLILGGSLFLTYEVLALKKAVTLDTQVVEREKMKSYIYVHTVSLDKGENHGIAWQARKELHKAVRKVLATSAKILRNPFADPFSTVDIEDHECAVWLLLRKSKSDDKTTRLEAVREMSETHHWHDYQYRIIAQACDPKTLIGLARSEESDLRFFLLPPPLPSLKEDSSTEEELRQLLASLPQTELDECIQYFTSLALSESSQSLAAQKGGLWCFGGNGLPYAESFGEVPSATVEMFCLEAIVKHSEISTHCDKIEANGGLQLLQRLYRLHKDCPKVQRNIMRVIGNMALNEHLHSSIVRSGWVSIMAEAMKSPHIMESSHAARILANLDRETVQEKYQDGVYVLHPQYRTSQPIKADVLFIHGLMGAAFKTWRQQDSEQAVIEKPMEDEDRYTTCWPKTWLAKDCPALRIISVEYDTSLSDWRARCPMERKSIAFRSNELLRKLRAAGVGDRPVVWISHSMGGLLVKKMLLEASTKPEMSTVINNTRGIIFYSVPHHGSRLAEYTVNIRYLLFPSLEVKELSKDSPALKTLQDDFLEFAKDKNFQVLNFVETLPTYIGSMIKLHVVPVESADLGIGDLIPVDVNHLNICKPKKKDAFLYQRTLQFIREALAKDLEN

SEQ ID NO: 63405 - protein, 866 aa, Homo sapiens
MNGEQQLDADAGSGMEEVELSWEDYLEETGSTAVPYGSFKHVDTRLQNGFAPGMKLEVAVRTDPETYWVATVITTCEQLLLLRYDGYGEDRRADFWCDIRKADLYPIGWCEQNKKTLEAPEGIRDKVSDWDEFLRQTLIGACSPPVPLLEGLRNGRNPLDLIAPGSRLECQAFQDSLSTWIVTVVENIGGRLKLRYEGLESSDNYEHWLYYLDPFLHHVGWAAQQGYELQPPSAIRHLKNEAEWQEILAKVKEEEEEPLPSYLFKDKQVIGIHTFSVNMKLEAVDPWSPFGISPATVVKVFDEKYFLVEMDDLRPENHARRSFVCHADSPGIFPVQWSLKNGLHISPPPGYPSQDFDWADYLKQCGAEAAPQRCFPPLISEHEFKENMKLEAVNPILPEEVCVATITAVRGSYLWLQLEGSKKPIPECIVSVESMDIFPLGWCETNGHPLSTPRRARVYKQRKIAVVQPEKQVPSSRTVHEGLRNQELNSTESVMINGKYCCPKIYFNHRCFSGPYLNKGRIAELPQCVGPGNCVLVLREVLTLLINAAYKPSRVLRELQLDKDSVWHGCGEVLKAKYKGKSYRATVEIVKTADRVTEFCRQTCIKLECCPNLFGPRMVLDKCSENCSVLTKTKYTHYYGKKKNKRIGRPPGGHSNLACALKKASKRRKRRKNVFVHKKKRSSASVDNTPAGSPQGSGGEDEDDPDEGDDDSLSEGSTSEQQDELQEESEMSEKKSCSSSPTQSEISTSLPPDRQRRKRELRTFSFSDDENKPPSPKEIRIEVAERLHLDSNPLKWSVADVVRFIRSTDCAPLARIFLDQEIDGQALLLLTLPTVQECMDLKLGPAIKLCHHIERIKFAFYEQFAN

SEQ ID NO: 63406 - protein, 866 aa, Homo sapiens; identical to SEQ ID NO: 63405

SEQ ID NO: 63407 - protein, 866 aa, Homo sapiens; identical to SEQ ID NO: 63405

SEQ ID NO: 63408 - protein, 197 aa, Homo sapiens
MPIPASPLHPPLPSLLLYLLLELAGVTHVFHVQQTEMSQTVSTGESIILSCSVPDTLPNGPVLWFKGTGPNRKLIYNFKQGNFPRVKEIGDTTKPGNTDFSTRIREISLADAGTYYCVKFIKGRAIKEYQSGRGTQVFVTEQNPRPPKNRPAGRAGSRAHHDAHTCLSALPERNSTNYFVQPCCCLRLLGLTGLLSK

SEQ ID NO: 63409 - protein, 564 aa, Homo sapiens
MSSHGNSLFLRESGQRLGRVGWLQRLQESLQQRALRTRLRLQTMTLEHVLRFLRRNAFILLTVSAVVIGVSLAFALRPYQLTYRQIKYFSFPGELLMRMLQMLVLPLIVSSLVTGMASLDNKATGRMGMRAAVYYMVTTIIAVFIGILMVTIIHPGKGSKEGLHREGRIETIPTADAFMDLIRNMFPPNLVEACFKQFKTQYSTRVVTRTMVRTENGSEPGASMPPPFSVENGTSFLENVTRALGTLQEMLSFEETVPVPGSANGINALGLVVFSVAFGLVIGGMKHKGRVLRDFFDSLNEAIMRLVGIIIWYAPVGILFLIAGKILEMEDMAVLGGQLGMYTLTVIVGLFLHAGIVLPLIYFLVTHRNPFPFIGGMLQALITAMGTSSSSATLPITFRCLEEGLGVDRRITRFVLPVGATVNMDGTALYEALAAIFIAQVNNYELNLGQITTISITATAASVGAAGIPQAGLVTMVIVLTSVGLPTEDITLIIAVDWFLDRLRTMTNVLGDSIGAAVIEHLSQRELELQEAELTLPSLGKPYKSLMAQEKGASRGRGGNESAM

SEQ ID NO: 63410 - protein, 594 aa, Homo sapiens
MAGEENFKEELRSQDASRNLNQHEVAGHPHSWSLEMLLRRLRAVHTKQDDKFANLLDAVGEFGTFQQRLVALTFIPSIMSAFFMFADHFVFTAQKPYCNTSWILAVGPHLSKAEQLNLTIPQAPNGSFLTCFMYLPVPWNLDSTIQFGLNDTDTCQDGWIYPDAKKRSLINEFDLVCGMETKKDTAQIMFMAGLPIGSLIFRLITDKMGRYPAILLSLLGLIIFGFGTAFMNSFHLYLFFRFGISQSVVGYAISSISLATEWLVGEHRAHAIILGHCFFAVWAMLLTGIAYGLPHWQLLFLVGGILVIPFISYIWILPESPRWLMMKGKVKEAKQVLCYAASVNKKTIPSNLLDELQLPRKKVTRASVLDFCKNRQLCKVTLVMSCVWFTVSYTYFTLSLRMRELGVSVHFRHVVPSIMEVPARLCCIFLLQQIGRKWSLAVTLLQAIIWCLLLLFLPEGEDGLRLKWPRCPATELKSMTILVLMLREFSLAATVTVFFLYTAELLPTVLRATGLGLVSLASVAGAILSLTIISQTPSLLPIFLCCVLAIVAFSLSSLLPETRDQPLSESLNHSSQIRNKVKDMKTKETSSDDV

SEQ ID NO: 63411 - protein, 470 aa, Homo sapiens
MSLLGRDYNSELNSLDNGPQSPSESSSSITSENVHPAGEAGLSMMQTLIHLLKCNIGTGLLGLPLAIKNAGLLVGPVSLLAIGVLTVHCMVILLNCAQHLSQRLQKTFVNYGEATMYGLETCPNTWLRAHAVWGRYTVSFLLVITQLGFCSVYFMFMADNLQQMVEEAHVTSNICQPREILTLTPILDIRFYMLIILPFLILLVFIQNLKVLSVFSTLANITTLGSMALIFEYIMEGIPYPSNLPLMANWKTFLLFFGTAIFTFEGVGMVLPLKNQMKHPQQFSFVLYLGMSIVIILYILLGTLGYMKFGSDTQASITLNLPNCWLYQSVKLMYSIGIFFTYALQFHVPAEIIIPFAISQVSESWALFVDLSVRSALVCLTCVSAILIPRLDLVISLVGSVSSSALALIIPALLEIVIFYSEDMSCVTIAKDIMISIVGLLGCIFGTYQALYELPQPISHSMANSTGVHA

SEQ ID NO: 63412 - protein, 719 aa, Homo sapiens
MNDTEKPADTPSEEEDFGDPRTYDPDFKGPVANRSCTDVLCCMIFLLCIIGYIVLGLVAWVHGDPRRAAYPTDSQGHFCGQKGTPNENKTILFYFNLLRCTSPSVLLNLQCPTTQICVSKCPEKFLTYVEMQLLYTKDKSYWEDYRQFCKTTAKPVKSLTQLLLDDDCPTAIFPSKPFLQRCFPDFSTKNGTLTIGSKMMFQDGNGGTRSVVELGIAANGINKLLDAKSLGLKVFEDYARTWYWILIGLTIAMVLSWIFLILLRFIAGCLFWVFMIGVIGIIGYGIWHCYQQYTNLQERPSSVLTIYDIGIQTNISMYFELQQTWFTFMIILCIIEVIVILMLIFLRNRIRVAIILLKEGSKAIGYVPSTLVYPALTFILLSICICYWVVTAVFLATSGVPVYKVIAPGGHCIHENQTCDPEIFNTTEIAKACPGALCNFAFYGGKSLYHQYIPTFHVYNLFVFLWLINFVIALGQCALAGAFATYYWAMKKPDDIPRYPLFTAFGRAIRYHTGSLAFGSLIIALIQMFKIVLEYLDHRLKRTQNTLSKFLQCCLRCCFWCLENAIKFLNRNAYIMIAIYGRNFCRSAKDAFNLLMRNVLKVAVTDEVTYFVLFLGKLLVAGSIGVLAFLFFTQRLPVIAQGPASLYYYWVPLLTVIFGSYLIAHGFFSVYAMCVETIFICFCEDLERNDGSTEKPYFVTPNLHGILIKKQLVPQKQKE

SEQ ID NO: 63413 - protein, 80 aa, Homo sapiens
MKYPLMPLVNDLTFSFLVFWFCLPVGLLLLLIIWLRFLLSQDSEENDSSVCLDWEPWSKGPAEFCWKGTLHGQEKERPCW

SEQ ID NO: 63414 - protein, 116 aa, Homo sapiens
MCDQTKHSKCCPAKGNQCCPPQQNQCCQSKGNQCCPPKQNQCCQPKGSQCCPPKHNHCCQPKPPCCIQARCCGLETKPEVSPLNMESEPNSPQTQDKGCQTQQQPHSPQNESRPSK

SEQ ID NO: 63415 - protein, 446 aa, Homo sapiens
MRPVRENSSGARSPRVPADLARSILISLPFPPDSLAHRPPSSAPTESQGLFTVAAPAPGAPSPPATLAHLLPAPAMYSLLETELKNPVGTPTQAAGTGGPAAPGGAGKSSANAAGGANSGGGSSGGASGGGGGTDQDRVKRPMNAFMVWSRGQRRKMALENPKMHNSEISKRLGADWKLLTDAEKRPFIDEAKRLRAVHMKEYPDYKYRPRRKTKTLLKKDKYSLPSGLLPPGAAAAAAAAAAAAAAASSPVGVGQRLDTYTHVNGWANGAYSLVQEQLGYAQPPSMSSPPPPPALPPMHRYDMAGLQYSPMMPPGAQSYMNVAAAAAAASGYGGMAPSATAAAAAAYGQQPATAAAAAAAAAAMSLGPMGSVVKSEPSSPPPAIASHSQRACLGDLRDMISMYLPPGGDAADAASPLPGGRLHGVHQHYQGAGTAVNGTVPLTHI

SEQ ID NO: 63416 - protein, 501 aa, Homo sapiens
MERARPEPPPQPRPLRPAPPPLPVEGTSFWAAAMEPPPSSPTLSAAASATLASSCGEAVASGLQPAVRRLLQVKPEQVLLLPQPQAQNEEAAASSAQARLLQFRPDLRLLQPPTASDGATSRPELHPVQPLALHVKAKKQKLGPSLDQSVGPRGAVETGPRASRVVKLEGPGPALGYFRGDEKGKLEAEEVMRDSMQGGAGKSPAAIREGVIKTEEPERLLEDCRLGAEPASNGLVHGSAEVILAPTSGAFGPHQQDLRIPLTLHTVPPGARIQFQGAPPSELIRLTKVPLTPVPTKMQSLLEPSVKIETKDVPLTVLPSDAGIPDTPFSKDRNGHVKRPMNAFMVWARIHRPALAKANPAANNAEISVQLGLEWNKLSEEQKKPYYDEAQKIKEKHREEFPGWVYQPRPGKRKRFPLSVSNVFSGTTQNIISTNPTTVYPYRSPTYSVVIPSLQNPITHPVVHALTVGLPLAMEIFRVQCQNALVIMKTGTQNMRVSFQL

SEQ ID NO: 63417 - protein, 753 aa, Homo sapiens [sequence omitted]

SEQ ID NO: 63418 - protein, 294 aa, Homo sapiens
MSPRGTGCSAGLLMTVGWLLLAGLQSARGTNVTAAVQDAGLAHEGEGEEETENNDSETAENYAPPETEDVSNRNVVKEVEFGMCTVTCGIGVREVILTNGCPGGESKCVVRVEECRGPTDCGWGKPISESLESVRLACIHTSPLNRFKYMWKLLRQDQQSIILVNDSAILEVRKESHPLAFECDTLDNNEIVATIKFTVYTSSELQMRRSSLPATDAALIFVLTIGVIICVFIIFLLIFIIINWAAVKAFWGAKASTPEVQSEQSSVRYKDSTSLDQLPTEMPGEDDALSEWNE

SEQ ID NO: 63419 - protein, 215 aa, Homo sapiens [sequence omitted]

SEQ ID NO: 63420 - protein, 124 aa, Homo sapiens
MVLCWLLLLVMALPPGTTGVKDCVFCELTDSMQCPGTYMHCGDDEDCFTGHGVAPGTGPVINKGCLRATSCGLEEPVSYRGVTYSLTTNCCTGRLCNRAPSSQTVGATTSLALGLGMLLPPRLL

SEQ ID NO: 63421 - protein, 631 aa, Homo sapiens
MAAQRGMPSSAVRVLEEALGMGLTAAGDARDTADAVAAEGAYYLEQVTITEASEDDYEYEEIPDDNFSIPEGEEDLAKAIQMAQEQATDTEILERKTVLPSKHAVPEVIEDFLCNFLIKMGMTRTLDCFQSEWYELIQKGVTELRTVGNVPDVYTQIMLLENENKNLKKDLKHYKQAADKAREDLLKIQKERDFHRMHHKRIVQEKNKLINDLKGLKLHYASYEPTIRVLHEKHHTLLKEKMLTSLERDKVVGQISGLQETLKKLQRGHSYHGPQIKVDHSREKENAPEGPTQKGLREAREQNKCKTKMKGNTKDSEFPIDMQPNPNLNVSKESLSPAKFDYKLKNIFRLHELPVSCVSMQPHKDILVSCGEDRLWKVLGLPKCNVLLTGFGHTDWLSDCCFHPSGDKLATSSGDTTVKLWDLCKGDCILTFEGHSRAVWSCTWHSCGNFVASSSLDKTSKIWDVNSERCRCTLYGHTDSVNSIEFFPFSNTLLTSSADKTLSIWDARTGICEQSLYGHMHSINDAIFDPRGHMIASCDACGVTKLWDFRKLLPIVSIDIGPSPGNEVNFDSSGRVLAQASGNGVIHLLDLKSGEIHKLMGHENEAHTVVFSHDGEILFSGGSDGTVRTWS

SEQ ID NO: 63422 - protein, 509 aa, Homo sapiens
MSQRQVLQVFEQYQKARTQFVQMVAELATRPQNIETLQNAGVMSLLRTLLLDVVPTIQQTAALALGRLANYNDDLAEAVVKCDILPQLVYSLAEQNRFYKKAAAFVLRAVGKHSPQLAQAIVDCGALDTLVICLEDFDPGVKEAAAWALRYIARHNAELSQAVVDAGAVPLLVLCIQEPEIALKRIAASALSDIAKHSPELAQTVVDAGAVAHLAQMILNPDAKLKHQILSALSQVSKHSVDLAEMVVEAEIFPVVLTCLKDKDEYVKKNASTLIREIAKHTPELSQLVVNAGGVAAVIDCIGSCKGNTRLPGIMMLGYVAAHSENLAMAVIISKGVPQLSVCLSEEPEDHIKAAAAWALGQIGRHTPEHARAVAVTNTLPVLLSLYMSTESSEDLQVKSKKAIKNILQKCTYLPALEPFLYDAPPNILKHVVGQFSKVLPHDSKARRLFVTSGGLKKVQEIKAEPGSLLQEYINSINSCYPEEIVRYYSPGYSDTLLQRVDSYQPLNN

SEQ ID NO: 63423 - protein, 458 aa, Homo sapiens
MSQRQVLQVFEQYQKARTQFVQMVAELATRPQNIETLQNAGVMSLLRTLLLDVVPTIQQTAALALGRLANYNDDLAEAVVKCDILPQLVYSLAEQNRFYKKAAAFVLRAVGKHSPQLAQAIVDCGALDTLVICLEDFDPGVKEAAAWALRYIARHNAELSQAVVDAGAVPLLVLCIQEPEIALKRIAASALSDIAKHSPELAQTVVDAGAVAHLAQMILNPDAKLKHQILSALSQVSKHSVDLAEMVVEAEIFPVVLTCLKDKDEYVKKNASTLIREIAKHTPELSQLVVNAGGVAAVIDCIGSCKGNTRLPGIMMLGYVAAHSENLAMAVIISKGVPQLSVCLSEEPEDHIKAAAAWALGQIGRHTPEHARAVAVTNTLPVLLSLYMSTESSEDLQVKSKKAIKNILQKCTYLPALEPFLYDAPPNILKHVVGQFSKVLFPWIFRYTSAEGGQLSTT

SEQ ID NO: 63424 - protein, 509 aa, Homo sapiens
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 63425 - protein, 99 aa, Homo sapiens
MEEPTSSTNENKMKSPCESNKRKVDKKKKNLHRASAPEQSLKETEKAKYPTLVFYCRKNKKRNSNQLENNQPTESSTDPIKEKGDLDISAGSPQDGGQN

SEQ ID NO: 63426 - protein, 72 aa, Homo sapiens
MEKPTSSTNGEKRKSPCDSNSKNDEMQETPNRDLVLEPSLKKMKTSEYSTVLVLCYRKTKKIHSNQLENDQS

SEQ ID NO: 63427 - protein, 190 aa, Homo sapiens
MSSSALTCGSTLEKSGDTWEMKALDSSRLVPWPPRGLGSSTQHPNKPHCALASCQGPGVLPGAASALPELTFQGDVCQSETCQRYLQAAISLDIAVSQINLLGRPSSPPALLIQQGSCEQVIHNSTPQFLGMEDGDNERTTGWLWRLCEDIDAEPSSTGCSRSNQLTFTEGCFVRSLSTVYSNTHIHTHL

SEQ ID NO: 63428 - protein, 167 aa, Homo sapiens
MIITTWIVYILARKGVGLPFLPITSSDIDVVESEAVSVLHHWLKKTEEEASRGIKEKLSINHPSQGVREKMSTDSPPTHGQDIHVTRDVVKHHLSKSDLLANQSQEVLEERTRIQFIRWSHTRIFQVPSEMTEDIMRDRIEQVRRSISRLTDVSAQDFSMRPSSSDC

SEQ ID NO: 63429 - protein, 192 aa, Homo sapiens
MKKVKKKRSEARRHRDSTSQHASSNSTSQQPSPESTPQQPSPESTPQQPSPESTPQHSSLETTSRQPAFQALPAPEIRRSSCCLLSPDANVKAAPQSRKAGPLIRAGPHSCSCATCPCSSACWRRLGLCHSRIFDVLLPRDWQMAPGRGLPNLLTFYRKSSRKPSSHRNACPPSPRNCGCGSGGSRSCLLHH

SEQ ID NO: 63430 - protein, 305 aa, Homo sapiens
MAAAGQEKGYLTQTAAALDKSPSLSPQLAAPIRGRPKKCLVYPHAPKSSRLSRSVLRWLQGLDLSFFPRNINRDFSNGFLIAEIFCIYYPWELELSSFENGTSLKVKLDNWAQLEKFLARKKFKLPKELIHGTIHCKAGVPEILIEEVYTLLTHREIKSIQDDFVNFTDYSYQMRLPLVSRSTVSKSIKDNIRLSELLSNPNMLTNELKAEFLILLHMLQRKLGRKLNPEWFDVKPTVGEVTLNHLPAQASGRRYNLKVKRGRVVPVLPNIGSGGSSHREIHVKQAGQHSYYSAMKPIRNMDKKP

SEQ ID NO: 63431 - protein, 893 aa, Homo sapiens
MSSKKNRKRLNQSAENGSSLPSAASSCAEARAPSAGSDFAATSGTLTVTNLLEKVDDKIPKTFQNPLIHLGLNTMKSANICIGRPVLLTSLNGKQEVYTAWPMAGFPGGKVGLSEMAQKNVGVRPGDAIQVQPLVGAVLQAEEMDVALSDKDMEINEEELTGCILRKLDGKIVLPGNFLYCTFYGRPYKLQVLRVKGADGMILGGPQSDPDTDAQRMAFEQSSMETSSLELSLQLSQLDLEDTQIPTSRSTPYKPIDDRITNKASDVLLDVTQSPGDGSGLMLEEVTGLKCNFESAREGNEQLTEEERLLKFSIGAKCNTDTFYFISSTTRVNFTEIDKNSKEQDNQFKVTYDMIGGLSSQLKAIREIIELPLKQPELFKSYGIPAPRGVLLYGPPGTGKTMIARAVANEVGAYVSVINGPEIISKFYGETEAKLRQIFAEATLRHPSIIFIDELDALCPKREGAQNEVEKRVVASLLTLMDGIGSEVSEGQVLVLGATNRPHALDAALRRPGRFDKEIEIGVPNAQDRLDILQKLLRRVPHLLTEAELLQLANSAHGYVGADLKVLCNEAGLCALRRILKKQPNLPDVKVAGLVKITLKDFFQAMNDIRPSAMREIAIDVPNVSWSDIGGLESIKLKLEQAVEWPLKHPESFIRMGIQPPKGVLLYGPPGCSKTMIAKALANESGLNFLAIKGPELMNKYVGESERAVRETFRKARAVAPSIIFFDELDALAVERGSSLGAGNVADRVLAQLLTEMDGIEQLKDVTILAATNRPDRIDKALMRPGRIDRIIYVPLPDAATRREIFKLQFHSMPVSNEVDLDELILQTDAYSGAEIVAVCREAALLALEEGIQANLIMKRHFTQALSTVTPRIPESLRRFYEDYQEKSGLRTL

SEQ ID NO: 63432 - protein, 599 aa, Homo sapiens
MDGSRRVRATSVLPRYGPPCLFKGHLSTKSNAFCTDSSSLRLSTLQLVKNHMAVHYNKILSAKAAVDCSVPVSVSTSIKYADQQRREKLKKELAQCEKEFKLTKTAMRANYKNNSKSLFNTLQKPSGEPQIEDDMLKEEMNGFSSFARSLVPSSERLHLSLHKSSKVITNGPEKNSSSSPSSVDYAASGPRKLSSGALYGRRPRSTFPNSHRFQLVTSKAPSGDLLDKHSELFSNKQLPFTPRTLKTEAKSFLSQYRYYTPAKRKKDFTDQRIEAETQTELSFKSELGTAETKNMTDSEMNIKQASNCVTYDAKEKIAPLPLEGHDSTWDEIKDDALQHSSPRAMCQYSLKPPSTRKIYSDEEELLYLSFIEDVTDEILKLGLFSNRFLERLFERHIKQNKHLEEEKMRHLLHVLKVDLGCTSEENSVKQNDVDMLNVFDFEKAGNSEPNELKNESEVTIQQERQQYQKALDMLLSAPKDENEIFPSPTEFFMPIYKSKHSEGVIIQQVNDETNLETSTLDENHPSISDSLTDRETSVNVIEGDSDPEKVEISNGLCGLNTSPSQSVQFSSVKGDNNHDMELSTLKIMEMSIEDCPLDV

SEQ ID NO: 63433 - protein, 254 aa, Homo sapiens
MPIKPVGWICGQVLKNFSGRIEGIQKAIMDLVDEFKDEFPTILRLSQSNQKREPAQKTSKIRMAIALAKINRATLIRGLNSISRSSKSVAKLLHPQLACRLLELRDISGRLLREVNAPRQPLYNIQVRKGSLFEIISFPAKTALTSIIYASYAALIYLAVCVNAVLKKVKNIFQEEESIRQNREESENCRKAFSEPVLSEPMFAEGEIKAKPYRSLPEKPDISDYPKLLANKQSNNIQVLHSVFDQSAEMNEQI

SEQ ID NO: 63434 - protein, 500 aa, Homo sapiens
MALAPLAEMLTSLQPSATPGSLMSPLTGTLSTLLSGPAPTSQSSPLTSFLTSPIAGPLTGTLASSLGLPSTGTLTPSSLVAGPVAMSQSSPLIAPVMGTVAVSLSSPLLSSTATPPGVSQNLLANPMSNLVLPEAPRLRLAEPLRGGPTGPQSPACVVPTATTKVPLSTEPPQSTQDPEPLSMAFAGAPLQTSTPIGAMGTPAPKTAFSFNTSDTQAQPSAAQEQVVPASVPTSPTTSPTVTVLASAPALAPQVATSYTPSSTTHIAQGAPHPPSRMHNSPTQNLPVPHCPPHNAHSPPRTSSSPASVNDSRGPRTTEPSTKSMMEVERKLAHRKTSKFPENPRESKQLAWERLVGEIAFQLDRRILSSIFPERVRLYGFTASNIPEKIIQASLNPSDHKLDEKLCQRLTQRYVSVMNRLQSLGYNGRVHPALTEQLVNAYGILRERPELAASEGGPYTVDFLQRVVVETVHPGMLADALLLLSCLSQLAHDDGKPMFIW

SEQ ID NO: 63435 - protein, 300 aa, Homo sapiens
MSPSMLTGNSPRGCRLPSISSTTCGRQLEKVPEKRDSGMTEVERTYSANCSDFLESKGCFANTTPSGKSVSSSSSVETGPSVSEPPGLPRVSAYVDTTADLDRKLSFSHSDHSSEMSLPEVQKDKYPEEFSLLKLQTKDGHRPEWTFYPRFSSNIHTYHVGKQCFFNGVFLGNKRSLSERTVDKCFGRKKYDIDPRNGIPKLTPGDNPYMYPEQSKGFHKAGSMLPPVNFSIVPYEKKFDTFIPLEPLPQIPNLPFWVKEKANSLKNEIQEVEELDNWQPAVPLMHMLHLSGALDFPRQS

SEQ ID NO: 63436 - protein, 396 aa, Homo sapiens
MAFAPMGPEASFFDVLDRHRESLLAALRRGGREPPTGGSRLASSSEVLASIENIIQDIITSLARNEAPAFTIDNRSSWENIKFEDSVGLQMVSHCTTRKIKSDSPKSAQKFSLILKILSMIYKLVQSNTYATKRDIYYTDSQLFGNQTVVDNIINDISCMLKVSRRSLHILSTSKGLIAGNLRYIEEDGTKVNCTCGATAVAVPSNIQGIRNLVTDAKFVLIVEKDATFQRLLDDNFCNKLSPCIMITGKGVPDLNTRLLVKKLWDTFHVPVFTLVDADPHGIEIMCIYKYGSMSMSFEAHHLTVPAIRWLGLLPSDLKRLNVPKDSLIPLTKRDQMKLDSILRRPYVTCQPFWRKEMEIMADSKMKAEIQALTFLSSDYLSRVYLPNKLKFGGWI

SEQ ID NO: 63437 - protein, 358 aa, Homo sapiens
MAFAPMGPEASFFDVLDRHRESLLAALRRGGREPPTGGSRLASRFEDSVGLQMVSHCTTRKIKSDSPKSAQKFSLILKILSMIYKLVQSNTYATKRDIYYTDSQLFGNQTVVDNIINDISCMLKVSRRSLHILSTSKGLIAGNLRYIEEDGTKVNCTCGATAVAVPSNIQGIRNLVTDAKFVLIVEKDATFQRLLDDNFCNKLSPCIMITGKGVPDLNTRLLVKKLWDTFHVPVFTLVDADPHGIEIMCIYKYGSMSMSFEAHHLTVPAIRWLGLLPSDLKRLNVPKDSLIPLTKRDQMKLDSILRRPYVTCQPFWRKEMEIMADSKMKAEIQALTFLSSDYLSRVYLPNKLKFGGWI

SEQ ID NO: 63438 - protein, 430 aa, Homo sapiens
MASSAKSAEMPTISKTLNPTPDPHQEYLDPRITIALFEIGSHSPSSWGSLPFLKNSSHQVTEQQTAQKFNNLLKEIKDILKNMAGFEEKITEAKELFEETNITEDVSAHKENIRGLDKINEMLSTNLPVSLAPEKEDNEKKQEMILETNITEDVSAHKENIRGLDKINEMLSTNLPVSLAPEKEDNEKKQQMIMENQNSENTAQVFARDLVNRLEEKKVLNETQQSQEKAKNRLNVQEETMKIRNNMEQLLQEAEHWSKQHTELSKLIKSYQKSQKDISETLGNNGVGFQTQPNNEVSAKHELEEQVKKLSHDTYSLQLMAALLENECQILQQRVEILKELHHQKQGTLQEKPIQINYKQDKKNQKPSEAKKVEMYKQNKQAMKGTFWKKDRSCRSLDVCLNKKACNTQFNIHVARKALRGKMRSASSLR

SEQ ID NO: 63439 - protein, 223 aa, Homo sapiens
MNGDDAFARRPTVGAQIPEKIQKAFDDIAKYFSKEEWEKMKASEKIFYVYMKRKYEAMTKLGFKATLPPFMCNKRAEDFQGNDLDNDPNRGNQVERPQMTFGRLQGISPKIMPKKPAEEGNDSEEVPEASGPQNDGKELCPPGKPTTSEKIHERSGNREAQEKEERRGTAHRWSSQNTHNIGRFSLSTSMGAVHGTPKTITHNRDPKGGNMPGPTDCVRENSW

SEQ ID NO: 63440 - protein, 188 aa, Homo sapiens
MNGDDAFARRPTVGAQIPEKIQKAFDDIAKYFSKEEWEKMKASEKIFYVYMKRKYEAMTKLGFKATLPPFMCNKRAEDFQGNDLDNDPNRGNQVERPQMTFGRLQGISPKIMPKKPAEEGNDSEEVPEASGPQNDGKELCPPGKPTTSEKIHERSGPKRGEHAWTHRLRERKQLVIYEEISDPEEDDE

SEQ ID NO: 63441 - protein, 188 aa, Homo sapiens
MNGDDTFARRPTVGAQIPEKIQKAFDDIAKYFSKEEWEKMKVSEKIVYVYMKRKYEAMTKLGFKAILPSFMRNKRVTDFQGNDFDNDPNRGNQVQRPQMTFGRLQGIFPKIMPKKPAEEGNVSKEVPEASGPQNDGKQLCPPGKPTTSEKINMISGPKRGEHAWTHRLRERKQLVIYEEISDPEEDDE

SEQ ID NO: 63442 - protein, 188 aa, Homo sapiens; identical to SEQ ID NO: 63242

SEQ ID NO: 63443 - protein, 153 aa, Homo sapiens; identical to SEQ ID NO: 63243

SEQ ID NO: 63444 - protein, 188 aa, Homo sapiens; identical to SEQ ID NO: 63242

SEQ ID NO: 63445 - protein, 188 aa, Homo sapiens
MNGDDAFAKRPRDDAKASEKRSKAFDDIAKYFSKEEWEKMKFSEKISCVHMKRKYEAMTKLGFNVTLSLFMRNKRATDSQRNDSDNDRNRGNEVERPQMTFGRLQRIIPKIMPEKPAEEGSDSKGVPEASGPQNDGKKLCPPGKASSSEKIHERSGPKRGKHAWTHRLRERKQLVIYEEISDPEEDDK

SEQ ID NO: 63446 - protein, 1225 aa, Homo sapiens
MSSPLQRAVGDTKRALSASSSSSASLPFDDRDSNHTSEGNGDSLLADEDTDFEDSLNRNVKKRAAKRPPKTTPVAKHPKKGSRVVHRHSRKQSEPPANDLFNAVKAAKSDMQSLVDEWLDSYKQDQDAGFLELVNFFIQSCGCKGIVTPEMFKKMSNSEIIQHLTEQFNEDSGDYPLIAPGPSWKKFQGSFCEFVRTLVCQCQYSLLYDGFPMDDLISLLTGLSDSQVRAFRHTSTLAAMKLMTSLVKVALQLSVHQDNNQRQYEAERNKGPGQRAPERLESLLEKRKELQEHQEEIEGMMNALFRGVFVHRYRDVLPEIRAICIEEIGCWMQSYSTSFLTDSYLKYIGWTLHDKHREVRLKCVKALKGLYGNRDLTTRLELFTSRFKDRMVSMVMDREYDVAVEAVRLLILILKNMEGVLTDADCESVYPVVYASHRGLASAAGEFLYWKLFYPECEIRMMGGREQRQSPGAQRTFFQLLLSFFVESELHDHAAYLVDSLWDCAGARLKDWEGLTSLLLEKDQNLGDVQESTLIEILVSSARQASEGHPPVGRVTGRKGLTSKERKTQADDRVKLTEHLIPLLPQLLAKFSADAEKVTPLLQLLSCFDLHIYCTGRLEKHLELFLQQLQEVVVKHAEPAVLEAGAHALYLLCNPEFTFFSRADFARSQLVDLLTDRFQQELEELLQSSFLDEDEVYNLAATLKRLSAFYNTHDLTRWELYEPCCQLLQKAVDTGEVPHQVILPALTLVYFSILWTLTHISKSDASQKQLSSLRDRMVAFCELCQSCLSDVDTEIQEQAFVLLSDLLLIFSPQMIVGGRDFLRPLVFFPEATLQSELASFLMDHVFIQPGDLGSGDSQEDHLQIERLHQRRRLLAGFCKLLLYGVLEMDAASDVFKHYNKFYNDYGDIIKETLTRARQIDRSHCSRILLLSLKQLYTELLQEHGPQGLNELPAFIEMRDLARRFALSFGPQQLQNRDLVVMLHKEGIQFSLSELPPAGSSNQPPNLAFLELLSEFSPRLFHQDKQLLLSYLEKCLQHVSQAPGHPWGPVTTYCHSLSPVENTAETSPQVLPSSKRRRVEGPAKPNREDVSSSQEESLQLNSIPPTPTLTSTAVKSRQPLWGLKEMEEEDGSELDFAQGQPVAGTERSRFLGPQYFQTPHNPSGPGLGNQLMRLSLMEEDEEEELEIQDESNEERQDTDMQASSYSSTSERGLDLLDSTELDIEDF

SEQ ID NO: 63447 - protein, 433 aa, Homo sapiens
MEVVDPQQLGMFTEGELMSVGMDTFIHRIDSTEVIYQPRRKRAKLIGKYLMGDLLGEGSYGKVKEVLDSETLCRRAVKILKKKKLRRIPNGEANVKKEIQLLRRLRHKNVIQLVDVLYNEEKQKMYMVMEYCVCGMQEMLDSVPEKRFPVCQAHGYFCQLIDGLEYLHSQGIVHKDIKPGNLLLTTGGTLKISDLGVAEALHPFAADDTCRTSQGSPAFQPPEIANGLDTFSGFKVDIWSAGVTLYNITTGLYPFEGDNIYKLFENIGKGSYAIPGDCGPPLSDLLKGMLEYEPAKRFSIRQIRQHSWFRKKHPPAEAPVPIPPSPDTKDRWRSMTVVPYLEDLHGADEDEDLFDIEDDIIYTQDFTVPGQVPEEEASHNGQRRGLPKAVCMNGTEAAQLSTKSRAEGRAPNPARKACSASSKIRRLSACKQQ

SEQ ID NO: 63448 - protein, 282 aa, Homo sapiens
MEMVQKLQKVGSLEPRVEVLINRINEVQQAKKKANKDLGEARTICEALQKELDSLHGEKVHLKEILSKKQETLRILRLHCQEKESEAHRKHTMLQECKERISALNLQIEEEKNKQRQLRLAFEEQLEDLMGQHKDLWDFHMPERLAKEICALDSSKEQLLKEEKLVKATLEDVKHQLCSLCGAEGPSTLDEGLFLRSQEAAATVQLFQEEHRKAEELLAAAAQRHQQLQQKCQQQQQKRQRLKEELEKHGMQVPAQAQSTQEEEAGPGDVAPRPGRPVTWWS

SEQ ID NO: 63449 - protein, 190 aa, Homo sapiens
MLQECKERISALNLQIEEEKNKQRQLRLAFEEQLEDLMGQHKDLWDFHMPERLAKEICALDSSKEQLLKEEKLVKATLEDVKHQLCSLCGAEGPSTLDEGLFLRSQEAAATVQLFQEEHRKAEELLAAAAQRHQQLQQKCQQQQQKRQRLKEELEKHGMQVPAQAQSTQEEEAGPGDVAPRPGRPVTWWS

SEQ ID NO: 63450 - protein, 234 aa, Homo sapiens
MHIPKSLQELANSEAVQFLRRPKTITRVFEGVFSLIVFSSLLTDGYQNKMESPQLHCILNSNSVACSFAVGAGFLAFLSCLAFLVLDTQETRIAGTRFKTAFQLLDFILAVLWAVVWFMGFCFLANQWQHSPPKEFLLGSSSAQAAIAFTFFSILVWIFQAYLAFQDLRNDAPVPYKRFLDEGGMVLTTLPLPSANSPVNMPTTGPNSLSYASSALSPCLTAPKSPRLAMMPDN

SEQ ID NO: 63451 - protein, 299 aa, Homo sapiens
MLESHLIIYFLLAVIQFLLGIFTNGIIVVVNGIDLIKHRKMAPLDLLLSCLAVSRIFLQLFIFYVNVIVIFFIEFIMCSANCAILLFINELELWLATWLGVFYCAKVASVRHPLFIWLKMRISKLVPWMILGSLLYVSMICVFHSKYAGFMVPYFLRKFFSQNATIQKEDTLAIQIFSFVAEFSVPLLIFLFAVLLLIFSLGRHTRQMRNTVAGSRVPGRGAPISALLSILSFLILYFSHCMIKVFLSSLKFHIRRFIFLFFILVIGIYPSGHSLILILGNPKLKQNAKKFLLHSKCCQ

SEQ ID NO: 63452 - protein, 520 aa, Homo sapiens
MALSSRARAFSVEALVGRPSKRKLQDPIQAEQPELREKKGGEEEEERRSSAAGKSEPLEKQPKTEPSTSASSGCGSDSGYGNSSESLEEKDIQMELQGSELWKRFHDIGTEMIITKAGRRMFPSVRVKVKGLDPGKQYHVAIDVVPVDSKRYRYVYHSSQWMVAGNTDHLCIIPRFYVHPDSPCSGETWMRQIISFDRMKLTNNEMDDKGHIILQSMHKYKPRVHVIEQGSSVDLSQIQSLPTEGVKTFSFKETEFTTVTAYQNQQITKLKIERNPFAKGFRDTGRNRGVLDGLLETYPWRPSFTLDFKTFGADTQSGSSGSSPVTSSGGAPSPLNSLLSPLCFSPMFHLPTSSLGMPCPEAYLPNVNLPLCYKICPTNFWQQQPLVLPAPERLASSNSSQSLAPLMMEVPMLSSLGVTNSKSGSSEDSSDQYLQAPNSTNQMLYGLQSPGNIFLPNSITPEALSCSFHPSYDFYRYNFSMPSRLISGSNHLKVNDDSQVSFGEGKCNHVHWYPAINHYL

SEQ ID NO: 63453 - protein, 401 aa, Homo sapiens
MSSKIIGINGDFFANMVVDAVLAIKYTDIRGQPRYPVNSVNILKAHGRSQMESMLISGYALNCVVGSQGMPKRIVNAKIACLDFSLQKTKMKLGVQVVITDPEKLDQIRQRESDITKERIQKILATGANVILTTGGIDDMCLKYFVEAGAMAVRRVLKRDLKRIAKASGATILSTLANLEGEETFEAAMLGQAEEVVQERICDDELILIKNTKARTSASIILRGANDFMCDEMERSLHDALCVVKRVLESKSVVPGGGAVEAALSIYLENYATSMGSREQLAIAEFARSLLVIPNTLAVNAAQDSTDLVAKLRAFHNEAQVNPERKNLKWIGLDLSNGKPRDNKQAGVFEPTIVKVKSLKFATEAAITILRIDDLIKLHPESKDDKHGSYEDAVHSGALND

SEQ ID NO: 63454 - protein, 556 aa, Homo sapiens
MEGPLSVFGDRSTGETIRSQNVMAAASIANIVKSSLGPVGLDKMLVDDIGDVTITNDGATILKLLEVEHPAAKVLCELADLQDKEVGDGTTSVVIIAAELLKNADELVKQKIHPTSVISGYRLACKEAVRYINENLIVNTDELGRDCLINAAKTSMSSKIIGINGDFFANMVVDAVLAIKYTDIRGQPRYPVNSVNILKAHGRSQMESMLISGYALNCVVGSQGMPKRIVNAKIACLDFSLQKTKMKLGVQVVITDPEKLDQIRQRESDITKERIQKILATGANVILTTGGIDDMCLKYFVEAGAMAVRRVLKRDLKRIAKASGATILSTLANLEGEETFEAAMLGQAEEVVQERICDDELILIKNTKARTSASIILRGANDFMCDEMERSLHDALCVVKRVLESKSVVPGGGAVEAALSIYLENYATSMGSREQLAIAEFARSLLVIPNTLAVNAAQDSTDLVAKLRAFHNEAQVNPERKNLKWIGLDLSNGKPRDNKQAGVFEPTIVKVKSLKFATEAAITILRIDDLIKLHPESKDDKHGSYEDAVHSGALND

SEQ ID NO: 63455 - protein, 198 aa, Homo sapiens
MEKRGRGVKSSPIQTPNQTPQQAPVTPRKERRPSMFEKEAYTQILRERLRESIHNVQYVEPPFDDSIADIGKEWKSALAKLKFANSYRMEPLKKFQAHSVETKVQQILTESLKDVKYDDKVFSHLSLELADRILLAVKEFGYHRYKFIIKVLFIQKTGQAINIASRWIWDIAWDSWVAAKHEAESYVALVLVFALYYE

SEQ ID NO: 63456 - protein, 770 aa, Homo sapiens
MTTTSINDQLVKEGLASYEIGYILKDNSQKHIEVWDPSPEEIISNEVHNLNPVSAKSLPNENFQSLYNKELPVHICNVISPEKIYVQWLLTENLLNSLEEKMIAAYENSKWEPVKWENDMHCAVKIQDKNQWRRGQIIRMVTDTLVEVLLYDVGVELVVNVDCLRKLEENLKTMGRLSLECSLVDIRPAGGSDKWTATACDCLSLYLTGAVATIILQVDSEENNTTWPLPVKIFCRDEKGERVDVSKYLIKKGLALRERRINNLDNSHSLSEKSLEVPLEQEDSVVTNCIKTNFDPDKKTADIISEQKVSEFQEKILEPRTTRGYKPPAIPNMNVFEATVSCVGDDGTIFVVPKLSEFELIKMTNEIQSNLKCLGLLEPYFWKKGEACAVRGSDTLWYRGKVMEVVGGAVRVQYLDHGFTEKIPQCHLYPILLYPDIPQFCIPCQLHNTTPVGNVWQPDAIEVLQQLLSKRQELPKNPWEKLSIHLYFDGMSLSYFMAYYKYCTSEHTEEMLKEKPRSDHDKKYEEKQWEIRFEELLSAETDTPLLPPYLSSSLPSPGELYAVQVKHVVSPNEVYICLDSIETSNQSNQHSDTDDSGVSGESESESLDEALQRVNKKVEALPPLTDFRTEMPCLAEYDDGLWYRAKIVAIKEFNPLSILVQFVDYGSTAKLTLNRLCQIPSHLMRYPARAIKVLLAGFKPPLRDLGETRIPYCPKWSMEALWAMIDCLQGKQLYAVSMAPAPEQIVTLYDDEQHPVHMPLVEMGLADKDE

SEQ ID NO: 63457 - protein, 981 aa, Homo sapiens
MSEQERIQECLRKEIRSLLISTKDGLSPQELEKEYLLMVGNHLPLRILGYRSTMELVLDMPDVVRVCPGAGGTVILKAIPDESTKGIASLVAKQRSSHKLRNSMHKGRPSIYSGPRSHRRVPYRGRVAPILPAVVKSELKDLLALSPVLLSDFEKAFAKRFGRSFQYMQYGFLSMFEVLNAASDVISVEQTRAGSLLMLKKSVTEEKPRGCPAGKIFTQPFRMKQGSYSTGFPVAKPCFSQPTSNMEPPKQIMSMEKTSKLNVVETSRLNHTEKLNQLENTFKSVIAQIGPGGTISSELKHKIKFVVSKFPEGLFISKLLGEYEVIFKEQLSPKKLGFLNVTELVGALSDILHVEFRKGHQDLLVFDADKKPLPPVQSDKKIEAKACVSSPPRNSLSTAAVKETVWNCPSKKQKEPQQKICKKPNLVVKPLQLQVETNKSELNLAMANHDIPPDAVPNKKLCRLPPLDTSSLIGVFVEYIISPSQFYIRIYSRDSSELLEDMMIEMRRCYSNQLVSDRYVMPECFIQPGHLCCVRISEDKWWYRVIIHRVLEKQEVEVFYPDFGNIGIVQKSSLRFLKCCYTKLPAQAIPCSLAWVRPVEEHWTSKAILQFQKLCGLKPLVGVVDEYVDGILNIFLCDTSSNEDVYFHHVLRTEGHAIVCRENISSKGFSELNPLALYTTSSGGPEDIVLTELGYPSQQHYFNEDRKISPQSKESELRILDEIPTGMPCLESVTIGDDIWDENWLPLQAKMGKGGDAASHLFTASLGGKNQYSSCKEMPQKDWCFSTPKDTWDDSWQPSGLVNGTKVEVHKPEVLGAQEKNTGTNRTQKQLDINGSSDSSTLPKLEEFCTSLTQSEQSADGSQSEPNNSQTQPKQIQLSTAAPCSTTAVDDSAEKPSGSVESSPEILKNEDFSSSRAITLYKDKRQESVDQLSLILSYECQISQKLYIPRSTATAALGAAARLATSRSLLHWYPSVKRMEA

SEQ ID NO: 63458 - protein, 430 aa, Homo sapiens
MATLSVKPSRRFQLPDWHTNSYLLSTNAQLQRDASHQIRQEARVLRNETNNQTIWDEHDNRTRLVERIDTVNRWKEMLDKCLTDLDAEIDALTQMKESAEQNLQAKNLPLDVAIECLTLRESRRDIDVVKDPVEDELHKEVEVIEATKKALQQKVSQAFEQLCLLQEVQQQLNSDHRGKMETLEIDRGCLSLNLRSPNISLKVDPTRVPDGSTTLQQWDDFSRFNKDRAEAEMKAATELREATALTIAETNNELEAQRVATEFAFRKRLREMEKVYSELKWQEKNTLEEIAELQEDIRHLEEDLRTKLLSLKLSHTRLEARTYRPNVELCRDQAQYGLTDEVHQLEATIAALKQKLAQAQDALDALCKHLARLQADIACKANSMLLDTKCMDTRRKLTVPAERFVPEVDTFTRTTNSTLSPLKSCQLELA

SEQ ID NO: 63459 - protein, 490 aa, Homo sapiens
MERVGCTLTTTYAHPRPTPTNFLPAISTMASSYRDRFPHSNLTHSLSLPWRPSTYYKVASNSPSVAPYCTRSQRVSENTMLPFVSNRTTFFTRYTPDDWYRSNLTNYQESNTSRHNSEKLRVDTSRLIQDKYQQTRKTQADTTQNLGERVNDIGFWKSEIIHELDEMIGETNALTDVKKRLERALMETEAPLQVARECLFHREKRMGIDLVHDEVEAQLLTEVDTILCCQERMKLHLDKAIAQLAANRASQHELEKDLSDKQTAYRIDDKCHHLRNTSDGVGYFRGVERVDATVSVPESWAKFTDDNILRSQSERAASAKLRDDIENLLVVTANEMWNQFNKVNLSFTNRIAETADAKNKIQTHLAKTLQEIFQTEMTIESIKKAIKDKTAFLKVAQTRLDERTRRPNIELCRDMAQLRLVNEVHEVDDTIQTLQQRLRDAEDTLQSLVHIKATLEYDLAVKANSLYIDQEKCMSMRKSYPNTLRLVGFC

SEQ ID NO: 63460 - protein, 267 aa, Homo sapiens
MGARQIQTSSSQTSPEEAMGTPRIQHLLILLVLGASLLTSGLELYCQKGLSMTVEADPANMFNWTTEEVETCDKGALCQETILIIKAGTETAILATKGCIPEGEEAITIVQHSSPPGLIVTSYSNYCEDSFCNDKDSLSQFWEFSETTASTVSTTLHCPTCVALGTCFSAPSLPYPNGTTRCYQGKLEITGGGIESSVEVKGCTAMIGCRLMSGILAVGPMFVREACPHQLLTQPRKTENGATCLPIPVWGLQLLLPLLLPSFIHFS

SEQ ID NO: 63461 - protein, 2789 aa, Homo sapiens
MPSDAKDSVNGDLLLNWTSLKNILSGLNASFPLHNNTGSSTVTTSKSIKDPRLMRREESMGEQSSTAGLNEVLQFEKSSDNVNSEIKSTPSNSASSSEVVPGDRAVLTNGLDTPCFKTSVNDSQSWAHNMGSEDYDCIPPNKVTMAGQCKDQGNFSFPISVSNVVSEVENQNHSEEKAQRAQQESGNAYTKEYSSHIFQDSQSSDLKTIYQTGCQTSTVFPLKKKVSIDEYLQNTGKMKNFADLEDSSKHEEKQTSWKEIDNDFTNETKISPIDNYIVLHQEYKESESHNSFGKSCDKILITQELEITKSSTSTIKDKDELDHLALEWQITPSFESLSQKHPQHSVEYEGNIHTSLAIAQKLMELKLGKINQNYASIITEAFPKPKDIPQAKEMFIDTVISSYNIETAHDSSNCSITREHICVHRKNENEPVSLENIQRDYKETAYVEDRGQDHNLFCNSQLSNDIWLNVNFKKQTDRENQNEAKENSASCVENNIENIYGDKKQDSHTNENFSNIDEKEDKNYHNIEILSSEEFSTKFNLICREDNAVSAATALLESEEDTISAVKQKDTENTGRSVEHLASTTFPKTASSSVCVASNAAIQIASATMPALSLNNDDHQIYQFKETCSSESPDFGLLVKHRVSDCEIDTDKNKSQESFHQSINENLVLQSIELESEIEIELEDCDDAFIFQQDTHSHENMLCEEFVTSYKALKSRISWEGLLALDNGEMEVLESTTGRENSDQHYSKESNYFYSSTQNNETELTSPILLPDLQIKITNIFRPGFSPTADSLALKDSFCTHVTEATKPEINKEDGEILGFDIYSQPFGENADYPCEDKVDNIRQESGPVSNSEISLSFDLSRNTDVNHTSENQNSESLFTEPSNVTTIDDGSRCFFTKSKTDYNDTKNKKEVESRISKRKLHISSRDQNIPHKDLRRHKIYGRKRRLTSQDSSECFSSLSQGRIKTFSQSEKHIKSVLNILSDEASLCKSKCLSRKLDKAVVHLKKAHRRVHTSLQLITKVGEERKGPLPKSYAVICNNFWESCDLQGYSSVSQRKYYSTKHFSSKRKYDKRRKKRAPKADISKSLTHVSKHKSYKTSGEKKCLSRKSMASSVSKSHPTTSHMGEFCNQEHPESQLPVSSTSQSTSQSVYYNSSVSNPSLSEEHQPFSGKTAYLFSPDHSDEKLIEKENQIDTAFLSSTSKYEKLEKHSANHNVKDATKENSCDANEVINESNSVSLSCIKENINSSTGNDCDATCIGHTKAKTDVLISVLDSNVKHFLNDLYQQGNLILSDCKRNLEVKWTDPIERPKQSIITGNFLMGPLNLTLIASKKYSIPQVSAAAVTDSEGESSKSYLDKQRILTVDSFAASSTVPHCEQSCREKELLKTEQCSSGNCLHTDGNETNVTENYELDVASGTEEDKSYGENIVELSSSDSSLLLRDNVKGSSSETCIVKKDTEDRITWKVKQAEKAKDSVYKRSMTEGSTVNTEYKNQKNQISEESCLNEKIITTNLIDSHLSTKNTTTESVPLKNTVSNPLNKREKKGEIKVSKDSQSDLTLHSEIAYISKPGILGVNHTPILPAHSETCKVPTLLKKPASYVSDFKEKHCSANHTALIANLSQILQRADEASSLQILQEETKVCLNILPLFVEAFERKQECSVEQILISRELLVDQNLWNNCKHTLKPCAVDTLVELQMMMETIQFIENKKRHLEGEPTLRSLLWYDETLYAELLGKPRGFQQQSNFYPGFQGRLKYNAFCELQTYHDQLVELLEETKREKNSYYVFLKYKRQVNECEAIMEHCSDCFDFSLSVPFTCGVNFGDSLEDLEILRKSTLKLINVCGDSPKVHSYPGKQDHLWIIIEMISSKVNFIKNNEAVRVKISLYGLEHIFFDAAKNLVWKERTQSFSKKYSQKKDEERLLRVNKCAFSKLQKIYDTLSKDLNNEPISPIGLEEDTIIASRKSDHPINEATISIENSKFNSNLLAHPDICCISEILDQAEFADLKKLQDLTLRCTDHLEILKKYFQMLQDNNMDNIFITEENVLDVVINHSHEAIILKPEAIEMYIEIVMVSETIHFLKNSIAKKLDKQRFRGMLWFDLSLLPELVQCQEKMASFSFLKDNSTDVCLWKVIETAVSELKKDLDIICKYNEAVNCSYAIHLLSRELQELSEIKKLLKKSKYFISTYIDFVPYIASINYGSTVTELEYNYNQFSTLLKNVMSAPRKDLGKMAHIRKVMKTIEHMKMICTKNAELTISFFLCQMLYNRRKILQLKRKEKMNIHIVKPGENNNKFSISTMLPPVSECINKNISNSSKKRPSTVDKCEDSQEQQQDTTVSSCKKLKVDMKDVTKINREKATFKHPRTTGSHPKSENKIVPSSCDSLKRNHLTPKKVEMQRSLPGSLLPLENPKDTCASKSESKIDLTVSSDHFSGQQENLNSMKKRNVNFSAAETKSDKKDCAAFAICDQKSVHGTFSPDHGTLLQKFLKNSPDPTQKSCLSDINPETDVSLVPDASVLSKPIFCFVKDVHPDLEMNDTVFELQDNDIVNSSIKNSSCMTSPEPICIQNKIPTLQINKLQPTETESEDKYMKDTLNPNTVHTFGASGHITLNVNQGAEYSLSEQQNDKNSKVLMQNAATYWNELPQSACNPTYNSSEHLFGTSYPYSAWCVYQYSNSNGNAITQTYQGITSYEVQPSPSGLLTTVASTAQGTHSNLLYSQYFTYFAGEPQANGFVPVNGYFQSQIPASNFRQPIFSQYASHQPLPQATYPYLPNRFVPPEVPWVYAPWHQESFHPGH

SEQ ID NO: 63462 - protein, 851 aa, Homo sapiens
MTSHYVIAIFALMSSCLATAGPEPGALCELSPVSASHPVQALMESFTVLSGCASRGTTGLPQEVHVLNLRTAGQGPGQLQREVTLHLNPISSVHIHHKSVVFLLNSPHPLVWHLKTERLATGVSRLFLVSEGSVVQFSSANFSLTAETEERNFPHGNEHLLNWARKEYGAVTSFTELKIARNIYIKVGEDQVFPPKCNIGKNFLSLNYLAEYLQPKAAEGCVMSSQPQNEEVHIIELITPNSNPYSAFQVDITIDIRPSQEDLEVVKNLILILKCKKSVNWVIKSFDVKGSLKIIAPNSIGFGKESERSMTMTKSIRDDIPSTQGNLVKWALDNGYSPITSYTMAPVANRFHLRLENNAEEMGDEEVHTIPPELRILLDPGALPALQNPPIRGGEGQNGGLPFPFPDISRRVWNEEGEDGLPRPKDPVIPSIQLFPGLREPEEVQGSVDIALSVKCDNEKMIVAVEKDSFQASGYSGMDVTLLDPTCKAKMNGTHFVLESPLNGCGTRPRWSALDGVVYYNSIVIQVPALGDSSGWPDGYEDLESGDNGFPGDMDEGDASLFTRPEIVVFNCSLQQVRNPSSFQEQPHGNITFNMELYNTDLFLVPSQGVFSVPENGHVYVEVSVTKAEQELGFAIQTCFISPYSNPDRMSHYTIIENICPKDESVKFYSPKRVHFPIPQADMDKKRFSFVFKPVFNTSLLFLQCELTLCTKMEKHPQKLPKCVPPDEACTSLDASIIWAMMQNKKTFTKPLAVIHHEAESKEKGPSMKEPNPISPPIFHGLDTLTVMGIAFAAFVIGALLTGALWYIYSHTGETAGRQQVPTSPPASENSSAAHSIGSTQSTPCSSSSTA

SEQ ID NO: 63463 - protein, 903 aa, Homo sapiens
MTRSCSAVGCSTRDTVLSRERGLSFHQFPTDTIQRSKWIRAVNRVDPRSKKIWIPGPGAILCSKHFQESDFESYGIRRKLKKGAVPSVSLYKIPQGVHLKGKARQKILKQPLPDNSQEVATEDHNYSLKTPLTIGAEKLAEVQQMLQVSKKRLISVKNYRMIKKRKGLRLIDALVEEKLLSEETECLLRAQFSDFKWELYNWRETDEYSAEMKQFACTLYLCSSKVYDYVRKILKLPHSSILRTWLSKCQPSPGFNSNIFSFLQRRVENGDQLYQYCSLLIKSIPLKQQLQWDPSSHSLQGFMDFGLGKLDADETPLASETVLLMAVGIFGHWRTPLGYFFVNRASGYLQAQLLRLTIGKLSDIGITVLAVTSDATAHSVQMAKALGIHIDGDDMKCTFQHPSSSSQQIAYFFDSCHLLRLIRNAFQNFQSIQFINGIAHWQHLVELVALEEQELSNMERIPSTLANLKNHVLKVNSATQLFSESVASALEYLLSLDLPPFQNCIGTIHFLRLINNLFDIFNSRNCYGKGLKGPLLPETYSKINHVLIEAKTIFVTLSDTSNNQIIKGKQKLGFLGFLLNAESLKWLYQNYVFPKVMPFPYLLTYKFSHDHLELFLKMLRQVLVTSSSPTCMAFQKAYYNLETRYKFQDEVFLSKVSIFDISIARRKDLALWTVQRQYGVSVTKTVFHEEGICQDWSHCSLSEALLDLSDHRRNLICYAGYVANKLSALLTCEDCITALYASDLKASKIGSLLFVKKKNGLHFPSESLCRVINICERVVRTHSRMAIFELVSKQRELYLQQKILCELSGHIDLFVDVNKHLFDGEVCAINHFVKLLKDIIICFLNIRAKNVAQNPLKHHSERTDMKTLSRKHWSPVQDYKCSSFANTSSKFRHLLSNDGYPFK

SEQ ID NO: 63464 - protein, 596 aa, Homo sapiens
MADAEARAEFPEEARPDRGTLQVFQDMASRLRIHSIRATCSTSSGHPTSCSSSSEIMSVLFFYIMRYKQSDPENPDNDRFVLAKRLSFVDVATGWLGQGLGVACGMAYTGKYFDRASYRVFCLMSDGESSEGSVWEAMAFASYYSLDNLVATFDVNRLGHSGALPAEHCINIYQRRCEAFGWNTYVVDGRDVEALCQVFWQASQVKHKPTAVVAKTFKGRGTPSIEDAESWHAKPMPRERADAIIKLIESQIQTSRNLDPQPPIEDSPEVNITDVRMTSPPDYRVGDKIATRKACGLALAKLGYANNRVVVLDGDTRYSTFSEIFNKEYPERFIECFMAEQNMVSVALGCASRGRTIAFASTFAAFLTRAFDHIRIGGLAESNINIIGSHCGVSVGDDGASQMALEDIAMFRTIPKCTIFYPTDAVSTEHAVALAANAKGMCFIRTTRPETMVIYTPQERFEIGQAKVLRHCVSDKVTVIGAGITVYEALAAADELSKQDIFIRVIDLFTIKPLDVATIVSSAKATEGRIITVEDHYPQGGIGEAVCAAVSMDPDIQVHSLAVSGVPQSGKSEELLDMYGISARHIIVAVKCMLLN

SEQ ID NO: 63465 - protein, 158 aa, Homo sapiens
MALEVLMLLAVLIWTGAENLHVKISCSLDWLMVSVIPVAESRNLYIFADELHLGMGCPANRIHTYVYEFIYLVRDCGIRTRVVSEETLLFQTELYFTPRNIDHDPQEIHLECSTSRKSVWLTPVSTENEIKLDPSPFIADFQTTAEELGLLSSSPNLL

SEQ ID NO: 63466 - protein, 159 aa, Homo sapiens
MLHVLASLPLLLLLVTSASTHAWSRPLWYQVGLDLQPWGCQPKSVEGCRGGLSCPGYWLGPGASRIYPVAAVMITTTMLMICRKILQGRRRSQATKGEHPQVTTEPCGPWKRRAPISDHTLLRGVLHMLDALLVHIEGHLRHLATQRQIQIKGTSTQSG

SEQ ID NO: 63467 - protein, 186 aa, Homo sapiens
MDTFSTKSLALQAQKKLLSKMASKAVVAVLVDDTSSEVLDELYRATREFTRSRKEAQKMLKNLVKVALKLGLLLRGDQLGGEELALLRRFRHRARCLAMTAVSFHQVDFTFDRRVLAVGLLECRDLLHQAVGPHLTAKSHGRINHVFGHLADCDFLAALYGPAEPYRSHLRRICEGLGRMLDEGSL

SEQ ID NO: 63468 - protein, 1299 aa, Homo sapiens
MAAETQTLNFGPEWLRALSSGGSITSPPLSPALPKYKLADYRYGREEMLALFLKDNKIPSDLLDKEFLPILQEEPLPPLALVPFTEEEQRNFSMSVNSAAVLRLTGRGGGGTVVGAPRGRSSSRGRGRGRGECGFYQRSFDEVEGVFGRGGGREMHRSQSWEERGDRRFEKPGRKDVGRPNFEEGGPTSVGRKHEFIRSESENWRIFREEQNGEDEDGGWRLAGSRRDGERWRPHSPDGPRSAGWREHMERRRRFEFDFRDRDDERGYRRVRSGSGSIDDDRDSLPEWCLEDAEEEMGTFDSSGAFLSLKKVQKEPIPEEQEMDFRPVDEGEECSDSEGSHNEEAKEPDKTNKKEGEKTDRVGVEASEETPQTSSSSARPGTPSDHQSQEASQFERKDEPKTEQTEKAEEETRMENSLPAKVPSRGDEMVADVQQPLSQIPSDTASPLLILPPPVPNPSPTLRPVETPVVGAPGMGSVSTEPDDEEGLKHLEQQAEKMVAYLQDSALDDERLASKLQEHRAKGVSIPLMHEAMQKWYYKDPQGEIQGPFNNQEMAEWFQAGYFTMSLLVKRACDESFQPLGDIMKMWGRVPFSPGPAPPPHMGELDQERLTRQQELTALYQMQHLQYQQFLIQQQYAQVLAQQQKAALSSQQQQQLALLLQQFQTLKMRISDQNIIPSVTRSVSVPDTGSIWELQPTASQPTVWEGGSVWDLPLDTTTPGPALEQLQQLEKAKAAKLEQERREAEMRAKREEEERKRQEELRRQQEEILRRQQEEERKRREEEELARRKQEEALRRQREQEIALRRQREEEERQQQEEALRRLEERRREEEERRKQEELLRKQEEEAAKWAREEEEAQRRLEENRLRMEEEAARLRHEEEERKRKELEVQRQKELMRQRQQQQEALRRLQQQQQQQQLAQMKLPSSSTWGQQSNTTACQSQATLSLAEIQKLEEERERQLREEQRRQQRELMKALQQQQQQQQQKLSGWGNVSKPSGTTKSLLEIQQEEARQMQKQQQQQQQHQQPNRARNNTHSNLHTSIGNSVWGSINTGPPNQWASDLVSSIWSNADTKNSNMGFWDDAVKEVGPRNSTNKNKNNASLSKSVGVSNRQNKKVEEEEKLLKLFQGVNKAQDGFTQWCEQMLHALNTANNLDVPTFVSFLKEVESPYEVHDYIRAYLGDTSEAKEFAKQFLERRAKQKANQQRQQQQLPQQQQQQPPQQPPQQPQQQDSVWGMNHSTLHSVFQTNQSNNQQSNFEAVQSGKKKKKQKMVRADPSLLGFSVNASSERLNMGEIETLDDY

SEQ ID NO: 63469 - protein, 217 aa, Homo sapiens
MSLVPGQHCSPSHTRLHLTSPITMGTEPATQNTEFSKGSLIYGVTSPQRGHSQHSEASQGPLSLDKPLQLPPIFLEGEKGESSVQNEQEGEPSLQSPSLELQSPAWPRHAGVAQEPLKVSSSYLSDTQSSESHVSSVQHPRPEEGSHASLSSGYAGDKEGSDISLVGSHRRVRLNRRLNTQAASNQTSQLGSIDPPSSLKSRLTGPAHSTKQTGGKE

SEQ ID NO: 63470 - protein, 124 aa, Homo sapiens
MRASPCISQPAASWHPRPSALRPTAGSGPDTRTPGTVEDGSAPCPAFRSPAVSPCGEEPCCFQISPAEETLELGRLVSPGNCDTLSPRAAGFYACHVRSLIPCRSTKGRWPLTASAAGLSSFSG

SEQ ID NO: 63471 - protein, 136 aa, Homo sapiens
MPHARTETSVGTYESHSTSELEDLTEPEQRELKTKLTKLEAEIVTLRHVLAAKERRCGELKRKLGLTALVGLRQNLSKSWLDVQVSNTYVKQKTSAALSTMGTLICRKLGGVKKSATLRSFEGLIFNKYTLNQGRN

SEQ ID NO: 63472 - protein, 445 aa, Homo sapiens
MNESPQTNEFKGTTEEAPAKESPHTSEFKGAALVSPISKRIFGVFLVLLDVTLLLADLIFTDSKLYIPLEYRSISLAIGLFFLMDVLLRVFVEGWTHLVRLLRLIILIRIFHLLHQKRQLEKLMRRLVSENKRRYTRDGFDLDLTYVTERIIAMSFPSSGRQSFYRNPIEEVVRFLDKKHRNHYRVYNLCSERAYDPKHFHNRVSRIMIDDHNVPTLHEMVVFTKEVNEWMAQDLENIVAIHCKGGKGRTGTMVCALLIASEIFLTAEESLYYFGERRTNKTHSNKFQGVETPSQNRYVGYFAQVKHLYNWNLPPRRILFIKRFIIYSIRGDVCDLKVQVVMEKKVVFSSTSLGNCSILHDIETDKVLINVYDGPPLYDDVKVQFFSSNLPKYYDNCPFFFWFNTSFIQNNRLCLPRNELDNPHKQKAWKIYPPEFAVEILFGEK

SEQ ID NO: 63473 - protein, 522 aa, Homo sapiens
MNESPQTNEFKGTTEEAPAKESPHTSEFKGAALVSPISKSMLERLSKFEVEDAENVASYDSKIKKIVHSIVSSFAFGIFGVFLVLLDVTLLLADLIFTDSKLYIPLEYRSISLAIGLFFLMDVLLRVFVEGRQQYFSDLFNILDTAIIVIPLLVDVIYIFFDIKLLRNIPRWTHLVRLLRLIILIRIFHLLHQKRQLEKLMRRLVSENKRRYTRDGFDLDLTYVTERIIAMSFPSSGRQSFYRNPIEEVVRFLDKKHRNHYRVYNLCSERAYDPKHFHNRVSRIMIDDHNVPTLHEMVVFTKEVNEWMAQDLENIVAIHCKGGKGRTGTMVCALLIASEIFLTAEESLYYFGERRTNKTHSNKFQGVETPSQNRYVGYFAQVKHLYNWNLPPRRILFIKRFIIYSIRGDVCDLKVQVVMEKKVVFSSTSLGNCSILHDIETDKVLINVYDGPPLYDDVKVQFFSSNLPKYYDNCPFFFWFNTSFIQNNRLCLPRNELDNPHKQKAWKIYPPEFAVEILFGEK

SEQ ID NO: 63474 - protein, 337 aa, Homo sapiens
MNESPQTNEFKGTTEEAPAKESPHTSEFKGAALVSPISKRWTHLVRLLRLIILIRIFHLLHQKRQLEKLMRRLVSENKRRYTRDGFDLDLTYVTERIIAMSFPSSGRQSFYRNPIEEVVRFLDKKHRNHYRVYNLCSERAYDPKHFHNRVSRIMIDDHNVPTLHEMVVFTKEVNEWMAQDLENIVAIHCKGGKGRTGTMVCALLIASEIFLTAEESLYYFGERRTNKTHSNKFQGVETPSQNRYVGYFAQVKHLYNWNLPPRRILFIKRFIIYSIRGDVCDLKVQVVMEKKVVFSSTSLGNCSREEGSTQGQLEGGAIPETCARLMGGSNSEREGGT

SEQ ID NO: 63475 - protein, 370 aa, Homo sapiens
MAFRRRTKSYPLFSQEFVIHNHADIGFCLVLCVLIGLMFEVTAKTAFLFILPQYNISVPTADSETVHYHYGPKDLVTILFYIFITIILHAVVQEYILDKISKRLHLSKVKHSKFNESGQLVVFHFTSVIWCFYVVVTEGYLTNPRSLWEDYPHVHLPFQVKFFYLCQLAYWLHALPELYFQKVRKEEIPRQLQYICLYLVHIAGAYLLNLSRLGLILLLLQYSTEFLFHTARLFYFADENNEKLFSAWAAVFGVTRLFILTLAVLAIGFGLARMENQAFDPEKGNFNTLFCRLCVLLLVCAAQAWLMWRFIHSQLRHWREYWNEQSAKRRVPATPRLPARLIKRESGYHENGVVKAENGTSPRTKKLKSP

SEQ ID NO: 63476 - protein, 477 aa, Homo sapiens
MEAVELARKLQEEATCSICLDYFTDPVMTTCGHNFCRACIQLSWEKARGKKGRRKRKGSFPCPECREMSPQRNLLPNRLLTKVAEMAQQHPGLQKQDLCQEHHEPLKLFCQKDQSPICVVCRESREHRLHRVLPAEEAVQGYKLKLEEDMEYLREQITRTGNLQAREEQSLAEWQGKVKERRERIVLEFEKMNLYLVEEEQRLLQALETEEEETASRLRESVACLDRQGHSLELLLLQLEERSTQGPLQMLQDMKEPLSRKNNVSVQCPEVAPPTRPRTVCRVPGQIEVLRGFLEDVVPDATSAYPYLLLYESRQRRYLGSSPEGSGFCSKDRFVAYPCAVGQTAFSSGRHYWEVGMNITGDALWALGVCRDNVSRKDRVPKCPENGFWVVQLSKGTKYLSTFSALTPVMLMEPPSHMGIFLDFEAGEVSFYSVSDGSHLHTYSQATFPGPLQPFFCLGAPKSGQMVISTVTMWVKG

SEQ ID NO: 63477 - protein, 450 aa, Homo sapiens
MTTCGHNFCRACIQLSWEKARGKKGRRKRKGSFPCPECREMSPQRNLLPNRLLTKVAEMAQQHPGLQKQDLCQEHHEPLKLFCQKDQSPICVVCRESREHRLHRVLPAEEAVQGYKLKLEEDMEYLREQITRTGNLQAREEQSLAEWQGKVKERRERIVLEFEKMNLYLVEEEQRLLQALETEEEETASRLRESVACLDRQGHSLELLLLQLEERSTQGPLQMLQDMKEPLSRKNNVSVQCPEVAPPTRPRTVCRVPGQIEVLRGFLEDVVPDATSAYPYLLLYESRQRRYLGSSPEGSGFCSKDRFVAYPCAVGQTAFSSGRHYWEVGMNITGDALWALGVCRDNVSRKDRVPKCPENGFWVVQLSKGTKYLSTFSALTPVMLMEPPSHMGIFLDFEAGEVSFYSVSDGSHLHTYSQATFPGPLQPFFCLGAPKSGQMVISTVTMWVKG

SEQ ID NO: 63478 - protein, 477 aa, Homo sapiens; identical to SEQ ID NO: 63476

SEQ ID NO: 63479 - protein, 60 aa, Homo sapiens
MSESGEMSEFGYIMELIAKGKMPDWRRGYRCRQGCGKTTELATATDFSQTGNKSGKHFKT

SEQ ID NO: 63480 - protein, 61 aa, Homo sapiens
MSESGEMSEFGYIMELIAKGKASAMGLQQTHEHSRLTSKGGEARCPFEISEVGKQSLPRRT

SEQ ID NO: 63481 - protein, 723 aa, Homo sapiens
METAMCVCCPCCTWQRCCPQLCSCLCCKFIFTSERNCTCFPCPYKDERNCQFCHCTCSESPNCHWCCCSWANDPNCKCCCTASSNLNCYYYESRCCRNTIITFHKGRLRSIHTSSKTALRTGSSDTQVDEVKSIPANSHLVNHLNCPMCSRLRLHSFMLPCNHSLCEKCLRQLQKHAEVTENFFILICPVCDRSHCMPYSNKMQLPENYLHGRLTKRYMQEHGYLKWRFDRSSGPILCQVCRNRRIAYKRCITCRLNLCNDCLKAFHSDVAMQDHVFVDTSAEEQDEKICIHHPSSRIIEYCRNDNKLLCTFCKFSFHNGHDTISLIDACSERAASLFSAIAKFKAVRYEIDNDLMEFNILKNSFKADKEAKRKEIRNGFLKLRSILQEKEKIIMEQIENLEVSRQKEIEKYVYVTTMKVNEMDGLIAYSKEALKETGQVAFLQSAKILVDQIEDGIQTTYRPDPQLRLHSINYVPLDFVELSSAIHELFPTGPKKVRSSGDSLPSPYPVHSETMIARKVTFSTHSLGNQHIYQRSSSMLSFSNTDKKAKVGLEACGRAQSATPAKPTDGLYTYWSAGADSQSVQNSSSFHNWYSFNDGSVKTPGPIVIYQTLVYPRAAKVYWTCPAEDVDSFEMEFYEVITSPPNNVQMELCGQIRDIMQQNLELHNLTPNTEYVFKVRAINDNGPGQWSDICKVVTPDGHGKNRAKWGLLKNIQSALQKHF

SEQ ID NO: 63482 - protein, 241 aa, Homo sapiens
MKFILLWALLNLTVALAFNPDYTVSSTPPYLVYLKSDYLPCAGVLIHPLWVITAAHCNLPKLRVILGVTIPADSNEKHLQVIGYEKMIHHPHFSVTSIDHDIMLIKLKTEAELNDYVKLANLPYQTISENTMCSVSTWSYNVCDIYKEPDSLQTVNISVISKPQCRDAYKTYNITENMLCVGIVPGRRQPCKEVSAAPAICNGMLQGILSFADGCVLRADVGIYAKIFYYIPWIENVIQNN

SEQ ID NO: 63483 - protein, 698 aa, Homo sapiens
MMRSRSKSPRRPSPTARGANCDVELLKTTTRDREELKCMLEKYERHLAEIQGNVKVLKSERDKIFLLYEQAQEEITRLRREMMKSCKSPKSTTAHAILRRVETERDVAFTDLRRMTTERDSLRERLKIAQETAFNEKAHLEQRIEELECTVHNLDDERMEQMSNMTLMKETISTVEKEMKSLARKAMDTESELGRQKAENNSLRLLYENTEKDLSDTQRHLAKKKYELQLTQEKIMCLDEKIDNFTRQNIAQREEISILGGTLNDLAKEKECLQACLDKKSENIASLGESLAMKEKTISGMKNIIAEMEQASRQCTEALIVCEQDVSRMRRQLDETNDELAQIARERDILAHDNDNLQEQFAKAKQENQALSKKLNDTHNELNDIKQKVQDTNLEVNKLKNILKSEESENRQMMEQLRKANEDAENWENKARQSEADNNTLKLELITAEAEGNRLKEKVDSLNREVEQHLNAERSYKSQISTLHKSVVKMEEELQKVQFEKVSALADLSSTRELCIKLDSSKELLNRQLVAKDQEIEMRENELDSAHSEIELLRSQMANERISMQNLEALLVANRDKEYQSQIALQEKESEIQLLKEHLCLAENKMAIQSRDVAQFRNVVTQLEADLDITKRQLGTERFERERAVQELRRQNYSSNAYHMSSTMKPNTKCHSPERAHHRSPDRGLDRSLEENLCYRDF

SEQ ID NO: 63484 - protein, 698 aa, Homo sapiens
MMRSRSKSPRRPSPTARGANCDVELLKTTTRDREELKCMLEKYERHLAEIQGNVKVLKSERDKIFLLYEQAQEEITRLRREMMKSCKSPKSTTAHAILRRVETERDVAFTDLRRMTTERDSLRERLKIAQETAFNEKAHLEQRIEELECTVHNLDDERMEQMSNMTLMKETISTVEKEMKSLARKAMDTESELGRQKAENNSLRLLYENTEKDLSDTQRHLAKKKYELQLTQEKIMCLDEKIDNFTRQNIAQREEISILGGTLNDLAKEKECMQACLDKKSENIASLGESLAMKEKTISGMKNIIAEMEQASRQCTEALIVCEQDVSRMRRQLDETNDELAQIARERDILAHDNDNLQEQFAKAKQENQALSKKLNDTHNELNDIKQKVQDTNLEVNKLKNILKSEESENRQMMEQLRKANEDAENWENKARQSEADNNTLKLELITAEAEGNRLKEKVDSLNREVEQHLNAERSYKSQISTLHKSVVKMEEELQKVQFEKVSALADLSSTRELCIKLDSSKELLNRQLVAKDQEIEMRENELDSAHSEIELLRSQMANERISMQNLEALLVANRDKEYQSQIALQEKESEIQLLKEHLCLAENKMAIQSRDVAQFRNVVTQLEADLDITKRQLGTERFERERAVQELRRQNYSSNAYHMSSTMKPNTKCHSPERAHHRSPDRGLDRSLEENLCYRDF

SEQ ID NO: 63485 - protein, 556 aa, Homo sapiens
MGQDTDMLNTYQQLVRTPSVRPGQDVRLQAPGTRTGLLKLLSTVSQDKQGCLGSGDGVPNQDLQQRPQSSRQTAKKDRKPRGQSKKGQGSEESEDHFPLLPRKPSFPFQWAWESIATDVRAVLQPSSPTPGHQALPMPSSFSQRQSRRKSTANLPEAHGCCWKTEAQNLKARQQLGAWGGVSIPTGKGELGSEPPSGLQLPGRRPGSGSASDKQVQLQSLGAEEAERGLSSGVLPQRPRRGSISEEEQFSEATEEAEEGEHRTPCRRRAGCQRKGQISGEEASDEGEVQGQSQGSSPSFNNLRRRQWRKTRAKELQGPWDLEKLHRQLQRDLDCGPQKLPWKTLRAAFQASKRNGKAYASGYDETFVSANLPNRTFHKRQEATRSLLQAWERQRQEERQQAELRRARTQHVQRQVAHCLAAYAPRGSRGPGAAQRKLEELRRQERQRFAEYQAELQGIQHRVQARPFLFQQAMQANARLTVTRRFSQVLSALGLDEEQLLSEAGKVDREGTPRKPRSHRSMGVRMEHSPQRPPRTEPTGSQPDRHYNPSLDPECSP

SEQ ID NO: 63486 - protein, 275 aa, Homo sapiens
MSQKRQTKFQNGKSKTSENSSAKREKGMVVNSKEISDAVGQSKFVLENLRHYTVHPNLAQYYKPLKATALQKFLAQNRKNTSFMLKVTQYDQDKTLLIMTNNPPPCSITQQDKESASKYFSKELLLKVMESHHQHKPTENLWLPRMPQKKKLRSKLKPIFPLILSDDPTSKREQWFRFSTDNDFKSEGKYSKVYALRTQKKMYPQLTFAPVHERDMRKDASKKSASERPISKVIREPLTLASLLEDMPTRTAPGESAFRNGRAPQWIIKKATVIG

SEQ ID NO: 63487 - protein, 245 aa, Homo sapiens
MAEIHTPYSSLKKLLSLLNGFVAVSGIILVGLGIGGKCGGASLTNVLGLSSAYLLHVGNLCLVMGCITVLLGCAGWYGATKESRGTLLFCILSMVIVLIMEVTAATVVLLFFPIVGDVALEHTFVTLRKNYRGYNEPDDYSTQWNLVMEKLKCCGVNNYTDFSGSSFEMTTGHTYPRSCCKSIGSVSCDGRDVSPNVIHQKGCFHKLLKITKTQSFTLSGSSLGAAVIQRWGSRYVAQAGLELLA

SEQ ID NO: 63488 - protein, 410 aa, Homo sapiens
MSLPESPHSPATLDYALEDPHQGQRSREKSKATEVMADMFDGRLEPIVFPPPRLPEEGVAPQDPADGGHTFHILVDAGRSHGAIKAGQEVTPPPAEGLEAASASLTTDSSLKNGFPGEETHGLGGEKALETCGAGRSESEVIAEGKAEDVKPEECAMFSAPVDEKPGGEEMDVAEENRAIDEVNREAGPGPGPGPLNVGLHLNPLESIQLELDSVNAEADRALLQVERRFGQIHEYYLEQRNDIICNIPGFWVTAFRHHPQLSAMIRGQDAEMLSYLTNLEVKELRHPRTGCKFKFFFQRNPYFRNKLIVKVYEVRSFGQVVSFSTLIMWRRGHGPQSFIHRNRHVICSFFTWFSDHSLPESDRIAQIIKEDLWSNPLQYYLLGEDAHRARRRLVREPVEIPRPFGFQCG

SEQ ID NO: 63489 - protein, 367 aa, Homo sapiens
MDDAAVLKRRGYLLGINLGEGSYAKVKSAYSERLKFNVAIKIIDRKKAPADFLEKFLPREIEILAMLNHCSIIKTYEIFETSHGKVYIVMELAVQGDLLELIKTRGALHEDEARKKFHQLSLAIKYCHDLDVVHRDLKCDNLLLDKDFNIKLSDFSFSKRCLRDDSGRMALSKTFCGSPAYAAPEVLQGIPYQPKVYDIWSLGVILYIMVCGSMPYDDSNIKKMLRIQKEHRVNFPRSKHLTGECKDLIYHMLQPDVNRRLHIDEILSHCWMQPKARGSPSVAINKEGESSRGTEPLWTPEPGSDKKSATKLEPEGEAQPQAQPETKPEGTAMQMSRQSEILGFPSKPSTMETEEGPPQQPPETRAQ

SEQ ID NO: 63490 - protein, 268 aa, Homo sapiens
MEDFLLSNGYQLGKTIGEGTYSKVKEAFSKKHQRKVAIKVIDKMGGPEEFIQRFLPRELQIVRTLDHKNIIQVYEMLESADGKICLVMELAEGGDVFDCVLNGGPLPESRAKALFRQMVEAIRYCHGCGVAHRDLKCENALLQGFNLKLTDFGFAKVLPKSHRELSQTFCGSTAYAAPEVLQGIPHDSKKGDVWSMGVVLYVMLCASLPFDDTDIPKMLWQQQKGVSFPTHLSISADCQDLLKRLLEPDMILRPSIEEVSWHPWLAST

SEQ ID NO: 63491 - protein, 1649 aa, Homo sapiens
MESVEKDWGWGLWRNLRCLGHAHQGKCCTEGGISSTTKTSSENGSCCFEKAARKDHVCRFIGCGRNDRFNYVVMQLQGRNLADLRRSQSRGTFTISTTLRLGRQILESIESIHSVGFLHRDIKPSNFAMGRFPSTCRKCYMLDFGLARQFTNSCGDVRPPRAVAGFRGTVRYASINAHRNREMGRHDDLWSLFYMLVEFVVGQLPWRKIKDKEQVGSIKERYDHRLMLKHLPPEFSIFLDHISSLDYFTKPDYQMSIRVTRKSYKVSTSGPQAFNSLSYTSGPGACISSSSFSRMGSSSFRGGLGAGYGGASGGITTITVNQSLLSPLNLEVDPNIQAVRTQEEKQIKTLNNKFFSFIDKVRFLEQQNKMLETKWSLVQQQKMARSNMDNMFESYINNLKWQLETLGQEKLKLEAELGNMHGLVEDFRNKYEVEISKCTEMENEFVLIKEYVDEAYMNKMELESSLKELTAKISFLRQLYEEEIGSCSPRSRIHLWCCSWTTAASWTWTASSLRSRPEGFPGGCHADTEQRGELAIKDANAKLSELEAALQLASQDMARQLREYQELMNVKLALDIKIATYRKLLEGEESWLESGMQNMSIHMKTTSSYAGGQSLAYGGLTSPGLSYGLGSSFGSGMGSSSFSHTSSSRAVVMKKIETRDGKLVSESSNVLPNLRITATLLTSVFDNSIKTFGVIESDPFDWEKTGNDGSLTTTTTSTTPQLHTRLTPAAIGIANATPIPGDLLRENTDEVFPDEQLSDGENGIPVGVSPDKLPGSLGHPRPQEKDVWEEMDANKNKIKLGICKAATEEENSHGQANGLLNAPSLGSPIRVRSEITQPDRDIPLVRKLRSIHSFELEKRLTLEPKPDTDKFLETCLEKMQKDTSAGKESILPALLHKPCVPAVSRTDHIWHYDEEYLPDASKPASANTPEQADGGGSNGFIAVNLSSCKQEIDSKEWVIVDKEQDLQDFRTNEAVGHKTTGSPSDEEPEVLQVLEASPQDEKLQLGPWAENDHLKKETSGVVLALSAEGPPTAASEQYTDRLELQPGAASQFIAATPTSLMEAQAEGPLTAITIPRPSVASTQSTSGSFHCGQQPEKKDLQPMEPTVELYSPRENFSGLVVTEGEPPSGGSRTDLGLQIDHIGHDMLPNIRESNKSQDLGPKELPDHNRLVVREFENLPGETEEKSILLESDNEDEKLSRGQHCIEISSLPGDLVIVEKDHSATTEPLDVTKTQTFSVVPNQDKNNEIMKLLTVGTSEISSRDIDPHVEGQIGQVAEMQKNKISKDDDIMSEDLPGHQGDLSTFLHQEGKREKITPRNGELFHCVSENEHGAPTRKDMVRSSFVTRHSRIPVLAQEIDSTLESSSPVSAKEKLLQKKAYQPDLVKLLVEKRQFKSFLGDLSSASDKLLEEKLATVPAPFCEEEVLTPFSRLTVDSHLSRSAEDSFLSPIISQSRKSKIPRPVSWVNTDQVNSSTSSQFFPRPPPGKPPTRPGVEARLRRYKVLGSSNSDSDLFSRLAQILQNGSQKPRSTTQCKSPGSPHNPKTPPKSPVVPRRSPSASPRSSSLPRTSSSSPSRAGRPHHDQRSSSPHLGRSKSPPSHSGSSSSRRSCQQEHCKPSKNGLKGSGSLHHHSASTKTPQGKSKPASKLSR

SEQ ID NO: 63492 - protein, 1320 aa, Homo sapiens
MSSNDSSLMAGIIYYSQEKYFHHVQQAAAVGLEKFSNDPVLKFFKAYGVLKEEHIQDAISDLESIRHHPDVSLCSTMALIYAHKRCEIIDREAIQELEYSLKEIRKTVSGTALYYAGLFLWLIGRHDKAKEYIDRMLKISRGFREAYVLRGWGDLTSDKPHTAKKAIEYLEQGIQDTKDVLGLMGKAMYFMMQQNYSEALEVVNQITVTSGSFLPALVLKMQLFLARQDWEQTVEMGHRILEKDESNIDACQILTVHELAREGNMTTVSSLKTQKATNHVRNLIKALETREPENPSLHLKKIIVVSRLCGSHQVILGLVCSFIERTFMATPSYVHVATELGYLFILKNQVKEALLWYSEAMKLDKDGMAGLTGIILCHILEGHLEEAEYRLEFLKEVQKSLGKSEVLIFLQALLMSRKHKGEEETTALLKEAVELHFSSMQGIPLGSEYFEKLDPYFLVCIAKEYLLFCPKQPRLPGQIVSPLLKQVAVILNPVVKAAPALIDPLYLMAQVRYYSELENAQSILQRCLELDPASVDAHLLMCQIYLAQGNFGMCFHCLELGVSHNFQVRDHPLYHLIKARALNKAGDYPEAIKTLKMVIKLPALKKEEGRKFLRPSVQPSQRASILLELVEALRLNGELHEATKVMQDTINEFGGTPEENRITIANVDLVLSKGNVDVALNMLRNILPKQSCYMEAREKMANIYLQTLRDRRLYIRCYRELCEHLPGPHTSLLLGDALMSILEPEKALEVYDEAYRQNPHDASLASRIGHAYVKAHQYTEAIEYYEAAQKINGQDFLCCDLGELLLKLKKVNKAEKVLKQALEHDIVQDIPSMMNDVKCLLLLAKVYKSHKKEAVIETLNKALDLQSRILKRVPLEQPEMIPSQKQLAASICIQFAEHYLAEKEYDKAVQSYKDVFSYLPTDNKVMLELAQLYLLQGHLDLCEQHCAILLQTEQNHETASVLMADLMFRKQKHEAAINLYHQVLEKAPDNFLVLHKLIDLLRRSGKLEDIPAFFELAKKVSSRVPLEPGFNYCRGIYCWHIGQPNEALKFLNKARKDSTWGQSAIYHMVQICLNPDNEVVGGEAFENQGAESNYTEKKELEQQGVSTAEKLLREFYPHSDSSQTQLRLLQGLCRLATREKANMEAALGSFIQIAQAEKDSVPALLALAQAYVFLKQIPKARMQLKRLAKTPWVLSEAEDLEKSWLLLADIYCQGSKFDLALELLRRCVQYNKSCYKAYEYMGFIMEKEQSYKDAVTNYKLAWKYSHHANPAIGFKLAFNYLKDKKFVEAIEICNDVLREHPDYPKIREEILEKARKSLRP

SEQ ID NO: 63493 - protein, 672 aa, Homo sapiens
MSDPEGETLRSTFPSYMAEGERLYLCGEFSKAAQSFSNALYLQDGDKNCLVARSKCFLKMGDLERSLKDAEASLQSDPAFCKGILQKAETLYTMGDFEFALVFYHRGYKLRPDREFRVGIQKAQEAINNSVGSPSSIKLENKGDLSFLSKQAENIKAQQKPQPMKHLLHPTKGEPKWKASLKSEKTVRQLLGELYVDKEYLEKLLLDEDLIKGTMKGGLTVEDLIMTGINYLDTHSNFWRQQKPIYARERDRKLMQEKWLRDHKRRPSQTAHYILKSLEDIDMLLTSGSAEGSLQKAEKVLKKVLEWNKEEVPNKDELVGNLYSCIGNAQIELGQMEAALQSHRKDLEIAKEYDLPDAKSRALDNIGRVFARVGKFQQAIDTWEEKIPLAKTTLEKTWLFHEIGRCYLELDQAWQAQNYGEKSQQCAEEEGDIEWQLNASVLVAQAQVKLRDFESAVNNFEKALERAKLVHNNEAQQAIISALDDANKGIIRELRKTNYVENLKEKSEGEASLYEDRIITREKDMRRVRDEPEKVVKQWDHSEDEKETDEDDEAFGEALQSPASGKQSVEAGKARSDLGAVAKGLSGELGTRSGETGRKLLEAGRRESREIYRRPSGELEQRLSGEFSRQEPEELKKLSEVGRREPEELGKTQFGEIGETKKTGNEMEKEYE

SEQ ID NO: 63494 - protein, 843 aa, Homo sapiens
MATKKAGSRLETEIERCRSECQWERIPELVKQLSAKLIANDDMAELLLGESKLEQYLKEHPLRQGASPRGPKPQLTEVRKHLTAALDRGNLKSEFLQESNLIMAKLNYVEGDYKEALNIYARVGLDDLPLTAVPPYRLRVIAEAYATKGLCLEKLPISSSTSNLHVDREQDVITCYEKAGDIALLYLQEIERVILSNIQNRSPKPGPAPHDQELGFFLETGLQRAHVLYFKNGNLTRGVGRFRELLRAVETRTTQNLRMTIARQLAEILLRGMCEQSYWNPLEDPPCQSPLDDPLRKGANTKTYTLTRRARVYSGENIFCPQENTEEALLLLLISESMANRDAVLSRIPEHKSDRLISLQSASVVYDLLTIALGRRGQYEMLSECLERAMKFAFEEFHLWYQFALSLMAAGKSARAVKVLKECIRLKPDDATIPLLAAKLCMGSLHWLEEAEKFAKTVVDVGEKTSEFKAKGYLALGLTYSLQATDASLRGMQEVLQRKALLAFQRAHSLSPTDHQAAFYLALQLAISRQIPEALGYVRQALQLQGDDANSLHLLALLLSAQKHYHDALNIIDMALSEYPENFILLFSKVKLQSLCRGPDEALLTCKHMLQIWKSCYNLTNPSDSGRGSSLLDRTIADRRQLNTITLPDFSDPETGSVHATSVAASRVEQALSEVASSLQSSAPKQGPLHPWMTLAQIWLHAAEVYIGIGKPAEATACTQEAANLFPMSHNVLYMRGQIAELRGSMDEARRWYEEALAISPTHVKSMQRLALILHQLGRYSLAEKILRDAVQVNSTAHEVWNGLGEVLQAQGNDAAATECFLTALELEASSPAVPFTIIPRVL

SEQ ID NO: 63495 - protein, 569 aa, Homo sapiens
MEGCLGVAVLRKLSTFSAYLEDHSYNVEQIWRDIEDVIIKTLISAHPIIRHNYHTCFPNHTLNSACFEILGFDILLDHKLKPWLLEVNHSPSFSTDSRLDKEVKDGLLYDTLVLINLESCDKKKVLEEERQRGQFLQQCCSREMRIEEAKGFRAVQLKKTETYEKENCGGFRLIYPSLNSEKYEKFFQDNNSLFQNTVASRAREEYARQLIQELRLKREKKPFQMKKKVEMQGESAGEQVRKKGMRGWQQKQQQKDKAATQASKQYIQPLTLVSYTPDLLLSVRGERKNETDSSLNQEAPTEEASSVFPKLTSAKPFSSLPDLRNINLSSSKLEPSKPNFSIKEAKSASAVNVFTGTVHLTSVETTPESTTQLSISPKSPPTLAVTASSEYSGPETDRVVSFKCKKQQTPPHLTQKKMLKSFLPTKSKSFWESPNTNWTLLKSDMNKPHLISELLTKLQLSGKLSFFPAHYNPKLGMNNLSQNPSLPGECHSRSDSSGEKRQLDVSSLLLQSPQSYNVTLRDLLVIATPAQLDPRPCRSHASAMRDPCMQDQEAYSHCLISGQKGCERS

SEQ ID NO: 63496 - protein, 418 aa, Homo sapiens
MRECISIHVGQAGVQIGNACWELYCLEHGIQPDGQMPSDKTIGGGDDSFNTFFSETGAGKHVPRAVFVDLEPTVVDEVRTGTYRQLFHPEQLITGKEDAANNYARGHYTIGKEIVDLVLDRIRKLADLCTGLQGFLIFHSFGGGTGSGFASLLMERLSVDYGKKSKLEFAIYPAPQVSTAVVEPYNSILTTHTTLEHSDCAFMVDNEAIYDICRRNLDIERPTYTNLNRLIGQIVSSITASLRFDGALNVDLTEFQTNLVPYPRIHFPLATYAPVISAEKAYHEQLSVAEITNACFEPANQMVKCDPRHGKYMACCMLYRGDVVPKDVNAAIATIKTKRTIQFVDWCPTGFKVGINYQPPTVVPGGDLAKVQRAVCMLSNTTAIAEAWARLDLAALEKDYEEVGVDSVEAEAEEGEEY

SEQ ID NO: 63497 - protein, 655 aa, Homo sapiens
MAKGGEALPQGSPAPVQDPHLIKVTVKTPKDKEDFSVTDTCTIQQLKEEISQRFKAHPDQLVLIFAGKILKDPDSLAQCGVRDGLTVHLVIKRQHRAMGNECPAASVPTQGPSPGSLPQPSSIYPADGPPAFSLGLLTGLSRLGLAYRGFPDQPSSLMRQHVSVPEFVTQLIDDPFIPGLLSNTGLVRQLVLDNPHMQQLIQHNPEIGHILNNPEIMRQTLEFLRNPAMMQEMIRSQDRVLSNLESIPGGYNVLCTMYTDIMDPMLNAVQEQFGGNPFATATTDNATTTTSQPSRMENCDPLPNPWTSTHGGSGSRQGRQDGDQDAPDIRNRFPNFLGIIRLYDYLQQLHENPQSLGTYLQGTASALSQSQEPPPSVNRVPPSSPSSQEPGSGQPLPEESVAIKGRSSCPAFLRYPTENSTGQGGDQDGAGKSSTGHSTNLPDLVSGLGDSANRVPFAPLSFSPTAAIPGIPEPPWLPSPAYPRSLRPDGMNPAPQLQDEIQPQLPLLMHLQAAMANPRALQALRQIEQGLQVLATEAPRLLLWFMPCLAGTGSVAGGIESREDPLMSEDPLPNPPPEVFPALDSAELGFLSPPFLHMLQDLVSTNPQQLQPEAHFQVQLEQLRSMGFLNREANLQALIATGGDVDAAVEKLRQS

SEQ ID NO: 63498 - protein, 973 aa, Homo sapiens
MECSGPQDSKELLQNSQSRQAKGHKSGQPLGHSFRLENPTEFRPKSTLEGQLNESMFLLSSRPTPRTSTAVEVSPGEDMTHCSPQKTSPLTKITSGHLSQQDLESQMRELIYTDSDLVVTPIIDNPKIMKQPPVKFDAKILHLPTYSVDKLLFLKDQDWNDFLQQVCSQIDSTEKSMGASRAKLNLLCYLCVVAGHQEVATRLLHSPLFQLLIQHLRIAPNWDIRAKVAHVIGLLASHTAELQENTPVVEAIVLLTELIRENFRNSKLKQCLLPTLGELIYLVATQEEKKKNPRECWAVPLAAYTVLMRCLREGEERVVNHMAAKIIENVCTTFSAQSQGFITGEIGPILWYLFRHSTADSLRITAVSALCRITRHSPTAFQNVIEKVGLNSVINSLASAICKVQQYMLTLFAAMLSCGIHLQRLIQEKGFVSTIIRLLDSPSTCIRAKAFLVLLYILIYNREMLLLSCQARLVMYIERDSRKTTPGKEQQSGNEYLSKCLDLLICHIVQELPRILGDILNSLANVSGRKHPSTVQVKQLKLCLPLMPVVLHLVTSQVFRPQVVTEEFLFSYGTILSHIKSVDSGETNIDGAIGLTASEEFIKITLSAFEAIIQYPILLKDYRSTVVDYILPPLVSLVQSQNVEWRLFSLRLLSETTSLLVNQEFGDGKEKASVDSDSNLLALIRDVLLPQYEHILLEPDPVPAYALKLLVAMTEHNPTFTRLVEESKLIPLIFEVTLEHQESILGNTMQSVIALLSNLVACKDSNMELLYEQGLVSHICNLLTETATLCLDVDNKNNNEMAAPLLFSLLDILHSMLTYTSGIVRLALQAQKSGSGEDPQAAEDLLLLNRPLTDLISLLIPLLPNEDPEIFDVSSKCLSILVQLYGGENPDSLSPENVEIFAHLLTSKEDPKEQKLLLRILRRMITSNEKHLESLKNAGSLLRALERLAPGSGSFADSAVAPLALEILQAVGH

SEQ ID NO: 63499 - protein, 280 aa, Homo sapiens
MECSGPQDSKELLQNSQSRQAKGHKSGQPLGHSFRLENPTEFRPKSTLEGQLNESMFLLSSRPTPRTSTAVEVSPGEDMTHCSPQKTSPLTKITSGHLSQQDLESQMRELIYTDSDLVVTPIIDNPKIMKQPPVKFDAKILHLPTYSVDKLLFLKDQDWNDFLQQVCSQIDSTEKSMGASRAKLNLLCYLCVVAGHQEVATRLLHSPLFQLLIQHLRIAPNWDIRAKVAHVIGLLASHTAELQENTPVVETTSSIGIGILNCLVQHSTPVPRQCLVQLFS

SEQ ID NO: 63500 - protein, 580 aa, Homo sapiens
MENFILYEEIGRGSKTVVYKGRRKGTINFVAILCTDKCKRPEITNWVRLTREIKHKNIVTFHEWYETSNHLWLVVELCTGGSLKTVIAQDENLPEDVVREFGIDLISGLHHLHKLGILFCDISPRKILLEGPGTLKFSNFCLAKVEGENLEEFFALVAAEEGGGDNGENVLKKSMKSRVKGSPVYTAPEVVRGADFSISSDLWSLGCLLYEMFSGKPPFFSESISELTEKILCEDPLPPIPKDSSRPKASSDFINLLDGLLQRDPQKRLTWTRLLQHSFWKKAFAGADQESSVEDLSLSRNTMECSGPQDSKELLQNSQSRQAKGHKSGQPLGHSFRLENPTEFRPKSTLEGQLNESMFLLSSRPTPRTSTAVEVSPGEDMTHCSPQKTSPLTKITSGHLSQQDLESQMRELIYTDSDLVVTPIIDNPKIMKQPPVKFDAKILHLPTYSVDKLLFLKDQDWNDFLQQVCSQIDSTEKSMGASRAKLNLLCYLCVVAGHQEVATRLLHSPLFQLLIQHLRIAPNWDIRAKVAHVIGLLASHTAELQENTPVVETTSSIGIGILNCLVQHSTPVPRQCLVYV

SEQ ID NO: 63501 - protein, 580 aa, Homo sapiens; identical to SEQ ID NO: 63500

SEQ ID NO: 63502 - protein, 973 aa, Homo sapiens
MECSGPQDSKELLQNSQSRQAKGHKSGQPLGHSFRLENPTEFRPKSTLEGQLNESMFLLSSRPTPRTSTAVEVSPGEDMTHCSPQKTSPLTKITSGHLSQQDLESQMRELIYTDSDLVVTPIIDNPKIMKQPPVKFDAKILHLPTYSVDKLLFLKDQDWNDFLQQVCSQIDSTEKSMGASRAKLNLLCYLCVVAGHQEVATRLLHSPLFQLLIQHLRIAPNWDIRAKVAHVIGLLASHTTELQENTPVVEAIVLLTELIRENFRNSKLKQCLLPTLGELIYLVATQEEKKKNPRECWAVPLAAYTVLMRCLREGEERVVNHMAAKIIENVCTTFSAQSQGFITGEIGPILWYLFRHSTADSLRITAVSALCRITRHSPTAFQNVIEKVGLNSVINSLASAICKVQQYMLTLFAAMLSCGIHLQRLIQEKGFVSTIIRLLDSPSTCIRAKAFLVLLYILIYNREMLLLSCQARLVMYIERDSRKTTPGKEQQSGNEYLSKCLDLLICHIVQELPRILGDILNSLANVSGRKHPSTVQVKQLKLCLPLMPVVLHLVTSQVFRPQVVTEEFLFSYGTILSHIKSVDSGETNIDGAIGLTASEEFIKITLSAFEAIIQYPILLKDYRSTVVDYILPPLVSLVQSQNVEWRLFSLRLLSETTSLLVNQEFGDGKEKASVDSDSNLLALIRDVLLPQYEHILLEPDPVPAYALKLLVAMTEHNPTFTRLVEESKLIPLIFEVTLEHQESILGNTMQSVIALLSNLVACKDSNMELLYEQGLVSHICNLLTETATLCLDVDNKNNNEMAAPLLFSLLDILHSMLTYTSGIVRLALQAQKSGSGEDPQAAEDLLLLNRPLTDLISLLIPLLPNEDPEIFDVSSKCLSILVQLYGGENPDSLSPENVEIFAHLLTSKEDPKEQKLLLRILRRMITSNEKHLESLKNAGSLLRALERLAPGSGSFADSAVAPLALEILQAVGH

SEQ ID NO: 63503 - protein, 280 aa, Homo sapiens
MECSGPQDSKELLQNSQSRQAKGHKSGQPLGHSFRLENPTEFRPKSTLEGQLNESMFLLSSRPTPRTSTAVEVSPGEDMTHCSPQKTSPLTKITSGHLSQQDLESQMRELIYTDSDLVVTPIIDNPKIMKQPPVKFDAKILHLPTYSVDKLLFLKDQDWNDFLQQVCSQIDSTEKSMGASRAKLNLLCYLCVVAGHQEVATRLLHSPLFQLLIQHLRIAPNWDIRAKVAHVIGLLASHTTELQENTPVVETTSSIGIGILNCLVQHSTPVPRQCLVQLFS

SEQ ID NO: 63504 - protein, 580 aa, Homo sapiens [sequence omitted]

SEQ ID NO: 63505 - protein, 580 aa, Homo sapiens [sequence omitted]

SEQ ID NO: 63506 - protein, 580 aa, Homo sapiens [sequence omitted]

SEQ ID NO: 63507 - protein, 605 aa, Homo sapiens
MSQLSSTLKRYTESARYTDAHYAKSGYGAYTPSSYGANLAASLLEKEKLGFKPVPTSSFLTRPRTYGPSSLLDYDRGRPLLRPDITGGGKRAESQTRGTERPLGSGLSGGSGFPYGVTNNCLSYLPINAYDQGVTLTQKLDSQSDLARDFSSLRTSDSYRIDPRNLGRSPMLARTRKELCTLQGLYQTASCPEYLVDYLENYGRKGSASQVPSQAPPSRVPEIISPTYRPIGRYTLWETGKGQAPGPSRSSSPGRDGMNSKSAQGLAGLRNLGNTCFMNSILQCLSNTRELRDYCLQRLYMRDLHHGSNAHTALVEEFAKLIQTIWTSSPNDVVSPSEFKTQIQRYAPRFVGYNQQDAQEFLRFLLDGLHNEVNRVTLRPKSNPENLDHLPDDEKGRQMWRKYLEREDSRIGDLFVGQLKGSLTCTDCGYCSTVFDPFWDLSLPIAKRGYPEVTLMDCMRLFTKEDVLDGDEKPTCCRCRGRKRCIKKFSIQRFPKILVLRLKRFSESRIRTSKLTTFVNFPLRDLDLREFASENTNHAVYNLYAVSNHSGTTMGGHYTAYCRSPGTGEWHTFNDSSVTPMSSSQVRTSDAYLLFYELASPPSRM

SEQ ID NO: 63508 - protein, 341 aa, Homo sapiens
MLLRPRRPPPLAPPAPPSPASPDPEPRTPGDAPGTPPRRPASPSALGELGLPVSPGSAQRTPWSARETELLLGTLLQPAVWRALLLDRRQALPTYRRVSAALAQQQVRRTPAQCRRRYKFLKDKFREAHGQPPGPFDEQIRKLMGLLGDNGRKRPRRRSPGSGRPQRARRPVPNAHAPAPSEPDATPLPTARDRDADPTWTLRFSPSPPKSADASPAPGSPPAPAPTALATCIPEDRAPVRGPGSPPPPPAREDPDSPPGRPEDCAPPPAAPPSLNTALLQTLGHLGDIANILGPLRDQLLTLNQHVEQLRGAFDQTVSLAVGFILGSAAAERGVLRDPCQ

SEQ ID NO: 63509 - protein, 206 aa, Homo sapiens
MSPKPRASGPPAKATEAGKRKSSSQPSPSDPKKKTTKVAKKGKAVRRGRRGKKGAATKMAAVTAPEAESAPAAPGPSDQPSQELPQHELPPEEPVSEGTQHDPLSQEAELEEPLSQESEVEEPLSQESQVEEPLSQESEVEEPLSQESQVEEPLSQESEVEEPLSQESQVEEPLSQESEMEEPLSQESQVEEPPSQESEMEELPSV

SEQ ID NO: 63510 - protein, 216 aa, Homo sapiens
MSPKPRASGPPAKATEAGKRKSSSQPSPSDPKKKTTKVAKKGKAVRRGRRGKKGAATKMAAVTAPEAESGPAAPGPSDQPSQELPQHELPPEEPVSEGTQHDPLSQESELEEPLSQESEVEEPLSQESQVEEPLSQESEVEEPLSQESQVEEPLSQESEVEEPLSQESQVEEPLSQESEMEEPLSQESQVEEPLSQESEMEEPLSQESEMEELPSV

SEQ ID NO: 63511 - protein, 186 aa, Homo sapiens
MSPKPRASGPPAKATEAGKRKSSSQPSPSDPKKKTTKVAKKGKAVRRGRRGKKGAATKMAAVTAPEAESGPAAPGPSDQPSQELPQHELPPEEPVSEGTQHDPLSQESELEEPLSQESEVEEPLSQESQVEEPLSQESEVEEPLSQESQVEEPLSQESEVEEPLSQESQVEEPLSQESEMEELPSV

SEQ ID NO: 63512 - protein, 125 aa, Homo sapiens
MSPKPRASGPPAKAKETGKRKSSSQPSPSGPKKKTTKVAEKGEAVRGGRRGKKGAATKMAAVTAPEAESGPAAPGPSDQPSQELPQHELPPEEPVSEGTQHDPLSQESELEEPLSKGRPSTPLSP

SEQ ID NO: 63513 - protein, 125 aa, Homo sapiens; identical to SEQ ID NO: 63512

SEQ ID NO: 63514 - protein, 336 aa, Homo sapiens
MQKHYTVAWFLYSAPGVDPSPPCRSLGWKRKREWSDESEEEPEKELAPEPEETWVVETLCGLKMKLKQQRVSPILLEHHKDFNSQLAPGVDPSPPHRSFCWKRKMEWWDKSEESEEEPRKVLAPEPEEIWVAEMLCGLKMKLKRRRVSLVLPEHHEAFNRLLEDPVIKRFLAWDKDLRVSDKYLLAMVIAYFSRAGFPSWQYQRLHFFLALYLANDMEEDDEDSKQNIFHFLYGKNRSRIPLLRKRRFQLYRSMNPRARKNRSHIPLVRKRRFQLRRCMNPRARKNRSQIVLFQKRRFHFFCSMSCRAWVSPEELEEIQAYDPEHWVWARDRARLS

SEQ ID NO: 63515 - protein, 395 aa, Homo sapiens
MESKRPRLLEEADKQKKTVRVGLNAPSMLRKNQLGFLRFANYCRIARELRVSCMQRKKVQIHSWDPSSLASDRFNRILANTNTDQLFTVNQVEAGGSKYGIITMRGLTTPELRVYPHKTLYVPNRKVNSMCWASLNHLDSHLLLCFVGLADTPSCAVLLPASLFIGSFPGMRRPGMLCSFQIPDAWSCAWSLSIHAYHSFSTGLSQQVLLTNVVTGHQQSFGTSSDVLAQQFAIMTPLLFNGCRSGEIFGIDLRCGNQGSGWKAICLSHDSAVTSLQILQDGQFLVSSDMTGTIKLWDLRATKCVTQYEGHVNNSAYLPVHVNEEEGVVAAVGQDCYTRIWSLRHGHLLTTIPSPYPASENDIPSVAFSSRLGGFRGAPGLLMAVREDLYCFSYG

SEQ ID NO: 63516 - protein, 494 aa, Homo sapiens
MPTESASCSTARQTKQKRKSHSLSIRRTNSSEQERTGLPRDMLEGQDSKLPSSVRSTLLELFGQIEREFENLYIENLELRREIDTLNERLAAEGQAIDGAELSKGQLKTKASHSTSQLSQKLKTTYKASTSKIVSSFKTTTSRAACQLVKEYIGHRDGIWDVSVAKTQPVVLGTASADHTALLWSIETGKCLVKYAGHVGSVNSIKFHPSEQLALTASGDQTAHIWRYAVQLPTPQPVADTSISGEDEVECSDKDEPDLDGDVSSDCPTIRVPLTSLKSHQGVVIASDWLVGGKQAVTASWDRTANLYDVETSELVHSLTGHDQELTHCCTHPTQRLVVTSSRDTTFRLWDFRDPSIHSVNVFQGHTDTVTSAVFTVGDNVVSGSDDRTVKVWDLKNMRSPIATIRTDSAINRINVCVGQKIIALPHDNRQVRLFDMSGVRLARLPRSSRQGHRRMVCCSAWSEDHPVCNLFTCGFDRQAIGWNINIPALLQEK

SEQ ID NO: 63517 - protein, 358 aa, Homo sapiens
MAVKWTGGHSSPVLCLNASKEGLLASGAEGGDLTAWGEDGTPLGHTRFQGADDVTSVLFSPSCPTKLYASHGETISVLDVRSLKDSLDHFHVNEEEINCLSLNQTENLLASADDSGAIKILDLENKKVIRSLKRHSNICSSVAFRPQRPQSLVSCGLDMQVMLWSLQKARPLWITNLQEDETEEMEGPQSPGQLLNPALAHSISVASCGNIFSCGAEDGKVRIFRVMGVKCEQELGFKGHTSGVSQVCFLPESYLLLTGGNDGKITLWDANSEVEKKQKSPTKRTHRKKPKRGTCTKQGGNTNASVTDEEEHGNILPKLNIEHGEKVNWLLGTKIKGHQNILVADQTSCISVYPLNEF

SEQ ID NO: 63518 - protein, 1518 aa, Homo sapiens
MAAVGSGGYARNDAGEKLPSVMAGVPARRGQSSPPPAPPICLRRRTRLSTASEETVQNRVSLEKVLGITAQNSSGLTCDPGTGHVAYLAGCVVVILDPKENKQQHIFNTARKSLSALASSPDGKYIVTGENGHRPAVRIWDVEEKNQVAEMLGHKYGVACVAFSPNMKHIVSMGYQHDMVLNVWDWKKDIVVASNKVSCRVIALSFSEDSSYFVTVGNRHVRFWFLEVSTETKVTSTVPLVGRSGILGELHNNIFCGVACGRGRMAGSTFCVSYSGLLCQFNEKRVLEKWINLKVSLSSCLCVSQELIFCGCTDGIVRIFQAHSLHYLANLPKPHYLGVDVAQGLEPSFLFHRKAEAVYPDTVALTFDPIHQWLSCVYKDHSIYIWDVKDINRVGKVWSELFHSSYVWNVEVYPEFEDQRACLPSGSFLTCSSDNTIRFWNLDSSPDSHWQKNIFSNTLLKVVYVENDIQHLQDMSHFPDRGSENGTPMDVKAGVRVMQVSPDGQHLASGDRSGNLRIHELHFMDELVKVEAHDAEVLCLEYSKPETGLTLLASASRDRLIHVLNVEKNYNLEQTLDDHSSSITAIKFAGNRDIQMISCGADKSIYFRSAQQGSDGLHFVRTHHVAEKTTLYDMDIDITQKYVAVACQDRNVRVYNTVNGKQKKCYKGSQGDEGSLLKVHVDPSGTFLATSCSDKSISVIDFYSGECIAKMFGHSEIITSMKFTYDCHHLITVSGDSCVFIWHLGPEITNCMKQHLLEIDHRQQQQHTNDKKRSGHPRQDTYVSTPSEIHSLSPGEQTEDDLEEECEPEEMLKTPSKDSLDPDPRCLLTNGKLPLWAKRLLGDDDVADGSAFHAKRSYQPHGRWAERAGQEPLKTILDAQDLDCYFTPMKPESLENSILDSLEPQSLASLLSESESPQEAGRGHPSFLPQQKESSEASELILYSLEAEVTVTGTDSQYCRKEVEAGPGDQQGDSYLRVSSDSPKDQSPPEDSGESEADLECSFAAIHSPAPPPDPAPRFATSLPHFPGCAGPTEDELSLPEGPSVPSSSLPQTPEQEKFLRHHFETLTESPCRALGDVEASEAEDHFFNPRLSISTQFLSSLQKASRFTHTFPPRATQCLVKSPEVKLMDRGGSQPRAGTGYASPDRTHVLAAGKAEETLEAWRPPPPCLTSLASCVPASSVLPTDRNLPTPTSAPTPGLAQGVHAPSTCSYMEATASSRARISRSISLGDSEGPIVATLAQPLRRPSSVGELASLGQELQAITTATTPSLDSEGQEPALRSWGNHEARANLRLTLSSACDGLLLPPVDTQPGVTVPAVSFPAPSPVEESALRLHGSAFRPSLPAPESPGLPAHPSNPQLPEARPGIPGGTASLLEPTSGALGLFQGSPARWSEPWVPVEALPPSPLELSRVGNILHRLQTTFQEALDLYRVLVSSGQVDTGQQQARTELVSTFLWIHSQLEAECLVGTSVAPAQALPSPGPPSPPTLYPLASPDLQALLEHYSELLVQAVRRKARGH

SEQ ID NO: 63519 - protein, 415 aa, Homo sapiens
MKLKSLLLRYYPPGIMLEYEKHGELKTKSIDLLDLGPSTDVSALVEEIQKAEPLLTASRTEQVKLLIQRLQEKLGQNSNHTFYLFKVLKAHILPLTNVALNKSGSCFITGSYDRTCKLWDTASGEELNTLEGHRNVVYAIAFNNPYGDKIATGSFDKTCKLWSVETGKCYHTFRGHTAEIVCLSFNPQSTLVATGSMDTTAKLWDIQNGEEVYTLRGHSAEIISLSFNTSGDRIITGSFDHTVVVWDADTGRKVNILIGHCAEISSASFNWDCSLILTGSMDKTCKLWDATNGKCVATLTGHDDEILDSCFDYTGKLIATASADGTARIFSAATRKCIAKLEGHEGEISKISFNPQGNHLLTGSSDKTARIWDAQTGQCLQVLEGHTDEIFSCAFNYKGNIVITGSKDNTCRIWR

SEQ ID NO: 63520 - protein, 1743 aa, Homo sapiens
MATDSGDPASTEDSEKPDGISFENRVPQVAATLTVEARLKEKNSTFSASGETVERKRFFRKSVEMTEDDKVAESSPKDERIKAAMNIPRVDKLPSNVLRGGQEVKYEQCSKSTSEISKDCFKEKNEKEMEEEAEMKAVATSPSGRFLKFDIELGRGAFKTVYKGLDTETWVEVAWCELQDRKLTKAEQQRFKEEAEMLKGLQHPNIVRFYDSWESILKGKKCIVLVTELMTSGTLKTYLKRFKVMKPKVLRSWCRQILKGLQFLHTRTPPIIHRDLKCDNIFITGPTGSVKIGDLGLATLMRTSFAKSVIGTPEFMAPEMYEEHYDESVDVYAFGMCMLEMATSEYPYSECQNAAQIYRKVTSGIKPASFNKVTDPEVKEIIEGCIRQNKSERLSIRDLLNHAFFAEDTGLRVELAEEDDCSNSSLALRLWVEDPKKLKGKHKDNEAIEFSFNLETDTPEEVAYEMVKSGFFHESDSKAVAKSIRDRVTPIKKTREKKPAGCLEERRDSQCKSMGNVFPQPQNTTLPLAPAQQTGAECEETEVDQHVRQQLLQRKPQQHCSSVTGDNLSEAGAASVIHSDTSSQPSVAYSSNQTMGSQMVSNIPQAEVNVPGQIYSSQQLVGHYQQVSGLQKHSKLTQPQILPLVQGQSTVLPVHVLGPTVVSQPQVSPLTVQKVPQIKPVSQPVGAEQQAALLKPDLVRSLNQDVATTKENVSSPDNPSGNGKQDRIKQRRASCPRPEKGTKFQLTVLQVSTSGDNMVECQLETHNNKMVTFKFDVDGDAPEDIADYMVEDNFVLESEKEKFVEELRAIVGQAQEILHVHFATERATGVDSITVDSNSSQTGSSEQVQINSTSTQTSNESAPQSSPVGRWRFCINQTIRNRETQSPPSLQHSMSAVPGRHPLPSPKNTSNKEISRDTLLTIENNPCHRALFTSKSEHKDVVDGKISECASVETKQPAILYQVEDNRQIMAPVTNSSSYSTTSVRAVPAECEGLTKQASIFIPVYPCHQTASQADALMSHPGESTQTSGNSLTTLAFDQKPQTLSVQQPAMDAEFISQEGETTVNTEASSPKTVIPTQTPGLEPTTLQPTTVLESDGERPPKLEFADNRIKTLDEKLRNLLYQEHSISSIYPESQKDTQSIDSPFSSSAEDTLSCPVTEVIAISHCGIKDSPVQSPNFQQTGSKLLSNVAASQPANISVFKRDLNVITSVPSELCLHEMSSDASLPGDPEAYPAAVSSGGAIHLQTGVETEEMRSAIAPDPIPLTRESTADTRALNRCKAMSGSFQRGRFQVITIPQQQSAKMTSFGIEHISVFSETNHSSEEAFIKTAKSQLVEIEPATQNPKTSFSYEKLQALQETCKENKGVPKQGDNFLSFSAACETDVSSVTPEKEFEETSATGSSMQSGSELLLKEREILTAGKQPSSDSEFSASLAGSGKSVAKTGPESNQCLPHHEEQAYAQTQSSLFYSPSSPMSSDDESEIEDEDLKVELQRLREKHIQEVVNLQTQQNKELQELYERLRSIKDSKTQSTEIPLPPASPRRPRSFKSKLRSRPQSLTHVDNGIVATDPLCVESNAASCQQSPASKKGMFTDDLHKLVDDWTKEAVGNSLIKPSLNQLKQSQHKLETENWNKVSENTPSTMGYTSTWISSLSQIRGAVPTSLPQGLSLPSFPGPLSSYGMPHVCQYNAVAGAGYPVQWVGISGTTQQSVVIPAQSGGPFQPGMNMQAFPTSSVQNPATIPPGPK

SEQ ID NO: 63521 - protein, 1800 aa, Homo sapiens
MATDSGDPASTEDSEKPDGISFENRVPQVAATLTVEARLKEKNSTFSASGETVERKRFFRKSVEMTEDDKVAESSPKDERIKAAMNIPRVDKLPSNVLRGGQEVKYEQCSKSTSEISKDCFKEKNEKEMEEEAEMKAVATSPSGRFLKFDIELGRGAFKTVYKGLDTETWVEVAWCELQDRKLTKAEQQRFKEEAEMLKGLQHPNIVRFYDSWESILKGKKCIVLVTELMTSGTLKTYLKRFKVMKPKVLRSWCRQILKGLQFLHTRTPPIIHRDLKCDNIFITGPTGSVKIGDLGLATLMRTSFAKSVIGTPEFMAPEMYEEHYDESVDVYAFGMCMLEMATSEYPYSECQNAAQIYRKVTSGIKPASFNKVTDPEVKEIIEGCIRQNKSERLSIRDLLNHAFFAEDTGLRVELAEEDDCSNSSLALRLWVEDPKKLKGKHKDNEAIEFSFNLETDTPEEVAYEMVKSGFFHESDSKAVAKSIRDRVTPIKKTREKKPAGCLEERRDSQCKSMGNVFPQPQNTTLPLAPAQQTGAECEETEVDQHVRQQLLQRKPQQHCSSVTGDNLSEAGAASVIHSDTSSQPSVAYSSNQTMGSQMVSNIPQAEVNVPGQIYSSQQLVGHYQQVSGLQKHSKLTQPQILPLVQGQSTVLPVHVLGPTVVSQPQVSPLTVQKVPQIKPVSQPVGAEQQAALLKPDLVRSLNQDVATTKENVSSPDNPSGNGKQDRIKQRRASCPRPEKGTKFQLTVLQVSTSGDNMVECQLETHNNKMVTFKFDVDGDAPEDIADYMVEDNFVLESEKEKFVEELRAIVGQAQEILHVHFATERATGVDSITVDSNSSQTGSSEQVQINSTSTQTSNESAPQSSPVGRWRFCINQTIRNRETQSPPSLQHSMSAVPGRHPLPSPKNTSNKEISRDTLLTIENNPCHRALFTSKSEHKDVVDGKISECASVETKQPAILYQVEDNRQIMAPVTNSSSYSTTSVRAVPAECEGLTKQASIFIPVYPCHQTASQADALMSHPGESTQTSGNSLTTLAFDQKPQTLSVQQPAMDAEFISQEGETTVNTEASSPKTVIPTQTPGLEPTTLQPTTVLESDGERPPKLEFADNRIKTLDEKLRNLLYQEHSISSIYPESQKDTQSIDSPFSSSAEDTLSCPVTEVIAISHCGIKDSPVQSPNFQQTGSKLLSNVAASQPANISVFKRDLNVITSVPSELCLHEMSSDASLPGDPEAYPAAVSSGGAIHLQTGGGYFGLSFTCPSLKNPISKKSWTRKLKSWAYRLRQSTSFFKRSKVRQVETEEMRSAIAPDPIPLTRESTADTRALNRCKAMSGSFQRGRFQVITIPQQQSAKMTSFGIEHISVFSETNHSSEEAFIKTAKSQLVEIEPATQNPKTSFSYEKLQALQETCKENKGVPKQGDNFLSFSAACETDVSSVTPEKEFEETSATGSSMQSGSELLLKEREILTAGKQPSSDSEFSASLAGSGKSVAKTGPESNQCLPHHEEQAYAQTQSSLFYSPSSPMSSDDESEIEDEDLKVELQRLREKHIQEVVNLQTQQNKELQELYERLRSIKDSKTQSTEIPLPPASPRRPRSFKSKLRSRPQSLTHVDNGIVATGKSCLINELENPLCVESNAASCQQSPASKKGMFTDDLHKLVDDWTKEAVGNSLIKPSLNQLKQSQHKLETENWNKVSENTPSTMGYTSTWISSLSQIRGAVPTSLPQGLSLPSFPGPLSSYGMPHVCQYNAVAGAGYPVQWVGISGTTQQSVVIPAQSGGPFQPGMNMQAFPTSSVQNPATIPPGPK

SEQ ID NO: 63522 - protein, 146 aa, Homo sapiens; identical to SEQ ID NO: 63190

SEQ ID NO: 63523 - protein, 69 aa, Homo sapiens
MESPKKKNQQLKVGILHLGSRQKKIRIQLRSQVLGREMRDMEGDLQELHQSNTGDKSGFGFRRQGEDNT

SEQ ID NO: 63524 - protein, 160 aa, Homo sapiens; identical to SEQ ID NO: 63189

SEQ ID NO: 63525 - protein, 362 aa, Homo sapiens
METVFEEMDEESTGGVSSSKEEIVLGQRLHLSFPFSIIFSTVLYCGEVAFGLYMFEIYRKANDTFWMSFTISFIIVGAILDQIILMFFNKDLRRNKAALLFWHILLLGPIVRCLHTIRNYHKWLKNLKQEKEETQVSITKRNTMLEREIAFSIRDNFMQQKAFKYMSVIQAFLGSVPQLILQMYISLTIREWPLNRALLMTFSLLSVTYGAIRCNILAIQISNDDTTIKLPPIEFFCVVMWRFLEVISRVVTLALFIASLKLKSLPVLLIIYFVSLLAPWLEFWKSGAHLPGNKENNSNMVGTVLMLFLITLLYAAINFSCWSAVKLQLSDDKIIDGRQRWGHRILHYSFQFFRKCDNDIGI

SEQ ID NO: 63526 - protein, 166 aa, Homo sapiens
MSSKDFFACGHSGHWARGCPRGGAGGRRGGGHGRGSQCGSTTLSYTCYCCGESGRNAKNCVLLGNICYNCGRSGHIAKDCKDPKRERRQHCYTCGRLGHLARDCDRQKEQKCYSCGKLGHIQKDCAQVKCYRCGEIGHVAINCSKARPGQLLPLRQIPTSSQGMSQ

SEQ ID NO: 63527 - protein, 310 aa, Homo sapiens
MSQQLKKRAKTRHQKGLGGRAPSGAKPRQGKSSQDLQAEIEPVSAVWALCDGYVCYEPGPQALGGDDFSDCYIECVIRGEFSQPILEEDSLFESLEYLKKGSEQQLSQKVFEASSLECSLEYMKKGVKKELPQKIVGENSLEYSEYMTGKKLPPGGIPGIDLSDPKQLAEFARKKPPINKEYDSLSAIACPQSGCTRKLRNRAALRKHLLIHGPRDHVCAECGKAFVESSKLKRHFLVHTGEKPFRCTFEGCGKRFSLDFNLRTHVRIHTGEKRFVCPFQGCNRRFIQSNNLKAHILTHANTNKNEQEGK

SEQ ID NO: 63528 - protein, 365 aa, Homo sapiens
MNVIYPLAVPKGRRLCCEVCEAPAERVCAACTVTYYCGVVHQKADWDSIHEKICQLLIPLRTSMPFYNSEEERQHGLQQLQQRQKYLIEFCYTIAQKYLFEGKHEDAVPAALQSLRFRVKLYGLSSVELVPAYLLLAEASLGLGRIVQAEEYLFQAQWTVLKSTDCSNATHSLLHRNLGLLYIAKKNYEEARYHLANDIYFASCAFGTEDIRTSGGYFHLANIFYDLKKLDLADTLYTKVSEIWHAYLNNHYQVLSQAHIQQMDLLGKLFENDTGLDEAQEAEAIRILTSILNIRESTSDKAPQKTIFVLKILVMLYYLMMNSSKAQEYGMRALSLAKEQQLDVHEQSTIQELLSLISTEDHPIT

SEQ ID NO: 63529 - protein, 1048 aa, Homo sapiens
MQSKVTGNMPTQSLLMYMDGPEVIGSSLGSPMEMEDALSMKGTAVVPFRATQEKNVIQIEGYMPLDCMFCSQTFTHSEDLNKHVLMQHRPTLCEPAVLRVEAEYLSPLDKSQVRTEPPKEKNCKENEFSCEVCGQTFRVAFDVEIHMRTHKDSFTYGCNMCGRRFKEPWFLKNHMRTHNGKSGARSKLQQGLESSPATINEVVQVHAAESISSPYKICMVCGFLFPNKESLIEHRKVHTKKTAFGTSSAQTDSPQGGMPSSREDFLQLFNLRPKSHPETGKKPVRCIPQLDPFTTFQAWQLATKGKVAICQEVKESGQEGSTDNDDSSSEKELGETNKGSCAGLSQEKEKCKHSHGEAPSVDADPKLPSSKEKPTHCSECGKAFRTYHQLVLHSRVHKKDRRAGAESPTMSVDGRQPGTCSPDLAAPLDENGAVDRGEGGSEDGSEDGLPEGIHLDKNDDGGKIKHLTSSRECSYCGKFFRSNYYLNIHLRTHTGEKPYKCEFCEYAAAQKTSLRYHLERHHKEKQTDVAAEVKNDGKNQDTEDALLTADSAQTKNLKRFFDGAKDVTGSPPAKQLKEMPSVFQNVLGSAVLSPAHKDTQDFHKNAADDSADKVNKNPTPAYLDLLKKRSAVETQANNLICRTKADVTPPPDGSTTHNLEVSPKEKQTETAADCRYRPSVDCHEKPLNLSVGALHNCPAISLSKSLIPSITCPFCTFKTFYPEVLMMHQRLEHKYNPDVHKNCRNKSLLRSRRTGCPPALLGKDVPPLSSFCKPKPKSAFPAQSKSLPSAKGKQSPPGPGKAPLTSGIDSSTLAPSNLKSHRPQQNVGVQGAATRQQQSEMFPKTSVSPAPDKTKRPETKLKPLPVAPSQPTLGSSNINGSIDYPAKNDSPWAPPGRDYFCNRSASNTAAEFGEPLPKRLKSSVVALDVDQPGANYRRGYDLPKYHMVRGITSLLPQDCVYPSQALPPKPRFLSSSEVDSPNVLTVQKPYGGSGPLYTCVPAGSPASSSTLEGKRPVSYQHLSNSMAQKRNYENFIGNAHYRPNDKKT

SEQ ID NO: 63530 - protein, 670 aa, Homo sapiens
MTKFQEMVTFKDVAVVFTREELGLLDLAQRKLYQDVMLENFRNLLSVGYQPFKLDVILQLGKEDKLRMMETEIQGDGCSGHKNQNEIDTLQEVRLRFLSYEDLICWQIWEQFTSKLTSNQDLIINLQGKRSKLLKQGDSPCQVWTGESSQVSEDENYVIKLQGESSNSIKNQELPLRTTWDFWRKMYLREPQNYQSRCQQIDVKNKLCKCDHCVRQRIAHQHDDHGVHKREKAFSHNNCGKDCVKESSQHSIIQSGEQTSDENGKGLSVGSNLELHQQLHLRDKPHVNVEYGKGIGYSSGLPRHQCFHIGEKCYRNGDSGEGFSQGSHLQPHQRVSTGENLYRCQVYARSSNQNSCLPSHELTHPGEKLCTCGRCGKGFHHSLDFDIHCVDSAGERACKCDVYDKGFSQTSQLQAHQRGHSRDKTYKWEVSDRIFNRNSGLHQRVHTGEKPYKCEVCDKGFSKASNLQAHQRIHTGEKPYKCDVCDKNFSRNSHLQAHQRVHTGEKPYKCDTCGKDFSQISHLQAHQRVHTGEKPYKCETCGKGFSQSSHLQDHQQVHTGENPYKCDVCGKGFSWSSHLQAHQRVHTGEKPYKCEECRKGFIWNSYLHVHQRIHTGEKPYKCGMCGKSFSQTSHLQAHQRVHTGEKPYKCFVCGKGFSKSSLSSDSSESP

SEQ ID NO: 63531 - protein, 627 aa, Homo sapiens
MAAAVLTDRAQVSVTFDDVAVTFTKEEWGQLDLAQRTLYQEVMLENCGLLVSLGCPVPKAELICHLEHGQEPWTRKEDLSQDTCPGDKGKPKTTEPTTCEPALSEGISLQGQVTQGNSVDSQLGQAEDQDGLSEMQEGHFRPGIDPQEKSPGKMSPECDGLGTADGVCSRIGQEQVSPGDRVRSHNSCESGKDPMIQEEENNFKCSECGKVFNKKHLLAGHEKIHSGVKPYECTECGKTFIKSTHLLQHHMIHTGERPYECMECGKAFNRKSYLTQHQRIHSGEKPYKCNECGKAFTHRSNFVLHNRRHTGEKSFVCTECGQVFRHRPGFLRHYVVHSGENPYECLECGKVFKHRSYLMWHQQTHTGEKPYECSECGKVFLESAALIHHYVIHTGEKPFECLECGKAFNHRSYLKRHQRIHTGEKPFVCSECGKAFTHCSTFILHKRAHTGEKPFECKECGKAFSNRKDLIRHFSIHTGEKPYECVECGKAFTRMSGLTRHKRIHSGEKPYECVECGKSFCWSTNLIRHAIIHTGEKPYKCSECGKAFSRSSSLTQHQRMHTGKNPISVTDVGRPFTSGQTSVTLRELLLGKDFLNVTTEANILPEETSSSASDQPYQRETPQVSSL

SEQ ID NO: 63532 - protein, 871 aa, Homo sapiens
MAEEFVTLKDVGMDFTLGDWEQLGLEQGDTFWDTALDNCQDLFLLDPPRPNLTSHPDGSEDLEPLAGGSPEATSPDVTETKNSPLMEDFFEEGFSQEIIEMLSKDGFWNSNFGEACIEDTWLDSLLGDPESLLRSDIATNGESPTECKSHELKRGLSPVSTVSTGEDSMVHNVSEKTLTPAKSKEYRGEFFSYSDHSQQDSVQEGEKPYQCSECGKSFSGSYRLTQHWITHTREKPTVHQECEQGFDRNASLSVYPKTHTGYKFYVCNEYGTTFSQSTYLWHQKTHTGEKPCKSQDSDHPPSHDTQPGEHQKTHTDSKSYNCNECGKAFTRIFHLTRHQKIHTRKRYECSKCQATFNLRKHLIQHQKTHAAKTTSECQECGKIFRHSSLLIEHQALHAGEEPYKCNERGKSFRHNSTLKIHQRVHSGEKPYKCSECGKAFHRHTHLNEHRRIHTGYRPHKCQECVRSFSRPSHLMRHQAIHTAEKPYSCAECKETFSDNNRLVQHQKMHTVKTPYECQECGERFICGSTLKCHESVHAREKQGFFVSGKILDQNPEQKEKCFKCNKCEKTFSCSKYLTQHERIHTRGVKPFECDQCGKAFGQSTRLIHHQRIHSRVRLYKWGEQGKAISSASLIKLQSFHTKEHPFKCNECGKTFSHSAHLSKHQLIHAGENPFKCSKCDRVFTQRNYLVQHERTHARKKPLVCNECGKTFRQSSCLSKHQRIHSGEKPYVCDYCGKAFGLSAELVRHQRIHTGEKPYVCQECGKAFTQSSCLSIHRRVHTGEKPYRCGECGKAFAQKANLTQHQRIHTGEKPYSCNVCGKAFVLSAHLNQHLRVHTQETLYQCQRCQKAFRCHSSLSRHQRVHNKQQYCL

SEQ ID NO: 63533 - protein, 871 aa, Homo sapiens; identical to SEQ ID NO: 63532

SEQ ID NO: 63534 - protein, 524 aa, Homo sapiens
MAKRPGPPGSREMGLLTFRDIAIEFSLEEWQCLDCAQRNLYRDVMLENYRNLVSLGIAVSKPDLITCLEQNKESQNIKRNEMVAKHPVTRSHFTQDLQPEQGIKDSLQKVIPRTYGKCGHEKLQFKKCCKSVGEYEVHKGGYSEVNQCLSTTQNKIFQTHKYVKVFGKFSNSNRDKTRYTGNKHFKCNKYGKSFCMLSHLNQHQVIHTREKSYKCKECGKSFNCSSNHTTHKIIHTGEKPYRCEECGKAFSWSANLTRHKRTHTGEKPYTCEECGQAFRRSSALTNHKRIHTGERPYKCEECGKAFSVSSTLTDHKRIHTGEKPCRCEECGKAFSWSSNLTRHKRIHTREKPYACEECGQAFSLSSNLMRHRRIHTGEKPYTCEECGQDFRRSSALTIHKRIHTGERPYKCEECGKVFSLSSTLTDHKRIHTGERPYKCEECGKAFSLSSTLTDHKRIHTGERPYTCEECGKAFNCSSTLMQHKRIHTGEKPYKCEECEQAFKWHSSLAKHKIIHTGEKPYKCE

SEQ ID NO: 63535 - protein, 524 aa, Homo sapiens; identical to SEQ ID NO: 63534

SEQ ID NO: 63536 - protein, 103 aa, Homo sapiens
MSGFACLFVFQGLLTFRDIAIEFSLEEWQCLDCAQRNLYRDVMLENYRNLVSLGIAVSKPDLITCLEQNKESQNIKRNEMVAKRPDYLKNAYDVFMMAVSFFS

SEQ ID NO: 63537 - protein, 505 aa, Homo sapiens
MTKAQESLTLEDVAVDFTWEEWQFLSPAQKDLYRDVMLENYSNLVSVGYQAGKPDALTKLEQGEPLWTLEDEIHSPAHPEIEKADDHLQQPLQNQKILKRTGQRYEHGRTLKSYLGLTNQSRRYNRKEPAEFNGDGAFLHDNHEQMPTEIEFPESRKPISTKSQFLKHQQTHNIEKAHECTDCGKAFLKKSQLTEHKRIHTGKKPHVCSLCGKAFYKKYRLTEHERAHRGEKPHGCSLCGKAFYKRYRLTEHERAHKGEKPYGCSECGKAFPRKSELTEHQRIHTGIKPHQCSECGRAFSRKSLLVVHQRTHTGEKPHTCSECGKGFIQKGNLNIHQRTHTGEKPYGCIDCGKAFSQKSCLVAHQRYHTGKTPFVCPECGQPCSQKSGLIRHQKIHSGEKPYKCSDCGKAFLTKTMLIVHHRTHTGERPYGCDECEKAYFYMSCLVKHKRIHSREKRGDSVKVENPSTASHSLSPSEHVQGKSPVNMVTVAMVAGQCEFAHILHS

SEQ ID NO: 63538 - protein, 411 aa, Homo sapiens
MAKRPGSPGSREMGLLTFRDVVIEFSLEEWQCLDHAQQNLYRDVMLENYRNLVSLGIAVSKPDLITCLEQNKEPWNIKRNEMVTKHPVMCSHFTQDLPPELGIKDSLQKVIPRRYGKSGHDNLQVKTCKSMGECEVQKGGCNEVNQCLSTTQNKIFQTHKCVKVFGKFSNSNRHKTRHTGKKHFKCKKYGKSFCMVSQLHQHQIIHTRENSYQCEECGKPFNCSSTLSKHKRIHTGEKPYRCEECGKAFTWSSTLTKHRRIHTGEKPYTCEECGQAFSRSSTLANHKRIHTGEKPYTCEECGKAFSLSSSLTYHKRIHTGEKPYTCEKCGKAFNCSSTLKKHKIIHTGEKPYKCKECGKAFAFSSTLNTHKRIHTGEEPYKCEECDKAFKWSSSLANHKSMHTGEKPYKCE

SEQ ID NO: 63539 - protein, 641 aa, Homo sapiens
MDSVVFEDVAVNFTQEEWALLGPSQKKLYRDVMQETFVNLASIGENWEEKNIEDHKNQGRKLRSHMVERLCERKEGSQFGETISQTPNPKPNKKTFTRVKPYECSVCGKDYMCHSSLNRHMRSHTEHRSYEYHKYGEKSYECKECGKRFSFRSSFRIHERTHTGEKPYKCKQCGKAFSWPSSFQIHERTHTGEKPYECKECGKAFIYHTTFRGHMRMHTGEKPYKCKECGKTFSHPSSFRNHERTHSGEKPYECKQCGKAFRYYQTFQIHERTHTGEKPYQCKQCGKALSCPTSFRSHERIHTGEKPYKCKKCGKAFSFPSSFRKHERIHTGEKPYDCKECGKAFISLPSYRRHMIMHTGNGPYKCKECGKAFDCPSSFQIHERTHTGEKPYECKQCGKAFSCSSSFRMHERTHTGEKPHECKQCGKAFSCSSSVRIHERTHTGEKPYECKQCGKAFSCSSSFRMHERIHTGEKPYECKQCGKAFSFSSSFRMHERTHTGEKPYECKQCGKAFSCSSSFRMHERTHTGEKPYECKQCGKAFSCSSSIRIHERTHTGEKPYECKQCGKAFSCSSSVRMHERTHTGVKPYECKQCDKAFSCSRSFRIHERTHTGEKPYACQQCGKAFKCSRSFRIHERVHSGE

SEQ ID NO: 63540 - protein, 633 aa, Homo sapiens
MLRRGYKASERRRHLSERLSWHQDQALSSSIYLLREMGPTGFLLREEEPEYMDFRVFLGNPHVCNCSTFPKGGELCKHICWVLLKKFKLPRNHESALQLGLGEREISDLLRGIHRVQTPQPGTNDENEHVEEDGYIKQKEIDSEDICSICQELLLEKKLPVTFCRFGCGNSIHIKCMKILANYQSTSNTSMLKCPLCRKEFAPLKLILEEFKNSSKLVAAAEKERLDKHLGIPCNNCKQFPIEGKCYKCTECIEYHLCQECFDSCCHLSHTFTFREKRNQKWRSLEKRADEVVKYIDTKNEIEEKMSHFQEKQGQVYTPKHIVRSLPLQLITKNSKLLAPGYQCLLCLKAFHLGQHTRLLPCTHKFHRKCIDNWLFHKCNSCPIDGQVIYNPLTWKNSAVNGQAHQSVSNRDIIHLSKQKEPDLFIPGTGLVLKQNRLGILPSIPQCNFDELNTPQSPKDAYENTTIDNLCSIKLDNSNSKKLTYDYKISQHFPRYLQDLPTVSFGKIPSQTLLPPIVHKNIVCPTAMESPCISGKFHTSLSRMTKGCKCNNHNLKKTPATKIREDNKRSTLLPEDFNLIVNWSTAKLSLSKRYSNCMGEITRKCSHLSRQPVSHSVNTKSTELSLIIEGVQL

SEQ ID NO: 63541 - DNA, 20 bp, Homo sapiens
gatcacgtcctggttatgga

SEQ ID NO: 63542 - DNA, 20 bp, Homo sapiens
gatccctgtgctctatctca

SEQ ID NO: 63543 - DNA, 20 bp, Homo sapiens
gatcagtctctgatggtggg

SEQ ID NO: 63544 - DNA, 20 bp, Homo sapiens
gatcctgctgaatgctatcc

SEQ ID NO: 63545 - DNA, 20 bp, Homo sapiens
gatcaggaggtcgaggtcag

SEQ ID NO: 63546 - DNA, 20 bp, Homo sapiens
gatcgcctccaagattggtt

SEQ ID NO: 63547 - DNA, 20 bp, Homo sapiens
gatctgacctggttctcaac

SEQ ID NO: 63548 - DNA, 20 bp, Homo sapiens
gatcaacattttatgtaaag

SEQ ID NO: 63549 - DNA, 20 bp, Homo sapiens
gatcagcccaggaaatagat

SEQ ID NO: 63550 - DNA, 20 bp, Homo sapiens
gatccttggtttcgggaagt

SEQ ID NO: 63551 - DNA, 20 bp, Homo sapiens
gatcgaatgagctcctggat

SEQ ID NO: 63552 - DNA, 20 bp, Homo sapiens
gatctagaagcctgggccct

SEQ ID NO: 63553 - DNA, 20 bp, Homo sapiens
gatcacatgtaccactgact

SEQ ID NO: 63554 - DNA, 20 bp, Homo sapiens
gatcatccagtacagactgc

SEQ ID NO: 63555 - DNA, 20 bp, Homo sapiens
gatccgctacgtgctgccgg

SEQ ID NO: 63556 - DNA, 20 bp, Homo sapiens
gatcgccccggaggagcatg

SEQ ID NO: 63557 - DNA, 20 bp, Homo sapiens
gatcctccccgaggagcacg

SEQ ID NO: 63558 - DNA, 20 bp, Homo sapiens
gatcttgttttatatctgca

SEQ ID NO: 63559 - DNA, 20 bp, Homo sapiens
gatcacggctccccccgacc

SEQ ID NO: 63560 - DNA, 20 bp, Homo sapiens
gatccaaatgtatccatttt

SEQ ID NO: 63561 - DNA, 20 bp, Homo sapiens
gatctttaaaagaaatgaaa

SEQ ID NO: 63562 - DNA, 20 bp, Homo sapiens
gatctatggcctggtgggag

SEQ ID NO: 63563 - DNA, 20 bp, Homo sapiens
gatcttcccttacattagta

SEQ ID NO: 63564 - DNA, 20 bp, Homo sapiens
gatcatatatgcatccacag

SEQ ID NO: 63565 - DNA, 20 bp, Homo sapiens
gatctggaccaataaaaacc

SEQ ID NO: 63566 - DNA, 20 bp, Homo sapiens
gatcaaaacttgtgggaaaa

SEQ ID NO: 63567 - DNA, 20 bp, Homo sapiens
gatcaataaatgccgacaac

SEQ ID NO: 63568 - DNA, 20 bp, Homo sapiens
gatcagcaaataaacagcat

SEQ ID NO: 63569 - DNA, 20 bp, Homo sapiens
gatcaatttgcaaaaaaaaa

SEQ ID NO: 63570 - DNA, 20 bp, Homo sapiens
gatcctggaggagaagctga

SEQ ID NO: 63571 - DNA, 20 bp, Homo sapiens
gatctagttcgttatacccg

SEQ ID NO: 63572 - DNA, 20 bp, Homo sapiens
gatcctgaccaaatgaagtt

SEQ ID NO: 63573 - DNA, 20 bp, Homo sapiens
gatctgtctgtctacgctca

SEQ ID NO: 63574 - DNA, 20 bp, Homo sapiens
gatcacttgggagattatct

SEQ ID NO: 63575 - DNA, 20 bp, Homo sapiens
gatcgaggtgccaaagcact

SEQ ID NO: 63576 - DNA, 20 bp, Homo sapiens
gatctgctcactccggaaaa

SEQ ID NO: 63577 - DNA, 20 bp, Homo sapiens
gatccaggagaagctacttc

SEQ ID NO: 63578 - DNA, 20 bp, Homo sapiens
gatcccttcatcatcaccag

SEQ ID NO: 63579 - DNA, 20 bp, Homo sapiens
gatcgtgtctgccctgcttc

SEQ ID NO: 63580 - DNA, 20 bp, Homo sapiens
gatcagctcacaggttagcg

SEQ ID NO: 63581 - DNA, 20 bp, Homo sapiens
gatccttgactcctcttcat

SEQ ID NO: 63582 - DNA, 20 bp, Homo sapiens
gatctgacaaagcggaagaa

SEQ ID NO: 63583 - DNA, 20 bp, Homo sapiens
gatctcccccgtcaatattc

SEQ ID NO: 63584 - DNA, 20 bp, Homo sapiens
gatctgaaggtacctgaaga

SEQ ID NO: 63585 - DNA, 20 bp, Homo sapiens
gatcaggcaaaagtggattc

SEQ ID NO: 63586 - DNA, 20 bp, Homo sapiens
gatcaaattaccggattaca

SEQ ID NO: 63587 - DNA, 20 bp, Homo sapiens
gatcaaggcttttaggaaaa

SEQ ID NO: 63588 - DNA, 20 bp, Homo sapiens
gatcccgtgacaaaagttat

SEQ ID NO: 63589 - DNA, 20 bp, Homo sapiens
gatctcttcttttgtgtgac

SEQ ID NO: 63590 - DNA, 20 bp, Homo sapiens
gatcttgattttactttttt

SEQ ID NO: 63591 - DNA, 20 bp, Homo sapiens
gatcctgacggaagagaaca

SEQ ID NO: 63592 - DNA, 20 bp, Homo sapiens
gatcaccactgctggaggca

SEQ ID NO: 63593 - DNA, 20 bp, Homo sapiens
gatcttctcatgtactagga

SEQ ID NO: 63594 - DNA, 20 bp, Homo sapiens
gatcagcattggaagttttg

SEQ ID NO: 63595 - DNA, 20 bp, Homo sapiens
gatcagggaaactccttaag

SEQ ID NO: 63596 - DNA, 20 bp, Homo sapiens
gatcaggaagagggaactac

SEQ ID NO: 63597 - DNA, 20 bp, Homo sapiens
gatccagcagtccaaagcct

SEQ ID NO: 63598 - DNA, 20 bp, Homo sapiens
gatcaagaaatatgatgtaa

SEQ ID NO: 63599 - DNA, 20 bp, Homo sapiens
gatctgaaggtattccttca

SEQ ID NO: 63600 - DNA, 20 bp, Homo sapiens
gatcttgaagcgaaaaataa

SEQ ID NO: 63601 - DNA, 20 bp, Homo sapiens
gatcttcttcatgccagcca

SEQ ID NO: 63602 - DNA, 20 bp, Homo sapiens
gatcaactaaagttgattgt

SEQ ID NO: 63603 - DNA, 20 bp, Homo sapiens
gatcaattgaatttctttcc

SEQ ID NO: 63604 - DNA, 20 bp, Homo sapiens
gatcatccctgcctaggcaa

SEQ ID NO: 63605 - DNA, 20 bp, Homo sapiens
gatcagcagatatttctgtg

SEQ ID NO: 63606 - DNA, 20 bp, Homo sapiens
gatctagcacattacccagc

SEQ ID NO: 63607 - DNA, 20 bp, Homo sapiens
gatcgcgccaactgttcatt

SEQ ID NO: 63608 - DNA, 20 bp, Homo sapiens
gatcaaacataccatttttt

SEQ ID NO: 63609 - DNA, 20 bp, Homo sapiens
gatcctacattttggtaggg

SEQ ID NO: 63610 - DNA, 20 bp, Homo sapiens
gatctgtctgctgaagacat

SEQ ID NO: 63611 - DNA, 20 bp, Homo sapiens
gatcaacgctgtgaagtgaa

SEQ ID NO: 63612 - DNA, 20 bp, Homo sapiens
gatcagaattcagtaccatc

SEQ ID NO: 63613 - DNA, 20 bp, Homo sapiens
gatctgaccctggcacgtcc

SEQ ID NO: 63614 - DNA, 20 bp, Homo sapiens
gatcagctaccaagagaagt

SEQ ID NO: 63615 - DNA, 20 bp, Homo sapiens
gatctttacagattcattta

SEQ ID NO: 63616 - DNA, 20 bp, Homo sapiens
gatcagcctgaagaagtact

SEQ ID NO: 63617 - DNA, 20 bp, Homo sapiens
gatctccaggaagctgcagc

SEQ ID NO: 63618 - DNA, 20 bp, Homo sapiens
gatcactgctgcagaattta

SEQ ID NO: 63619 - DNA, 20 bp, Homo sapiens
gatccatgtgaactattaca

SEQ ID NO: 63620 - DNA, 20 bp, Homo sapiens
gatcatgtgcaaaggctgtg

SEQ ID NO: 63621 - DNA, 20 bp, Homo sapiens
gatcaaaccaaaaaattact

SEQ ID NO: 63622 - DNA, 20 bp, Homo sapiens
gatcgtatctaaatcacatt

SEQ ID NO: 63623 - DNA, 20 bp, Homo sapiens
gatcatttgtacagttcagt

SEQ ID NO: 63624 - DNA, 20 bp, Homo sapiens
gatcctggaggagacactct

SEQ ID NO: 63625 - DNA, 20 bp, Homo sapiens
gatcacgggggacaaccgga

SEQ ID NO: 63626 - DNA, 20 bp, Homo sapiens
gatcagccgcgacacggcgg

SEQ ID NO: 63627 - DNA, 20 bp, Homo sapiens
gatcgttcaactactagcca

SEQ ID NO: 63628 - DNA, 20 bp, Homo sapiens
gatcctgaagcacccctggg

SEQ ID NO: 63629 - DNA, 20 bp, Homo sapiens
gatctcagatttctgtcagc

SEQ ID NO: 63630 - DNA, 20 bp, Homo sapiens
gatcactgctcttctcctgg

SEQ ID NO: 63631 - DNA, 20 bp, Homo sapiens
gatctcacttttgatactgt

SEQ ID NO: 63632 - DNA, 20 bp, Homo sapiens
gatctgtaaatattgcttca

SEQ ID NO: 63633 - DNA, 20 bp, Homo sapiens
gatcgtgaacctgtattttc

SEQ ID NO: 63634 - DNA, 20 bp, Homo sapiens
gatcatgaagggtgttggaa

SEQ ID NO: 63635 - DNA, 20 bp, Homo sapiens
gatctagtgagcgctcagaa

SEQ ID NO: 63636 - DNA, 20 bp, Homo sapiens
gatcttctggaggatggtta

SEQ ID NO: 63637 - DNA, 20 bp, Homo sapiens
gatcagtattcttgcctttt

SEQ ID NO: 63638 - DNA, 20 bp, Homo sapiens
gatcatgttgatggtatttc

SEQ ID NO: 63639 - DNA, 20 bp, Homo sapiens
gatccagcttcaacgaacca

SEQ ID NO: 63640 - DNA, 20 bp, Homo sapiens
gatctcaaatacattaatta

SEQ ID NO: 63641 - DNA, 20 bp, Homo sapiens
gatcacagaagtaattgtgc

SEQ ID NO: 63642 - DNA, 20 bp, Homo sapiens
gatcatcatgtataccatat

SEQ ID NO: 63643 - DNA, 20 bp, Homo sapiens
gatcctggtacttctttgcc

SEQ ID NO: 63644 - DNA, 20 bp, Homo sapiens
gatctaatggaattgtcttt

SEQ ID NO: 63645 - DNA, 20 bp, Homo sapiens
gatcttttctaagcctttta

SEQ ID NO: 63646 - DNA, 20 bp, Homo sapiens
gatcaaaatgcatatggtaa

SEQ ID NO: 63647 - DNA, 20 bp, Homo sapiens
gatcccgattgaacctgttg

SEQ ID NO: 63648 - DNA, 20 bp, Homo sapiens
gatccctctgattttcttga

SEQ ID NO: 63649 - DNA, 20 bp, Homo sapiens
gatcttgggaatggattgac

SEQ ID NO: 63650 - DNA, 20 bp, Homo sapiens
gatcttttaccattcatttt

SEQ ID NO: 63651 - DNA, 20 bp, Homo sapiens
gatcctgaagatacagatga

SEQ ID NO: 63652 - DNA, 20 bp, Homo sapiens
gatcctgaaaaataccagca

SEQ ID NO: 63653 - DNA, 20 bp, Homo sapiens
gatctggtcaagacctacag

SEQ ID NO: 63654 - DNA, 20 bp, Homo sapiens
gatccagcaccactatttaa

SEQ ID NO: 63655 - DNA, 20 bp, Homo sapiens
gatccatgttaattcatatg

SEQ ID NO: 63656 - DNA, 20 bp, Homo sapiens
gatcatcattgctactttta

SEQ ID NO: 63657 - DNA, 20 bp, Homo sapiens
gatcctttctaaggagccga

SEQ ID NO: 63658 - DNA, 20 bp, Homo sapiens
gatctagtgtctgcgattag

SEQ ID NO: 63659 - DNA, 20 bp, Homo sapiens
gatctgtgacttcttggaag

SEQ ID NO: 63660 - DNA, 20 bp, Homo sapiens
gatcaagcctttttgttgct

SEQ ID NO: 63661 - DNA, 20 bp, Homo sapiens
gatcaggcaggtccacactt

SEQ ID NO: 63662 - DNA, 20 bp, Homo sapiens
gatcgtcaaaagtacctaaa

SEQ ID NO: 63663 - DNA, 20 bp, Homo sapiens
gatcacggagagggccaaga

SEQ ID NO: 63664 - DNA, 20 bp, Homo sapiens
gatcagcgaatacatgaact

SEQ ID NO: 63665 - DNA, 20 bp, Homo sapiens
gatcatgccaaccaactgtc

SEQ ID NO: 63666 - DNA, 20 bp, Homo sapiens
gatcttacaaagtaacagac

SEQ ID NO: 63667 - DNA, 20 bp, Homo sapiens
gatcctctttctgcacctct

SEQ ID NO: 63668 - DNA, 20 bp, Homo sapiens
gatccccactgttggaggtg

SEQ ID NO: 63669 - DNA, 20 bp, Homo sapiens
gatctcagacttctgtcctc

SEQ ID NO: 63670 - DNA, 20 bp, Homo sapiens
gatctggcataggggtactg

SEQ ID NO: 63671 - DNA, 20 bp, Homo sapiens
gatcgttttaggtgtgtcag

SEQ ID NO: 63672 - DNA, 20 bp, Homo sapiens
gatctatgtaaacaccttct

SEQ ID NO: 63673 - DNA, 20 bp, Homo sapiens
gatcttcctcagaagaacat

SEQ ID NO: 63674 - DNA, 20 bp, Homo sapiens
gatcaaccatgtacaaatca

SEQ ID NO: 63675 - DNA, 20 bp, Homo sapiens
gatcgcaggtttcctaagaa

SEQ ID NO: 63676 - DNA, 20 bp, Homo sapiens
gatctaatttcaaaatgtac

SEQ ID NO: 63677 - DNA, 20 bp, Homo sapiens
gatcagctgtatcttttatc

SEQ ID NO: 63678 - DNA, 20 bp, Homo sapiens
gatcaggaacaaaaggtaga

SEQ ID NO: 63679 - DNA, 20 bp, Homo sapiens
gatccacaaagtttgctatt

SEQ ID NO: 63680 - DNA, 20 bp, Homo sapiens
gatcgtttgagacccagaaa

SEQ ID NO: 63681 - DNA, 20 bp, Homo sapiens
gatcatttacagactcccta

SEQ ID NO: 63682 - DNA, 20 bp, Homo sapiens
gatctgcctgcagagctaaa

SEQ ID NO: 63683 - DNA, 20 bp, Homo sapiens
gatctgggagctgtttgatt

SEQ ID NO: 63684 - DNA, 20 bp, Homo sapiens
gatcctacgattcttcaagc

SEQ ID NO: 63685 - DNA, 20 bp, Homo sapiens
gatcggttgttttggaaggt

SEQ ID NO: 63686 - DNA, 20 bp, Homo sapiens
gatcgtggacttcttcaaga

SEQ ID NO: 63687 - DNA, 20 bp, Homo sapiens
gatctgttttatcttaagaa

SEQ ID NO: 63688 - DNA, 20 bp, Homo sapiens
gatcattactgtaaacatag

SEQ ID NO: 63689 - DNA, 20 bp, Homo sapiens
gatcgcactgctcacggaac

SEQ ID NO: 63690 - DNA, 20 bp, Homo sapiens
gatccagaagaaaacacaaa

SEQ ID NO: 63691 - DNA, 20 bp, Homo sapiens
gatcttccagaaaatgaggt

SEQ ID NO: 63692 - DNA, 20 bp, Homo sapiens
gatcagtgacccgcgagccg

SEQ ID NO: 63693 - DNA, 20 bp, Homo sapiens
gatccacaaactggtgcaga

SEQ ID NO: 63694 - DNA, 20 bp, Homo sapiens
gatcatcatgacgcccgaca

SEQ ID NO: 63695 - DNA, 20 bp, Homo sapiens
gatcatcatcacgcgagcgt

SEQ ID NO: 63696 - DNA, 20 bp, Homo sapiens
gatcaaagacatcagtggtg

SEQ ID NO: 63697 - DNA, 20 bp, Homo sapiens
gatcaagagggccaccatca

SEQ ID NO: 63698 - DNA, 20 bp, Homo sapiens
gatccccggcttgctgaagt

SEQ ID NO: 63699 - DNA, 20 bp, Homo sapiens
gatcagaggttttattgaat

SEQ ID NO: 63700 - DNA, 20 bp, Homo sapiens
gatcacctttgaatgaaatt

SEQ ID NO: 63701 - DNA, 20 bp, Homo sapiens
gatcccaggaccatgtcaag

SEQ ID NO: 63702 - DNA, 20 bp, Homo sapiens
gatcaagaaacagctccggg

SEQ ID NO: 63703 - DNA, 20 bp, Homo sapiens
gatcagcggcgtcgtggcac

SEQ ID NO: 63704 - DNA, 20 bp, Homo sapiens
gatcaggtgcaacaccacca

SEQ ID NO: 63705 - DNA, 20 bp, Homo sapiens
gatctcttcttcagatttgc

SEQ ID NO: 63706 - DNA, 20 bp, Homo sapiens
gatcagaggtcatactgtga

SEQ ID NO: 63707 - DNA, 20 bp, Homo sapiens
gatccggtggaagataaaca

SEQ ID NO: 63708 - DNA, 20 bp, Homo sapiens
gatcacggccaactccaaag

SEQ ID NO: 63709 - DNA, 20 bp, Homo sapiens
gatccccatcacagcttggg

SEQ ID NO: 63710 - DNA, 20 bp, Homo sapiens
gatcagctgtaccaggggaa

SEQ ID NO: 63711 - DNA, 20 bp, Homo sapiens
gatcacccgcacccaagtgc

SEQ ID NO: 63712 - DNA, 20 bp, Homo sapiens
gatctgaggaacattaaagt

SEQ ID NO: 63713 - DNA, 20 bp, Homo sapiens
gatcatagtgcaaagagagc

SEQ ID NO: 63714 - DNA, 20 bp, Homo sapiens
gatctgtttatgaaaatgaa

SEQ ID NO: 63715 - DNA, 20 bp, Homo sapiens
gatctttataatcatgtaaa

SEQ ID NO: 63716 - DNA, 20 bp, Homo sapiens
gatcagattatgcgacggta

SEQ ID NO: 63717 - DNA, 20 bp, Homo sapiens
gatcatgtgtgaatttcaca

SEQ ID NO: 63718 - DNA, 20 bp, Homo sapiens
gatctctgtacccccgcagt

SEQ ID NO: 63719 - DNA, 20 bp, Homo sapiens
gatcattataactgaaagtt

SEQ ID NO: 63720 - DNA, 20 bp, Homo sapiens
gatccatctgcagcagaggc

SEQ ID NO: 63721 - DNA, 20 bp, Homo sapiens
gatcttctttaatattgctc

SEQ ID NO: 63722 - DNA, 20 bp, Homo sapiens
gatcaaagaagacaagtcat

SEQ ID NO: 63723 - DNA, 20 bp, Homo sapiens
gatctagttcatgactttct

SEQ ID NO: 63724 - DNA, 20 bp, Homo sapiens
gatcaattatattttctctt

SEQ ID NO: 63725 - DNA, 20 bp, Homo sapiens
gatctttaattgttggatgg

SEQ ID NO: 63726 - DNA, 20 bp, Homo sapiens
gatctttgacactaaaaaaa

SEQ ID NO: 63727 - DNA, 20 bp, Homo sapiens
gatcaaggagaacaaaacct

SEQ ID NO: 63728 - DNA, 20 bp, Homo sapiens
gatcatgcaggcactgggct

SEQ ID NO: 63729 - DNA, 20 bp, Homo sapiens
gatcaattatcctgagaact

SEQ ID NO: 63730 - DNA, 20 bp, Homo sapiens
gatcaacaatccatgttagt

SEQ ID NO: 63731 - DNA, 20 bp, Homo sapiens
gatcaaccgagggcagcttt

SEQ ID NO: 63732 - DNA, 20 bp, Homo sapiens
gatcacaagcccaaggaatg

SEQ ID NO: 63733 - DNA, 20 bp, Homo sapiens
gatcatctgatgctatgatt

SEQ ID NO: 63734 - DNA, 20 bp, Homo sapiens
gatctcagcctgttccaatc

SEQ ID NO: 63735 - DNA, 20 bp, Homo sapiens
gatccctcagagaccagctc

SEQ ID NO: 63736 - DNA, 20 bp, Homo sapiens
gatcagtccaccctgaaggt

SEQ ID NO: 63737 - DNA, 20 bp, Homo sapiens
gatcgcctattactgacagt

SEQ ID NO: 63738 - DNA, 20 bp, Homo sapiens
gatccccttcatcactgtgg

SEQ ID NO: 63739 - DNA, 20 bp, Homo sapiens
gatcctttatctgttttatc

SEQ ID NO: 63740 - DNA, 20 bp, Homo sapiens
gatctgcggctggtgctgat

SEQ ID NO: 63741 - DNA, 20 bp, Homo sapiens
gatcagatggtactagaggc

SEQ ID NO: 63742 - DNA, 20 bp, Homo sapiens
gatcttgcgtgcagggatgc

SEQ ID NO: 63743 - DNA, 20 bp, Homo sapiens
gatctcagaccaataacaaa

SEQ ID NO: 63744 - DNA, 20 bp, Homo sapiens
gatcaggactaggggctctg

SEQ ID NO: 63745 - DNA, 20 bp, Homo sapiens
gatcctatgtttccttcttc

SEQ ID NO: 63746 - DNA, 20 bp, Homo sapiens
gatcggtgctggttttggtt

SEQ ID NO: 63747 - DNA, 20 bp, Homo sapiens
gatcttatttgtagactcgt

SEQ ID NO: 63748 - DNA, 20 bp, Homo sapiens
gatcttccatatggcaccta

SEQ ID NO: 63749 - DNA, 20 bp, Homo sapiens
gatctgcaggcatctctgac

SEQ ID NO: 63750 - DNA, 20 bp, Homo sapiens
gatctgtgaaatatggggag

SEQ ID NO: 63751 - DNA, 20 bp, Homo sapiens
gatctgagagacctgctgtg

SEQ ID NO: 63752 - DNA, 20 bp, Homo sapiens
gatcccagttcctccaaggg

SEQ ID NO: 63753 - DNA, 20 bp, Homo sapiens
gatccgatcccagttcctcc

SEQ ID NO: 63754 - DNA, 20 bp, Homo sapiens
gatcgtgctgattctccccc

SEQ ID NO: 63755 - DNA, 20 bp, Homo sapiens
gatctacaaccctaagtctg

SEQ ID NO: 63756 - DNA, 20 bp, Homo sapiens
gatctaaaaggggccagcct

SEQ ID NO: 63757 - DNA, 20 bp, Homo sapiens
gatcagtctggtactgaata

SEQ ID NO: 63758 - DNA, 20 bp, Homo sapiens
gatcaatttggtcaccaaag

SEQ ID NO: 63759 - DNA, 20 bp, Homo sapiens
gatcgcgagctcatggctga

SEQ ID NO: 63760 - DNA, 20 bp, Homo sapiens
gatcctataagttcaccatc

SEQ ID NO: 63761 - DNA, 20 bp, Homo sapiens
gatcagaaggaaagtccaca

SEQ ID NO: 63762 - DNA, 20 bp, Homo sapiens
gatctgaagaatggttctgg

SEQ ID NO: 63763 - DNA, 20 bp, Homo sapiens
gatcgctgctcagagtgagg

SEQ ID NO: 63764 - DNA, 20 bp, Homo sapiens
gatcaggctatgtcttgaaa

SEQ ID NO: 63765 - DNA, 20 bp, Homo sapiens
gatcataaagaaaaatcaac

SEQ ID NO: 63766 - DNA, 20 bp, Homo sapiens
gatctcagtgctcctgtgga

SEQ ID NO: 63767 - DNA, 20 bp, Homo sapiens
gatccaaatattgtagatgt

SEQ ID NO: 63768 - DNA, 20 bp, Homo sapiens
gatcgcgcagtatttctgcg

SEQ ID NO: 63769 - DNA, 20 bp, Homo sapiens
gatctcaataaacctctgca

SEQ ID NO: 63770 - DNA, 20 bp, Homo sapiens
gatctcacaggtcctttgag

SEQ ID NO: 63771 - DNA, 20 bp, Homo sapiens
gatcgtccacaccacaccct

SEQ ID NO: 63772 - DNA, 20 bp, Homo sapiens
gatcttccggtctcaacagg

SEQ ID NO: 63773 - DNA, 20 bp, Homo sapiens
gatcagccttcatggccatc

SEQ ID NO: 63774 - DNA, 20 bp, Homo sapiens
gatccccatttactcacacc

SEQ ID NO: 63775 - DNA, 20 bp, Homo sapiens
gatctccgtttacagttcag

SEQ ID NO: 63776 - DNA, 20 bp, Homo sapiens
gatcaacctccagttgacaa

SEQ ID NO: 63777 - DNA, 20 bp, Homo sapiens
gatccttaccaagtttcact

SEQ ID NO: 63778 - DNA, 20 bp, Homo sapiens
gatcggcgagtggcgcccac

SEQ ID NO: 63779 - DNA, 20 bp, Homo sapiens
gatccgtcgcctgtttcata

SEQ ID NO: 63780 - DNA, 20 bp, Homo sapiens
gatccttcttaccaaatgac

SEQ ID NO: 63781 - DNA, 20 bp, Homo sapiens
gatcagcaaaaccagtgtca

SEQ ID NO: 63782 - DNA, 20 bp, Homo sapiens
gatccaaataaaaaagaaaa

SEQ ID NO: 63783 - DNA, 20 bp, Homo sapiens
gatcctctgctgcaaacaga

SEQ ID NO: 63784 - DNA, 20 bp, Homo sapiens
gatctttaactgcctgctgt

SEQ ID NO: 63785 - DNA, 20 bp, Homo sapiens
gatctttaactgcctgctga

SEQ ID NO: 63786 - DNA, 20 bp, Homo sapiens
gatcagcaaaaacacatggg

SEQ ID NO: 63787 - DNA, 20 bp, Homo sapiens
gatcagaatcatctgagaaa

SEQ ID NO: 63788 - DNA, 20 bp, Homo sapiens
gatcaccaggaacgcatgat

SEQ ID NO: 63789 - DNA, 20 bp, Homo sapiens
gatcaattattttacagatg

SEQ ID NO: 63790 - DNA, 20 bp, Homo sapiens
gatctccacaagatgtctgc

SEQ ID NO: 63791 - DNA, 20 bp, Homo sapiens
gatcccagctctcagatggt

SEQ ID NO: 63792 - DNA, 20 bp, Homo sapiens
gatcattttgtcagatataa

SEQ ID NO: 63793 - DNA, 20 bp, Homo sapiens
gatcttagtcacttgagaag

SEQ ID NO: 63794 - DNA, 20 bp, Homo sapiens
gatctcttcacttgtcaacc

SEQ ID NO: 63795 - DNA, 20 bp, Homo sapiens
gatcttgaagactccattta

SEQ ID NO: 63796 - DNA, 20 bp, Homo sapiens
gatcttgatgtgcttctatt

SEQ ID NO: 63797 - DNA, 20 bp, Homo sapiens
gatcattcaacttcaagtgg

SEQ ID NO: 63798 - DNA, 20 bp, Homo sapiens
gatccaggcctgcaaggtca

SEQ ID NO: 63799 - DNA, 20 bp, Homo sapiens
gatcagtcactttgcaaata

SEQ ID NO: 63800 - DNA, 20 bp, Homo sapiens
gatcataattgacctttgag

SEQ ID NO: 63801 - DNA, 20 bp, Homo sapiens
gatcagtcttctcgccgagt

SEQ ID NO: 63802 - DNA, 20 bp, Homo sapiens
gatcaataattaatgaatga

SEQ ID NO: 63803 - DNA, 20 bp, Homo sapiens
gatcagtataatatgtgtcc

SEQ ID NO: 63804 - DNA, 20 bp, Homo sapiens
gatcaccatcactgtatctc

SEQ ID NO: 63805 - DNA, 20 bp, Homo sapiens
gatcaacccttcttggaaga

SEQ ID NO: 63806 - DNA, 20 bp, Homo sapiens
gatcagctttgcacacggtt

SEQ ID NO: 63807 - DNA, 20 bp, Homo sapiens
gatcctctacccttctctgg

SEQ ID NO: 63808 - DNA, 20 bp, Homo sapiens
gatcaggcacaagaacatca

SEQ ID NO: 63809 - DNA, 20 bp, Homo sapiens
gatcatactcccaattatgc

SEQ ID NO: 63810 - DNA, 20 bp, Homo sapiens
gatcagcaataaaagaggag

SEQ ID NO: 63811 - DNA, 20 bp, Homo sapiens
gatcttctgacaacagtgca

SEQ ID NO: 63812 - DNA, 20 bp, Homo sapiens
gatctggagccgtgtgtgtc

SEQ ID NO: 63813 - DNA, 20 bp, Homo sapiens
gatctctctatgatgaaata

SEQ ID NO: 63814 - DNA, 20 bp, Homo sapiens
gatctcctttaacttttcag

SEQ ID NO: 63815 - DNA, 20 bp, Homo sapiens
gatcactcacaattcaccac

SEQ ID NO: 63816 - DNA, 20 bp, Homo sapiens
gatcattacgtcttctatta

SEQ ID NO: 63817 - DNA, 20 bp, Homo sapiens
gatcagtcaccatccacagg

SEQ ID NO: 63818 - DNA, 20 bp, Homo sapiens
gatcagcaaaaatgtctatc

SEQ ID NO: 63819 - DNA, 20 bp, Homo sapiens
gatcgcccactccgagaagt

SEQ ID NO: 63820 - DNA, 20 bp, Homo sapiens
gatcacgagaccattcaaat

SEQ ID NO: 63821 - DNA, 20 bp, Homo sapiens
gatcaagttgcttgtcttaa

SEQ ID NO: 63822 - DNA, 20 bp, Homo sapiens
gatcagttttcagtttctgc

SEQ ID NO: 63823 - DNA, 20 bp, Homo sapiens
gatccagaaatgacgctgtc

SEQ ID NO: 63824 - DNA, 20 bp, Homo sapiens
gatcctgaactttttttagc

SEQ ID NO: 63825 - DNA, 20 bp, Homo sapiens
gatctggtgacaaatgtgct

SEQ ID NO: 63826 - DNA, 20 bp, Homo sapiens
gatcaaaaagcttagaaaat

SEQ ID NO: 63827 - DNA, 20 bp, Homo sapiens
gatcactaaagttcattcct

SEQ ID NO: 63828 - DNA, 20 bp, Homo sapiens
gatccccattggatataagg

SEQ ID NO: 63829 - DNA, 20 bp, Homo sapiens
gatcatagactttgacagct

SEQ ID NO: 63830 - DNA, 20 bp, Homo sapiens
gatcacaactatgaaacagg

SEQ ID NO: 63831 - DNA, 20 bp, Homo sapiens
gatcccttcgtagaattttt

SEQ ID NO: 63832 - DNA, 20 bp, Homo sapiens
gatcttccagtgacccgcac

SEQ ID NO: 63833 - DNA, 20 bp, Homo sapiens
gatctgtttcaggactgcca

SEQ ID NO: 63834 - DNA, 20 bp, Homo sapiens
gatcgtgcatgtgctgagcc

SEQ ID NO: 63835 - DNA, 20 bp, Homo sapiens
gatcgagaacctcatgagtc

SEQ ID NO: 63836 - DNA, 20 bp, Homo sapiens
gatctacagttttaacttcc

SEQ ID NO: 63837 - DNA, 20 bp, Homo sapiens
gatcaccagcatcaaggcac

SEQ ID NO: 63838 - DNA, 20 bp, Homo sapiens
gatcgcttgaaagctgagtg

SEQ ID NO: 63839 - DNA, 20 bp, Homo sapiens
gatccacgggaaaagccggg

SEQ ID NO: 63840 - DNA, 20 bp, Homo sapiens
gatctctgacaatgacatcc

SEQ ID NO: 63841 - DNA, 20 bp, Homo sapiens
gatctggccacacggctgca

SEQ ID NO: 63842 - DNA, 20 bp, Homo sapiens
gatctccaagaagaggctgc

SEQ ID NO: 63843 - DNA, 20 bp, Homo sapiens
gatcaggagcggaataaggc

SEQ ID NO: 63844 - DNA, 20 bp, Homo sapiens
gatctctttcttgtcaaaga

SEQ ID NO: 63845 - DNA, 20 bp, Homo sapiens
gatcgtgaaagaagaagtcg

SEQ ID NO: 63846 - DNA, 20 bp, Homo sapiens
gatcataaaaacatgcatca

SEQ ID NO: 63847 - DNA, 20 bp, Homo sapiens
gatcatagcagaacttcaga

SEQ ID NO: 63848 - DNA, 20 bp, Homo sapiens
gatcttaattacatttaagg

SEQ ID NO: 63849 - DNA, 20 bp, Homo sapiens
gatcaagctaacttttgttc

SEQ ID NO: 63850 - DNA, 20 bp, Homo sapiens
gatcaacttcagtccataaa

SEQ ID NO: 63851 - DNA, 20 bp, Homo sapiens
gatcacgaatttctcatcta

SEQ ID NO: 63852 - DNA, 20 bp, Homo sapiens
gatcgagttttagacgcatt

SEQ ID NO: 63853 - DNA, 20 bp, Homo sapiens
gatcaccctactgttgagtc

SEQ ID NO: 63854 - DNA, 20 bp, Homo sapiens
gatccaggaagaaagtaacc

SEQ ID NO: 63855 - DNA, 20 bp, Homo sapiens
gatcactatagcaactgtca

SEQ ID NO: 63856 - DNA, 20 bp, Homo sapiens
gatcaaactcttttacaagc

SEQ ID NO: 63857 - DNA, 20 bp, Homo sapiens
gatcaagtacagaaagtagc

SEQ ID NO: 63858 - DNA, 20 bp, Homo sapiens
gatcactgcccaaagcggaa

SEQ ID NO: 63859 - DNA, 20 bp, Homo sapiens
gatctgtggatattcttgga

SEQ ID NO: 63860 - DNA, 20 bp, Homo sapiens
gatccaataaagtcctgagg

SEQ ID NO: 63861 - DNA, 20 bp, Homo sapiens
gatctttcaaagcaaggaga

SEQ ID NO: 63862 - DNA, 20 bp, Homo sapiens
gatcactaaaggagacaggc

SEQ ID NO: 63863 - DNA, 20 bp, Homo sapiens
gatctgtttcagccgacaag

SEQ ID NO: 63864 - DNA, 20 bp, Homo sapiens
gatcaactaatgttgtttac

SEQ ID NO: 63865 - DNA, 20 bp, Homo sapiens
gatcaatagggtaacctggt

SEQ ID NO: 63866 - DNA, 20 bp, Homo sapiens
gatcatggtgcccgtcatcc

SEQ ID NO: 63867 - DNA, 20 bp, Homo sapiens
gatctcactgtagattgctt

SEQ ID NO: 63868 - DNA, 20 bp, Homo sapiens
gatccagagaacaaaaagac

SEQ ID NO: 63869 - DNA, 20 bp, Homo sapiens
gatcccaacaggccgaccta

SEQ ID NO: 63870 - DNA, 20 bp, Homo sapiens
gatcggtgagcactgtagcc

SEQ ID NO: 63871 - DNA, 20 bp, Homo sapiens
gatctgtatcaagataaagg

SEQ ID NO: 63872 - DNA, 20 bp, Homo sapiens
gatcttgattgtgaatctct

SEQ ID NO: 63873 - DNA, 20 bp, Homo sapiens
gatcccattggggctgcagc

SEQ ID NO: 63874 - DNA, 20 bp, Homo sapiens
gatcatctttgcccgcaagc

SEQ ID NO: 63875 - DNA, 20 bp, Homo sapiens
gatcatggtaggagccatgg

SEQ ID NO: 63876 - DNA, 20 bp, Homo sapiens
gatctgctgtaaaagatgaa

SEQ ID NO: 63877 - DNA, 20 bp, Homo sapiens
gatcctgatggaactttgga

SEQ ID NO: 63878 - DNA, 20 bp, Homo sapiens
gatcagtgaaaagcagggga

SEQ ID NO: 63879 - DNA, 20 bp, Homo sapiens
gatcgcattgtcactcaaaa

SEQ ID NO: 63880 - DNA, 20 bp, Homo sapiens
gatctggaatcctgactcta

SEQ ID NO: 63881 - DNA, 20 bp, Homo sapiens
gatcatgaagaagaccagcc

SEQ ID NO: 63882 - DNA, 20 bp, Homo sapiens
gatctagacaaattatgggg

SEQ ID NO: 63883 - DNA, 20 bp, Homo sapiens
gatctatttccatatctcta

SEQ ID NO: 63884 - DNA, 20 bp, Homo sapiens
gatcctcaacgagcccttca

SEQ ID NO: 63885 - DNA, 20 bp, Homo sapiens
gatcaagtgtgacggcagaa

SEQ ID NO: 63886 - DNA, 20 bp, Homo sapiens
gatcgcatattcattgatga

SEQ ID NO: 63887 - DNA, 20 bp, Homo sapiens
gatctgcaagatgaactgta

SEQ ID NO: 63888 - DNA, 20 bp, Homo sapiens
gatctggacaatgacaacat

SEQ ID NO: 63889 - DNA, 20 bp, Homo sapiens
gatctccaataggctctcct

SEQ ID NO: 63890 - DNA, 20 bp, Homo sapiens
gatcaatcttgaaaaagtat

SEQ ID NO: 63891 - DNA, 20 bp, Homo sapiens
gatctgacaagtataatttt

SEQ ID NO: 63892 - DNA, 20 bp, Homo sapiens
gatccgatatgtaatgtgcc

SEQ ID NO: 63893 - DNA, 20 bp, Homo sapiens
gatcctgtgctctcatctgc

SEQ ID NO: 63894 - DNA, 20 bp, Homo sapiens
gatctggagatgggccgata

SEQ ID NO: 63895 - DNA, 20 bp, Homo sapiens
gatcacccgagaggatgact

SEQ ID NO: 63896 - DNA, 20 bp, Homo sapiens
gatcatcgacaaggacagca

SEQ ID NO: 63897 - DNA, 20 bp, Homo sapiens
gatcatctggaataggaaaa

SEQ ID NO: 63898 - DNA, 20 bp, Homo sapiens
gatcgcagcacccactgtgg

SEQ ID NO: 63899 - DNA, 20 bp, Homo sapiens
gatcgtctacttcctcccct

SEQ ID NO: 63900 - DNA, 20 bp, Homo sapiens
gatctccagacgcagcttgg

SEQ ID NO: 63901 - DNA, 20 bp, Homo sapiens
gatcttaccaacagtatcat

SEQ ID NO: 63902 - DNA, 20 bp, Homo sapiens
gatcaagattcggagtttgg

SEQ ID NO: 63903 - DNA, 20 bp, Homo sapiens
gatccttattggtgcggctg

SEQ ID NO: 63904 - DNA, 20 bp, Homo sapiens
gatcgccgacttctcacagc

SEQ ID NO: 63905 - DNA, 20 bp, Homo sapiens
gatctcagcgtgccccaaga

SEQ ID NO: 63906 - DNA, 20 bp, Homo sapiens
gatcgtggagtttgtttttc

SEQ ID NO: 63907 - DNA, 20 bp, Homo sapiens
gatcaatatattactgtttt

SEQ ID NO: 63908 - DNA, 20 bp, Homo sapiens
gatcagcacattaagcaggt

SEQ ID NO: 63909 - DNA, 20 bp, Homo sapiens
gatctgcgacacctcagcct

SEQ ID NO: 63910 - DNA, 20 bp, Homo sapiens
gatcctgcatctttttgtct

SEQ ID NO: 63911 - DNA, 20 bp, Homo sapiens
gatcgccagtttctaacgcc

SEQ ID NO: 63912 - DNA, 20 bp, Homo sapiens
gatcatcttttctttgacat

SEQ ID NO: 63913 - DNA, 20 bp, Homo sapiens
gatcatccccacggcccagg

SEQ ID NO: 63914 - DNA, 20 bp, Homo sapiens
gatccacttccgctggaact

SEQ ID NO: 63915 - DNA, 20 bp, Homo sapiens
gatcagatgtgtgatgagtg

SEQ ID NO: 63916 - DNA, 20 bp, Homo sapiens
gatcctgactaagatagcaa

SEQ ID NO: 63917 - DNA, 20 bp, Homo sapiens
gatccgagctcctactgctg

SEQ ID NO: 63918 - DNA, 20 bp, Homo sapiens
gatctgatggtgttcaggga

SEQ ID NO: 63919 - DNA, 20 bp, Homo sapiens
gatcaaaatggtgcattacg

SEQ ID NO: 63920 - DNA, 20 bp, Homo sapiens
gatcatcacagaaatcactt

SEQ ID NO: 63921 - DNA, 20 bp, Homo sapiens
gatccaaagtcctagtgacc

SEQ ID NO: 63922 - DNA, 20 bp, Homo sapiens
gatcctagattttgtctatg

SEQ ID NO: 63923 - DNA, 20 bp, Homo sapiens
gatctcctaagtaactgtga

SEQ ID NO: 63924 - DNA, 20 bp, Homo sapiens
gatcctggaggccccccggc

SEQ ID NO: 63925 - DNA, 20 bp, Homo sapiens
gatcctcctcaccattcccc

SEQ ID NO: 63926 - DNA, 20 bp, Homo sapiens
gatcattaaacatcagcatt

SEQ ID NO: 63927 - DNA, 20 bp, Homo sapiens
gatcagattgctgttttcta

SEQ ID NO: 63928 - DNA, 20 bp, Homo sapiens
gatccagaaccacagcaaga

SEQ ID NO: 63929 - DNA, 20 bp, Homo sapiens
gatcattgataagccctaaa

SEQ ID NO: 63930 - DNA, 20 bp, Homo sapiens
gatcctcaatgattcaactg

SEQ ID NO: 63931 - DNA, 20 bp, Homo sapiens
gatcacatttgactggacaa

SEQ ID NO: 63932 - DNA, 20 bp, Homo sapiens
gatcacctgggaatgattgc

SEQ ID NO: 63933 - DNA, 20 bp, Homo sapiens
gatcccatatcagagatttg

SEQ ID NO: 63934 - DNA, 20 bp, Homo sapiens
gatcaccaactgaatgagat

SEQ ID NO: 63935 - DNA, 20 bp, Homo sapiens
gatcgtagacaaccattatg

SEQ ID NO: 63936 - DNA, 20 bp, Homo sapiens
gatctctagaaagatttaaa

SEQ ID NO: 63937 - DNA, 20 bp, Homo sapiens
gatcttcctgtcatgaaagt

SEQ ID NO: 63938 - DNA, 20 bp, Homo sapiens
gatcctccgctttcggtctg

SEQ ID NO: 63939 - DNA, 20 bp, Homo sapiens
gatcaaatggtactgataca

SEQ ID NO: 63940 - DNA, 20 bp, Homo sapiens
gatcatttttaaatggacaa

SEQ ID NO: 63941 - DNA, 20 bp, Homo sapiens
gatcctcctggcttatctag

SEQ ID NO: 63942 - DNA, 20 bp, Homo sapiens
gatctgtagtttttttggtg

SEQ ID NO: 63943 - DNA, 20 bp, Homo sapiens
gatcatttggataacatcaa

SEQ ID NO: 63944 - DNA, 20 bp, Homo sapiens
gatcatgaactggcacaagc

SEQ ID NO: 63945 - DNA, 20 bp, Homo sapiens
gatcccaaaggactatgttg

SEQ ID NO: 63946 - DNA, 20 bp, Homo sapiens
gatcaataccaaaagacact

SEQ ID NO: 63947 - DNA, 20 bp, Homo sapiens
gatcgtttatgatgttccaa

SEQ ID NO: 63948 - DNA, 20 bp, Homo sapiens
gatctaatcctttttgtcct

SEQ ID NO: 63949 - DNA, 20 bp, Homo sapiens
gatcaacccatggatatgct

SEQ ID NO: 63950 - DNA, 20 bp, Homo sapiens
gatcccctgcagtcaccctg

SEQ ID NO: 63951 - DNA, 20 bp, Homo sapiens
gatcgtatttctttggaaca

SEQ ID NO: 63952 - DNA, 20 bp, Homo sapiens
gatcacaagcttcacatcaa

SEQ ID NO: 63953 - DNA, 20 bp, Homo sapiens
gatccttttgaataaaaaaa

SEQ ID NO: 63954 - DNA, 20 bp, Homo sapiens
gatctccctgtaaaacaagg

SEQ ID NO: 63955 - DNA, 20 bp, Homo sapiens
gatctaaaagtaatagattc

SEQ ID NO: 63956 - DNA, 20 bp, Homo sapiens
gatcatttcatgaaaagtgg

SEQ ID NO: 63957 - DNA, 20 bp, Homo sapiens
gatcgcatgttggatatggg

SEQ ID NO: 63958 - DNA, 20 bp, Homo sapiens
gatcttgaatcggataacca

SEQ ID NO: 63959 - DNA, 20 bp, Homo sapiens
gatcaagaaaacctggacaa

SEQ ID NO: 63960 - DNA, 20 bp, Homo sapiens
gatcctacctgcctacttag

SEQ ID NO: 63961 - DNA, 20 bp, Homo sapiens
gatcaaggagagcgctcgag

SEQ ID NO: 63962 - DNA, 20 bp, Homo sapiens
gatcagaaaacaacgctact

SEQ ID NO: 63963 - DNA, 20 bp, Homo sapiens
gatcagcaagtctacgctga

SEQ ID NO: 63964 - DNA, 20 bp, Homo sapiens
gatcctgggattgtgatagg

SEQ ID NO: 63965 - DNA, 20 bp, Homo sapiens
gatcttagacaagtcattct

SEQ ID NO: 63966 - DNA, 20 bp, Homo sapiens
gatcagactaacggctaaag

SEQ ID NO: 63967 - DNA, 20 bp, Homo sapiens
gatcctggaaatttatggtc

SEQ ID NO: 63968 - DNA, 20 bp, Homo sapiens
gatctcctccacgcactggc

SEQ ID NO: 63969 - DNA, 20 bp, Homo sapiens
gatcagattcagaggtactt

SEQ ID NO: 63970 - DNA, 20 bp, Homo sapiens
gatcaagaaaaagtatctca

SEQ ID NO: 63971 - DNA, 20 bp, Homo sapiens
gatcaagtcatccgccaaag

SEQ ID NO: 63972 - DNA, 20 bp, Homo sapiens
gatcaggcatagtcccacta

SEQ ID NO: 63973 - DNA, 20 bp, Homo sapiens
gatcatcctctgggacatcg

SEQ ID NO: 63974 - DNA, 20 bp, Homo sapiens
gatcctgaagtggccccagc

SEQ ID NO: 63975 - DNA, 20 bp, Homo sapiens
gatctctgaggagctggtgg

SEQ ID NO: 63976 - DNA, 20 bp, Homo sapiens
gatcatgaagtcaacatgca

SEQ ID NO: 63977 - DNA, 20 bp, Homo sapiens
gatcgccccactacactcca

SEQ ID NO: 63978 - DNA, 20 bp, Homo sapiens
gatcagcagcccttgaaaag

SEQ ID NO: 63979 - DNA, 20 bp, Homo sapiens
gatcgtggagttcttccctg

SEQ ID NO: 63980 - DNA, 20 bp, Homo sapiens
gatcctgaatgagacaaaag

SEQ ID NO: 63981 - DNA, 20 bp, Homo sapiens
gatccagaacatcctggtgg

SEQ ID NO: 63982 - DNA, 20 bp, Homo sapiens
gatcttattaaaaacatttg

SEQ ID NO: 63983 - DNA, 20 bp, Homo sapiens
gatcaaagtcagatagctga

SEQ ID NO: 63984 - DNA, 20 bp, Homo sapiens
gatcaaatccacacatacca

SEQ ID NO: 63985 - DNA, 20 bp, Homo sapiens
gatcaggatgtcttaaaaac

SEQ ID NO: 63986 - DNA, 20 bp, Homo sapiens
gatcatcagagaattcacac

SEQ ID NO: 63987 - DNA, 20 bp, Homo sapiens
gatctggaatcaatgtgtga

SEQ ID NO: 63988 - DNA, 20 bp, Homo sapiens
gatcaccagggtagagagga

SEQ ID NO: 63989 - DNA, 20 bp, Homo sapiens
gatcattaagctgccacggc

SEQ ID NO: 63990 - DNA, 20 bp, Homo sapiens
gatcccctgtgaagaacagc

SEQ ID NO: 63991 - DNA, 20 bp, Homo sapiens
gatcacctgtgacatgaaca

SEQ ID NO: 63992 - DNA, 20 bp, Homo sapiens
gatcagaagcaccattctat

SEQ ID NO: 63993 - DNA, 20 bp, Homo sapiens
gatcccaggacccaagaagg

SEQ ID NO: 63994 - DNA, 20 bp, Homo sapiens
gatctcttgaaatccccaat

SEQ ID NO: 63995 - DNA, 20 bp, Homo sapiens
gatcctggcagccgtggcgc

SEQ ID NO: 63996 - DNA, 20 bp, Homo sapiens
gatcctgagaggagtggccc

SEQ ID NO: 63997 - DNA, 20 bp, Homo sapiens
gatcaggtggagctgaagga

SEQ ID NO: 63998 - DNA, 20 bp, Homo sapiens
gatccccctattttctcagc

SEQ ID NO: 63999 - DNA, 20 bp, Homo sapiens
gatcaatggccacaaggtca

SEQ ID NO: 64000 - DNA, 20 bp, Homo sapiens
gatcagccacgggattccag

SEQ ID NO: 64001 - DNA, 20 bp, Homo sapiens
gatcaagaaatgcagaaatt

SEQ ID NO: 64002 - DNA, 20 bp, Homo sapiens
gatctcgaagttattgcaca

SEQ ID NO: 64003 - DNA, 20 bp, Homo sapiens
gatcgcgccattacacttca

SEQ ID NO: 64004 - DNA, 20 bp, Homo sapiens
gatctggaaaagattgtact

SEQ ID NO: 64005 - DNA, 20 bp, Homo sapiens
gatctgagttcatcgggatt

SEQ ID NO: 64006 - DNA, 20 bp, Homo sapiens
gatcactgcagcctccacct

SEQ ID NO: 64007 - DNA, 20 bp, Homo sapiens
gatctcctgtcaaagacagt

SEQ ID NO: 64008 - DNA, 20 bp, Homo sapiens
gatcatcaaaaatgggacca

SEQ ID NO: 64009 - DNA, 20 bp, Homo sapiens
gatcacacacatcatctcta

SEQ ID NO: 64010 - DNA, 20 bp, Homo sapiens
gatcttgcaccaagactgaa

SEQ ID NO: 64011 - DNA, 20 bp, Homo sapiens
gatcaagatttgtaggacca

SEQ ID NO: 64012 - DNA, 20 bp, Homo sapiens
gatcgctgatttcagctagt

SEQ ID NO: 64013 - DNA, 20 bp, Homo sapiens
gatcgttatggagcacctaa

SEQ ID NO: 64014 - DNA, 20 bp, Homo sapiens
gatcgctccctgccgcggtc

SEQ ID NO: 64015 - DNA, 20 bp, Homo sapiens
gatcaatatcacgaactgtg

SEQ ID NO: 64016 - DNA, 20 bp, Homo sapiens
gatcctctttaaggtttcct

SEQ ID NO: 64017 - DNA, 20 bp, Homo sapiens
gatcgtcattcagaatccat

SEQ ID NO: 64018 - DNA, 20 bp, Homo sapiens
gatcataaaaatatacacat

SEQ ID NO: 64019 - DNA, 20 bp, Homo sapiens
gatcaaacgccctgagagtc

SEQ ID NO: 64020 - DNA, 20 bp, Homo sapiens
gatcagtgactgtagtagga

SEQ ID NO: 64021 - DNA, 20 bp, Homo sapiens
gatccagatgtaccagaagc

SEQ ID NO: 64022 - DNA, 20 bp, Homo sapiens
gatcctctacaaagcccact

SEQ ID NO: 64023 - DNA, 20 bp, Homo sapiens
gatcagaaagaatctctccc

SEQ ID NO: 64024 - DNA, 20 bp, Homo sapiens
gatcatgaccttataaatta

SEQ ID NO: 64025 - DNA, 20 bp, Homo sapiens
gatcaaaagaaaactaaata

SEQ ID NO: 64026 - DNA, 20 bp, Homo sapiens
gatccagtgttaaagtctcc

SEQ ID NO: 64027 - DNA, 20 bp, Homo sapiens
gatcttaaactgccagaagg

SEQ ID NO: 64028 - DNA, 20 bp, Homo sapiens
gatcccaggacactacaaac

SEQ ID NO: 64029 - DNA, 20 bp, Homo sapiens
gatcaccacgcattgaaata

SEQ ID NO: 64030 - DNA, 20 bp, Homo sapiens
gatcaccacaacctccgtct

SEQ ID NO: 64031 - DNA, 20 bp, Homo sapiens
gatcacaccagaagatggag

SEQ ID NO: 64032 - DNA, 20 bp, Homo sapiens
gatcaagatgtgcgcaaggt

SEQ ID NO: 64033 - DNA, 20 bp, Homo sapiens
gatctgcttagcacgtaagc

SEQ ID NO: 64034 - DNA, 20 bp, Homo sapiens
gatcgggatataaacccaag

SEQ ID NO: 64035 - DNA, 20 bp, Homo sapiens
gatccatccgcagagctgga

SEQ ID NO: 64036 - DNA, 20 bp, Homo sapiens
gatcctgctttgtgtgttca

SEQ ID NO: 64037 - DNA, 20 bp, Homo sapiens
gatccaatcaaacctcagcc

SEQ ID NO: 64038 - DNA, 20 bp, Homo sapiens
gatctggcactccaagggga

SEQ ID NO: 64039 - DNA, 20 bp, Homo sapiens
gatcgattcctggataagtc

SEQ ID NO: 64040 - DNA, 20 bp, Homo sapiens
gatcagagttcgactcttgc

SEQ ID NO: 64041 - DNA, 20 bp, Homo sapiens
gatcacttgaggtcaatagt

SEQ ID NO: 64042 - DNA, 20 bp, Homo sapiens
gatcctcagaccaggacagt

SEQ ID NO: 64043 - DNA, 20 bp, Homo sapiens
gatcttctggggactggtct

SEQ ID NO: 64044 - DNA, 20 bp, Homo sapiens
gatctgcaatcacataccta

SEQ ID NO: 64045 - DNA, 20 bp, Homo sapiens
gatcggcatcggaagcagct

SEQ ID NO: 64046 - DNA, 20 bp, Homo sapiens
gatcacttcccagtccatca

SEQ ID NO: 64047 - DNA, 20 bp, Homo sapiens
gatctatattcaatgtgaaa

SEQ ID NO: 64048 - DNA, 20 bp, Homo sapiens
gatctgcatcaaggaattaa

SEQ ID NO: 64049 - DNA, 20 bp, Homo sapiens
gatcaggccattggaaaact

SEQ ID NO: 64050 - DNA, 20 bp, Homo sapiens
gatcaagaccaaaagattaa

SEQ ID NO: 64051 - DNA, 20 bp, Homo sapiens
gatctggatgcccgcaaaac

SEQ ID NO: 64052 - DNA, 20 bp, Homo sapiens
gatcgtaaacacattgatgt

SEQ ID NO: 64053 - DNA, 20 bp, Homo sapiens
gatctgcgtgaacgccaaaa

SEQ ID NO: 64054 - DNA, 20 bp, Homo sapiens
gatcaccaaaaggggagaag

SEQ ID NO: 64055 - DNA, 20 bp, Homo sapiens
gatcaggaccaggtcagcat

SEQ ID NO: 64056 - DNA, 20 bp, Homo sapiens
gatcttgctatctgcaattg

SEQ ID NO: 64057 - DNA, 20 bp, Homo sapiens
gatctggaagtatccctaga

SEQ ID NO: 64058 - DNA, 20 bp, Homo sapiens
gatcagcaaaagaggagaag

SEQ ID NO: 64059 - DNA, 20 bp, Homo sapiens
gatcttagaactaaccaggc

SEQ ID NO: 64060 - DNA, 20 bp, Homo sapiens
gatcccgcccaagcaccggt

SEQ ID NO: 64061 - DNA, 20 bp, Homo sapiens
gatctgcttttccatttgtt

SEQ ID NO: 64062 - DNA, 20 bp, Homo sapiens
gatctggggtgaattagaga

SEQ ID NO: 64063 - DNA, 20 bp, Homo sapiens
gatcaaaaaggcaaatgatt

SEQ ID NO: 64064 - DNA, 20 bp, Homo sapiens
gatcaagaatttttcaattg

SEQ ID NO: 64065 - DNA, 20 bp, Homo sapiens
gatctgttgaatgaatccta

SEQ ID NO: 64066 - DNA, 20 bp, Homo sapiens
gatcaggctcgccagggcca

SEQ ID NO: 64067 - DNA, 20 bp, Homo sapiens
gatctggaaaagaaagccaa

SEQ ID NO: 64068 - DNA, 20 bp, Homo sapiens
gatcagggtctccctgtggc

SEQ ID NO: 64069 - DNA, 20 bp, Homo sapiens
gatcataatggaaacgtatg

SEQ ID NO: 64070 - DNA, 20 bp, Homo sapiens
gatcattttcaactctggtt

SEQ ID NO: 64071 - DNA, 20 bp, Homo sapiens
gatcctgacgctcctgaggg

SEQ ID NO: 64072 - DNA, 20 bp, Homo sapiens
gatcgccccagcgcggcctc

SEQ ID NO: 64073 - DNA, 20 bp, Homo sapiens
gatccttaagatgcaatact

SEQ ID NO: 64074 - DNA, 20 bp, Homo sapiens
gatcgtagggtggatgcccc

SEQ ID NO: 64075 - DNA, 20 bp, Homo sapiens
gatcgaatcagagcttagct

SEQ ID NO: 64076 - DNA, 20 bp, Homo sapiens
gatcaaaggcctgcctattg

SEQ ID NO: 64077 - DNA, 20 bp, Homo sapiens
gatcatagagtttgtaaagt

SEQ ID NO: 64078 - DNA, 20 bp, Homo sapiens
gatccccagaactcttgaag

SEQ ID NO: 64079 - DNA, 20 bp, Homo sapiens
gatcatcctgaacctaagaa

SEQ ID NO: 64080 - DNA, 20 bp, Homo sapiens
gatcagcagacaccagcagc

SEQ ID NO: 64081 - DNA, 20 bp, Homo sapiens
gatcctctgtgagttcatgt

SEQ ID NO: 64082 - DNA, 20 bp, Homo sapiens
gatctctgtgaagaacagtt

SEQ ID NO: 64083 - DNA, 20 bp, Homo sapiens
gatcattgaccaaaagaatg

SEQ ID NO: 64084 - DNA, 20 bp, Homo sapiens
gatccccaccagtcaaccct

SEQ ID NO: 64085 - DNA, 20 bp, Homo sapiens
gatctcagccactgttggag

SEQ ID NO: 64086 - DNA, 20 bp, Homo sapiens
gatcgagcaagagctgcaga

SEQ ID NO: 64087 - DNA, 20 bp, Homo sapiens
gatcttgcagaagagctcaa

SEQ ID NO: 64088 - DNA, 20 bp, Homo sapiens
gatcgggttcaacggcaggg

SEQ ID NO: 64089 - DNA, 20 bp, Homo sapiens
gatctcctaagaagtgtgct

SEQ ID NO: 64090 - DNA, 20 bp, Homo sapiens
gatccatcagaggagacaaa

SEQ ID NO: 64091 - DNA, 20 bp, Homo sapiens
gatcgaagggcagcaatgga

SEQ ID NO: 64092 - DNA, 20 bp, Homo sapiens
gatcccagctccagctcact

SEQ ID NO: 64093 - DNA, 20 bp, Homo sapiens
gatcctgctctgctacacca

SEQ ID NO: 64094 - DNA, 20 bp, Homo sapiens
gatcaaccaaaaataagaaa

SEQ ID NO: 64095 - DNA, 20 bp, Homo sapiens
gatcactctgcgtcactgaa

SEQ ID NO: 64096 - DNA, 20 bp, Homo sapiens
gatccagaatgcacacaaga

SEQ ID NO: 64097 - DNA, 20 bp, Homo sapiens
gatcccaaacaccagcctgc

SEQ ID NO: 64098 - DNA, 20 bp, Homo sapiens
gatcataataatccacaagt

SEQ ID NO: 64099 - DNA, 20 bp, Homo sapiens
gatccagcagaacctgagga

SEQ ID NO: 64100 - DNA, 20 bp, Homo sapiens
gatcccggggctgctgggct

SEQ ID NO: 64101 - DNA, 20 bp, Homo sapiens
gatcagcctgtacgaggaag

SEQ ID NO: 64102 - DNA, 20 bp, Homo sapiens
gatccatgtacaggcccgtc

SEQ ID NO: 64103 - DNA, 20 bp, Homo sapiens
gatcctgcaacagtctggga

SEQ ID NO: 64104 - DNA, 20 bp, Homo sapiens
gatcctactacttgccgcca

SEQ ID NO: 64105 - DNA, 20 bp, Homo sapiens
gatcagaaatcaagaaaaga

SEQ ID NO: 64106 - DNA, 20 bp, Homo sapiens
gatctgaacacttacagaca

SEQ ID NO: 64107 - DNA, 20 bp, Homo sapiens
gatcagccatgcaagaataa

SEQ ID NO: 64108 - DNA, 20 bp, Homo sapiens
gatcattgttaaccaataca

SEQ ID NO: 64109 - DNA, 20 bp, Homo sapiens
gatccaagacatctggtggg

SEQ ID NO: 64110 - DNA, 20 bp, Homo sapiens
gatcgtaaagttgtcttcca

SEQ ID NO: 64111 - DNA, 20 bp, Homo sapiens
gatcaaggctgggggttggt

SEQ ID NO: 64112 - DNA, 20 bp, Homo sapiens
gatcctctgtttcaaagaca

SEQ ID NO: 64113 - DNA, 20 bp, Homo sapiens
gatccacatccctgtatttt

SEQ ID NO: 64114 - DNA, 20 bp, Homo sapiens
gatcagcgatacctgaccac

SEQ ID NO: 64115 - DNA, 20 bp, Homo sapiens
gatcttccaggccgagaaca

SEQ ID NO: 64116 - DNA, 20 bp, Homo sapiens
gatctctggtctacagtgga

SEQ ID NO: 64117 - DNA, 20 bp, Homo sapiens
gatcatctcattgcatgatt

SEQ ID NO: 64118 - DNA, 20 bp, Homo sapiens
gatcagactccggagtcgca

SEQ ID NO: 64119 - DNA, 20 bp, Homo sapiens
gatccccacattgttcctcc

SEQ ID NO: 64120 - DNA, 20 bp, Homo sapiens
gatctgggttagggagatgc

SEQ ID NO: 64121 - DNA, 20 bp, Homo sapiens
gatcggcattttgttcactg

SEQ ID NO: 64122 - DNA, 20 bp, Homo sapiens
gatcgcttaattgtggatga

SEQ ID NO: 64123 - DNA, 20 bp, Homo sapiens
gatctgccgcctctgggctc

SEQ ID NO: 64124 - DNA, 20 bp, Homo sapiens
gatcatcaatatctaaaagt

SEQ ID NO: 64125 - DNA, 20 bp, Homo sapiens
gatccaaaatcatacaacta

SEQ ID NO: 64126 - DNA, 20 bp, Homo sapiens
gatctgaaataaactcccgt

SEQ ID NO: 64127 - DNA, 20 bp, Homo sapiens
gatcttttaagcaaggagag

SEQ ID NO: 64128 - DNA, 20 bp, Homo sapiens
gatcgtaaagcgactcaacc

SEQ ID NO: 64129 - DNA, 20 bp, Homo sapiens
gatcaatatcagaaaaagaa

SEQ ID NO: 64130 - DNA, 20 bp, Homo sapiens
gatctgatttatttaggaag

SEQ ID NO: 64131 - DNA, 20 bp, Homo sapiens
gatcaaagttccaggccaag

SEQ ID NO: 64132 - DNA, 20 bp, Homo sapiens
gatcttattgtattttaggc

SEQ ID NO: 64133 - DNA, 20 bp, Homo sapiens
gatccatgtattagtgtcca

SEQ ID NO: 64134 - DNA, 20 bp, Homo sapiens
gatctcaccaggtctctgcc

SEQ ID NO: 64135 - DNA, 20 bp, Homo sapiens
gatccagctccttggtctgc

SEQ ID NO: 64136 - DNA, 20 bp, Homo sapiens
gatccttttagaggagattg

SEQ ID NO: 64137 - DNA, 20 bp, Homo sapiens
gatctcctgctatccttaca

SEQ ID NO: 64138 - DNA, 20 bp, Homo sapiens
gatctctgtaatatttctag

SEQ ID NO: 64139 - DNA, 20 bp, Homo sapiens
gatctgcagtgactctgttt

SEQ ID NO: 64140 - DNA, 20 bp, Homo sapiens
gatcgccacctaccaccgcc

SEQ ID NO: 64141 - DNA, 20 bp, Homo sapiens
gatcctgtgccacatctaaa

SEQ ID NO: 64142 - DNA, 20 bp, Homo sapiens
gatcactataggagggcact

SEQ ID NO: 64143 - DNA, 20 bp, Homo sapiens
gatcatagacaaggacagat

SEQ ID NO: 64144 - DNA, 20 bp, Homo sapiens
gatcaccaggtgggtccact

SEQ ID NO: 64145 - DNA, 20 bp, Homo sapiens
gatcgatatgaaaactggat

SEQ ID NO: 64146 - DNA, 20 bp, Homo sapiens
gatcttcctcaccagctcac

SEQ ID NO: 64147 - DNA, 20 bp, Homo sapiens
gatcttttaatggaaactct

SEQ ID NO: 64148 - DNA, 20 bp, Homo sapiens
gatcgagttcatcaaagtgg

SEQ ID NO: 64149 - DNA, 20 bp, Homo sapiens
gatcaggaacaagacaataa

SEQ ID NO: 64150 - DNA, 20 bp, Homo sapiens
gatctggtggaagttccagg

SEQ ID NO: 64151 - DNA, 20 bp, Homo sapiens
gatcctttgtttgttatcag

SEQ ID NO: 64152 - DNA, 20 bp, Homo sapiens
gatcatagacaaggacagac

SEQ ID NO: 64153 - DNA, 20 bp, Homo sapiens
gatcagggaggccaaagcct

SEQ ID NO: 64154 - DNA, 20 bp, Homo sapiens
gatcgatgagaagagtctgc

SEQ ID NO: 64155 - DNA, 20 bp, Homo sapiens
gatcataagatattcaggag

SEQ ID NO: 64156 - DNA, 20 bp, Homo sapiens
gatcagccttatcctggtat

SEQ ID NO: 64157 - DNA, 20 bp, Homo sapiens
gatctggaatacctatttcc

SEQ ID NO: 64158 - DNA, 20 bp, Homo sapiens
gatcgcctgccttcccgtgg

SEQ ID NO: 64159 - DNA, 20 bp, Homo sapiens
gatcaaacctcagccgcagc

SEQ ID NO: 64160 - DNA, 20 bp, Homo sapiens
gatcggcgagacgctgcagc

SEQ ID NO: 64161 - DNA, 20 bp, Homo sapiens
gatcggtggtgaacctgttg

SEQ ID NO: 64162 - DNA, 20 bp, Homo sapiens
gatcttccagaaagctccag

SEQ ID NO: 64163 - DNA, 20 bp, Homo sapiens
gatccaagagaagaacatct

SEQ ID NO: 64164 - DNA, 20 bp, Homo sapiens
gatcttgactctgaggttcc

SEQ ID NO: 64165 - DNA, 20 bp, Homo sapiens
gatcatttcaactctggcaa

SEQ ID NO: 64166 - DNA, 20 bp, Homo sapiens
gatccaaagaccaaagtcag

SEQ ID NO: 64167 - DNA, 20 bp, Homo sapiens
gatcaatatacatcctttgc

SEQ ID NO: 64168 - DNA, 20 bp, Homo sapiens
gatcctgcagctgctcagga

SEQ ID NO: 64169 - DNA, 20 bp, Homo sapiens
gatcttcctcgccaactcat

SEQ ID NO: 64170 - DNA, 20 bp, Homo sapiens
gatcgacctattattggcct

SEQ ID NO: 64171 - DNA, 20 bp, Homo sapiens
gatcgctgcctgacagaccc

SEQ ID NO: 64172 - DNA, 20 bp, Homo sapiens
gatctggatgtgtggaggcc

SEQ ID NO: 64173 - DNA, 20 bp, Homo sapiens
gatcattcacagccaccacc

SEQ ID NO: 64174 - DNA, 20 bp, Homo sapiens
gatcccaaatcgctcgtgga

SEQ ID NO: 64175 - DNA, 20 bp, Homo sapiens
gatcgtggaagggttgatga

SEQ ID NO: 64176 - DNA, 20 bp, Homo sapiens
gatcctatagttattgttct

SEQ ID NO: 64177 - DNA, 20 bp, Homo sapiens
gatccccatggctgaatact

SEQ ID NO: 64178 - DNA, 20 bp, Homo sapiens
gatccgccgcctgctggagg

SEQ ID NO: 64179 - DNA, 20 bp, Homo sapiens
gatccttctatcttctctag

SEQ ID NO: 64180 - DNA, 20 bp, Homo sapiens
gatcacattagtaaaaagac

SEQ ID NO: 64181 - DNA, 20 bp, Homo sapiens
gatcatgttgagcgttacaa

SEQ ID NO: 64182 - DNA, 20 bp, Homo sapiens
gatctaaagtgaaagtatta

SEQ ID NO: 64183 - DNA, 20 bp, Homo sapiens
gatcttgagaaggcattgtt

SEQ ID NO: 64184 - DNA, 20 bp, Homo sapiens
gatctggttcacaggcgccg

SEQ ID NO: 64185 - DNA, 20 bp, Homo sapiens
gatctaacatagaagctgat

SEQ ID NO: 64186 - DNA, 20 bp, Homo sapiens
gatcgtgcaggaccaccagg

SEQ ID NO: 64187 - DNA, 20 bp, Homo sapiens
gatcataagaaatcctttaa

SEQ ID NO: 64188 - DNA, 20 bp, Homo sapiens
gatcccacatggctgtgtcc

SEQ ID NO: 64189 - DNA, 20 bp, Homo sapiens
gatcgtcttcgtcatctgct

SEQ ID NO: 64190 - DNA, 20 bp, Homo sapiens
gatctgaaggactaaaaccg

SEQ ID NO: 64191 - DNA, 20 bp, Homo sapiens
gatcgtgtccggagctcgag

SEQ ID NO: 64192 - DNA, 20 bp, Homo sapiens
gatctagacaagaacataca

SEQ ID NO: 64193 - DNA, 20 bp, Homo sapiens
gatcacctacatcggacttc

SEQ ID NO: 64194 - DNA, 20 bp, Homo sapiens
gatctgcgttcccagggata

SEQ ID NO: 64195 - DNA, 20 bp, Homo sapiens
gatcagactgtaagtaggca

SEQ ID NO: 64196 - DNA, 20 bp, Homo sapiens
gatcaggaagaccttcagat

SEQ ID NO: 64197 - DNA, 20 bp, Homo sapiens
gatccagttgggaatgcatc

SEQ ID NO: 64198 - DNA, 20 bp, Homo sapiens
gatcgaacttatggtccagg

SEQ ID NO: 64199 - DNA, 20 bp, Homo sapiens
gatcggcaatgcctgctggg

SEQ ID NO: 64200 - DNA, 20 bp, Homo sapiens
gatctcatgtatgccaagcg

SEQ ID NO: 64201 - DNA, 20 bp, Homo sapiens
gatctgcccaatcaggcgat

SEQ ID NO: 64202 - DNA, 20 bp, Homo sapiens
gatcatcctggacccgcagc

SEQ ID NO: 64203 - DNA, 20 bp, Homo sapiens
gatcaaacttccgaaactgc

SEQ ID NO: 64204 - DNA, 20 bp, Homo sapiens
gatccttggctgccgctttc

SEQ ID NO: 64205 - DNA, 20 bp, Homo sapiens
gatctgagaaccaaccatag

SEQ ID NO: 64206 - DNA, 20 bp, Homo sapiens
gatcctaaagcacaccagga

SEQ ID NO: 64207 - DNA, 20 bp, Homo sapiens
gatcaaacgccaagagatgg

SEQ ID NO: 64208 - DNA, 20 bp, Homo sapiens
gatccgttttggaggggcct

SEQ ID NO: 64209 - DNA, 20 bp, Homo sapiens
gatcaagcgcatgctgacct

SEQ ID NO: 64210 - DNA, 20 bp, Homo sapiens
gatcagtggaatgtacctgg

SEQ ID NO: 64211 - DNA, 20 bp, Homo sapiens
gatccagtttgaaaaaacaa

SEQ ID NO: 64212 - DNA, 20 bp, Homo sapiens
gatccatcagctctgcctga

SEQ ID NO: 64213 - DNA, 20 bp, Homo sapiens
gatcccgctttctccgtttc

SEQ ID NO: 64214 - DNA, 20 bp, Homo sapiens
gatctccatttttccgaaca

SEQ ID NO: 64215 - DNA, 20 bp, Homo sapiens
gatcttctatctcactggct

SEQ ID NO: 64216 - DNA, 20 bp, Homo sapiens
gatcaaatgtttatgtaaag

SEQ ID NO: 64217 - DNA, 20 bp, Homo sapiens
gatcgtctccatttttatgc

SEQ ID NO: 64218 - DNA, 20 bp, Homo sapiens
gatctttgataaacatctgc

SEQ ID NO: 64219 - DNA, 20 bp, Homo sapiens
gatcccaagttaaatccagc

SEQ ID NO: 64220 - DNA, 20 bp, Homo sapiens
gatctggactttctttagac

SEQ ID NO: 64221 - DNA, 20 bp, Homo sapiens
gatctttctatttctcattc

SEQ ID NO: 64222 - DNA, 20 bp, Homo sapiens
gatcagctaattgtgggacc

SEQ ID NO: 64223 - DNA, 20 bp, Homo sapiens
gatcgcccatcagggtctag

SEQ ID NO: 64224 - DNA, 20 bp, Homo sapiens
gatcgaagtgttccgtcctg

SEQ ID NO: 64225 - DNA, 20 bp, Homo sapiens
gatcgtgcagtacagcctga

SEQ ID NO: 64226 - DNA, 20 bp, Homo sapiens
gatcgactaatgcagttggc

SEQ ID NO: 64227 - DNA, 20 bp, Homo sapiens
gatctgaaaaataaacacaa

SEQ ID NO: 64228 - DNA, 20 bp, Homo sapiens
gatctgccattaaaagagga

SEQ ID NO: 64229 - DNA, 20 bp, Homo sapiens
gatcgatgcttagtgagcac

SEQ ID NO: 64230 - DNA, 20 bp, Homo sapiens
gatcataagagaaaggaatt

SEQ ID NO: 64231 - DNA, 20 bp, Homo sapiens
gatcctgtggtaaaagtttc

SEQ ID NO: 64232 - DNA, 20 bp, Homo sapiens
gatcttaaatgcggacctgg

SEQ ID NO: 64233 - DNA, 20 bp, Homo sapiens
gatcctgtccttcttcattt

SEQ ID NO: 64234 - DNA, 20 bp, Homo sapiens
gatcgggagcaaaccaaaga

SEQ ID NO: 64235 - DNA, 20 bp, Homo sapiens
gatctcaaagatgtgccaag

SEQ ID NO: 64236 - DNA, 20 bp, Homo sapiens
gatcaacgtgtcaggctgca

SEQ ID NO: 64237 - DNA, 20 bp, Homo sapiens
gatcaataaaatcaaactct

SEQ ID NO: 64238 - DNA, 20 bp, Homo sapiens
gatcccactcatgcccctga

SEQ ID NO: 64239 - DNA, 20 bp, Homo sapiens
gatcggctgcgacaacgacg

SEQ ID NO: 64240 - DNA, 20 bp, Homo sapiens
gatccccgctttcacagatg

SEQ ID NO: 64241 - DNA, 20 bp, Homo sapiens
gatcctccaagccagggcta

SEQ ID NO: 64242 - DNA, 20 bp, Homo sapiens
gatcatcacttgtaactaag

SEQ ID NO: 64243 - DNA, 20 bp, Homo sapiens
gatcggcttcagccacacac

SEQ ID NO: 64244 - DNA, 20 bp, Homo sapiens
gatcttgctggactcagggc

SEQ ID NO: 64245 - DNA, 20 bp, Homo sapiens
gatcatcaactcctaagggc

SEQ ID NO: 64246 - DNA, 20 bp, Homo sapiens
gatccgtcagcggcggcagg

SEQ ID NO: 64247 - DNA, 20 bp, Homo sapiens
gatcaactagcgatgaatta

SEQ ID NO: 64248 - DNA, 20 bp, Homo sapiens
gatcaaaattccttggtgtt

SEQ ID NO: 64249 - DNA, 20 bp, Homo sapiens
gatcagcaccgtggtctgat

SEQ ID NO: 64250 - DNA, 20 bp, Homo sapiens
gatcacgcatcctgtgactc

SEQ ID NO: 64251 - DNA, 20 bp, Homo sapiens
gatccgagaccactgtgccg

SEQ ID NO: 64252 - DNA, 20 bp, Homo sapiens
gatccggccactcctagaag

SEQ ID NO: 64253 - DNA, 20 bp, Homo sapiens
gatcgatttcatcaaatcct

SEQ ID NO: 64254 - DNA, 20 bp, Homo sapiens
gatcagctaacgtcaatgcc

SEQ ID NO: 64255 - DNA, 20 bp, Homo sapiens
gatcctgctacctcatagat

SEQ ID NO: 64256 - DNA, 20 bp, Homo sapiens
gatctgcagttagtggcact

SEQ ID NO: 64257 - DNA, 20 bp, Homo sapiens
gatcagtctacagccacaga

SEQ ID NO: 64258 - DNA, 20 bp, Homo sapiens
gatcctttcaaagcactgct

SEQ ID NO: 64259 - DNA, 20 bp, Homo sapiens
gatcattctcaacgggatgc

SEQ ID NO: 64260 - DNA, 20 bp, Homo sapiens
gatcttctttcgaagctatg

SEQ ID NO: 64261 - DNA, 20 bp, Homo sapiens
gatcaggcaagcacagctcc

SEQ ID NO: 64262 - DNA, 20 bp, Homo sapiens
gatcaaggccttatttagaa

SEQ ID NO: 64263 - DNA, 20 bp, Homo sapiens
gatcaccaaggatggcggca

SEQ ID NO: 64264 - DNA, 20 bp, Homo sapiens
gatcccttgcccccactatt

SEQ ID NO: 64265 - DNA, 20 bp, Homo sapiens
gatctcatcagctttgtcct

SEQ ID NO: 64266 - DNA, 20 bp, Homo sapiens
gatcatatctcatgaggctg

SEQ ID NO: 64267 - DNA, 20 bp, Homo sapiens
gatcagtttacacaatcggc

SEQ ID NO: 64268 - DNA, 20 bp, Homo sapiens
gatcttatatagtaattagc

SEQ ID NO: 64269 - DNA, 20 bp, Homo sapiens
gatcatcatcagtaatgtgt

SEQ ID NO: 64270 - DNA, 20 bp, Homo sapiens
gatccaactattagaacttc

SEQ ID NO: 64271 - DNA, 20 bp, Homo sapiens
gatctccgactcggctcccc

SEQ ID NO: 64272 - DNA, 20 bp, Homo sapiens
gatcagtcagacattttaat

SEQ ID NO: 64273 - DNA, 20 bp, Homo sapiens
gatcacacagctaggaaatg

SEQ ID NO: 64274 - DNA, 20 bp, Homo sapiens
gatcttcagtctctgaaggg

SEQ ID NO: 64275 - DNA, 20 bp, Homo sapiens
gatcacatgtccctccatgg

SEQ ID NO: 64276 - DNA, 20 bp, Homo sapiens
gatccagcaggtgggcagga

SEQ ID NO: 64277 - DNA, 20 bp, Homo sapiens
gatcggtcttcagtcaagag

SEQ ID NO: 64278 - DNA, 20 bp, Homo sapiens
gatcacacataggtaaactg

SEQ ID NO: 64279 - DNA, 20 bp, Homo sapiens
gatcctgaactaagtggaga

SEQ ID NO: 64280 - DNA, 20 bp, Homo sapiens
gatcaaagctggaagaaatg

SEQ ID NO: 64281 - DNA, 20 bp, Homo sapiens
gatcagaagaccccagaagc

SEQ ID NO: 64282 - DNA, 20 bp, Homo sapiens
gatcaagggccacgacagtc

SEQ ID NO: 64283 - DNA, 20 bp, Homo sapiens
gatcataagaagaaacttaa

SEQ ID NO: 64284 - DNA, 20 bp, Homo sapiens
gatcctcctgagaagcttaa

SEQ ID NO: 64285 - DNA, 20 bp, Homo sapiens
gatcatacagcaaggaccag

SEQ ID NO: 64286 - DNA, 20 bp, Homo sapiens
gatcgccaagcccatccgcc

SEQ ID NO: 64287 - DNA, 20 bp, Homo sapiens
gatcagtgtcgccaccgcct

SEQ ID NO: 64288 - DNA, 20 bp, Homo sapiens
gatcatagacaacatttatg

SEQ ID NO: 64289 - DNA, 20 bp, Homo sapiens
gatcttcaacgagcttagac

SEQ ID NO: 64290 - DNA, 20 bp, Homo sapiens
gatcccataccggtacttgc

SEQ ID NO: 64291 - DNA, 20 bp, Homo sapiens
gatcaactaaaaagtaagga

SEQ ID NO: 64292 - DNA, 20 bp, Homo sapiens
gatcgtggtgacatgtagtg

SEQ ID NO: 64293 - DNA, 20 bp, Homo sapiens
gatcatacttgcagggacaa

SEQ ID NO: 64294 - DNA, 20 bp, Homo sapiens
gatccccctattagtgatga

SEQ ID NO: 64295 - DNA, 20 bp, Homo sapiens
gatcgacgacggctggatgt

SEQ ID NO: 64296 - DNA, 20 bp, Homo sapiens
gatcgctccacggcactcca

SEQ ID NO: 64297 - DNA, 20 bp, Homo sapiens
gatcctgagcagtgggaaaa

SEQ ID NO: 64298 - DNA, 20 bp, Homo sapiens
gatcatagatacaggattat

SEQ ID NO: 64299 - DNA, 20 bp, Homo sapiens
gatccatcacagacagtcca

SEQ ID NO: 64300 - DNA, 20 bp, Homo sapiens
gatccttttgaatattccaa

SEQ ID NO: 64301 - DNA, 20 bp, Homo sapiens
gatctaatattttaaattaa

SEQ ID NO: 64302 - DNA, 20 bp, Homo sapiens
gatcccaagtgtgaacaaaa

SEQ ID NO: 64303 - DNA, 20 bp, Homo sapiens
gatcgcagttcttgggctca

SEQ ID NO: 64304 - DNA, 20 bp, Homo sapiens
gatcggtgtctgggctcagc

SEQ ID NO: 64305 - DNA, 20 bp, Homo sapiens
gatcaagaacagcaagggaa

SEQ ID NO: 64306 - DNA, 20 bp, Homo sapiens
gatcaagccaaagaattctc

SEQ ID NO: 64307 - DNA, 20 bp, Homo sapiens
gatctgtgtcttaattgttc

SEQ ID NO: 64308 - DNA, 20 bp, Homo sapiens
gatctacatcattcctaatg

SEQ ID NO: 64309 - DNA, 20 bp, Homo sapiens
gatcaaagtaccttgcctca

SEQ ID NO: 64310 - DNA, 20 bp, Homo sapiens
gatctctggtcattcggtga

SEQ ID NO: 64311 - DNA, 20 bp, Homo sapiens
gatcgaacttatggaccagg

SEQ ID NO: 64312 - DNA, 20 bp, Homo sapiens
gatcgtgtcctccatcacgg

SEQ ID NO: 64313 - DNA, 20 bp, Homo sapiens
gatctcatgtatgccaagtg

SEQ ID NO: 64314 - DNA, 20 bp, Homo sapiens
gatcgttacaaagctcaata

SEQ ID NO: 64315 - DNA, 20 bp, Homo sapiens
gatcacagtgagaaacctct

SEQ ID NO: 64316 - DNA, 20 bp, Homo sapiens
gatcttcaggaaacattttc

SEQ ID NO: 64317 - DNA, 20 bp, Homo sapiens
gatcctgtctgcttccaagg

SEQ ID NO: 64318 - DNA, 20 bp, Homo sapiens
gatcaacctgtgcgacatgg

SEQ ID NO: 64319 - DNA, 20 bp, Homo sapiens
gatccattaaaaaaaaaatc

SEQ ID NO: 64320 - DNA, 20 bp, Homo sapiens
gatctacactgttaactgag

SEQ ID NO: 64321 - DNA, 20 bp, Homo sapiens
gatctgttggttgaaataat

SEQ ID NO: 64322 - DNA, 20 bp, Homo sapiens
gatcaggctcttttctgaag

SEQ ID NO: 64323 - DNA, 20 bp, Homo sapiens
gatcctgtaggaaatatact

SEQ ID NO: 64324 - DNA, 20 bp, Homo sapiens
gatcagattttctgggaaca

SEQ ID NO: 64325 - DNA, 20 bp, Homo sapiens
gatctgctttcatgacagcc

SEQ ID NO: 64326 - DNA, 20 bp, Homo sapiens
gatcttctagtgactattta

SEQ ID NO: 64327 - DNA, 20 bp, Homo sapiens
gatcagtaacacgcttctta

SEQ ID NO: 64328 - DNA, 20 bp, Homo sapiens
gatcataagctaaatgtgga

SEQ ID NO: 64329 - DNA, 20 bp, Homo sapiens
gatcgagaatgccaaaaaac

SEQ ID NO: 64330 - DNA, 20 bp, Homo sapiens
gatctatatctgctatgatt

SEQ ID NO: 64331 - DNA, 20 bp, Homo sapiens
gatctaaaaagatgaaagag

SEQ ID NO: 64332 - DNA, 20 bp, Homo sapiens
gatcttctgtggagcatctt

SEQ ID NO: 64333 - DNA, 20 bp, Homo sapiens
gatcaataaataactgtgac

SEQ ID NO: 64334 - DNA, 20 bp, Homo sapiens
gatccaaaatgcccctcgtg

SEQ ID NO: 64335 - DNA, 20 bp, Homo sapiens
gatctggccactggggaccc

SEQ ID NO: 64336 - DNA, 20 bp, Homo sapiens
gatctttcccatactgggct

SEQ ID NO: 64337 - DNA, 20 bp, Homo sapiens
gatcaagctgagtctccttg

SEQ ID NO: 64338 - DNA, 20 bp, Homo sapiens
gatcaaagagagcaaatggc

SEQ ID NO: 64339 - DNA, 20 bp, Homo sapiens
gatcctgtttatgagggcac

SEQ ID NO: 64340 - DNA, 20 bp, Homo sapiens
gatcataatggcgtgtaagc

SEQ ID NO: 64341 - DNA, 20 bp, Homo sapiens
gatccaagcaaaataaaact

SEQ ID NO: 64342 - DNA, 20 bp, Homo sapiens
gatcctcaagccaaaaccca

SEQ ID NO: 64343 - DNA, 20 bp, Homo sapiens
gatcagaacaagattcccaa

SEQ ID NO: 64344 - DNA, 20 bp, Homo sapiens
gatcgtaatactctcagttg

SEQ ID NO: 64345 - DNA, 20 bp, Homo sapiens
gatctacaagctggtggctc

SEQ ID NO: 64346 - DNA, 20 bp, Homo sapiens
gatctgattacgtcagtccc

SEQ ID NO: 64347 - DNA, 20 bp, Homo sapiens
gatctgtgtttttccaaagg

SEQ ID NO: 64348 - DNA, 20 bp, Homo sapiens
gatcccggaccccctggacc

SEQ ID NO: 64349 - DNA, 20 bp, Homo sapiens
gatcaagtaatccacccgcc

SEQ ID NO: 64350 - DNA, 20 bp, Homo sapiens
gatcagcagtgctaaggtgg

SEQ ID NO: 64351 - DNA, 20 bp, Homo sapiens
gatccagaagcagcaggaga

SEQ ID NO: 64352 - DNA, 20 bp, Homo sapiens
gatcaactgcgggacgtgat

SEQ ID NO: 64353 - DNA, 20 bp, Homo sapiens
gatccagaagcagcaggaaa

SEQ ID NO: 64354 - DNA, 20 bp, Homo sapiens
gatccaggaaatatttgtga

SEQ ID NO: 64355 - DNA, 20 bp, Homo sapiens
gatccagaacacattcgcca

SEQ ID NO: 64356 - DNA, 20 bp, Homo sapiens
gatcgagaggaagagttcaa

SEQ ID NO: 64357 - DNA, 20 bp, Homo sapiens
gatctcccctaacagtgtcg

SEQ ID NO: 64358 - DNA, 20 bp, Homo sapiens
gatcggacagcctcttttca

SEQ ID NO: 64359 - DNA, 20 bp, Homo sapiens
gatcactctattctcaatga

SEQ ID NO: 64360 - DNA, 20 bp, Homo sapiens
gatcacaacactgaattcca

SEQ ID NO: 64361 - DNA, 20 bp, Homo sapiens
gatcccatgctgcccctagt

SEQ ID NO: 64362 - DNA, 20 bp, Homo sapiens
gatcaacaagcctcttcaga

SEQ ID NO: 64363 - DNA, 20 bp, Homo sapiens
gatcggaaaagaatgcctca

SEQ ID NO: 64364 - DNA, 20 bp, Homo sapiens
gatctcaagacactcccgac

SEQ ID NO: 64365 - DNA, 20 bp, Homo sapiens
gatctctctgtattatttcc

SEQ ID NO: 64366 - DNA, 20 bp, Homo sapiens
gatcattagaagattgatgt

SEQ ID NO: 64367 - DNA, 20 bp, Homo sapiens
gatcatgagtgttgctgcaa

SEQ ID NO: 64368 - DNA, 20 bp, Homo sapiens
gatccatcttcaccttcgtc

SEQ ID NO: 64369 - DNA, 20 bp, Homo sapiens
gatcaatagagaagatatgg

SEQ ID NO: 64370 - DNA, 20 bp, Homo sapiens
gatcacagggtcgttctcag

SEQ ID NO: 64371 - DNA, 20 bp, Homo sapiens
gatcggaaataaatatatca

SEQ ID NO: 64372 - DNA, 20 bp, Homo sapiens
gatcccaacctgggcctctc

SEQ ID NO: 64373 - DNA, 20 bp, Homo sapiens
gatcacgaagaagtttttta

SEQ ID NO: 64374 - DNA, 20 bp, Homo sapiens
gatccaagaactcttcattc

SEQ ID NO: 64375 - DNA, 20 bp, Homo sapiens
gatctgtgaaaattgtcaac

SEQ ID NO: 64376 - DNA, 20 bp, Homo sapiens
gatcagtagagtgtccaatc

SEQ ID NO: 64377 - DNA, 20 bp, Homo sapiens
gatcctttgcaaggtgagct

SEQ ID NO: 64378 - DNA, 20 bp, Homo sapiens
gatcttcccagagtacaaaa

SEQ ID NO: 64379 - DNA, 20 bp, Homo sapiens
gatcgtgaccatttggaaga

SEQ ID NO: 64380 - DNA, 20 bp, Homo sapiens
gatctacacgcacaagaatc

SEQ ID NO: 64381 - DNA, 20 bp, Homo sapiens
gatcctgggtcgtgaccagc

SEQ ID NO: 64382 - DNA, 20 bp, Homo sapiens
gatcttgccctaaaacgtgc

SEQ ID NO: 64383 - DNA, 20 bp, Homo sapiens
gatcctggagccaatgtcca

SEQ ID NO: 64384 - DNA, 20 bp, Homo sapiens
gatcgccacaagtagcatct

SEQ ID NO: 64385 - DNA, 20 bp, Homo sapiens
gatcctgtacaaaggccgcg

SEQ ID NO: 64386 - DNA, 20 bp, Homo sapiens
gatcacacacaggcgagaga

SEQ ID NO: 64387 - DNA, 20 bp, Homo sapiens
gatctactatctgaagctcc

SEQ ID NO: 64388 - DNA, 20 bp, Homo sapiens
gatctcatctctgcaggtca

SEQ ID NO: 64389 - DNA, 20 bp, Homo sapiens
gatcgggctcacctacaaga

SEQ ID NO: 64390 - DNA, 20 bp, Homo sapiens
gatcatcctggagtgatgaa

SEQ ID NO: 64391 - DNA, 20 bp, Homo sapiens
gatcactcaacacaacgtga

SEQ ID NO: 64392 - DNA, 20 bp, Homo sapiens
gatctgacactgagtctcag

SEQ ID NO: 64393 - DNA, 20 bp, Homo sapiens
gatcactggcctttctttct

SEQ ID NO: 64394 - DNA, 20 bp, Homo sapiens
gatccccattcccacttccc

SEQ ID NO: 64395 - DNA, 20 bp, Homo sapiens
gatctggcctggggctgctg

SEQ ID NO: 64396 - DNA, 20 bp, Homo sapiens
gatccatggatgtacagcag

SEQ ID NO: 64397 - DNA, 20 bp, Homo sapiens
gatcgcgaaataaagtacat

SEQ ID NO: 64398 - DNA, 20 bp, Homo sapiens
gatcgcgctattgtcatgga

SEQ ID NO: 64399 - DNA, 20 bp, Homo sapiens
gatctgcacttggggtggtc

SEQ ID NO: 64400 - DNA, 20 bp, Homo sapiens
gatcgatgggttcaatggaa

SEQ ID NO: 64401 - DNA, 20 bp, Homo sapiens
gatccgtgaaggaggggctc

SEQ ID NO: 64402 - DNA, 20 bp, Homo sapiens
gatcacctcaagcaaatgcc

SEQ ID NO: 64403 - DNA, 20 bp, Homo sapiens
gatccccgcctgcagaatca

SEQ ID NO: 64404 - DNA, 20 bp, Homo sapiens
gatccgcctgtgctttgaga

SEQ ID NO: 64405 - DNA, 20 bp, Homo sapiens
gatctgtatctgagccacag

SEQ ID NO: 64406 - DNA, 20 bp, Homo sapiens
gatcctgaaatgttgtcccg

SEQ ID NO: 64407 - DNA, 20 bp, Homo sapiens
gatcatttgtggttcccttt

SEQ ID NO: 64408 - DNA, 20 bp, Homo sapiens
gatcacccgtttgctaagga

SEQ ID NO: 64409 - DNA, 20 bp, Homo sapiens
gatcattcagtgctggtgga

SEQ ID NO: 64410 - DNA, 20 bp, Homo sapiens
gatcagaaaattctctccat

SEQ ID NO: 64411 - DNA, 20 bp, Homo sapiens
gatccggacagttctgcccc

SEQ ID NO: 64412 - DNA, 20 bp, Homo sapiens
gatctaacaatccctgggga

SEQ ID NO: 64413 - DNA, 20 bp, Homo sapiens
gatcacgttgtcctccaagg

SEQ ID NO: 64414 - DNA, 20 bp, Homo sapiens
gatctgaatgcatatgcttc

SEQ ID NO: 64415 - DNA, 20 bp, Homo sapiens
gatcacatctggtttggtgc

SEQ ID NO: 64416 - DNA, 20 bp, Homo sapiens
gatcatcaatatctaaaaag

SEQ ID NO: 64417 - DNA, 20 bp, Homo sapiens
gatcacagctcacggtagcc

SEQ ID NO: 64418 - DNA, 20 bp, Homo sapiens
gatcaacgaaagtctgcgtt

SEQ ID NO: 64419 - DNA, 20 bp, Homo sapiens
gatcagactcccaggccgtg

SEQ ID NO: 64420 - DNA, 20 bp, Homo sapiens
gatctacccttaacgtatat

SEQ ID NO: 64421 - DNA, 20 bp, Homo sapiens
gatctcactaaagataaaaa

SEQ ID NO: 64422 - DNA, 20 bp, Homo sapiens
gatcaagttctgggcctgaa

SEQ ID NO: 64423 - DNA, 20 bp, Homo sapiens
gatctccagtcagcttttgc

SEQ ID NO: 64424 - DNA, 20 bp, Homo sapiens
gatccccttctacatggggt

SEQ ID NO: 64425 - DNA, 20 bp, Homo sapiens
gatccctgcgtgttggccaa

SEQ ID NO: 64426 - DNA, 20 bp, Homo sapiens
gatcattggtaacacaatgg

SEQ ID NO: 64427 - DNA, 20 bp, Homo sapiens
gatcttctcgtggatgtcct

SEQ ID NO: 64428 - DNA, 20 bp, Homo sapiens
gatcagtgcagaactcatgg

SEQ ID NO: 64429 - DNA, 20 bp, Homo sapiens
gatctgggacaggtattcct

SEQ ID NO: 64430 - DNA, 20 bp, Homo sapiens
gatctatttatacatcagac

SEQ ID NO: 64431 - DNA, 20 bp, Homo sapiens
gatcaccctcatctgaaagc

SEQ ID NO: 64432 - DNA, 20 bp, Homo sapiens
gatcactcagaggaagagga

SEQ ID NO: 64433 - DNA, 20 bp, Homo sapiens
gatcttcaacttccagtctt

SEQ ID NO: 64434 - DNA, 20 bp, Homo sapiens
gatcggctggaaaacaacgc

SEQ ID NO: 64435 - DNA, 20 bp, Homo sapiens
gatctctcttccaataaaga

SEQ ID NO: 64436 - DNA, 20 bp, Homo sapiens
gatctagtgtgcataggtct

SEQ ID NO: 64437 - DNA, 20 bp, Homo sapiens
gatcaaaatgtttctccaaa

SEQ ID NO: 64438 - DNA, 20 bp, Homo sapiens
gatcttcacacacttataat

SEQ ID NO: 64439 - DNA, 20 bp, Homo sapiens
gatcactgcagacctgctga

SEQ ID NO: 64440 - DNA, 20 bp, Homo sapiens
gatcaagacgtcaggagatt

SEQ ID NO: 64441 - DNA, 20 bp, Homo sapiens
gatcccccatctgcccatct

SEQ ID NO: 64442 - DNA, 20 bp, Homo sapiens
gatcatgcttccaggagtgt

SEQ ID NO: 64443 - DNA, 20 bp, Homo sapiens
gatcttcactcccttccttc

SEQ ID NO: 64444 - DNA, 20 bp, Homo sapiens
gatcttgtccaaccccctcc

SEQ ID NO: 64445 - DNA, 20 bp, Homo sapiens
gatcagtgatgactttgacc

SEQ ID NO: 64446 - DNA, 20 bp, Homo sapiens
gatcacgttgtcctcctagg

SEQ ID NO: 64447 - DNA, 20 bp, Homo sapiens
gatctgcctggggtcaggct

SEQ ID NO: 64448 - DNA, 20 bp, Homo sapiens
gatcccgcaggaccggctct

SEQ ID NO: 64449 - DNA, 20 bp, Homo sapiens
gatcatcagagatagttggc

SEQ ID NO: 64450 - DNA, 20 bp, Homo sapiens
gatcaccagatgatactggt

SEQ ID NO: 64451 - DNA, 20 bp, Homo sapiens
gatctggtaaacaaataaaa

SEQ ID NO: 64452 - DNA, 20 bp, Homo sapiens
gatcatgaagaacattaagg

SEQ ID NO: 64453 - DNA, 20 bp, Homo sapiens
gatccgaaagacaagaaaac

SEQ ID NO: 64454 - DNA, 20 bp, Homo sapiens
gatctgattgaaagcatgct

SEQ ID NO: 64455 - DNA, 20 bp, Homo sapiens
gatcatgtgtgtacagcagc

SEQ ID NO: 64456 - DNA, 20 bp, Homo sapiens
gatccaattccctggagaat

SEQ ID NO: 64457 - DNA, 20 bp, Homo sapiens
gatccctgaactaattatag

SEQ ID NO: 64458 - DNA, 20 bp, Homo sapiens
gatctgtcaacactaggtgg

SEQ ID NO: 64459 - DNA, 20 bp, Homo sapiens
gatcatggaacaaaatatga

SEQ ID NO: 64460 - DNA, 20 bp, Homo sapiens
gatcttcaacattaaataaa

SEQ ID NO: 64461 - DNA, 20 bp, Homo sapiens
gatcagtgcctgttgcgtgt

SEQ ID NO: 64462 - DNA, 20 bp, Homo sapiens
gatcatccccagagtagatg

SEQ ID NO: 64463 - DNA, 20 bp, Homo sapiens
gatcggatgggtccgaaagt

SEQ ID NO: 64464 - DNA, 20 bp, Homo sapiens
gatcagtgtccttcagtgat

SEQ ID NO: 64465 - DNA, 20 bp, Homo sapiens
gatcacactgcacagagtgc

SEQ ID NO: 64466 - DNA, 20 bp, Homo sapiens
gatccgaaatcccagtgccc

SEQ ID NO: 64467 - DNA, 20 bp, Homo sapiens
gatccagaagctgcttatac

SEQ ID NO: 64468 - DNA, 20 bp, Homo sapiens
gatcaccccagcctgtgaga

SEQ ID NO: 64469 - DNA, 20 bp, Homo sapiens
gatcacctgactgtagaaac

SEQ ID NO: 64470 - DNA, 20 bp, Homo sapiens
gatcgtctatcagcgataga

SEQ ID NO: 64471 - DNA, 20 bp, Homo sapiens
gatcccgtggaagaattcat

SEQ ID NO: 64472 - DNA, 20 bp, Homo sapiens
gatctgtccacttcaagcta

SEQ ID NO: 64473 - DNA, 20 bp, Homo sapiens
gatcagatgtaaccagaaac

SEQ ID NO: 64474 - DNA, 20 bp, Homo sapiens
gatcatattaaatgatgtta

SEQ ID NO: 64475 - DNA, 20 bp, Homo sapiens
gatcatttctcaagagtttc

SEQ ID NO: 64476 - DNA, 20 bp, Homo sapiens
gatctcagttcaccacaacc

SEQ ID NO: 64477 - DNA, 20 bp, Homo sapiens
gatcttaaaagaaggactcc

SEQ ID NO: 64478 - DNA, 20 bp, Homo sapiens
gatcttatttttaaaaatga

SEQ ID NO: 64479 - DNA, 20 bp, Homo sapiens
gatcgaacagtggcttcgtt

SEQ ID NO: 64480 - DNA, 20 bp, Homo sapiens
gatcagagccttgtggccat

SEQ ID NO: 64481 - DNA, 20 bp, Homo sapiens
gatcagcgaccctgaggaag

SEQ ID NO: 64482 - DNA, 20 bp, Homo sapiens
gatcaagaatttgtctttct

SEQ ID NO: 64483 - DNA, 20 bp, Homo sapiens
gatcatctaaaacaaataaa

SEQ ID NO: 64484 - DNA, 20 bp, Homo sapiens
gatctggaagaagaaatata

SEQ ID NO: 64485 - DNA, 20 bp, Homo sapiens
gatcctaaaatttatctaga

SEQ ID NO: 64486 - DNA, 20 bp, Homo sapiens
gatcttctcggaagatgagg

SEQ ID NO: 64487 - DNA, 20 bp, Homo sapiens
gatcaggaaaagaagaccta

SEQ ID NO: 64488 - DNA, 20 bp, Homo sapiens
gatcaagagttaagagacgt

SEQ ID NO: 64489 - DNA, 20 bp, Homo sapiens
gatcaaatttctgtgttcag

SEQ ID NO: 64490 - DNA, 20 bp, Homo sapiens
gatcactgcagcctctaact

SEQ ID NO: 64491 - DNA, 20 bp, Homo sapiens
gatcttcaaggaggccgctg

SEQ ID NO: 64492 - DNA, 20 bp, Homo sapiens
gatcctgggacaaccaataa

SEQ ID NO: 64493 - DNA, 20 bp, Homo sapiens
gatccctctctaacagagac

SEQ ID NO: 64494 - DNA, 20 bp, Homo sapiens
gatcgcactgtcgcgcagaa

SEQ ID NO: 64495 - DNA, 20 bp, Homo sapiens
gatcttgcaatgttgcccag

SEQ ID NO: 64496 - DNA, 20 bp, Homo sapiens
gatctgaataaggacttgga

SEQ ID NO: 64497 - DNA, 20 bp, Homo sapiens
gatcttaggaagtgctgtgg

SEQ ID NO: 64498 - DNA, 20 bp, Homo sapiens
gatcacatcggcaatgacct

SEQ ID NO: 64499 - DNA, 20 bp, Homo sapiens
gatcacaatgcgggttgcat

SEQ ID NO: 64500 - DNA, 20 bp, Homo sapiens
gatcctttctaccaagtcct

SEQ ID NO: 64501 - DNA, 20 bp, Homo sapiens
gatctaaaagtccaaatagt

SEQ ID NO: 64502 - DNA, 20 bp, Homo sapiens
gatcgttggccggagacagg

SEQ ID NO: 64503 - DNA, 20 bp, Homo sapiens
gatctacatccaatgcccag

SEQ ID NO: 64504 - DNA, 20 bp, Homo sapiens
gatcagagaatgtaactact

SEQ ID NO: 64505 - DNA, 20 bp, Homo sapiens
gatcaccaaataattaccta

SEQ ID NO: 64506 - DNA, 20 bp, Homo sapiens
gatcctgcagctgctcagaa

SEQ ID NO: 64507 - DNA, 20 bp, Homo sapiens
gatcatagatatagggttat

SEQ ID NO: 64508 - DNA, 20 bp, Homo sapiens
gatccgccgctgcggccgcc

SEQ ID NO: 64509 - DNA, 20 bp, Homo sapiens
gatcttccagagcacacatc

SEQ ID NO: 64510 - DNA, 20 bp, Homo sapiens
gatcaagaaaaggaggaaga

SEQ ID NO: 64511 - DNA, 20 bp, Homo sapiens
gatcaattcatgatatgtca

SEQ ID NO: 64512 - DNA, 20 bp, Homo sapiens
gatcatccacaaaataaatg

SEQ ID NO: 64513 - DNA, 20 bp, Homo sapiens
gatccgaaatcacaccatta

SEQ ID NO: 64514 - DNA, 20 bp, Homo sapiens
gatcgtgcagctgtctcctg

SEQ ID NO: 64515 - DNA, 20 bp, Homo sapiens
gatccccagcagccctctgc

SEQ ID NO: 64516 - DNA, 20 bp, Homo sapiens
gatcagtagcccttgaaaag

SEQ ID NO: 64517 - DNA, 20 bp, Homo sapiens
gatcacccagtgaagactgt

SEQ ID NO: 64518 - DNA, 20 bp, Homo sapiens
gatccagccgtgcgctctgg

SEQ ID NO: 64519 - DNA, 20 bp, Homo sapiens
gatccggattaaggagctgg

SEQ ID NO: 64520 - DNA, 20 bp, Homo sapiens
gatccatatctccttccaac

SEQ ID NO: 64521 - DNA, 20 bp, Homo sapiens
gatcgctcgcttcgttcttc

SEQ ID NO: 64522 - DNA, 20 bp, Homo sapiens
gatccagtttgctgtgccac

SEQ ID NO: 64523 - DNA, 20 bp, Homo sapiens
gatctgtgatagaggaataa

SEQ ID NO: 64524 - DNA, 20 bp, Homo sapiens
gatctctgccaccatgggtg

SEQ ID NO: 64525 - DNA, 20 bp, Homo sapiens
gatctccatactcagcattt

SEQ ID NO: 64526 - DNA, 20 bp, Homo sapiens
gatctcctttaagctgggag

SEQ ID NO: 64527 - DNA, 20 bp, Homo sapiens
gatcccaagacccaagctgc

SEQ ID NO: 64528 - DNA, 20 bp, Homo sapiens
gatcttgcctttgctccatc

SEQ ID NO: 64529 - DNA, 20 bp, Homo sapiens
gatcgatactccgattatgg

SEQ ID NO: 64530 - DNA, 20 bp, Homo sapiens
gatcctgttcccgcccccga

SEQ ID NO: 64531 - DNA, 20 bp, Homo sapiens
gatccaagaaaggctgagaa

SEQ ID NO: 64532 - DNA, 20 bp, Homo sapiens
gatccagttgtggaagtctc

SEQ ID NO: 64533 - DNA, 20 bp, Homo sapiens
gatcccgccttggctcctcc

SEQ ID NO: 64534 - DNA, 20 bp, Homo sapiens
gatcaacgggagcaatcctg

SEQ ID NO: 64535 - DNA, 20 bp, Homo sapiens
gatccagagagcccatctcc

SEQ ID NO: 64536 - DNA, 20 bp, Homo sapiens
gatcagccttctggatgtca

SEQ ID NO: 64537 - DNA, 20 bp, Homo sapiens
gatccactgaaagagattca

SEQ ID NO: 64538 - DNA, 20 bp, Homo sapiens
gatcttgccattgctccatc

SEQ ID NO: 64539 - DNA, 20 bp, Homo sapiens
gatcaatcaacctcatgaca

SEQ ID NO: 64540 - DNA, 20 bp, Homo sapiens
gatccacggcttcattcttg

SEQ ID NO: 64541 - DNA, 20 bp, Homo sapiens
gatccagatggaagccatca

SEQ ID NO: 64542 - DNA, 20 bp, Homo sapiens
gatcaaatgtgagtcccact

SEQ ID NO: 64543 - DNA, 20 bp, Homo sapiens
gatcactttcaccttgtccc

SEQ ID NO: 64544 - DNA, 20 bp, Homo sapiens
gatcctgagcaaggaggact

SEQ ID NO: 64545 - DNA, 20 bp, Homo sapiens
gatcttgaagatactcacag

SEQ ID NO: 64546 - DNA, 20 bp, Homo sapiens
gatcggccgagacccagaag

SEQ ID NO: 64547 - DNA, 20 bp, Homo sapiens
gatcaccattttattttcat

SEQ ID NO: 64548 - DNA, 20 bp, Homo sapiens
gatccgaggcttgtttttcc

SEQ ID NO: 64549 - DNA, 20 bp, Homo sapiens
gatcaccagcctccaccaag

SEQ ID NO: 64550 - DNA, 20 bp, Homo sapiens
gatcagcaaggaagtgttgt

SEQ ID NO: 64551 - DNA, 20 bp, Homo sapiens
gatcttacagcaaaacaggt

SEQ ID NO: 64552 - DNA, 20 bp, Homo sapiens
gatccgattaagtatagctc

SEQ ID NO: 64553 - DNA, 20 bp, Homo sapiens
gatccagaaccacggcaaga

SEQ ID NO: 64554 - DNA, 20 bp, Homo sapiens
gatcagttggctcagattcg

SEQ ID NO: 64555 - DNA, 20 bp, Homo sapiens
gatccctaactggtagctcc

SEQ ID NO: 64556 - DNA, 20 bp, Homo sapiens
gatcggcagggaccacttcc

SEQ ID NO: 64557 - DNA, 20 bp, Homo sapiens
gatctcaccagcagggtgct

SEQ ID NO: 64558 - DNA, 20 bp, Homo sapiens
gatcaccatcaccaatgaca

SEQ ID NO: 64559 - DNA, 20 bp, Homo sapiens
gatctgcaagagctgcatca

SEQ ID NO: 64560 - DNA, 20 bp, Homo sapiens
gatcaagcatgtctctgtgt

SEQ ID NO: 64561 - DNA, 20 bp, Homo sapiens
gatcatattcaagagggtaa

SEQ ID NO: 64562 - DNA, 20 bp, Homo sapiens
gatcgagtcacaaaaattca

SEQ ID NO: 64563 - DNA, 20 bp, Homo sapiens
gatccgtgtgaacagctact

SEQ ID NO: 64564 - DNA, 20 bp, Homo sapiens
gatcctgcgcactacgagtt

SEQ ID NO: 64565 - DNA, 20 bp, Homo sapiens
gatccaggaggccgcatcgg

SEQ ID NO: 64566 - DNA, 20 bp, Homo sapiens
gatccaaaaattcatccatg

SEQ ID NO: 64567 - DNA, 20 bp, Homo sapiens
gatcagacagcagccctgat

SEQ ID NO: 64568 - DNA, 20 bp, Homo sapiens
gatcgaggccgaaaagtctt

SEQ ID NO: 64569 - DNA, 20 bp, Homo sapiens
gatctgggatgcagtgtcct

SEQ ID NO: 64570 - DNA, 20 bp, Homo sapiens
gatcgcctcaagaagccccc

SEQ ID NO: 64571 - DNA, 20 bp, Homo sapiens
gatctttagattaaaaaaaa

SEQ ID NO: 64572 - DNA, 20 bp, Homo sapiens
gatcagatgcctaaggaaca

SEQ ID NO: 64573 - DNA, 20 bp, Homo sapiens
gatcaccaatgcctgcttcg

SEQ ID NO: 64574 - DNA, 20 bp, Homo sapiens
gatcaagtggacagagatat

SEQ ID NO: 64575 - DNA, 20 bp, Homo sapiens
gatcacagcttccaggccaa

SEQ ID NO: 64576 - DNA, 20 bp, Homo sapiens
gatcccatcattcaaaagta

SEQ ID NO: 64577 - DNA, 20 bp, Homo sapiens
gatcttaaaagtggaaagca

SEQ ID NO: 64578 - DNA, 20 bp, Homo sapiens
gatccaaacctaaagcctac

SEQ ID NO: 64579 - DNA, 20 bp, Homo sapiens
gatctgaaaagaacaattgc

SEQ ID NO: 64580 - DNA, 20 bp, Homo sapiens
gatcacgaaagatgcattcc

SEQ ID NO: 64581 - DNA, 20 bp, Homo sapiens
gatcagatactcttggccac

SEQ ID NO: 64582 - DNA, 20 bp, Homo sapiens
gatcctgaagtggcggccct

SEQ ID NO: 64583 - DNA, 20 bp, Homo sapiens
gatcctgtttcagccccctg

SEQ ID NO: 64584 - DNA, 20 bp, Homo sapiens
gatcgagatttccatgttca

SEQ ID NO: 64585 - DNA, 20 bp, Homo sapiens
gatctcacccaattccatgg

SEQ ID NO: 64586 - DNA, 20 bp, Homo sapiens
gatcacccactcttacctgc

SEQ ID NO: 64587 - DNA, 20 bp, Homo sapiens
gatcgtcgacgggcggccct

SEQ ID NO: 64588 - DNA, 20 bp, Homo sapiens
gatcatcatgtgatttctga

SEQ ID NO: 64589 - DNA, 20 bp, Homo sapiens
gatccagcaaattgagaacc

SEQ ID NO: 64590 - DNA, 20 bp, Homo sapiens
gatcgagagccagaggggac

SEQ ID NO: 64591 - DNA, 20 bp, Homo sapiens
gatcgacctgtcctttaatg

SEQ ID NO: 64592 - DNA, 20 bp, Homo sapiens
gatctccccattcactttct

SEQ ID NO: 64593 - DNA, 20 bp, Homo sapiens
gatcactctcactaacatca

SEQ ID NO: 64594 - DNA, 20 bp, Homo sapiens
gatcattggtagccaggggt

SEQ ID NO: 64595 - DNA, 20 bp, Homo sapiens
gatccagactgaaactgatt

SEQ ID NO: 64596 - DNA, 20 bp, Homo sapiens
gatcctgcttggggtgtcgt

SEQ ID NO: 64597 - DNA, 20 bp, Homo sapiens
gatctcacgggggtgaggga

SEQ ID NO: 64598 - DNA, 20 bp, Homo sapiens
gatcttgcctggaggatgct

SEQ ID NO: 64599 - DNA, 20 bp, Homo sapiens
gatcaaataatatctcctca

SEQ ID NO: 64600 - DNA, 20 bp, Homo sapiens
gatcaagaagtgaagaatgg

SEQ ID NO: 64601 - DNA, 20 bp, Homo sapiens
gatcactgatgacctcacag

SEQ ID NO: 64602 - DNA, 20 bp, Homo sapiens
gatcaacagcttcgcgtggt

SEQ ID NO: 64603 - DNA, 20 bp, Homo sapiens
gatcatcaaaaggattgact

SEQ ID NO: 64604 - DNA, 20 bp, Homo sapiens
gatctcaccactttaagagt

SEQ ID NO: 64605 - DNA, 20 bp, Homo sapiens
gatctgctgaatcccaacct

SEQ ID NO: 64606 - DNA, 20 bp, Homo sapiens
gatcaaacacacccattggt

SEQ ID NO: 64607 - DNA, 20 bp, Homo sapiens
gatcaagctctccttggagg

SEQ ID NO: 64608 - DNA, 20 bp, Homo sapiens
gatcaatctataacattccc

SEQ ID NO: 64609 - DNA, 20 bp, Homo sapiens
gatcacatcaatgacaaatg

SEQ ID NO: 64610 - DNA, 20 bp, Homo sapiens
gatcattctttctcctgata

SEQ ID NO: 64611 - DNA, 20 bp, Homo sapiens
gatctgtttaatatgactgt

SEQ ID NO: 64612 - DNA, 20 bp, Homo sapiens
gatcttgcctgatttctgat

SEQ ID NO: 64613 - DNA, 20 bp, Homo sapiens
gatcagtggaggacctcaca

SEQ ID NO: 64614 - DNA, 20 bp, Homo sapiens
gatctttcccaagacaggcc

SEQ ID NO: 64615 - DNA, 20 bp, Homo sapiens
gatcacacatttattggtgc

SEQ ID NO: 64616 - DNA, 20 bp, Homo sapiens
gatctatatcatttgtaaat

SEQ ID NO: 64617 - DNA, 20 bp, Homo sapiens
gatctgttgcaagataactt

SEQ ID NO: 64618 - DNA, 20 bp, Homo sapiens
gatctagaacaagataatat

SEQ ID NO: 64619 - DNA, 20 bp, Homo sapiens
gatcctcccatttctaggga

SEQ ID NO: 64620 - DNA, 20 bp, Homo sapiens
gatctgtaacagggtagtgt

SEQ ID NO: 64621 - DNA, 20 bp, Homo sapiens
gatccacttagcacctctca

SEQ ID NO: 64622 - DNA, 20 bp, Homo sapiens
gatcgcagaagaatacgcag

SEQ ID NO: 64623 - DNA, 20 bp, Homo sapiens
gatcaaaaatccattttgcc

SEQ ID NO: 64624 - DNA, 20 bp, Homo sapiens
gatctatgttcaaaactgtc

SEQ ID NO: 64625 - DNA, 20 bp, Homo sapiens
gatcctctcaatcaaaataa

SEQ ID NO: 64626 - DNA, 20 bp, Homo sapiens
gatcttgccagtggtctgga

SEQ ID NO: 64627 - DNA, 20 bp, Homo sapiens
gatctgatgttgcataatac

SEQ ID NO: 64628 - DNA, 20 bp, Homo sapiens
gatcacctgcagctccatgc

SEQ ID NO: 64629 - DNA, 20 bp, Homo sapiens
gatcttaagcaacatgatag

SEQ ID NO: 64630 - DNA, 20 bp, Homo sapiens
gatcacgctgtacacttagc

SEQ ID NO: 64631 - DNA, 20 bp, Homo sapiens
gatctctgccaaatacctta

SEQ ID NO: 64632 - DNA, 20 bp, Homo sapiens
gatcgccaagcgcatcccca

SEQ ID NO: 64633 - DNA, 20 bp, Homo sapiens
gatccgagcggggctggcct

SEQ ID NO: 64634 - DNA, 20 bp, Homo sapiens
gatcaaatttcatccataat

SEQ ID NO: 64635 - DNA, 20 bp, Homo sapiens
gatcatccagcccgacaaga

SEQ ID NO: 64636 - DNA, 20 bp, Homo sapiens
gatcattggtcgtggctgaa

SEQ ID NO: 64637 - DNA, 20 bp, Homo sapiens
gatcaaaaggttcagaaaaa

SEQ ID NO: 64638 - DNA, 20 bp, Homo sapiens
gatcttgggtctgtgtttgg

SEQ ID NO: 64639 - DNA, 20 bp, Homo sapiens
gatcactatctgtactggag

SEQ ID NO: 64640 - DNA, 20 bp, Homo sapiens
gatccttggtaatcaaatct

SEQ ID NO: 64641 - DNA, 20 bp, Homo sapiens
gatcccatgttacaggaggg

SEQ ID NO: 64642 - DNA, 20 bp, Homo sapiens
gatcgggggctccatcctgg

SEQ ID NO: 64643 - DNA, 20 bp, Homo sapiens
gatctccagtatgtgaagat

SEQ ID NO: 64644 - DNA, 20 bp, Homo sapiens
gatctttattcgtgacagaa

SEQ ID NO: 64645 - DNA, 20 bp, Homo sapiens
gatcaggcctccttcaagac

SEQ ID NO: 64646 - DNA, 20 bp, Homo sapiens
gatccctgggaccctcacgc

SEQ ID NO: 64647 - DNA, 20 bp, Homo sapiens
gatctctggaggccactgaa

SEQ ID NO: 64648 - DNA, 20 bp, Homo sapiens
gatcctactgaggcaagcag

SEQ ID NO: 64649 - DNA, 20 bp, Homo sapiens
gatcaagaagtgtgcgacac

SEQ ID NO: 64650 - DNA, 20 bp, Homo sapiens
gatcaaatcgcatgctttat

SEQ ID NO: 64651 - DNA, 20 bp, Homo sapiens
gatcgctttattcgtactca

SEQ ID NO: 64652 - DNA, 20 bp, Homo sapiens
gatcagccagaggcagggcg

SEQ ID NO: 64653 - DNA, 20 bp, Homo sapiens
gatcaaatttaccaacggaa

SEQ ID NO: 64654 - DNA, 20 bp, Homo sapiens
gatctctgccttcagctgtc

SEQ ID NO: 64655 - DNA, 20 bp, Homo sapiens
gatcctgcacagttcaggga

SEQ ID NO: 64656 - DNA, 20 bp, Homo sapiens
gatctcggggagtccccgag

SEQ ID NO: 64657 - DNA, 20 bp, Homo sapiens
gatccaccatgacttattca

SEQ ID NO: 64658 - DNA, 20 bp, Homo sapiens
gatcacccacctcatcagga

SEQ ID NO: 64659 - DNA, 20 bp, Homo sapiens
gatccctggagctccaggac

SEQ ID NO: 64660 - DNA, 20 bp, Homo sapiens
gatctcgatggtccacagac

SEQ ID NO: 64661 - DNA, 20 bp, Homo sapiens
gatctacacagaacaacaag

SEQ ID NO: 64662 - DNA, 20 bp, Homo sapiens
gatcacatctggtgaccagg

SEQ ID NO: 64663 - DNA, 20 bp, Homo sapiens
gatcagaataaaaagaacga

SEQ ID NO: 64664 - DNA, 20 bp, Homo sapiens
gatcaaatgttttgggggac

SEQ ID NO: 64665 - DNA, 20 bp, Homo sapiens
gatctccttccatgttcaat

SEQ ID NO: 64666 - DNA, 20 bp, Homo sapiens
gatcctcctttacatagcac

SEQ ID NO: 64667 - DNA, 20 bp, Homo sapiens
gatccgtttgatttttattt

SEQ ID NO: 64668 - DNA, 20 bp, Homo sapiens
gatcagagaatgaagagggt

SEQ ID NO: 64669 - DNA, 20 bp, Homo sapiens
gatctcatcctggaatgcat

SEQ ID NO: 64670 - DNA, 20 bp, Homo sapiens
gatctgcagtggctgacagc

SEQ ID NO: 64671 - DNA, 20 bp, Homo sapiens
gatcattaaatatttacaaa

SEQ ID NO: 64672 - DNA, 20 bp, Homo sapiens
gatcaaaactacatttgtgg

SEQ ID NO: 64673 - DNA, 20 bp, Homo sapiens
gatccttaaagagatgaaca

SEQ ID NO: 64674 - DNA, 20 bp, Homo sapiens
gatcaactcttccaggacca

SEQ ID NO: 64675 - DNA, 20 bp, Homo sapiens
gatcctggaggaatttggaa

SEQ ID NO: 64676 - DNA, 20 bp, Homo sapiens
gatcttcccttgtaaatgtg

SEQ ID NO: 64677 - DNA, 20 bp, Homo sapiens
gatcactgactacatggcct

SEQ ID NO: 64678 - DNA, 20 bp, Homo sapiens
gatcaaagacaaagaagaca

SEQ ID NO: 64679 - DNA, 20 bp, Homo sapiens
gatccccagttgcttctttt

SEQ ID NO: 64680 - DNA, 20 bp, Homo sapiens
gatcagcaaggattgagtct

SEQ ID NO: 64681 - DNA, 20 bp, Homo sapiens
gatcatagcaagtgtcagtg

SEQ ID NO: 64682 - DNA, 20 bp, Homo sapiens
gatccaagatttatctcagc

SEQ ID NO: 64683 - DNA, 20 bp, Homo sapiens
gatcaaagaactgcagacca

SEQ ID NO: 64684 - DNA, 20 bp, Homo sapiens
gatcaggaggaaaatgaaga

SEQ ID NO: 64685 - DNA, 20 bp, Homo sapiens
gatccacgaagagctgcgac

SEQ ID NO: 64686 - DNA, 20 bp, Homo sapiens
gatccccagtggccaccacc

SEQ ID NO: 64687 - DNA, 20 bp, Homo sapiens
gatctgccctcgcgctggcc

SEQ ID NO: 64688 - DNA, 20 bp, Homo sapiens
gatctgctggctcagcaact

SEQ ID NO: 64689 - DNA, 20 bp, Homo sapiens
gatcacgaacccactcaacc

SEQ ID NO: 64690 - DNA, 20 bp, Homo sapiens
gatcgggcgagccgagtcat

SEQ ID NO: 64691 - DNA, 20 bp, Homo sapiens
gatcctcaactccaaatcca

SEQ ID NO: 64692 - DNA, 20 bp, Homo sapiens
gatctccagaaccgattgag

SEQ ID NO: 64693 - DNA, 20 bp, Homo sapiens
gatcaacagccatttccact

SEQ ID NO: 64694 - DNA, 20 bp, Homo sapiens
gatctcggaactttcagcag

SEQ ID NO: 64695 - DNA, 20 bp, Homo sapiens
gatcttgtatcagacacttt

SEQ ID NO: 64696 - DNA, 20 bp, Homo sapiens
gatcgtgtgaagcttgcttg

SEQ ID NO: 64697 - DNA, 20 bp, Homo sapiens
gatcagtttctttcagttcc

SEQ ID NO: 64698 - DNA, 20 bp, Homo sapiens
gatcgagagcctaactttgc

SEQ ID NO: 64699 - DNA, 20 bp, Homo sapiens
gatcattacaacatgaaaaa

SEQ ID NO: 64700 - DNA, 20 bp, Homo sapiens
gatcccactggaaaagcatg

SEQ ID NO: 64701 - DNA, 20 bp, Homo sapiens
gatctggttccagaatcatc

SEQ ID NO: 64702 - DNA, 20 bp, Homo sapiens
gatcactgaagattccttgg

SEQ ID NO: 64703 - DNA, 20 bp, Homo sapiens
gatcactgtatagattaaaa

SEQ ID NO: 64704 - DNA, 20 bp, Homo sapiens
gatctcatgatgtgcttacc

SEQ ID NO: 64705 - DNA, 20 bp, Homo sapiens
gatcacttaacttatagacc

SEQ ID NO: 64706 - DNA, 20 bp, Homo sapiens
gatcaggccattgggctctg

SEQ ID NO: 64707 - DNA, 20 bp, Homo sapiens
gatccacagagtttcatatt

SEQ ID NO: 64708 - DNA, 20 bp, Homo sapiens
gatccggccccacatcttct

SEQ ID NO: 64709 - DNA, 20 bp, Homo sapiens
gatcataaaacggatgaaag

SEQ ID NO: 64710 - DNA, 20 bp, Homo sapiens
gatcataaacttctagtagt

SEQ ID NO: 64711 - DNA, 20 bp, Homo sapiens
gatctgtaaaataaaaactc

SEQ ID NO: 64712 - DNA, 20 bp, Homo sapiens
gatcctgctcttgaccctct

SEQ ID NO: 64713 - DNA, 20 bp, Homo sapiens
gatcccactccaagtctaga

SEQ ID NO: 64714 - DNA, 20 bp, Homo sapiens
gatcattcagtgtttttcct

SEQ ID NO: 64715 - DNA, 20 bp, Homo sapiens
gatcctacaggtcttctggg

SEQ ID NO: 64716 - DNA, 20 bp, Homo sapiens
gatctgtccaagcctaaaaa

SEQ ID NO: 64717 - DNA, 20 bp, Homo sapiens
gatctctgttccttttcaca

SEQ ID NO: 64718 - DNA, 20 bp, Homo sapiens
gatcagaactgactaaagat

SEQ ID NO: 64719 - DNA, 20 bp, Homo sapiens
gatcagacacaaggaagtga

SEQ ID NO: 64720 - DNA, 20 bp, Homo sapiens
gatcaaaaaaatgaaactta

SEQ ID NO: 64721 - DNA, 20 bp, Homo sapiens
gatccgactggttcaaattc

SEQ ID NO: 64722 - DNA, 20 bp, Homo sapiens
gatcctatccaaccttccct

SEQ ID NO: 64723 - DNA, 20 bp, Homo sapiens
gatcaacagcaatctgaaga

SEQ ID NO: 64724 - DNA, 20 bp, Homo sapiens
gatcacatgaagtagaagtt

SEQ ID NO: 64725 - DNA, 20 bp, Homo sapiens
gatcactgagccattttctg

SEQ ID NO: 64726 - DNA, 20 bp, Homo sapiens
gatcaccctgccctccctcc

SEQ ID NO: 64727 - DNA, 20 bp, Homo sapiens
gatcggaacgacagaggtgc

SEQ ID NO: 64728 - DNA, 20 bp, Homo sapiens
gatcgggtagaggtagttac

SEQ ID NO: 64729 - DNA, 20 bp, Homo sapiens
gatcggtgcatccagaagaa

SEQ ID NO: 64730 - DNA, 20 bp, Homo sapiens
gatccaaggcagtcgtacct

SEQ ID NO: 64731 - DNA, 20 bp, Homo sapiens
gatcctaaaatgttactgct

SEQ ID NO: 64732 - DNA, 20 bp, Homo sapiens
gatccttgcaacccgtgtta

SEQ ID NO: 64733 - DNA, 20 bp, Homo sapiens
gatcgagtctccttgctacc

SEQ ID NO: 64734 - DNA, 20 bp, Homo sapiens
gatcgcttggaatagcacaa

SEQ ID NO: 64735 - DNA, 20 bp, Homo sapiens
gatcacgccaccatcttcag

SEQ ID NO: 64736 - DNA, 20 bp, Homo sapiens
gatccttaaagatgagatga

SEQ ID NO: 64737 - DNA, 20 bp, Homo sapiens
gatccttgtcagcgagttgc

SEQ ID NO: 64738 - DNA, 20 bp, Homo sapiens
gatcttcaggatgtcaggga

SEQ ID NO: 64739 - DNA, 20 bp, Homo sapiens
gatcttgttctctttgtcac

SEQ ID NO: 64740 - DNA, 20 bp, Homo sapiens
gatcacggaggcgaagctgg

SEQ ID NO: 64741 - DNA, 20 bp, Homo sapiens
gatcctgagcagaaggatac

SEQ ID NO: 64742 - DNA, 20 bp, Homo sapiens
gatcaggctgtgtctctgac

SEQ ID NO: 64743 - DNA, 20 bp, Homo sapiens
gatcctcctggaatatgaga

SEQ ID NO: 64744 - DNA, 20 bp, Homo sapiens
gatctttccattgatgaatc

SEQ ID NO: 64745 - DNA, 20 bp, Homo sapiens
gatccgctgaccggggagat

SEQ ID NO: 64746 - DNA, 20 bp, Homo sapiens
gatcagacctcttgagaagc

SEQ ID NO: 64747 - DNA, 20 bp, Homo sapiens
gatcacggcgttgtcgcagg

SEQ ID NO: 64748 - DNA, 20 bp, Homo sapiens
gatcagggatgggagatggc

SEQ ID NO: 64749 - DNA, 20 bp, Homo sapiens
gatctccgaggaaaatagag

SEQ ID NO: 64750 - DNA, 20 bp, Homo sapiens
gatcccactgcccccgcctc

SEQ ID NO: 64751 - DNA, 20 bp, Homo sapiens
gatcagagaccacgaaaaga

SEQ ID NO: 64752 - DNA, 20 bp, Homo sapiens
gatctcactaaagtgctgga

SEQ ID NO: 64753 - DNA, 20 bp, Homo sapiens
gatcaagactctaatcatcc

SEQ ID NO: 64754 - DNA, 20 bp, Homo sapiens
gatcccactaaagtgctgga

SEQ ID NO: 64755 - DNA, 20 bp, Homo sapiens
gatcagcaaggctctttcgt

SEQ ID NO: 64756 - DNA, 20 bp, Homo sapiens
gatcagaagtccacattagt

SEQ ID NO: 64757 - DNA, 20 bp, Homo sapiens
gatcagcaatactttaagtt

SEQ ID NO: 64758 - DNA, 20 bp, Homo sapiens
gatcaagccaccaaatatgg

SEQ ID NO: 64759 - DNA, 20 bp, Homo sapiens
gatcagaagaccaagtgaag

SEQ ID NO: 64760 - DNA, 20 bp, Homo sapiens
gatcgagctgaggtgccgcc

SEQ ID NO: 64761 - DNA, 20 bp, Homo sapiens
gatccccgagcgcatccagc

SEQ ID NO: 64762 - DNA, 20 bp, Homo sapiens
gatcaacctgcctcccctcc

SEQ ID NO: 64763 - DNA, 20 bp, Homo sapiens
gatctgatgtcttgtctgcc

SEQ ID NO: 64764 - DNA, 20 bp, Homo sapiens
gatcagtaatttcaagacac

SEQ ID NO: 64765 - DNA, 20 bp, Homo sapiens
gatcatctcagctgaagtgt

SEQ ID NO: 64766 - DNA, 20 bp, Homo sapiens
gatcattaataaaagtaatg

SEQ ID NO: 64767 - DNA, 20 bp, Homo sapiens
gatcatttacgtccctaatc

SEQ ID NO: 64768 - DNA, 20 bp, Homo sapiens
gatcagtcaccagagagatg

SEQ ID NO: 64769 - DNA, 20 bp, Homo sapiens
gatcaggaggagaagacgga

SEQ ID NO: 64770 - DNA, 20 bp, Homo sapiens
gatctcgctcaccagcccca

SEQ ID NO: 64771 - DNA, 20 bp, Homo sapiens
gatcaagcatcccaatgtgt

SEQ ID NO: 64772 - DNA, 20 bp, Homo sapiens
gatcaccaacaatcgcaagg

SEQ ID NO: 64773 - DNA, 20 bp, Homo sapiens
gatcctgaggggcttcaaac

SEQ ID NO: 64774 - DNA, 20 bp, Homo sapiens
gatcaagtttaagtccgtca

SEQ ID NO: 64775 - DNA, 20 bp, Homo sapiens
gatccgaatgcttactctgg

SEQ ID NO: 64776 - DNA, 20 bp, Homo sapiens
gatctactgaaaagcttggg

SEQ ID NO: 64777 - DNA, 20 bp, Homo sapiens
gatcaactgttttttaataa

SEQ ID NO: 64778 - DNA, 20 bp, Homo sapiens
gatcgagaattactatattt

SEQ ID NO: 64779 - DNA, 20 bp, Homo sapiens
gatcaagacctatgtaatgg

SEQ ID NO: 64780 - DNA, 20 bp, Homo sapiens
gatcgttaaagatatcatgg

SEQ ID NO: 64781 - DNA, 20 bp, Homo sapiens
gatctaggagtagattttaa

SEQ ID NO: 64782 - DNA, 20 bp, Homo sapiens
gatccttctgctccgctcag

SEQ ID NO: 64783 - DNA, 20 bp, Homo sapiens
gatcgccctctgctgctcaa

SEQ ID NO: 64784 - DNA, 20 bp, Homo sapiens
gatcagtgcctcagaaactt

SEQ ID NO: 64785 - DNA, 20 bp, Homo sapiens
gatcccacggaacccacagg

SEQ ID NO: 64786 - DNA, 20 bp, Homo sapiens
gatccccaggttctcgaagg

SEQ ID NO: 64787 - DNA, 20 bp, Homo sapiens
gatcccgaaaaattagggga

SEQ ID NO: 64788 - DNA, 20 bp, Homo sapiens
gatccgcatgtagcacacag

SEQ ID NO: 64789 - DNA, 20 bp, Homo sapiens
gatcgtgacgtcttgtaact

SEQ ID NO: 64790 - DNA, 20 bp, Homo sapiens
gatctaacagtaagaaatgg

SEQ ID NO: 64791 - DNA, 20 bp, Homo sapiens
gatctgctttgtgtgcaaga

SEQ ID NO: 64792 - DNA, 20 bp, Homo sapiens
gatcttcaaaacatctgagg

SEQ ID NO: 64793 - DNA, 20 bp, Homo sapiens
gatcttcctagaagcccggg

SEQ ID NO: 64794 - DNA, 20 bp, Homo sapiens
gatcgtgcgcgccgcgccgg

SEQ ID NO: 64795 - DNA, 20 bp, Homo sapiens
gatcttgcttcacccaccgc

SEQ ID NO: 64796 - DNA, 20 bp, Homo sapiens
gatcaaccgaagtcacactg

SEQ ID NO: 64797 - DNA, 20 bp, Homo sapiens
gatcaataacatctactttc

SEQ ID NO: 64798 - DNA, 20 bp, Homo sapiens
gatcctgctgctattccgcc

SEQ ID NO: 64799 - DNA, 20 bp, Homo sapiens
gatctgaagtaataacaggc

SEQ ID NO: 64800 - DNA, 20 bp, Homo sapiens
gatcatcgtgtaccgcgatg

SEQ ID NO: 64801 - DNA, 20 bp, Homo sapiens
gatctagcattttatttcta

SEQ ID NO: 64802 - DNA, 20 bp, Homo sapiens
gatcacaagagggactagag

SEQ ID NO: 64803 - DNA, 20 bp, Homo sapiens
gatcacagtgtgggattcct

SEQ ID NO: 64804 - DNA, 20 bp, Homo sapiens
gatcccactctctgtttcaa

SEQ ID NO: 64805 - DNA, 20 bp, Homo sapiens
gatcaaatgaagcagcagac

SEQ ID NO: 64806 - DNA, 20 bp, Homo sapiens
gatcatggctgcaggcacaa

SEQ ID NO: 64807 - DNA, 20 bp, Homo sapiens
gatctaaacggttccttcct

SEQ ID NO: 64808 - DNA, 20 bp, Homo sapiens
gatcagctcttacaggagta

SEQ ID NO: 64809 - DNA, 20 bp, Homo sapiens
gatctggaagatggtttttt

SEQ ID NO: 64810 - DNA, 20 bp, Homo sapiens
gatcaatccgtgagacattt

SEQ ID NO: 64811 - DNA, 20 bp, Homo sapiens
gatcccaattcatcccacaa

SEQ ID NO: 64812 - DNA, 20 bp, Homo sapiens
gatctaaaacggcctattta

SEQ ID NO: 64813 - DNA, 20 bp, Homo sapiens
gatcagatacaaagtaataa

SEQ ID NO: 64814 - DNA, 20 bp, Homo sapiens
gatcagctgtttgtggattt

SEQ ID NO: 64815 - DNA, 20 bp, Homo sapiens
gatccttatgcttgattttc

SEQ ID NO: 64816 - DNA, 20 bp, Homo sapiens
gatctctaggaaactcaaag

SEQ ID NO: 64817 - DNA, 20 bp, Homo sapiens
gatcttaaatttttttctaa

SEQ ID NO: 64818 - DNA, 20 bp, Homo sapiens
gatcttgcttttctttggga

SEQ ID NO: 64819 - DNA, 20 bp, Homo sapiens
gatccacaagaagctggtcc

SEQ ID NO: 64820 - DNA, 20 bp, Homo sapiens
gatctaactggatatttggg

SEQ ID NO: 64821 - DNA, 20 bp, Homo sapiens
gatcacattaactcctcaag

SEQ ID NO: 64822 - DNA, 20 bp, Homo sapiens
gatctttggggagatacatc

SEQ ID NO: 64823 - DNA, 20 bp, Homo sapiens
gatctccatcaatgagaagt

SEQ ID NO: 64824 - DNA, 20 bp, Homo sapiens
gatctgggcaacctcgggca

SEQ ID NO: 64825 - DNA, 20 bp, Homo sapiens
gatcctcttgccacatcttg

SEQ ID NO: 64826 - DNA, 20 bp, Homo sapiens
gatcttgaagtctggtaaca

SEQ ID NO: 64827 - DNA, 20 bp, Homo sapiens
gatccacaggcggcagcatc

SEQ ID NO: 64828 - DNA, 20 bp, Homo sapiens
gatccggtgcagcctccttc

SEQ ID NO: 64829 - DNA, 20 bp, Homo sapiens
gatctcccaacaccatggtc

SEQ ID NO: 64830 - DNA, 20 bp, Homo sapiens
gatctggtggctcctgggct

SEQ ID NO: 64831 - DNA, 20 bp, Homo sapiens
gatcttgtgggcttctcggc

SEQ ID NO: 64832 - DNA, 20 bp, Homo sapiens
gatcactttatgtctcacag

SEQ ID NO: 64833 - DNA, 20 bp, Homo sapiens
gatcagagagcaagaaaaaa

SEQ ID NO: 64834 - DNA, 20 bp, Homo sapiens
gatcttaaacattactcata

SEQ ID NO: 64835 - DNA, 20 bp, Homo sapiens
gatcttgctcctttcattct

SEQ ID NO: 64836 - DNA, 20 bp, Homo sapiens
gatcctcaacatatactata

SEQ ID NO: 64837 - DNA, 20 bp, Homo sapiens
gatcaaaccccaacctcagt

SEQ ID NO: 64838 - DNA, 20 bp, Homo sapiens
gatcaagaaggtaaagaaga

SEQ ID NO: 64839 - DNA, 20 bp, Homo sapiens
gatcattggcttcttatcgg

SEQ ID NO: 64840 - DNA, 20 bp, Homo sapiens
gatcccccctcaggacaaat

SEQ ID NO: 64841 - DNA, 20 bp, Homo sapiens
gatccttgcagaagccataa

SEQ ID NO: 64842 - DNA, 20 bp, Homo sapiens
gatccagaagctgatggccc

SEQ ID NO: 64843 - DNA, 20 bp, Homo sapiens
gatctttctggtaatccgtg

SEQ ID NO: 64844 - DNA, 20 bp, Homo sapiens
gatcactttttatatttttc

SEQ ID NO: 64845 - DNA, 20 bp, Homo sapiens
gatctctgcccacggaaagg

SEQ ID NO: 64846 - DNA, 20 bp, Homo sapiens
gatcaaggcggtagtcactt

SEQ ID NO: 64847 - DNA, 20 bp, Homo sapiens
gatctaagcctcccagagag

SEQ ID NO: 64848 - DNA, 20 bp, Homo sapiens
gatctgcactgtcaagtaaa

SEQ ID NO: 64849 - DNA, 20 bp, Homo sapiens
gatcaaacactaaggcacgg

SEQ ID NO: 64850 - DNA, 20 bp, Homo sapiens
gatcaccgtgtacgcgtcgc

SEQ ID NO: 64851 - DNA, 20 bp, Homo sapiens
gatcagagggaagtcaatga

SEQ ID NO: 64852 - DNA, 20 bp, Homo sapiens
gatcagatgttttgggaggt

SEQ ID NO: 64853 - DNA, 20 bp, Homo sapiens
gatcgccgtcaggattgctg

SEQ ID NO: 64854 - DNA, 20 bp, Homo sapiens
gatctaggatacagggcagg

SEQ ID NO: 64855 - DNA, 20 bp, Homo sapiens
gatctgattgaaaaaaaggc

SEQ ID NO: 64856 - DNA, 20 bp, Homo sapiens
gatcatcctagaatacctgt

SEQ ID NO: 64857 - DNA, 20 bp, Homo sapiens
gatctgaaaaaggagactcg

SEQ ID NO: 64858 - DNA, 20 bp, Homo sapiens
gatcaggagttactcccagt

SEQ ID NO: 64859 - DNA, 20 bp, Homo sapiens
gatcccagggttaaaagttg

SEQ ID NO: 64860 - DNA, 20 bp, Homo sapiens
gatcatccttgaagtacttc

SEQ ID NO: 64861 - DNA, 20 bp, Homo sapiens
gatctcgaacggaacttaat

SEQ ID NO: 64862 - DNA, 20 bp, Homo sapiens
gatctcattcagagtatttg

SEQ ID NO: 64863 - DNA, 20 bp, Homo sapiens
gatcaaagattttatttaca

SEQ ID NO: 64864 - DNA, 20 bp, Homo sapiens
gatcaatgtgggatgaataa

SEQ ID NO: 64865 - DNA, 20 bp, Homo sapiens
gatcacaccactcagtgtga

SEQ ID NO: 64866 - DNA, 20 bp, Homo sapiens
gatctgttgtttatggcctt

SEQ ID NO: 64867 - DNA, 20 bp, Homo sapiens
gatccaagaagaactagaaa

SEQ ID NO: 64868 - DNA, 20 bp, Homo sapiens
gatcgaaatcaaaggaaggc

SEQ ID NO: 64869 - DNA, 20 bp, Homo sapiens
gatcttaagaagaattctct

SEQ ID NO: 64870 - DNA, 20 bp, Homo sapiens
gatccaagtgtcatccggag

SEQ ID NO: 64871 - DNA, 20 bp, Homo sapiens
gatccgcctagtccagaagc

SEQ ID NO: 64872 - DNA, 20 bp, Homo sapiens
gatcgaggcgcacatcacgc

SEQ ID NO: 64873 - DNA, 20 bp, Homo sapiens
gatctgtgaaaagagaacgc

SEQ ID NO: 64874 - DNA, 20 bp, Homo sapiens
gatccgagaggagcttggaa

SEQ ID NO: 64875 - DNA, 20 bp, Homo sapiens
gatcctttttgaatgttcgt

SEQ ID NO: 64876 - DNA, 20 bp, Homo sapiens
gatcgtgcaagtggagcaat

SEQ ID NO: 64877 - DNA, 20 bp, Homo sapiens
gatcaggaggtcaggaagcc

SEQ ID NO: 64878 - DNA, 20 bp, Homo sapiens
gatcgagccaaaagctgcaa

SEQ ID NO: 64879 - DNA, 20 bp, Homo sapiens
gatcacatgctacaactaga

SEQ ID NO: 64880 - DNA, 20 bp, Homo sapiens
gatcatctataacgttccag

SEQ ID NO: 64881 - DNA, 20 bp, Homo sapiens
gatcttcagaacacatttgg

SEQ ID NO: 64882 - DNA, 20 bp, Homo sapiens
gatctcttggttcctgtaat

SEQ ID NO: 64883 - DNA, 20 bp, Homo sapiens
gatctttccaaatacaaaga

SEQ ID NO: 64884 - DNA, 20 bp, Homo sapiens
gatctcaacctcttcgccag

SEQ ID NO: 64885 - DNA, 20 bp, Homo sapiens
gatctagtaaagctggaatg

SEQ ID NO: 64886 - DNA, 20 bp, Homo sapiens
gatcccggttttctagcagg

SEQ ID NO: 64887 - DNA, 20 bp, Homo sapiens
gatcttggtgccgtgaagac

SEQ ID NO: 64888 - DNA, 20 bp, Homo sapiens
gatcacagaagaggaatggg

SEQ ID NO: 64889 - DNA, 20 bp, Homo sapiens
gatcccaaaccgccgccgtt

SEQ ID NO: 64890 - DNA, 20 bp, Homo sapiens
gatctaaaggctctggattt

SEQ ID NO: 64891 - DNA, 20 bp, Homo sapiens
gatcccagcagccaatacca

SEQ ID NO: 64892 - DNA, 20 bp, Homo sapiens
gatccgctgcaccaggagct

SEQ ID NO: 64893 - DNA, 20 bp, Homo sapiens
gatcgagtggctgaagtttt

SEQ ID NO: 64894 - DNA, 20 bp, Homo sapiens
gatctctgcatcacatgtca

SEQ ID NO: 64895 - DNA, 20 bp, Homo sapiens
gatctcacatgtttgtttat

SEQ ID NO: 64896 - DNA, 20 bp, Homo sapiens
gatccggagggcgggcccgc

SEQ ID NO: 64897 - DNA, 20 bp, Homo sapiens
gatccttgtgaaaacaaaat

SEQ ID NO: 64898 - DNA, 20 bp, Homo sapiens
gatctgctgagcgcagaaca

SEQ ID NO: 64899 - DNA, 20 bp, Homo sapiens
gatctcagtgaaagcctatc

SEQ ID NO: 64900 - DNA, 20 bp, Homo sapiens
gatcaagtcacaagtcaagg

SEQ ID NO: 64901 - DNA, 20 bp, Homo sapiens
gatcttcctgtgtccgtatt

SEQ ID NO: 64902 - DNA, 20 bp, Homo sapiens
gatccagctttggaaaaacc

SEQ ID NO: 64903 - DNA, 20 bp, Homo sapiens
gatctcagattactgcagcc

SEQ ID NO: 64904 - DNA, 20 bp, Homo sapiens
gatccgcctgaccgtgcaca

SEQ ID NO: 64905 - DNA, 20 bp, Homo sapiens
gatcacccatatctgtcttg

SEQ ID NO: 64906 - DNA, 20 bp, Homo sapiens
gatcttcaagctgacccgaa

SEQ ID NO: 64907 - DNA, 20 bp, Homo sapiens
gatcgcacagaaatcactgc

SEQ ID NO: 64908 - DNA, 20 bp, Homo sapiens
gatcagacaaggagtcctgg

SEQ ID NO: 64909 - DNA, 20 bp, Homo sapiens
gatcagttccatggcttttt

SEQ ID NO: 64910 - DNA, 20 bp, Homo sapiens
gatctatgccttttgggctt

SEQ ID NO: 64911 - DNA, 20 bp, Homo sapiens
gatccataccatgtcacaat

SEQ ID NO: 64912 - DNA, 20 bp, Homo sapiens
gatctggctaccccaatagg

SEQ ID NO: 64913 - DNA, 20 bp, Homo sapiens
gatccgcatctttgacctgg

SEQ ID NO: 64914 - DNA, 20 bp, Homo sapiens
gatcgtgaacttgatacagc

SEQ ID NO: 64915 - DNA, 20 bp, Homo sapiens
gatcatggagatgagtgacc

SEQ ID NO: 64916 - DNA, 20 bp, Homo sapiens
gatcgccatcagtgtcatcg

SEQ ID NO: 64917 - DNA, 20 bp, Homo sapiens
gatcttcaaaaaaacaaatt

SEQ ID NO: 64918 - DNA, 20 bp, Homo sapiens
gatcaaggcctacagctccc

SEQ ID NO: 64919 - DNA, 20 bp, Homo sapiens
gatcccctctcggaacgtcc

SEQ ID NO: 64920 - DNA, 20 bp, Homo sapiens
gatctggtactggcgcgggt

SEQ ID NO: 64921 - DNA, 20 bp, Homo sapiens
gatcaggaccagcaaccttt

SEQ ID NO: 64922 - DNA, 20 bp, Homo sapiens
gatcatcaagtggtttaatt

SEQ ID NO: 64923 - DNA, 20 bp, Homo sapiens
gatcactcccaagtgtatcc

SEQ ID NO: 64924 - DNA, 20 bp, Homo sapiens
gatcgaagccaacgtcacca

SEQ ID NO: 64925 - DNA, 20 bp, Homo sapiens
gatcagtccaaactccaccc

SEQ ID NO: 64926 - DNA, 20 bp, Homo sapiens
gatctaattcctgtggatgt

SEQ ID NO: 64927 - DNA, 20 bp, Homo sapiens
gatctcagtgctaatcttca

SEQ ID NO: 64928 - DNA, 20 bp, Homo sapiens
gatcttgctaatgacaacaa

SEQ ID NO: 64929 - DNA, 20 bp, Homo sapiens
gatcgggtgactgaattctg

SEQ ID NO: 64930 - DNA, 20 bp, Homo sapiens
gatcgtgcctttacctcagt

SEQ ID NO: 64931 - DNA, 20 bp, Homo sapiens
gatcaccttctgaaatgctg

SEQ ID NO: 64932 - DNA, 20 bp, Homo sapiens
gatccacggcaaagccgtcc

SEQ ID NO: 64933 - DNA, 20 bp, Homo sapiens
gatcgtacaataaatctgtc

SEQ ID NO: 64934 - DNA, 20 bp, Homo sapiens
gatcttggaagagtttgctg

SEQ ID NO: 64935 - DNA, 20 bp, Homo sapiens
gatcagaaatatgtttccac

SEQ ID NO: 64936 - DNA, 20 bp, Homo sapiens
gatcctgagattggacccat

SEQ ID NO: 64937 - DNA, 20 bp, Homo sapiens
gatccgagtccatgagtttg

SEQ ID NO: 64938 - DNA, 20 bp, Homo sapiens
gatcacatctataatcaaag

SEQ ID NO: 64939 - DNA, 20 bp, Homo sapiens
gatcatttaaaatttgataa

SEQ ID NO: 64940 - DNA, 20 bp, Homo sapiens
gatcatactcccaaatcaca

SEQ ID NO: 64941 - DNA, 20 bp, Homo sapiens
gatcgtcatcttttactctg

SEQ ID NO: 64942 - DNA, 20 bp, Homo sapiens
gatctttaattattgcatta

SEQ ID NO: 64943 - DNA, 20 bp, Homo sapiens
gatcctcggacaccgtcagc

SEQ ID NO: 64944 - DNA, 20 bp, Homo sapiens
gatccagaaccacttttatt

SEQ ID NO: 64945 - DNA, 20 bp, Homo sapiens
gatctttttttcctatagat

SEQ ID NO: 64946 - DNA, 20 bp, Homo sapiens
gatcttggtgctaagcagaa

SEQ ID NO: 64947 - DNA, 20 bp, Homo sapiens
gatctgcattttcataataa

SEQ ID NO: 64948 - DNA, 20 bp, Homo sapiens
gatcatctggctacgcttct

SEQ ID NO: 64949 - DNA, 20 bp, Homo sapiens
gatcttgccttgcacccaag

SEQ ID NO: 64950 - DNA, 20 bp, Homo sapiens
gatcaataatacctactgga

SEQ ID NO: 64951 - DNA, 20 bp, Homo sapiens
gatcactaggaaagatgatt

SEQ ID NO: 64952 - DNA, 20 bp, Homo sapiens
gatcctgacatttagacagc

SEQ ID NO: 64953 - DNA, 20 bp, Homo sapiens
gatcttcctcagcagcctag

SEQ ID NO: 64954 - DNA, 20 bp, Homo sapiens
gatcctggaacctttaatta

SEQ ID NO: 64955 - DNA, 20 bp, Homo sapiens
gatcctcaggaagaggtata

SEQ ID NO: 64956 - DNA, 20 bp, Homo sapiens
gatcaataaattttataacc

SEQ ID NO: 64957 - DNA, 20 bp, Homo sapiens
gatccaccgaccagcactag

SEQ ID NO: 64958 - DNA, 20 bp, Homo sapiens
gatccaagtctacctgtcta

SEQ ID NO: 64959 - DNA, 20 bp, Homo sapiens
gatccagatgtagattatgg

SEQ ID NO: 64960 - DNA, 20 bp, Homo sapiens
gatcaatggagaggatgaaa

SEQ ID NO: 64961 - DNA, 20 bp, Homo sapiens
gatcaaagttggttttctct

SEQ ID NO: 64962 - DNA, 20 bp, Homo sapiens
gatcacttttctcaggtggt

SEQ ID NO: 64963 - DNA, 20 bp, Homo sapiens
gatcctaaacaagaagagtc

SEQ ID NO: 64964 - DNA, 20 bp, Homo sapiens
gatctcagaggttatgtgtt

SEQ ID NO: 64965 - DNA, 20 bp, Homo sapiens
gatcttcataatcataaatt

SEQ ID NO: 64966 - DNA, 20 bp, Homo sapiens
gatcaacagccggaggtggt

SEQ ID NO: 64967 - DNA, 20 bp, Homo sapiens
gatccgccactccccatgtc

SEQ ID NO: 64968 - DNA, 20 bp, Homo sapiens
gatcttaaatctggggagat

SEQ ID NO: 64969 - DNA, 20 bp, Homo sapiens
gatctcaagcaactggggga

SEQ ID NO: 64970 - DNA, 20 bp, Homo sapiens
gatcatctgggctaaatgag

SEQ ID NO: 64971 - DNA, 20 bp, Homo sapiens
gatcctcagaactttctgtt

SEQ ID NO: 64972 - DNA, 20 bp, Homo sapiens
gatctccaagtaaaaagtaa

SEQ ID NO: 64973 - DNA, 20 bp, Homo sapiens
gatctgagcaatggaaattt

SEQ ID NO: 64974 - DNA, 20 bp, Homo sapiens
gatcaagttttgaaattcct

SEQ ID NO: 64975 - DNA, 20 bp, Homo sapiens
gatcttcacaggacagtggg

SEQ ID NO: 64976 - DNA, 20 bp, Homo sapiens
gatctccacaggatggtggg

SEQ ID NO: 64977 - DNA, 20 bp, Homo sapiens
gatcgtcagaggagggtgag

SEQ ID NO: 64978 - DNA, 20 bp, Homo sapiens
gatcccagcctgcagtatca

SEQ ID NO: 64979 - DNA, 20 bp, Homo sapiens
gatcatattccacacacgtt

SEQ ID NO: 64980 - DNA, 20 bp, Homo sapiens
gatccaaaaggttggacaaa

SEQ ID NO: 64981 - DNA, 20 bp, Homo sapiens
gatctgtaagtcgttgtcga

SEQ ID NO: 64982 - DNA, 20 bp, Homo sapiens
gatcgaatagagcaggtgag

SEQ ID NO: 64983 - DNA, 20 bp, Homo sapiens
gatctcgcatgatgtcctct

SEQ ID NO: 64984 - DNA, 20 bp, Homo sapiens
gatcgatttcataaaagaca

SEQ ID NO: 64985 - DNA, 20 bp, Homo sapiens
gatcgtgaacttccgagact

SEQ ID NO: 64986 - DNA, 20 bp, Homo sapiens
gatcatttcttggtctaggc

SEQ ID NO: 64987 - DNA, 20 bp, Homo sapiens
gatccaggggggacgatgct

SEQ ID NO: 64988 - DNA, 20 bp, Homo sapiens
gatctaccatgaagaaggtc

SEQ ID NO: 64989 - DNA, 20 bp, Homo sapiens
gatctcagcttcttccccag

SEQ ID NO: 64990 - DNA, 20 bp, Homo sapiens
gatcgtgttttggctcagct

SEQ ID NO: 64991 - DNA, 20 bp, Homo sapiens
gatcacatcaaacattttca

SEQ ID NO: 64992 - DNA, 20 bp, Homo sapiens
gatccatgaccgggtaaaaa

SEQ ID NO: 64993 - DNA, 20 bp, Homo sapiens
gatcaacggatagaagctga

SEQ ID NO: 64994 - DNA, 20 bp, Homo sapiens
gatccagaaatatatgagaa

SEQ ID NO: 64995 - DNA, 20 bp, Homo sapiens
gatccttggagcttagctcg

SEQ ID NO: 64996 - DNA, 20 bp, Homo sapiens
gatcctccaaatcagtggcc

SEQ ID NO: 64997 - DNA, 20 bp, Homo sapiens
gatcatccaggcttccctga

SEQ ID NO: 64998 - DNA, 20 bp, Homo sapiens
gatcatggccttggcacccc

SEQ ID NO: 64999 - DNA, 20 bp, Homo sapiens
gatcaatgctcccaccagtg

SEQ ID NO: 65000 - DNA, 20 bp, Homo sapiens
gatccttctcaagcttatac

SEQ ID NO: 65001 - DNA, 20 bp, Homo sapiens
gatccatatggaaaatcaga

SEQ ID NO: 65002 - DNA, 20 bp, Homo sapiens
gatcaaggagagtcacagcc

SEQ ID NO: 65003 - DNA, 20 bp, Homo sapiens
gatcacctaaaacgaagcct

SEQ ID NO: 65004 - DNA, 20 bp, Homo sapiens
gatcagagaggctgcgaagg

SEQ ID NO: 65005 - DNA, 20 bp, Homo sapiens
gatccctcaatttggtctgt

SEQ ID NO: 65006 - DNA, 20 bp, Homo sapiens
gatcactggtgttgagcttt

SEQ ID NO: 65007 - DNA, 20 bp, Homo sapiens
gatctcaaacaagatgtatg

SEQ ID NO: 65008 - DNA, 20 bp, Homo sapiens
gatcttagcccttcccagaa

SEQ ID NO: 65009 - DNA, 20 bp, Homo sapiens
gatcttggaatgctgagagt

SEQ ID NO: 65010 - DNA, 20 bp, Homo sapiens
gatctttcaggaattggcac

SEQ ID NO: 65011 - DNA, 20 bp, Homo sapiens
gatcagatttttgccgcatc

SEQ ID NO: 65012 - DNA, 20 bp, Homo sapiens
gatctgaatttgagatgttg

SEQ ID NO: 65013 - DNA, 20 bp, Homo sapiens
gatctaaataaaaaccagaa

SEQ ID NO: 65014 - DNA, 20 bp, Homo sapiens
gatcccgatgttagaaatgg

SEQ ID NO: 65015 - DNA, 20 bp, Homo sapiens
gatctcgaagttatcgtcat

SEQ ID NO: 65016 - DNA, 20 bp, Homo sapiens
gatcacaggaaggttgctat

SEQ ID NO: 65017 - DNA, 20 bp, Homo sapiens
gatcaggaattgactacttt

SEQ ID NO: 65018 - DNA, 20 bp, Homo sapiens
gatccaggtcttgacgccac

SEQ ID NO: 65019 - DNA, 20 bp, Homo sapiens
gatcctgaggaagatgatga

SEQ ID NO: 65020 - DNA, 20 bp, Homo sapiens
gatcatttacagatagagcg

SEQ ID NO: 65021 - DNA, 20 bp, Homo sapiens
gatccggcagcacagctggt

SEQ ID NO: 65022 - DNA, 20 bp, Homo sapiens
gatcagtttcatctggatga

SEQ ID NO: 65023 - DNA, 20 bp, Homo sapiens
gatccggcaatgtgaagctt

SEQ ID NO: 65024 - DNA, 20 bp, Homo sapiens
gatcagtggatgtagcatcc

SEQ ID NO: 65025 - DNA, 20 bp, Homo sapiens
gatcataccaactgctgtta

SEQ ID NO: 65026 - DNA, 20 bp, Homo sapiens
gatcaaagagatacgtgatt

SEQ ID NO: 65027 - DNA, 20 bp, Homo sapiens
gatctggactatgagtctga

SEQ ID NO: 65028 - DNA, 20 bp, Homo sapiens
gatctgatgggccagcacaa

SEQ ID NO: 65029 - DNA, 20 bp, Homo sapiens
gatctacactgaagtttgga

SEQ ID NO: 65030 - DNA, 20 bp, Homo sapiens
gatcatcatatccacaaaat

SEQ ID NO: 65031 - DNA, 20 bp, Homo sapiens
gatcaaaggcagaagcttaa

SEQ ID NO: 65032 - DNA, 20 bp, Homo sapiens
gatcgtcttctcctccctgc

SEQ ID NO: 65033 - DNA, 20 bp, Homo sapiens
gatccttgtagtagttagga

SEQ ID NO: 65034 - DNA, 20 bp, Homo sapiens
gatctccttctttcttgtct

SEQ ID NO: 65035 - DNA, 20 bp, Homo sapiens
gatctctgccgcctgcgtgg

SEQ ID NO: 65036 - DNA, 20 bp, Homo sapiens
gatcaaatgaaaagtaaaac

SEQ ID NO: 65037 - DNA, 20 bp, Homo sapiens
gatcagtatctacaagcacc

SEQ ID NO: 65038 - DNA, 20 bp, Homo sapiens
gatcgtttccccagtgctgc

SEQ ID NO: 65039 - DNA, 20 bp, Homo sapiens
gatcgtcatctaacaattca

SEQ ID NO: 65040 - DNA, 20 bp, Homo sapiens
gatcaagcatgtaaacacca

SEQ ID NO: 65041 - DNA, 20 bp, Homo sapiens
gatcaataacactgcagaca

SEQ ID NO: 65042 - DNA, 20 bp, Homo sapiens
gatccctacagccttggtgt

SEQ ID NO: 65043 - DNA, 20 bp, Homo sapiens
gatcctaaaaaccctcattt

SEQ ID NO: 65044 - DNA, 20 bp, Homo sapiens
gatctcagtgtagtagggac

SEQ ID NO: 65045 - DNA, 20 bp, Homo sapiens
gatctgggacattgcatggg

SEQ ID NO: 65046 - DNA, 20 bp, Homo sapiens
gatctaggggagacaagaat

SEQ ID NO: 65047 - DNA, 20 bp, Homo sapiens
gatcattgatacttttgtct

SEQ ID NO: 65048 - DNA, 20 bp, Homo sapiens
gatcacatcgggatgcacgt

SEQ ID NO: 65049 - DNA, 20 bp, Homo sapiens
gatccatgtagacacgataa

SEQ ID NO: 65050 - DNA, 20 bp, Homo sapiens
gatcctctgcatttattcca

SEQ ID NO: 65051 - DNA, 20 bp, Homo sapiens
gatcgacgacaaatgccacc

SEQ ID NO: 65052 - DNA, 20 bp, Homo sapiens
gatcactggaggtggcattg

SEQ ID NO: 65053 - DNA, 20 bp, Homo sapiens
gatcatagacggactcctgg

SEQ ID NO: 65054 - DNA, 20 bp, Homo sapiens
gatcctagtcagacagagcc

SEQ ID NO: 65055 - DNA, 20 bp, Homo sapiens
gatcttctacgtcgcacaat

SEQ ID NO: 65056 - DNA, 20 bp, Homo sapiens
gatcacccgttgtattcacc

SEQ ID NO: 65057 - DNA, 20 bp, Homo sapiens
gatcagctctatcaatactg

SEQ ID NO: 65058 - DNA, 20 bp, Homo sapiens
gatcctgcgaacgagaaatt

SEQ ID NO: 65059 - DNA, 20 bp, Homo sapiens
gatcaacccaggcctggcct

SEQ ID NO: 65060 - DNA, 20 bp, Homo sapiens
gatcatcgccccctccttgg

SEQ ID NO: 65061 - DNA, 20 bp, Homo sapiens
gatcctgacattcaggttca

SEQ ID NO: 65062 - DNA, 20 bp, Homo sapiens
gatcactacagggaaggtgg

SEQ ID NO: 65063 - DNA, 20 bp, Homo sapiens
gatcaccaaagagacagaga

SEQ ID NO: 65064 - DNA, 20 bp, Homo sapiens
gatcggattaaggaagagtt

SEQ ID NO: 65065 - DNA, 20 bp, Homo sapiens
gatcttttaaaaggcacctt

SEQ ID NO: 65066 - DNA, 20 bp, Homo sapiens
gatcagctggattaagtagt

SEQ ID NO: 65067 - DNA, 20 bp, Homo sapiens
gatccgagcctgtagaaggg

SEQ ID NO: 65068 - DNA, 20 bp, Homo sapiens
gatctaattgataagaacct

SEQ ID NO: 65069 - DNA, 20 bp, Homo sapiens
gatcagaatgaagacaataa

SEQ ID NO: 65070 - DNA, 20 bp, Homo sapiens
gatcttcttctgattctttt

SEQ ID NO: 65071 - DNA, 20 bp, Homo sapiens
gatctgccgcaagatactgc

SEQ ID NO: 65072 - DNA, 20 bp, Homo sapiens
gatcacatcagtgggttcgc

SEQ ID NO: 65073 - DNA, 20 bp, Homo sapiens
gatcctcatagctttatgtt

SEQ ID NO: 65074 - DNA, 20 bp, Homo sapiens
gatcctttaatgtggacagc

SEQ ID NO: 65075 - DNA, 20 bp, Homo sapiens
gatcatgtcgcctgggattt

SEQ ID NO: 65076 - DNA, 20 bp, Homo sapiens
gatcattacagatggaatta

SEQ ID NO: 65077 - DNA, 20 bp, Homo sapiens
gatcagatttcaacctggga

SEQ ID NO: 65078 - DNA, 20 bp, Homo sapiens
gatcaaagccagagaggagc

SEQ ID NO: 65079 - DNA, 20 bp, Homo sapiens
gatcaaatgccagttgtgac

SEQ ID NO: 65080 - DNA, 20 bp, Homo sapiens
gatccacattccataggctc

SEQ ID NO: 65081 - DNA, 20 bp, Homo sapiens
gatcggctcttgctcctcct

SEQ ID NO: 65082 - DNA, 20 bp, Homo sapiens
gatctaacatcaggtctcct

SEQ ID NO: 65083 - DNA, 20 bp, Homo sapiens
gatctcctcacaagggagtc

SEQ ID NO: 65084 - DNA, 20 bp, Homo sapiens
gatccagcaggtgtacaaaa

SEQ ID NO: 65085 - DNA, 20 bp, Homo sapiens
gatcatctcaggctttttct

SEQ ID NO: 65086 - DNA, 20 bp, Homo sapiens
gatccatcaatggcaaaacc

SEQ ID NO: 65087 - DNA, 20 bp, Homo sapiens
gatccccatgcctgggcacc

SEQ ID NO: 65088 - DNA, 20 bp, Homo sapiens
gatcttcaataaatacacgt

SEQ ID NO: 65089 - DNA, 20 bp, Homo sapiens
gatctgggagcctctttcac

SEQ ID NO: 65090 - DNA, 20 bp, Homo sapiens
gatcacgtacataacgagga

SEQ ID NO: 65091 - DNA, 20 bp, Homo sapiens
gatcgtaagctctttcactg

SEQ ID NO: 65092 - DNA, 20 bp, Homo sapiens
gatctaaaaatccaaataga

SEQ ID NO: 65093 - DNA, 20 bp, Homo sapiens
gatccgactaagtatagctc

SEQ ID NO: 65094 - DNA, 20 bp, Homo sapiens
gatcccgagaaagggaactt

SEQ ID NO: 65095 - DNA, 20 bp, Homo sapiens
gatcaccaggacagggaatc

SEQ ID NO: 65096 - DNA, 20 bp, Homo sapiens
gatcctagcaagccgggcga

SEQ ID NO: 65097 - DNA, 20 bp, Homo sapiens
gatcagatgaaatgccttta

SEQ ID NO: 65098 - DNA, 20 bp, Homo sapiens
gatcgaggacggcatccaga

SEQ ID NO: 65099 - DNA, 20 bp, Homo sapiens
gatctgggctcagaagacaa

SEQ ID NO: 65100 - DNA, 20 bp, Homo sapiens
gatcatgacatcatgctaat

SEQ ID NO: 65101 - DNA, 20 bp, Homo sapiens
gatcactgcaacatggcaca

SEQ ID NO: 65102 - DNA, 20 bp, Homo sapiens
gatctgagatgacttataaa

SEQ ID NO: 65103 - DNA, 20 bp, Homo sapiens
gatctcagaggaggagcaat

SEQ ID NO: 65104 - DNA, 20 bp, Homo sapiens
gatcccacatccaagcgaga

SEQ ID NO: 65105 - DNA, 20 bp, Homo sapiens
gatcatcctagccgactgaa

SEQ ID NO: 65106 - DNA, 20 bp, Homo sapiens
gatcatctcagcaacctgcc

SEQ ID NO: 65107 - DNA, 20 bp, Homo sapiens
gatcgtggagggagcacatc

SEQ ID NO: 65108 - DNA, 20 bp, Homo sapiens
gatccctatcatcttgggaa

SEQ ID NO: 65109 - DNA, 20 bp, Homo sapiens
gatctgctggcaaaccctga

SEQ ID NO: 65110 - DNA, 20 bp, Homo sapiens
gatctccagaacactggtgg

SEQ ID NO: 65111 - DNA, 20 bp, Homo sapiens
gatccataaacttttaaaga

SEQ ID NO: 65112 - DNA, 20 bp, Homo sapiens
gatcctcaggagtagcatgg

SEQ ID NO: 65113 - DNA, 20 bp, Homo sapiens
gatctgaagaaggcacaggt

SEQ ID NO: 65114 - DNA, 20 bp, Homo sapiens
gatcctccggccttcaattg

SEQ ID NO: 65115 - DNA, 20 bp, Homo sapiens
gatcaggctgcttgaggcca

SEQ ID NO: 65116 - DNA, 20 bp, Homo sapiens
gatcccgggagctggaggcg

SEQ ID NO: 65117 - DNA, 20 bp, Homo sapiens
gatcgccgagctgctgcagt

SEQ ID NO: 65118 - DNA, 20 bp, Homo sapiens
gatcttctcttgcaaaagaa

SEQ ID NO: 65119 - DNA, 20 bp, Homo sapiens
gatcagggaggaaattttgg

SEQ ID NO: 65120 - DNA, 20 bp, Homo sapiens
gatcatgggattttattaaa

SEQ ID NO: 65121 - DNA, 20 bp, Homo sapiens
gatctgtgggtgacaggctg

SEQ ID NO: 65122 - DNA, 20 bp, Homo sapiens
gatcctgtcctagagaaagc

SEQ ID NO: 65123 - DNA, 20 bp, Homo sapiens
gatctctgccacttttccct

SEQ ID NO: 65124 - DNA, 20 bp, Homo sapiens
gatcactggggtcttctgtg

SEQ ID NO: 65125 - DNA, 20 bp, Homo sapiens
gatcccaaacaccaagaaca

SEQ ID NO: 65126 - DNA, 20 bp, Homo sapiens
gatcctggattgtgaaatct

SEQ ID NO: 65127 - DNA, 20 bp, Homo sapiens
gatcatcaagtgtgcatcac

SEQ ID NO: 65128 - DNA, 20 bp, Homo sapiens
gatctacagcatcagaaaga

SEQ ID NO: 65129 - DNA, 20 bp, Homo sapiens
gatcagctgctgcctcctcc

SEQ ID NO: 65130 - DNA, 20 bp, Homo sapiens
gatcagtaaacgggccatcc

SEQ ID NO: 65131 - DNA, 20 bp, Homo sapiens
gatccttgccctcacagagc

SEQ ID NO: 65132 - DNA, 20 bp, Homo sapiens
gatcaggatgcacctgacat

SEQ ID NO: 65133 - DNA, 20 bp, Homo sapiens
gatcctctcccaaatccacc

SEQ ID NO: 65134 - DNA, 20 bp, Homo sapiens
gatcagtttgctttcttcca

SEQ ID NO: 65135 - DNA, 20 bp, Homo sapiens
gatcgactccactgagaaga

SEQ ID NO: 65136 - DNA, 20 bp, Homo sapiens
gatctactgaagagagtgct

SEQ ID NO: 65137 - DNA, 20 bp, Homo sapiens
gatcctggctcctgctctgt

SEQ ID NO: 65138 - DNA, 20 bp, Homo sapiens
gatcctgattgaaaaacatt

SEQ ID NO: 65139 - DNA, 20 bp, Homo sapiens
gatcgcctggacgtggagcc

SEQ ID NO: 65140 - DNA, 20 bp, Homo sapiens
gatcgagaagtaaacaatgg

SEQ ID NO: 65141 - DNA, 20 bp, Homo sapiens
gatctttgatgagctgctgg

SEQ ID NO: 65142 - DNA, 20 bp, Homo sapiens
gatccaaagacaatggggtt

SEQ ID NO: 65143 - DNA, 20 bp, Homo sapiens
gatccggaagctcatggggc

SEQ ID NO: 65144 - DNA, 20 bp, Homo sapiens
gatctcacggaggtcatgga

SEQ ID NO: 65145 - DNA, 20 bp, Homo sapiens
gatctcaccagcggggtgct

SEQ ID NO: 65146 - DNA, 20 bp, Homo sapiens
gatctctgaggtctggcggc

SEQ ID NO: 65147 - DNA, 20 bp, Homo sapiens
gatcaacctcttcaaccact

SEQ ID NO: 65148 - DNA, 20 bp, Homo sapiens
gatctgtttttgtcatgtct

SEQ ID NO: 65149 - DNA, 20 bp, Homo sapiens
gatcattcgaaggtagtatt

SEQ ID NO: 65150 - DNA, 20 bp, Homo sapiens
gatcaatgtatgtgtcggcc

SEQ ID NO: 65151 - DNA, 20 bp, Homo sapiens
gatcagctactaatatattt

SEQ ID NO: 65152 - DNA, 20 bp, Homo sapiens
gatccacaggaaggtggaga

SEQ ID NO: 65153 - DNA, 20 bp, Homo sapiens
gatcataccgttgtagtgtg

SEQ ID NO: 65154 - DNA, 20 bp, Homo sapiens
gatccaagtcaaaccaatca

SEQ ID NO: 65155 - DNA, 20 bp, Homo sapiens
gatcactgtcaagttgcact

SEQ ID NO: 65156 - DNA, 20 bp, Homo sapiens
gatcacactgctatatgctg

SEQ ID NO: 65157 - DNA, 20 bp, Homo sapiens
gatcataaaatggcttcaga

SEQ ID NO: 65158 - DNA, 20 bp, Homo sapiens
gatcccctcggcggggacag

SEQ ID NO: 65159 - DNA, 20 bp, Homo sapiens
gatctgtcatgtgccacctg

SEQ ID NO: 65160 - DNA, 20 bp, Homo sapiens
gatcaaagacaatggctggg

SEQ ID NO: 65161 - DNA, 20 bp, Homo sapiens
gatcatatgagcaagctcaa

SEQ ID NO: 65162 - DNA, 20 bp, Homo sapiens
gatctgtcctcttcgtgtac

SEQ ID NO: 65163 - DNA, 20 bp, Homo sapiens
gatcctggaacgcaacgaat

SEQ ID NO: 65164 - DNA, 20 bp, Homo sapiens
gatcgtcagaaagagcagaa

SEQ ID NO: 65165 - DNA, 20 bp, Homo sapiens
gatcagttccccagagacag

SEQ ID NO: 65166 - DNA, 20 bp, Homo sapiens
gatcagtggaatgaaataac

SEQ ID NO: 65167 - DNA, 20 bp, Homo sapiens
gatcagtgacaaacatgcct

SEQ ID NO: 65168 - DNA, 20 bp, Homo sapiens
gatcccagaaatctgggagc

SEQ ID NO: 65169 - DNA, 20 bp, Homo sapiens
gatcggtcagcagctttacc

SEQ ID NO: 65170 - DNA, 20 bp, Homo sapiens
gatctccctcctcctcaccc

SEQ ID NO: 65171 - DNA, 20 bp, Homo sapiens
gatcttgaggttcaggggtg

SEQ ID NO: 65172 - DNA, 20 bp, Homo sapiens
gatcactaatatggtatttg

SEQ ID NO: 65173 - DNA, 20 bp, Homo sapiens
gatctaatatattccagcct

SEQ ID NO: 65174 - DNA, 20 bp, Homo sapiens
gatcagcagttgaaactcag

SEQ ID NO: 65175 - DNA, 20 bp, Homo sapiens
gatcgtgaccttgaacaagt

SEQ ID NO: 65176 - DNA, 20 bp, Homo sapiens
gatcaaccataccaaagaga

SEQ ID NO: 65177 - DNA, 20 bp, Homo sapiens
gatcttgccagacgaaagcg

SEQ ID NO: 65178 - DNA, 20 bp, Homo sapiens
gatctggaacaagagcttag

SEQ ID NO: 65179 - DNA, 20 bp, Homo sapiens
gatcaaggttttctggagct

SEQ ID NO: 65180 - DNA, 20 bp, Homo sapiens
gatcagaacccagaacagaa

SEQ ID NO: 65181 - DNA, 20 bp, Homo sapiens
gatcacctgtctggagcaaa

SEQ ID NO: 65182 - DNA, 20 bp, Homo sapiens
gatcctccctaaattttggc

SEQ ID NO: 65183 - DNA, 20 bp, Homo sapiens
gatcaacaacataataaatc

SEQ ID NO: 65184 - DNA, 20 bp, Homo sapiens
gatctagtgccccctggtgc

SEQ ID NO: 65185 - DNA, 20 bp, Homo sapiens
gatcacaaaaatcaggggag

SEQ ID NO: 65186 - DNA, 20 bp, Homo sapiens
gatctagggcagggaggggg

SEQ ID NO: 65187 - DNA, 20 bp, Homo sapiens
gatcaacaagttttccagtg

SEQ ID NO: 65188 - DNA, 20 bp, Homo sapiens
gatcacacagcactcaggac

SEQ ID NO: 65189 - DNA, 20 bp, Homo sapiens
gatcatataacccccgtgat

SEQ ID NO: 65190 - DNA, 20 bp, Homo sapiens
gatcagtggttgccagggca

SEQ ID NO: 65191 - DNA, 20 bp, Homo sapiens
gatcgaatagaagacttttt

SEQ ID NO: 65192 - DNA, 20 bp, Homo sapiens
gatctttttactgtctctac

SEQ ID NO: 65193 - DNA, 20 bp, Homo sapiens
gatcaactttacttccagag

SEQ ID NO: 65194 - DNA, 1209 bp, Homo sapiens
aggagcgtttttggagaaagctgcactctgttgagctccagggcgcagtggagggagggagtgaaggagctctctgtacccaaggaaagtgcagctgagactcagacaagattacaatgaaccaactcagcttcctgctgtttctcatagcgaccaccagaggatggagtacagatgaggctaatacttacttcaaggaatggacctgttcttcgtctccatctctgcccagaagctgcaaggaaatcaaagacgaatgtcctagtgcatttgatggcctgtattttctccgcactgagaatggtgttatctaccagaccttctgtgacatgacctctgggggtggcggctggaccctggtggccagcgtgcacgagaatgacatgcgtgggaagtgcacggtgggcgatcgctggtccagtcagcagggcagcaaagcagtctacccagagggggacggcaactgggccaactacaacacctttggatctgcagaggcggccacgagcgatgactacaagaaccctggctactacgacatccaggccaaggacctgggcatctggcacgtgcccaataagtcccccatgcagcactggagaaacagctccctgctgaggtaccgcacggacactggcttcctccagacactgggacataatctgtttggcatctaccagaaatatccagtgaaatatggagaaggaaagtgttggactgacaacggcccggtgatccctgtggtctatgattttggcgacgcccagaaaacagcatcttattactcaccctatggccagcgggaattcactgcgggatttgttcagttcagggtatttaataacgagagagcagccaacgccttgtgtgctggaatgagggtcaccggatgtaacactgagcaccactgcattggtggaggaggatactttccagaggccagtccccagcagtgtggagatttttctggttttgattggagtggatatggaactcatgttggttacagcagcagccgtgagataactgaggcagctgtgcttctattctatcgttgagagttttgtgggagggaacccagacctctcctcccaaccatgagatcccaaggatggagaacaacttacccagtagctagaatgttaatggcagaagagaaaacaataaatcatattgactcaaaaaaaaaaaaaaaaaaaaaaaaaaaaa

SEQ ID NO: 65195 - DNA, 592 bp, Homo sapiens
atgctgcttcccggattcctagaagtccagacacctcacccccctaacctggatggaccacgcagagccaataggaatacttttctgtggacgtgccatgttggaatcccagatctccctgccctgccagcccctgccagcttcctggggacccaactgaccctgaagaaagcctctgatgggcctagaacagagaaggtgacccaggaccttgcccagcctttctggacaactggaagacagttacgcttcgtcctccacctctccctccaacaaaaggatcttagcaagtgttggagaggtgctgaagtcgtattaggaccaaccagactttttctttgaggatactcagaaggagtgaaggagaatggaacagggggtgtgaataaatgagctttctccatgtgtgattcaaagtggtttaacccatgcctcaccttctagaacacccgtggccctctctagccatgagaagtgtcaccactagccatcaaaatgctcccaaaagtccaacctttgaccaaactacatttcagattttcatttcagattttcttaaattctggagaaaaaagaaaataaagtaaaagaa

SEQ ID NO: 65196 - protein, 313 aa, Homo sapiens
MNQLSFLLFLIATTRGWSTDEANTYFKEWTCSSSPSLPRSCKEIKDECPSAFDGLYFLRTENGVIYQTFCDMTSGGGGWTLVASVHENDMRGKCTVGDRWSSQQGSKAVYPEGDGNWANYNTFGSAEAATSDDYKNPGYYDIQAKDLGIWHVPNKSPMQHWRNSSLLRYRTDTGFLQTLGHNLFGIYQKYPVKYGEGKCWTDNGPVIPVVYDFGDAQKTASYYSPYGQREFTAGFVQFRVFNNERAANALCAGMRVTGCNTEHHCIGGGGYFPEASPQQCGDFSGFDWSGYGTHVGYSSSREITEAAVLLFYR

SEQ ID NO: 65197 - protein, 113 aa, Homo sapiens
MLLPGFLEVQTPHPPNLDGPRRANRNTFLWTCHVGIPDLPALPAPASFLGTQLTLKKASDGPRTEKVTQDLAQPFWTTGRQLRFVLHLSLQQKDLSKCWRGAEVVLGPTRLFL

SEQ ID NO: 65198 - DNA, 20 bp, Homo sapiens
gatcttctttaataaacttg

SEQ ID NO: 65199 - DNA, 20 bp, Homo sapiens
gatcccaaggatggagaaca

SEQ ID NO: 65200 - DNA, 20 bp, Homo sapiens
gatcgcccaccgtgcacttc

SEQ ID NO: 65201 - DNA, 20 bp, Homo sapiens
gatctcatggttgggaggag

SEQ ID NO: 65202 - DNA, 20 bp, Homo sapiens
gatcttagcaagtgttggag

SEQ ID NO: 65203 - DNA, 1722 bp, Homo sapiens
ccaggagccccagttaccgggagaggctgtgtcaaaggcgccatgagcaagatcagcgaggccgtgaagcgcgcccgcgccgccttcagctcgggcaggacccgtccgctgcagttccggatccagcagctggaggcgctgcagcgcctgatccaggagcaggagcaggagctggtgggcgcgctggccgcagacctgcacaagaatgaatggaacgcctactatgaggaggtggtgtacgtcctagaggagatcgagtacatgatccagaagctccctgagtgggccgcggatgagcccgtggagaagacgccccagactcagcaggacgagctctacatccactcggagccactgggcgtggtcctcgtcattggcacctggaactaccccttcaacctcaccatccagcccatggtgggcgccatcgctgcagggaactcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccgacgcatcgcctgggggaaattcatgaacagtggccagacctgcgtggcccctgactacatcctctgtgacccctcgatccagaaccaaattgtggagaagctcaagaagtcactgaaagagttctacggggaagatgctaagaaatcccgggactatggaagaatcattagtgcccggcacttccagagggtgatgggcctgattgagggccagaaggtggcttatgggggcaccggggatgccgccactcgctacatagcccccaccatcctcacggacgtggacccccagtccccggtgatgcaagaggagatcttcgggcctgtgctgcccatcgtgtgcgtgcgcagcctggaggaggccatccagttcatcaaccagcgtgagaagcccctggccctctacatgttctccagcaacgacaaggtgattaagaagatgattgcagagacatccagtggtggggtggcggccaacgatgtcatcgtccacatcaccttgcactctctgcccttcgggggcgtggggaacagcggcatgggatcctaccatggcaagaagagcttcgagactttctctcaccgccgctcttgcctggtgaggcctctgatgaatgatgaaggcctgaaggtcagataccccccgagcccggccaagatgacccagcactgaggaggggttgctccgcctggcctggccatactgtgtcccatcggagtgcggaccaccctcactggctctcctggccctgggagaatcgctcctgcagccccagcccagccccactcctctgctgacctgctgacctgtgcacaccccactcccacatgggcccaggcctcaccattccaagtctccacccctttctagaccaataaagagacgaatacaattttctaactcagcaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 65204 - DNA, 2707 bp, Homo sapiens
catctttgagcaagatgggtctctaccgcatccgcgtgtccactggggcctcgctctatgccggttccaacaaccaggtgcagctgtggctggtcggccagcacggggaggcggcgctcgggaagcgactgtggcccgcacggggcaaggagacagaactcaaggtggaagtaccggagtatctggggccgctgctgtttgtgaaactgcgcaaacggcacctccttaaggacgacgcctggttctgcaactggatctctgtgcagggccccggagccggggacgaggtcaggttcccttgttaccgctgggtggagggcaacggcgtcctgagcctgcctgaaggcaccggccgcactgtgggcgaggaccctcagggcctgttccagaaacaccgggaagaagagctggaagagagaaggaagttgtaccggtggggaaactggaaggacgggttaattctgaatatggctggggccaaactatatgacctccctgtggatgagcgatttctggaagacaagagagttgactttgaggtttcgctggccaaggggctggccgacctcgctatcaaagactctctaaatgttctgacttgctggaaggatctagatgacttcaaccggattttctggtgtggtcagagcaagctggctgagcgcgtgcgggactcctggaaggaagatgccttatttgggtaccagtttcttaatggcgccaaccccgtggtgctgaggcgctctgctcaccttcctgctcgcctagtgttccctccaggcatggaggaactgcaggcccagctggagaaggagctggagggaggcacactgttcgaagctgacttctccctgctggatgggatcaaggccaacgtcattctctgtagccagcagcacctggctgcccctctagtcatgctgaaattgcagcctgatgggaaactcttgcccatggtcatccagctccagctgccccgcacaggatccccaccacctccccttttcttgcctacggatcccccaatggcctggcttctggccaaatgctgggtgcgcagctctgacttccagctccatgagctgcagtctcatcttctgaggggacacttgatggctgaggtcattgttgtggccaccatgaggtgcctgccgtcgatacatcctatcttcaagcttataattccccacctgcgatacaccctggaaattaacgtccgggccaggactgggctggtctctgacatgggaattttcgaccagataatgagcactggtgggggaggccacgtgcagctgctcaagcaagctggagccttcctaacctacagctccttctgtccccctgatgacttggccgaccgggggctcctgggagtgaagtcttccttctatgcccaagatgcgctgcggctctgggaaatcatctatcggtatgtggaaggaatcgtgagtctccactataagacagacgtggctgtgaaagacgacccagagctgcagacctggtgtcgagagatcactgaaatcgggctgcaaggggcccaggaccgagggtttcctgtctctttacaggctcgggaccaggtttgccactttgtcaccatgtgtatcttcacctgcaccggccaacacgcctctgtgcacctgggccagctggactggtactcttgggtgcctaatgcaccctgcacgatgcggctgcccccgccaaccaccaaggatgcaacgctggagacagtgatggcgacactgcccaacttccaccaggcttctctccagatgtccatcacttggcagctgggcagacgccagcccgttatggtggctgtgggccagcatgaggaggagtatttttcgggccctgagcctaaggctgtgctgaagaagttcagggaggagctggctgccctggataaggaaattgagatccggaatgcaaagctggacatgccctacgagtacctgcggcccagcgtggtggaaaacagtgtggccatctaagcgtcgccaccctttggttatttcagcccccatcacccaagccacaagctgaccccttcgtggttatagccctgccctcccaagtcccaccctcttcccatgtcccaccctccctagaggggcaccttttcatggtctctgcacccagtgaacacattttactctagaggcatcacctgggaccttactcctctttccttccttcctcctttcctatcttccttcctctctctcttcctctttcttcattcagatctatatggcaaatagccacaattatataaatcatttcaagactagaatagggggatataatacatattactccacaccttttatgaatcaaatatgatttttttgttgttgttaagacagagtctcactttgacacccaggctggagtgcagtggtgccatcaccacggctcactgcagcctcagcgtcctgggctcaaatgatcctcccacctcagcctcctgagtagctgggactacaggctcatgccatcatgcccagctaatatttttttattttcgtggagacggggcctcactatgttgcctaggctggaaataggattttgaacccaaattgagtttaacaataataaaaagttgttttacgctaaagatggaaaagaactaggactgaactattttaaataaaatattggcaaaagaaaaaaaaaaaaaaaaaaaaaaaaa

SEQ ID NO: 65205 - DNA, 1897 bp, Homo sapiens
aaacacttgcaaccacaagcaaactcgccgctccctgggtcccttcccagtggactctgcacattgggagccttataaagtagcctctgcatctgcctgcctcgggcagaggagggctaccctggggctgagagttcacctgtctcaggaaccacctgagcccacagatcctgtgggcagcggccagggcagccatggcttgggcaagtaggctgggcctgctgctggcactgctgctgcccgtggtcggtgcctccacgccaggcaccgtggtccgactcaacaaggcagcattgagctacgtgtctgaaattgggaaagcccctctccagcgggccctgcaggtcactgtccctcatttcctggactggagtggagaggcgcttcagcccaccaggatccggattctgaatgtccatgtgccccgcctccacctgaaattcattgctggtttcggagtgcgcctgctggcagcagctaattttactttcaaggtctttcgcgccccagagcccctggagctgacgctgcctgtggaactgctggctgacacccgcgtgacccagagctccatcaggacccctgtggtcagcatctctgcctgctctttattctcgggccacgccaacgagtttgatggcagtaacagcacctcccacgcgctgctggtcctggtgcagaagcacattaaagctgtcttgagtaacaagctgtgcctgagcatctccaacctggtgcagggtgtcaatgtccacctgggcaccttaattggcctcaaccccgtgggtcctgagtcccagatccgctattccatggtcagtgtgcccactgtcaccagtgactacatttccctggaagtcaatgctgttctcttcctgctgggcaagcccatcatcctgcccacggatgccaccccttttgtgttgccaaggcatgtgggtaccgagggctccatggccaccgtgggcctctcccagcagctgtttgactctgcgctcctgctgctgcagaaggccggtgccctcaacctggacatcacagggcagctgaggtcggatgacaacctgctgaacacctctgctctgggccggctcatcccggaggtggcccgccagtttcccgagcccatgcctgtggtgctcaaggtgcggctgggtgccacacctgtggccatgctccacacaaacaacgccaccctgcggctgcagcccttcgtggaggtcctggccacagcctccaactcggctttccagtccctcttctccctggatgtggtagtgaacttgagactccagctctctgtgtccaaggtgaagcttcaggggaccacgtctgtgctgggggatgtccagctcacggtggcctcctccaacgtgggcttcattgatacagatcaggtgcgcacactgatgggcaccgtttttgagaagcccctgctggaccatctcaatgctctcttggccatgggaattgccctccctggtgtggtcaacctccactatgtcgcccctgagatctttgtctatgagggctacgtggtgatatccagtggactcttctaccagagctgaggcaagaccactgggaggcctgagagtgggccagctcgctgctcaggcgaatttctcatttcaagccactggggaaactgaggcaaaaccatacttagtcatcaccaacaagctggactgcttagctgggctgttttatcttccctgagtgcctgggtctccctccctcacttctgccctttcccttcctcctcctcttctcctccctcttccctcatctcccccctccttcctctgccccaccccagcggggagcagactgctcctccaggctgtatagacctgccctcttgcattaaacaacttctcttgagctgcaactttca

SEQ ID NO: 65206 - DNA, 3318 bp, Homo sapiens
gactgctaagagggggttaaagggggacgatgtgaaggagagaacctgtggtccttcagaaggcgaagaagaaagaaaggggaagcagtgaagaaagggacggagatactgggacagggagaaaaaagttgtggagagtagcttttaaggagtcatttggtggccatggatccaacgtgctcttctgagtgcatttataacctcatacccagtgacttgaaggagcctccccagcctcctaggtacatatccatttttaaggcaactgtaaaagatgacatgcaaaaagctaaaactgcaatgaaaactatgggaccagcaaaagttgaagtaccttctccaaaggatttcctaaagaaacattcaaaggagaaaactctaccacccaaaaaaaactttgatcggaacgtgcccaaaaagcctgctgtgccattgaagactgatcatcctgtcatgggaatacagagtggaaaaaattttataaatacaaatgcagctgatatcatcatgggagtggctaaaaagcctaaaccaatttatgttgataaaagaactggagacaagcatgatcttgagccttcaggactagttccaaagtacatcaataaaaaggattatggtgtcacacctgaatacatatgtaagcgaaacgaggaaataaagaaagcccaagaagactatgatcgttatatccaggaaaaccttaagaaagcagctatgaaaaggctctccgatgaagaaagggaggcagttttgcaggggctgaaaaagaactgggaagaggtgcataaagaattccagtccctctcggtctttatagattctataccaaagaagatccgcaagcagaggctggaagaagaaatgaaacaactagaacacgacattggcataattgaaaagcacaagattatttatattgccaataacgcatgataccaacagcacaactttgaaaactgttaagtattttgaactggaaatagtaacacgtgccttcttgctactctaaactgtctccaacacattgtttctgagctccacaaatgcaaaagatgtattttcctgtggcccatgacatttgcagttattcccagtgagaaatattttcagtattcgtaacactgtatatgatgaaaggcttctatttggaggaagaaaaattaagaagacaacttacaaaatcaagatgacaacttataaaggcatcattgaggatgattaaggagaatagcctcctttctagcataccaacctcgatactcttattttattccacaactcactatgcatatcttatttaaatgtttttttccttttggtcctttctacttatctattttgtgaattctaaagttacatttgtaagattacataatctattaagcaataagtttatgttagtagagctgttttcaacccaaaaataagaaaaaatagctctaaatatctaaaaggaaaaggttattttatgaaattttaaattagaaaaatttggtaaaatatatgcaactataaaatatcagagaaataacaatttctactgcttacactggtttttatcctctggacaacataaaaaacaaaatatgggagtctttcaggcttttttcacaaacacagaatttggaagccttatagaaaagcttattttggttacttaaagaaaagtagtttatatacaattattttttgaaaattcacttgaaacttgtccatatgagtatctttattcctttattaacttagggcagatataaaataaaggataatatatgacaaattctcacttaccaagaatggttggttgctatttagggtaggctaacagctgtgacagtacactccaaaatgtataattacgtaaacacatattcaattcttgctaacatagcagtactttgctgtgagcaggtcagcaggaacccttttctgcagtcactcagggacccagacttacagagtgggtaggatgcatctgatccagagttagggagaggcacgtacaggccaggcctagaaatgatgcatatcattcccgtttgcatcgctaagtaagcaacttaagttgctttaacaaactaactccaaatctcagtttcctgataaagatacatttttcatttacatcactgtgcaatgtgactaagggtaggggtataagtctgttccatgcagtcactcagggacccagtctccttttgtctggtgactctgttgatccaggcagtctttctctgccaattcaggatgagatgtttaggtaagtattttatttgtgaaatgattgctatacatactcatttttaaataattcaaaatcagtagcaatgcaaaaatattctgattactttagccttatggatattatgctttgaagtcatgagtgggagttgccttaaatgttaaaatgaaaactttgtggttttaacagctaattcttttgctttctgtaaatgtctactaaagaatctagacttttctctatggtctacagtgttgtcctagatgaacattgttgcctttctttcacagagccttcagagggaaacattcccatccattgttcctggaaaggtgatccctaccacgggatcccaaacttggatagagccagttcaacctcccccaatccatacacatacatacctaggtcatcctatcacccaaaagagggacaaacatctgacttggacagctgaccagtgactgatcagattctctctctcttgagagcatgaattaagagacatggagactgcagtcacttgggagtagacacctgaaactaaaaagtcaaacttcattatgcagctagtttgacttggtttctcttcctgttcaaaggaagaatgggtagaataaagatttgatgtggtctggccccttgtctatgatctttttagcttgatttcttgaaatgctgcttcttccctacccactgtaactggcattcccatagtactgaggtactagagacctctgagatctgcacacatggttccctccacccagaaaactgcccttttctttctctcatcctacatagctgcctggcaaatccctagtcttcatcagctcacatcacatttccatgacaatcccctttgattcctcagaatctggccttcctttatagcactggtcatattgtattgtgcatatctggttatttgcctgttttccatgaacatttcaagcttatgggggagaagacactgtatacattttcatctgcattccttagaatctgcataacagctggtatagagaaggtactcaaaaaatccttaatgaataaagtaatggatcgtaccc

SEQ ID NO: 65207 - DNA, 1893 bp, Homo sapiens
tgggctgagaccctgagccccaactgtcagaaggagcctgaggctgaggtggaggctgggagtttggggctgtgggtggatcctctgaaggccatggaatcctccacggggcccaggatgcctttgctcaaatactgcagcgtggccacaagcctgaaggcccctggctgggacggtgctgctccaccttgggacctctccttcacctacccctttgccctccaagcaccctggctcaccgggcacaagccccttgcaaggcatgcctcttcttgcccatgtctccacgttgccgacccagcatggcaggggcctggctggctgggaagagctggagatgctgccaacacatgggtcctagcaagaagggaagcagatggtttttactaccgggcccaaataaaggccactcccgagctggagagacagggggtcctgcttgtggaattcgaggctcctcttgtcgcaggcccaaagctgccagcccagcagcagagagtggtcttagaagaggatgtcattcctctctcaccatctgtaggatactcactgagaccaggggataaggtgctggcactctgggagccaggccaacagcagtatggccctggcactgttcttttgggcttggagatgagagatccccagagagcatcaaaggaaaaagaaatcactgttcatttctggaatggcaaagctgctaaagtgcccctaggtggggtccagtcggtgtccctgaccatctggaagaaggctgtggagaggctgcacaagtctttcaccagggagcaccccaggccccttcactgggccccttgctgctctctgctagggccaatcactgggcgcatcactaatgagcttcctccggatgctccattcctgtgccctctctgccaccatcatgcctgctgccagctactgtgccagggctgcctctgtggctgcccgccatgtggcacgacttggtggcctctaaccaggacctcagaagtcatggccagagaacttccagagttggagcccacagcacagcttttgcccctggaaggtcctaaagaggagaaagtagcaatgcacgctcccctggctgtttcttcctcctcatcctcctcctgtgaacaagatggtgtggagaatgatctggagatgggccctccccagagactgatggtgaacagtgcagtcaacacagatcccatctttcttgagatgcctctgagacagagtggcctctgccagcctgagtggaggtattggaagagaaacgggcctgagccatgccctgggaagccaggaacaagatattccaacatctgcaaagaagaaaaggatcacaaacagcagagagcacaaactgtagtagtggggactaccaaggagctggtctcgaaagcaacccacatgaagccaccgcagaccccgccaggggaagctgaacacagaaagcggagtcagagccttgcaatatgtcagtggaacaagaattcccgttagactaagagccctgaggatctaggtaaagaataaacatggtaaatattcgaggagagttatacagagtggctgacaaggccttcttcaacggaaggaggcagaggacaggccacaggtaacagtcaaataaccaccagtatctccaccccacgaagacctccctgcagataagcagcaggaaggcacctgttgtgagggctataggaatgtgggatcctgccctggggctccctgccagggccctggtgaaactgctttaagatgcctcttccgtggaagagggggtcagcctgctttgggcaaatgtgtccacagccactctgccaccttcccataaagcctagttgtacatgagtgacattttgtttcacctcttaataaaaatgaattctcttc

SEQ ID NO: 65208 - DNA, 2099 bp, Homo sapiens
attcatgtgtcaatgaagaattcctgccagacttccagtactgtcctcgaccatgggcagaatcccagctgcccctcccagaacactccatgccactggaactcaggagcgcaggtgggcttatctaaatcagatcccaaatagtatttaaaaagcctctaccaaaagaagaggaggggctcaacctgagagaaaactcaccagggcagaaaagatgacagccatggaagcagagctcaaaggactgaagagctcatgaaagacttcttagagaagagagacaaggggaaacttctcatacagagaagtagaagactaaaacagaatctcttgagaccgatgcaactttccgtaactgaagatggctatattcattacggtgacaaagtgatgcttgtgaatcctgatgatcctgacacagaagctgatgtgtttctgcgtggggacctgagcctgtgtatgactccagatgaaattcagtcccatctgaaagacgaattagaggtaccctgtggcctgagcgcagttcaagccaagaccccaattggcagaaacacttttatcattttgagtgtacacagagatgccactggtcaagtccttagatatgggcaggacttttgcctggggataacaggaggatttgacaacaaaatgttgtatttgtcaagtgaccacaggaccctcctgaaatcgtctaagaggtcttggctccaggaagtgtacctaacagatgaggtctcccatgtgaactgctggaatatgaaggcttccccgtcccggcaaatgctaaaattctcatcaatcactgtcacacaaatcggggactggcagcccaccggcatcttttcttaaggtattgtatttcagggtacaacaaaatgctgtgattggggctgggggccatgaatataagcaaagaagctcaattgatagtgtatggctgcacatacaaaaaatgtcctttgctgatgaaataccgccacatagaacttcaatggtgtgaaaaatcctattagagccccttcttttatacaaatcctacccctacaagaggactttggttctaatgggatcctactggcctaatctttgcccaaataaggtgtaacctccctgcaaacatgtcccattttagagattccctagggctttatctagcaatccgcttcttaaggtgctttcgagattaaattattaataacagcttattgagagttgttattcaatttcaaaccacaactgattctctcttgctccagcacctattttggaaaggaggctgaggttgtagctcacacatacctggattcacatagagttgagaaaccaaggaaccactggatgttggttactgggaatcccagggatgcctcgtcctccatgttggatctgcccaaaccacccacagaggacactcgagccatggagcaggccatgggccttgacacgcagtaacacgccaggcacgtgcatgttttccctggtcccgctctcatcaaatgtagctttaaaagaaattaacaaccttggtcatgcctcaagctatttttgaatcagatgtgggactctctgggcactatattaaaataaagattacattaagattattgaatttgtggtgggagtctagggccgaagaaaaacagctctggagaataattagtatttgaaagtgacaaacaatagccttttgttgataaacaaattctgaagaactcagcttcctctacttatatccttcattatctacaaggacagtgcgttactttttaaagttatgtctatgtaataaagctgttggacctatactgaatttttggtaccacagtttccctcttgaatgtactaaaacacaaaaaactgacagctctgagctgtggccttaccttggaattaaacatttccacctttgtaaaacatcctatttttgtttctacctttggctttccaggtcaggacctctacctgatcagtaacctattattttgtaatgatttttaagctgcagaatctctaccttgtctttgaaactggcacattagttgtggcacccatgtgattagatagttcctgacaaaataaatgtatgtccttcc

SEQ ID NO: 65209 - DNA, 2343 bp, Homo sapiens
tcacatgtgctagccctagcagctcgcgatgtgcttcagcagagcagacgctgcggataactacccttttggaacatgtcaacagaggaaactttttcctcacttccatcccccgaatttgattgggaacaagtttgtccctcttaggggatcaccccacagagggcctgggtgttatttttcagatggatatggcttggcatacgacttatctaggatcccaaccagtataaaaggatatactttgggagccagaacagctgtgaggtttaagccaatacagaaggaaatgacacctcatgcaggcaggtaccagaaagtaagtcctcagcaggaaaaacacaaacaaaattttgctccatttaatgtcttggtgcctcgatttaagaactacccaaaggacacttactatcccagccctggtgcatacaacccagagaagaagccaccgccaaaaattgcctggccaatgaaatttggatctccagactgggctcaggttccatgtctacagaaaagaaccctaaaagctgagctgtccacagacaaagactttagaaagcatcggaaccgtgtggcctacctaagcctgtattataattgagcggctgtgactaccttcacgtgctcctcttatacacagactctccaggactgaggacagagctgctcttcttcttctacgttactgtggccctcttgtctggcagcctggagcccagggagggacaggggcttatagctgctgtatgagaacataaagactagtgcacagtgctatctccatctactgacttgtggtgtacacgtgcatgtctgggtctgtgggtttctattgggtgctgagttgggtgatttcattttagtgaaatatttgtgggcccctgctctctagttctaattcccaggagccaattttatatattctaccactagccctggtcataggaggctgttagcctatacatgtcaagggtttggatgggatttgggcttgctagatacagaaaacacttaaggcagattaaaacatgtattggagctctcccaattgtgttgctcagtgtggagtgggaaggtcttgatttggttgactttcccagattgacataaaactcaaaaaccaaaaaattgcccctttcctatgacatcatccatttagtctgtgagtcaacatatatactgaggtcctactatgtgttgagcagagcagtaagcactggggatatggcaggaatcaaaataaacttatctactaagtccttgggcctggcctgaagtcagaggaggactccccagggcagctaggggattgggtctgccctccaatctgaatgaccccctagaaccttacaagtcattctggggttataaagatcataacatgatttatagccccagactgacttgtaagcagctgcatttaaagtacttactcagacactcaggcctgagagatagacccctttctttccagcactagctgaaataatcaagtatatagtttgttcaggattggcactaaatgtgatttaatcttttaataaaagggtccttttgtacccacttaggcttcttcgtaattaccagaaaggtgataagcctgcatgtgtctggacaccaaagattgagaagctgccagtggctgcaagagagcctactgtaaccctcatggccaccccctgatgagtgttacctggggaaagggctagcaagaggtgaagcctcctggtcatatgatgctgggggtgcctaattccttaaaggccaaggtcttctgaaataataatggtgaaggacagaaaagtctttatgagaaatcacataggatatattaagataatgataaagatacctcagcaagaacatacctaatatatacacttcttttaatctgatgacttaatgatttctgttatcaagaagtatttatgacttgagataagtcaggattaactgttatcacctctcctgtacacctccctcctttttctcctttgtacccacatgtgcaaattttttcagaggtgacaatttagcatttaatgtttttttttctgcttcaagttcttaggtccctttggaggatattgatgggggtggaggtggggatagaacatctttcacactgtttggtacagagatgctcaaagcttttcccagggaaaggaactctctaaaatagtaatctgatttgatgaaagataaaattttaatatagcttcagttaaccttcaggatactttaaatgctacattgtatataaaagtaataaagtacaaatgaccccgaaaaaaaaaaaaaaaaaaaaaaaaaaaaaaaaaaaaaaaaaaaaaaaaaaaa

SEQ ID NO: 65210 - DNA, 792 bp, Homo sapiens
ggccagagcttgcggggcgcacagagcccccaggcctcatggcgcagaaacctctcagcaccgcggcggctgaacgcatgaaccttgtgggtcaggatgagatctggaaataccgtctgaaggctgaatcggaagcacggcagaactggccccagaactgggggtttttaacaaccccttttgaggagttgatcaagtgtgaagaagatctccccaccccaaagcccaaaatcgagcttcctgagcgtttccgcatccggccggtgaccccagtggagaagtacatcaaggtctttccatcccccccagtcccacagaccacccagggcttcatcggctggagatctgcagtgccaggcctgaacaagtgcctagagctcgacgatgcgatcagaagctgcaaaggtgcttttgcacgagagctgtgctggcccaagcagggcgtgcactgaatccagacggagttctgcccaggggtgctgcatatcggtcaccaggcacccagggccatgccagggaaaggaagagctcccctgaatcccgaggacacagtcccctgcgtacttgctcatgggatgttgcaaagaacacaaagtgtgccttagacattctcaagtcatcagcgtcacccttccagaatgttcacgtccacacccattcttggctaatgtaatgaataaggcttctctcatttgtttttgataccttgggaatttctatgcagggctttaaaaaaaaataagtgattcaattttaaaaaaaaaaaaaaaaaaaaaaaaaaaaaaaaaaaaa

SEQ ID NO: 65211 - DNA, 2020 bp, Homo sapiens
agcttggaagcttaggggagctgctgtggcccagggctcagtggggaggaagaggaggccaggagtcttggactagctgcagggtttgagctaggctgaagcagcagaaccacagaggtggctgagcaggggcctggccctgggacccagccatccacactcacacatccacttctccctccagagcccggccctgaagcaggtctctgctccacgcttttccttagttggggaatcgagagttgggggatcaaagccccccacatctccctcacccgctgcagctatgtttatcaaggtgatgtttggggctggctgctcggtgctggtgaacacctcttgcaggctggtgaacctcaccgcccacctgaggcagaaagcagggttgcccccagatgtctctctccatgtcctcccagcgaccattgctctcctggctgaggatggcaacctagtgagcctggaggaggacctgaaggaaggggcttcccgggcccagaccatgggcaactccctactgaaggagcgaaccatatatgtcctcgttcggatcatcagtaaggtggcccaaggttctctcccctgcagctatggtagaatgtaagaggggggcatagcagaccatagaccacccaaggccctgtccagcctcccacctcggctggggacctagccccaatccatccctacccaatgctctgctcccagcctggactagcaaacagttccagagtgagaggcagagtagggaccattaggccagtcaggtgtccttcatcgtctctccacatgtcacagagggagaggacatggcctccacccgctatgagtccctattggagaacctggatgaccattacccagagctggcaggtgagtgtcagggtacagcccagggggagggcacaccttctccctaacccctaccaacaggacttcctgggccttccagaggaactgcgcaggctgtcaggcctctcctctgtgggccacaactggaggaagcgtatgggcactcggcgaggccgccatgagcaaagccccacttcaaggcccagaaaggtgagctccctgccacccaggagttgctagctggggcagggagccaggtacagagcagatttggacatccacagagacacccagagtgggatcccttcctgcaggacagacacatatgatgaggggcagaccctcaacaccaactccacgcacatatacccccagatggaacacactgtaccctgagacaggtccccaccaccccacgggagtgccagcgcactaagggccggaatgtcctcaggcttcacagatgtggcataggggctggcacacagtaggagctcagtgcacaactgctggatgaactcaatgaaggcggcagcatggtgtgtgatggcacggcccacactgggtttgaagggcttgttcttccattctggcaggcttggggacctggcacactactgccaactagccaagttggactcagacccaggggggttagccatgacctctgccttgtgtgatcaggtgcaaacagacaacaacccagcaggactcctcttgcagaatctggaattgctgagaagttgcatcagcaagaggggcaaggtcagacaggatttgaggccgccaggggcacctaagctgtgggtgcagagaatgggatgcagaggtagagacaagaagggtagaggtggcaggtatccctgataagggggagaccatgggttcatcctgggattccaccctcagagtcagatgcccttgggatcaccgactaatgcctctccacctcactctggactgcccaaggaatctgtcctgtgctacccacagtgcagattgcaacagggctcctcctccccacccagggccctgattaaggggatggattgcacactgtagtgagacatccatcctgaccccacctcatcagccagggagctccctgaagacaggccatcgagagaggcacacaacaggctgtggtctaaaataaacttttaattgc

SEQ ID NO: 65212 - DNA, 5242 bp, Homo sapiens
gttccgggtccgagcgcgcccccgggctcgggtcgtcatgagcctggactgcaccagccatatcgcgctgggtgccgcttcgccagcgcccgaggaaacttacgatcatctttcggaagtcccggtcacgcgggagcagttaaaccactatcggaatgtggctcaaaatgctcgaagtgaacttgcagcaactttggtcaaatttgaatgtgctcagtctgagcttcaagacctccgatccaagatgctttctaaagaagtctcctgtcaagaactgaaagctgaaatggagagctacaaggaaaacaatgccagaaaatcatctctccttacctctttgagagacagagttcaggaactagaagaagaatcagcagcactttccacttctaaaatcagaacagaaatcacagctcacgctgcaatcaaggagaaccaggaattaaagaagaaagttgtagagttaaatgaaaaattacaaaagtgttcaaaagaaaatgaggagaataagaaacaagtttcaaagaattgcaggaaacatgaggaatttctgactcaactgcgtgactgcttggatccagatgagaggaatgacaaggcatcagatgaagatttaattttaaagcttagagacctgcgcaaagaaaatgaattcgtgaaaggacaaattgttattcttgaagagactataaatgtccatgagatggaagcaaaagctagcagagaaacgatcatgaggctggcttcagaagtcaacagagagcagaaaaaagctgcctcctgtactgaagagaaagagaagctgaaccaggacctgctcagtgctgtagaagcaaaagaagctcttgaaagggaagttaagatcttccaagaaaggctgcttgctggccagcaggtctgggatgcctcaaagcaggaagtgagcctcctgaagaaaagctcttctgagttggagaagagtttgaaggccagtcaggatgcagtcacaacctcacaaagccagtacttctcatttagggagaaaatcgcagccctccttaggggcagattgagcatgactgggtccactgaggacaccattttggagaagattcgagaaatggacagccgggaagaaagcagggaccggatggtctcccagcttgaagcccaaatatctgagcttgttgaacagttgggaaaggagtctgggtttcaccagaaagctctccagagggcccagaaagcagagaatatgttggagactcttcagggtcagctgacacacctggaggcagagctggtttctggaggtgttttgcgagacaacttgaattttgagaaacaaaaatatcttaaatttctggatcagctttctcagaaaatgaagttggaccagatggctgccgaacttggctttgacatgcggctggacgtggttttagctcgaacagagcagctggttcgtcttgagagcaatgcagtcattgagaacaagaccattgcccacaatttgcagagaaagctaaagacacagaaagagagactggagagcaaagaattacacatgagcctcctccggcagaaaatagcccagctggaggaggagaagcaggcacgcacggccttggtggttgagagggacaacgcgcatcttaccatcaggaacttgcagaagaaggtggagaggctgcagaaagagctgaacacgtgtcgagacttgcacaccgagctcaaagccaaactggccgacaccaatgaactgaagattaaaactttggaacagactaaagccattgaagatctaaacaaatccagagaccaactggagaagatgaaggagaaagctgagaaaaagctcatgtctgtcaagtcagaactggataccacagaacatgaggctaaggagaataaagaaagggccagaaacatgatagaagtggtaaccagtgaaatgaagacactaaaaaaatctctggaagaagcagaaaagagagaaaagcagctggcagacttcagggaggtggtgtcgcagatgctaggcttgaacgtgaccagccttgctcttcctgattatgaaatcatcaagtgtcttgaaagattggtccattcacatcagcatcactttgttacctgtgcctgcctcaaagatgtgactactgggcaagagaggcacccacaaggccatttacagcttcttcattgaacactgtatctcttgagagaggtggccataagacatggcacacaattcccaatttcacaaattcctcatgtctttgagatttgatcagtttgtgaatattttatgctttgatgatatagtgagaatgcatcacttgcaaaaacgatctcaaaagtgtcagccttagataaacgttcagcattaaaaacgcctattatttcatttactagcattttaggatccagaagaattccaccagattgcatgagttagattgggaaatgggagtgggagataacattgggaggtatctattttaagtcaggggctttactagccgatttagttctcacaataaccatgtggagaagctgtgacatttttaatttacaacctttctggggctcagacataaagttacctatccaaggttgcagttgggtagtggtgggaccaggatggacaactcattggccctgcctcaaaagccatacctcttctcctgctacgcagaatctgtttctcctgaatctctgtgatgctggtgggaattgtttgcatagaggaaggacaataaccctgccatcgtgagttaatgtccgggctggtcatagtggttcatgcctgtaatcccagcactttgggagtccaaggcaggcatatcatttgaggtcaggagtttaagaccagcctggctaacatagtgagaccctgtttctactaaaaatacaaaaataagccaggtgtggtggtgcatgactgtaatcccaactactcagcaggagaagcacttgaacccaggagacggaggcggcagtgagccaagattgtgccactgcactccagcctgggcgacagagtgaaactacatctcagaaaaaaaaaaaaaaaaaaaaaaagttaatgtccaaaaatgacagatttacaagtgtaagctatatgatttcttcaaaaagcaaaagcaatatacctaattcatttggatcaaacttacataggtctcaggtcctgtaagaaacttgcctgttctaactgttgctaccagattatatctggtggtaattgttaatgtttcagcagggctggtctcagtcctttaaaatggaaagctttatttggagcccaaccctataagatgaagaaatcctatatagtcttattcaccaatatatccaatacacccacagcaatggtacctttttaagatcaggattttattatgaattcctgtcactttctgttttccatttaaatttctattttacaaatttttcagggaatcatattcttaacttcactgagaaaaatgtgttactcttttggacaatttatcttatttctatcatataagatgtatttttttattgtccttaaaagaagctctagcatgaaattaaaggaaagggaaagaaatagatctggtgcacccgaacattaggagaaaatgaaaaatatacaaccaaccgttcgtgagtcatcaaaaagtcaaagtcagcctggccaacatggcaaaactccgtctctgcaaaaaatacaaaaatgagcccggtatgttggcatatgcctgtaatcccagctactcgagaggctgagacacgaaaattgcttgaacctgggaggcggaggttgcaatgagccgagatcgcgctactgcactccagcctgggcaacagagagagaccttgtctcaaaaaacaacaacaacaaaaagtcaaagtcataataagcaaattattggcttctttcttctagactaaaagaaattaaagagatgaaacaatcaattgcaagggtcaaaactagattggatcttggtttgaatgaaaaaaagcataaaatattcttgcaataattgtaaaaatttgaatgtggactaagtcctagattatattaaaatatttttaattttttaagcttgacaaatgcactgattgttatactttaaataactaaaaatctgagaatccacagtgctacagacaataagtgataaaatgggaaaaaatagtgaagatcttcttttaggaaaactaccaataaatgtagaatggatgattccaaaaaaaaaaaaaaaaagaagaaagagagaaagaaagaaacagaaaaacctaaaagaaagcgaatgaatttgacacctgttggttggatgacagaccacacagagggagagtgaccaggctttgcttgtggagcgggcatccctgcctagctatctccttcatgtgcaaggacagtataagtagtattttgcatgtgagtaaacacacctgcgcagccctggctgaggtcactaggctggccagaggcaggacaggcagtcttgaatttcctctaggggaggcctgcagttttccccaccaaccccttttcacatgctccaaagatgtagtagtgtctgctgttttggatcgaaaatcaccttgagtggaggaagtgacttcactgggtctctggaggctctcggagcttgagtggctctgccccaccctgaatcatgcacccataaatgcagttatgggtggatgtgggtgtatgagagtggagattgtttttgtacattctctttgttttcattttccaaatataatctttaataaacttgatttagtttcttgggaaatttattttctacgctattcaaagatattttaaataatattttaaaaacatgaaatttttttttcatttttgatttgatatcattaattttatatcaggattcatgtaagagactaaaaatgatccatagtggttagtactgtaatttctgtttattacatgaaattacattccatttatccaaatatatgtttatataatatttccactgtgtgactctagtgatctttaacatacacagaatgatctacagtgatctttaacatactcagaaatatgaaaaatgtttgaatatgatctttagggacttctaatgaaaagggtatatgaaatgggaacaataaattctgtacatgtatacagtccatatacacattaagtgtttgtcatttggacaaattgaaaacttttaataaagccattttcttctttgttaaaatgccaaaaaaaaaaaaaaaa

SEQ ID NO: 65213 - DNA, 948 bp, Homo sapiens
tggagaaaaggcagaaccagagtagagattgacagtgagctgagccaatcaggctgtgaatctgcagcagtgatcccaggtcctccaattaatactaagagagtggaccagggcccctgaggaagacagatggcagggacagcgcgccatgaccgagagatggcgatccaggccaagaaaaagctcaccacggccaccaaccccattgaaagactccgactgcagtgcctggccaggggctctgctgggatcaaaggacttggcagagtgtttagaattatggatgacgataataatcgaacccttgattttaaagaatttatgaaagggttaaatgattatgctgtggtcatggaaaaagaagaggtggaagaacttttccggaggtttgataaagatggaaatggaacaatagacttcaatgaatttcttctcacattaagacctccaatgtccagagccagaaaagaggtaatcatgcaagcttttagaaagttagacaagactggagatggtgttataacaatcgaagaccttcgtgaagtatataatgcaaaacaccacccaaagtaccagaatggggaatggagtgaggaacaagtatttaggaaatttctggataactttgattcaccctatgacaaagatggattggtgacccctgaggagttcatgaactactatgcaggtgtgagcgcatccattgacactgatgtgtacttcatcatcatgatgagaaccgcctggaagctttaagcacatgacctggggaccaggccctgggacagccatgtggctccaaatgactaaatgtcagctcaaaaaccagaatcgtatttgatttcacactcatcctaatgtttttttctgtgtcaaaatattgcattttctggggccaaaaaacaggcagaaataaaagacattgagtagtcaaaaaaaaaaaaaaaa

SEQ ID NO: 65214 - DNA, 1693 bp, Homo sapiens
cgcacttagcagtgccagtggcagcagcagccatggggaagccgggcgtggaggcagcaccgggctcggagctggccagggttccctagcctatggagcacgcagccaccacaggccccaggcctggacctccctctcggcgggtggagaatgttgtgctacgagccaaggactggctgccaggagctcctgggggcaccgcagtgtgggccaccagcttggaagcagaggtcccaccagatctagcgctcaataaggagcagcagctgcagatctccaaggagctggtcgacattcagatcacaacccaccacctacatgagcagcatgaggctgaaatcttccagctgaagagtgagatccttcggctggagagccgggtactggagctggagctgcgaggagatggcaccagccagggctgtgcagtcccagtggagtctgaccccaggcatccccgggcagcagcccaagagctcagacacaaagcccaggtgcctggacactctgatgaccacagattccaggtgcagcccaagaacaccatgaaccccgagaatgagcagcacaggctggggagcggcctgcagggggaagtgaagtgggcgctggagcatcaggaggcccggcagcaggcactggtgacgcgtgtggcaaccctgggccggcagctgcagggagcccgagaggaggccagggcagccgggcagcgactggccacacaggctgtggtgctgtgcagctgccaaggccagctccgtcaggcagaggctgaaaatgcccggctgcagctgcagctcaagaaactgaaggatgagtacgtcctacggctgcaacactgcgcccggcaggcagtggagcacgcagatggtgcaggccaagcgccagccaccacggccctccggacattcctggaggcgactctggaggacatccgggcagcgcaccgcagccgtgagcagcagctggcccgggctgcccgcagctaccacaagaggctggtggatctgagccgcaggcatgaagagctactggttgcctacagggcacctgggaacccccaagctatttttgacatagccagcttggacctggaaccattgcccgtgcccctggtcactgacttcagccatcgggaggaccagcacggcgggcctggggcactgctctcatccccaaaaaagagacccggtggagcctcccaggggggaacatcagagccacagggcctggacgctgcatcctgggcccagatccaccagaagctccgggacttctcccgcagcacccagagctggaacgggagcgggcacagctgctggtccgggccacgatggctgaagagcaactttctgagctacaggagtacgtggaccagcacctgggcaggtacaagcacgaaatcctgaggctgaggaagctggcaggtgcaggggacccctggaaagtgggggctgtgcctccagccaagccccagcatccaaggaccggcagccactaggccgtctcccaaggagcagagcagagcagagctcctcagccagcacagaaccctcccacccagccccccataaaacatgagtcaggatagaacccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 65215 - DNA, 3454 bp, Homo sapiens
ggacttagcagtgccagtggcagcagcagccatggggaagccgggcgtggaggcagcaccgggctcggagctggccagggttccctagcctatggagcacgcagccaccacaggccccaggcctggacctccctctcggcgggtggagaatgtgagtcctctgggacttgccgctcctgccatggggttgaagtctgcccgttcccccaaaggccaggaaggtgcaggttcctgcaccctgggcctaatttcagccaggagagggacttttacagctcagccaggcagggaggcgggactggtgactgcatgggagtggggccacagcccagcctgggacccacctggggaatgggtggcggtacctccccaggttgtgctacgagccaaggactggctgccaggagctcctgggggcaccgcagtgtgggccaccagcttggaagcagaggtcccaccagatctagcgctcaataaggagcagcagctgcagatctccaaggagctggtcgacattcagatcacaacccaccacctacatgagcagcatgaggctgaaatcttccagctgaagagtgagatccttcggctggagagccgggtactggagctggagctgcgaggagatggcaccagccagggctgtgcagtcccagtggagtctgaccccaggcatccccgggcagcagcccaagagctcagacacaaagcccaggtgcctggacactctgatgaccacagattccaggtgcagcccaagaacaccatggaccccgagaatgagcagcacaggctggggagcggcgtgagtgtgcagccacctagctcaggggagagggcagcaccagagaccccaagcctagggtctcatccagccagccctgtgtgccccacagctgcagggggaagtgaagtgggcgctggagcatcaggaggcccggcagcaggcactggtgacgcgtgtgtgagtggccatctcacctggggccccatcctggagcagagagaacccctgatcgtgggcctgctgagcctcacccccgtgtcttcagggcaaccctgggccggcagctgcagggagcccgagaggaggccagggcagccgggcagcgactggccacacaggctgtggtgaggctctgccctgactgcttggagacctggagggtgggggccccagaagctcagccggggtccactctcagggcacaggtggagggctgcttccaccccaggtgctgtgcagctgccaaggccagctccgtcaggcagaggctgaaaatgcccggctgcagctgcagctcaagaaactgaaggatgagtacgtcctacggctgcaacactgcgcccggcaggcagtggtgagccctgcaggagcaccctgaggcctagggagcccaagcctggcctgggtgtgctggatagcttcagggagaccccagggccccggcactgctcagcctgctggggtggggggatggttggaaaagatggggggtgggccccatgcggacccagcccaccgcctccaggagcacgcagatggtgcaggccaagcgccagccaccacggccctccggacattcctggaggcgactctggaggacatccgggcagcgcaccgcagccgtgagcagcagctggcccgggctgcccgcagctaccacaagaggctggtggatctgagccgcaggcatgaagagctactggttgcctacaggtgggccccgctgggatgggaggtgtcaggcatctgtgggtctctaagcctctgtgcctcaaaggcttggtgtgcagcaggagtggccccagacagacactagcctaccctgacagggcacctgggaacccccaagctatttttgacatagccagcttggacctggaaccattgcccgtgcccctggtcactgacttcagccatcgggaggaccaggtgaggctagagacccccagaagctccaggcccgggtgccccccacccacccactgccccacactggccccaggcctcatcctgggctcaacagagacctcagccccgggcctctgaggggcttgccttgttcagccaactgaaacgtccccaccacaaacctctgtagcacggcgggcctggggcactgctctcatccccaaaaaagagacccggtggagcctcccaggggggaacatcagagccacagtgagtgccctcatgggtgtgggggaggcctgtgggggatgagcagagagcacaacgcctgcaccctggggcccccagttgctccaccaagcccccgccagacagggtctggtcacagcaatgcactcagtggcacatccccaccctggggtccctccgtgggtcccggcgacactgataatcacaggaaagagaagaggggctgctgcaggtggagctggccttgaacacggaggatcagggagagcacacctgagggaggtttccgctgagacctggaggacgcgaggggtgggagcagggcgcctggtgaccgggccagcccttgcctctgggcctccatgttcccagctgtacaatgggcagggctccccaaggaccatttcctggggtttagggcacacccgtgtgggggtggcatccctgttgatgctggagtcactgtctgggctggccttgtggtttagccctcccccagcagccagcagaacccctgggcccgggctgtccctatatacggatggctccaaggcctgggggggggcgccacaggagcacgggggggcccatgcctccctcactcactcccaggtgtcccctcccggctctgggaacctgactcagcacggtcacgtctgtccctgtgtcaccatgccagctctcaaaaccactcctcctttcctctcccctcacaggggcctggacgctgcatcctgggcccagatccaccagaagctccgggacttctcccgcagcacccaggtaggaggcaagggctggcccaggcccatcctcacgccatgccccagctcatggcttacatccccatgccaggcagagctggaacgggagcgggcacagctgctggtccgggccacgatggctgaagagcaactttctgagctacaggagtacgtggaccagcacctgggcaggtgggcagagggagctgggtgtgaccccagggccctggtctggttggaatgaaggatgatggctgcctcaggcgctaaaggcagacctgtccacagctgggcaagtcacttaagcatggttcctctgagcaggtacaagcacgaaatcctgaggctgaggaagctggcaggtgcaggggacccctggaaagtgggggctgtgcctccagccaagccccagcatccaaggaccggcagccactaggccgtctcccaaggagcagagcagagcagagctcctcagccagcacagaaccctcccacccagccccccataaaacatgagtcaggatag

SEQ ID NO: 65216 - DNA, 1925 bp, Homo sapiens
agtggagtgggacaggtatataaaggaagtacagggcctggggaagaggccctgtctaggtagctggcaccaggagccgtgggcaagggaagaggccacaccctgccctgctctgctgcagccagaatgggtgtgaaggcgtctcaaacaggctttgtggtcctggtgctgctccagtgctgctctgcatacaaactggtctgctactacaccagctggtcccagtaccgggaaggcgatgggagctgcttcccagatgcccttgaccgcttcctctgtacccacatcatctacagctttgccaatataagcaacgatcacatcgacacctgggagtggaatgatgtgacgctctacggcatgctcaacacactcaagaacaggaaccccaacctgaagactctcttgtctgtcggaggatggaactttgggtctcaaagattttccaagatagcctccaacacccagagtcgccggactttcatcaagtcagtaccgccattcctgcgcacccatggctttgatgggctggaccttgcctggctctaccctggacggagagacaaacagcattttaccaccctaatcaaggaaatgaaggccgaatttataaaggaagcccagccagggaaaaagcagctcctgctcagcgcagcactgtctgcggggaaggtcaccattgacagcagctatgacattgccaagatatcccaacacctggatttcattagcatcatgacctacgattttcatggagcctggcgtgggaccacaggccatcacagtcccctgttccgaggtcaggaggatgcaagtcctgacagattcagcaacactgactatgctgtggggtacatgttgaggctgggggctcctgccagtaagctggtgatgggcatccccaccttcgggaggagcttcactctggcttcttctgagactggtgttggagccccaatctcaggaccgggaattccaggccggttcaccaaggaggcagggacccttgcctactatgagatctgtgacttcctccgcggagccacagtccatagaaccctcggccagcaggtcccctatgccaccaagggcaaccagtgggtaggatacgacgaccaggaaagcgtcaaaagcaaggtgcagtacctgaaggataggcagctggcaggcgccatggtatgggccctggacctggatgacttccagggctccttctgcggccaggatctgcgcttccctctcaccaatgccatcaaggatgcactcgctgcaacgtagccctctgttctgcacacagcacgggggccaaggatgccccgtccccctctggctccagctggccgggagcctgatcacctgccctgctgagtcccaggctgagcctcagtctccctcccttggggcctatgcagaggtccacaacacacagatttgagctcagccctggtgggcagagaggtagggatggggctgtggggatagtgaggcatcgcaatgtaagactcgggattagtacacacttgttgatgattaatggaaatgtttacagatccccaagcctggcaagggaatttcttcaactccctgccccctagccctccttatcaaaggacaccattttggcaagctctatcaccaaggagccaaacatcctacaagacacagtgaccatactaattataccccctgcaaagccagcttgaaaccttcacttaggaacgtaatcgtgtcccctatcctacttccccttcctaattccacagctgctcaataaagtacaagagtttaacagtgtgttggcgctttgctttggtctatctttgagcgcccactagacccactggactcacctcccccatctcttctgggttccttcctctgagccttgggacccctgagcttgcagagatgaaggccgccatgtt

SEQ ID NO: 65217 - DNA, 1518 bp, Homo sapiens
aaaacagcccggagcctgcagcccagccccacccagacccatggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctggtgagtgagtgtgccacctacaagctgtgccaccccgaggagctggtgctgctcggacactctctgggcatcccctgggctcccctgagcagctgccccagccaggccctgcagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgcctcccatctgcagagcttcctggaggtgtcgtaccgcgttctacgccaccttgcccagccctgagccaagccctccccatcccatgtatttatctctatttaatatttatgtctatttaagcctcatatttaaagacagggaagagcagaacggagccccaggcctctgtgtccttccctgcatttctgagtttcattctcctgcctgtagcagtgagaaaaagctcctgtcctcccatcccctggactgggaggtagataggtaaataccaagtatttattactatgactgctccccagccctggctctgcaatgggcactgggatgagccgctgtgagcccctggtcctgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgtgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctcca

SEQ ID NO: 65218 - DNA, 1509 bp, Homo sapiens
aaaacagcccggagcctgcagcccagccccacccagacccatggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagcagctgccccagccaggccctgcagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgcctcccatctgcagagcttcctggaggtgtcgtaccgcgttctacgccaccttgcccagccctgagccaagccctccccatcccatgtatttatctctatttaatatttatgtctatttaagcctcatatttaaagacagggaagagcagaacggagccccaggcctctgtgtccttccctgcatttctgagtttcattctcctgcctgtagcagtgagaaaaagctcctgtcctcccatcccctggactgggaggtagataggtaaataccaagtatttattactatgactgctccccagccctggctctgcaatgggcactgggatgagccgctgtgagcccctggtcctgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgtgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctcca

SEQ ID NO: 65219 - DNA, 1703 bp, Homo sapiens
aaaacagcccggagcctgcagcccagccccacccagacccatggctggacctgccacccagagccccatgaagctgatgggtgagtgtcttggcccaggatgggagagccgcctgccctggcatgggagggaggctggtgtgacagaggggctggggatccccgttctgggaatggggattaaaggcacccagtgtccccgagagggcctcaggtggtagggaacagcatgtctcctgagcccgctctgtccccagccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagcagctgccccagccaggccctgcagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgcctcccatctgcagagcttcctggaggtgtcgtaccgcgttctacgccaccttgcccagccctgagccaagccctccccatcccatgtatttatctctatttaatatttatgtctatttaagcctcatatttaaagacagggaagagcagaacggagccccaggcctctgtgtccttccctgcatttctgagtttcattctcctgcctgtagcagtgagaaaaagctcctgtcctcccatcccctggactgggaggtagataggtaaataccaagtatttattactatgactgctccccagccctggctctgcaatgggcactgggatgagccgctgtgagcccctggtcctgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgtgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccaaaaaaaaaaaaaaaaaaa

SEQ ID NO: 65220 - DNA, 1103 bp, Homo sapiens
cacagagcccgggccgcaggcacctcctcgccagctcttccgctcctctcacagccgccagacccgcctgctgagccccatggcccgcgctgctctctccgccgcccccagcaatccccggctcctgcgagtggcactgctgctcctgctcctggtagccgctggccggcgcgcagcaggagcgtccgtggccactgaactgcgctgccagtgcttgcagaccctgcagggaattcaccccaagaacatccaaagtgtgaacgtgaagtcccccggaccccactgcgcccaaaccgaagtcatagccacactcaagaatgggcggaaagcttgcctcaatcctgcatcccccatagttaagaaaatcatcgaaaagatgctgaacagtgacaaatccaactgaccagaagggaggaggaagctcactggtggctgttcctgaaggaggccctgcccttataggaacagaagaggaaagagagacacagctgcagaggccacctggattgtgcctaatgtgtttgagcatcgcttaggagaagtcttctatttatttatttattcattagttttgaagattctatgttaatattttaggtgtaaaataattaagggtatgattaactctacctgcacactgtcctattatattcattctttttgaaatgtcaaccccaagttagttcaatctggattcatatttaatttgaaggtagaatgttttcaaatgttctccagtcattatgttaatatttctgaggagcctgcaacatgccagccactgtgatagaggctggcggatccaagcaaatggccaatgagatcattgtgaaggcaggggaatgtatgtgcacatctgttttgtaactgtttagatgaatgtcagttgttatttattgaaatgatttcacagtgtgtggtcaacatttctcatgttgaaactttaagaactaaaatgttctaaatatcccttggacattttatgtctttcttgtaaggcatactgccttgtttaatggtagttttacagtgtttctggcttagaacaaaggggcttaattattgatgttttcatagagaatataaaaataaagcacttatag

SEQ ID NO: 65221 - DNA, 1678 bp, Homo sapiens
cgccacgctctgcacagtctattttcggagcctagccagagacgggaaaactgaccaagataatggaatctgaaaatatggattctgaaaatatgaagacagaaaatatggaatctcaaaatgtagactttgagagtgtttcttcagttacagctctggaagccctctctaagctacttaatcctgaagaagaggatgattctgactatggacagacaaatggtttatctactattggagccatgggtcctgggaatattggaccaccccaaatagaagagctcaaagtcatccctgaaaccagcgaggaaaataatgaggacatctggaattcagaagagattccagaaggagcagaatatgatgatatgtgggatgttagagaaatcccagagtatgagattatattcagacagcaggtgggaactgaagatatatttttagggttgtcaaaaaaggactcctcaacaggttgttgcagtgaactagtggctaaaattaaattgccaaatacaaacccttctgatattcaaattgatatccaggaaacaatccttgaccttcgtactcctcagaagaagctgttgataactcttcctgagctggtggaatgtaccagtgccaaagcattctatatcccagagactgaaactcttgaaatcactatgactatgaaaagagagttagatattgctaatttcttctgaaactgcatgaaaaagataaaaagtagtaaaatggcattggtaacaattaaaaaactttgaaaaaaatgattgttttctatattctctttattattctgacatatttttgaaagggacaaaattcagttctagtgatattgtgaccatttacagtaatttctattactctgttaggaaatatgtttccttggccaggtgcaatggctcatgcctgtaatcccaacactttgggaggccgaagcaggcggatcacttgaggtcaggagtttgagaccagcctggtcaacatggcgaaaccctgtctctactaaaaatacgaaaattagcctggcgtggtggcaggtgcctgtaatcccagctactctgtctcaaaaaacaaacaaaaaaaggaaatatgttttcttatgtaaataaactattctatttttatagtgatagctgagtagaatctttacaggttaaaaaattagaatatttcatggtcaattacataattgaaatatgatcatgaaatggttggtccacttacttcagtagtctgaaaaacttatgctaattatttacatttacactgtgatacaatcagttgcatagcaattggtcattattattaccagagaattttatttggttgctttttcattgatttgagcaaatgatttacagtgttctctgtttaggctctcactgttgttctggaatatacaggtaataaatagtttgatgtaccatactatcaacatatttacttgagtaaggaacacttttgtgcgtacagtattatttggcttcttcagttgtgcttttaatgcttggatatagttaggttaaaaacattttttatatgcactaataattattagcattgcctttttgggtactgtatttatatgtagtcaattgaaatccttgactttaaaataaatttaaagtgtggcacatttaaaaaaaaaaaaaaaaaaaaaaaaaaa

SEQ ID NO: 65222 - DNA, 1993 bp, Homo sapiens
aggaagaaaatataaagtacacttttaaaacatgaagtcttcatagcagcttatagtcgttcagagaaacatgttccactgagaatgacttgagagagaggattacatcattatgccagaaggaagaagccactgtgcatgctctatcaccagcctcaccctcctggtcagccttacaagagtgacactggatatactccagaagttggacccaccacagcctgcacactggacttcttggcttttatgagctattcaagagatatttagtcatcacgttgtgtcacaatgggagtgactcacagagcaaggagagaacctgaggattcctcacacatgtagtactcagagctctacggaaacccaggcacctcgacctcaagaggatcagcctggccagggtggcacaactcttccttccccgtgcacagcaggaaagctgccatcagctgagcaagtccaccaacagtttctgtgtcccacttcatctttaataaggacaccatcttcttgtattatacaagaaaggagtgtacctatcacacacagggggaaaaatgctcttttgggtgctaggcctcctaatcctctgtggttttctgtggactcgtaaaggaaaactaaagattgaagacatcactgataagtacatttttatcactggatgtgactcgggctttggaaacttggcagccagaacttttgataaaaagggatttcatgtaatcgctgcctgtctgactgaatcaggatcaacagctttaaaggcagaaacctcagagagacttcgtactgtgcttctggatgtgaccgacccagagaatgtcaagaggactgcccagtgggtgaagaaccaagttggggagaaaggtctctggggtctgatcaataatgctggtgttcccggcgtgctggctcccactgactggctgacactagaggactacagagaacctattgaagtgaacctgtttggactcatcagtgtgacactaaatatgcttcctttggtcaagaaagctcaagggagagttattaatgtctccagtgttggaggtcgccttgcaatcgttggagggggctatactccatccaaatatgcagtggaaggtttcaatgacagcttaagacgggacatgaaagcttttggtgtgcacgtctcatgcattgaaccaggattgttcaaaacaaacttggcagatccagtaaaggtaattgaaaaaaaactcgccatttgggagcagctgtctccagacatcaaacaacaatatggagaaggttacattgaaaaaagtctagacaaactgaaaggcaataaatcctatgtgaacatggacctctctccggtggtagagtgcatggaccacgctctaacaagtctcttccctaagactcattatgccgctggaaaagatgccaaaattttctggatacctctgtctcacatgccagcagctttgcaagactttttattgttgaaacagaaagcagagctggctaatcccaaggcagtgtgactcagctaaccacaaatgtctcctccaggctatgaaattggccgatttcaagaacacatctccttttcaaccccattccttatctgctccaacctggactcatttagatcgtgcttatttggattgcaaaagggagtcccaccatcgctggtggtatcccagggtccctgctcaagttttctttgaaaaggagggctggaatggtacatcacataggcaagtcctgccctgtatttaggctttgcctgcttggtgtgatgtaagggaaattgaaagacttgcccattcaaaatgatctttaccgtggcctgccccatgcttatggtccccagcatttacagtaacttgtgaatgttaagtatcatctcttatctaaatattaaaagataagtcaaacattaaaaaaaaaaaaaaaaaaaaaaaaaaaaaaaaaaaaaaaaaaaaaaaaaaaaaaaaaaaaaaaaaaaaaaaaaaaa

SEQ ID NO: 65223 - DNA, 3811 bp, Homo sapiens
actggaaaactttgggtgtgagacgggattcaggctgtggctaatgtgctggaagcacgcacagttgtgaccatcaagtatgcaggaagcaatcattctcctggctctcctgggtgccatgtcagggggagaagcactacacctaatcctcttacctgctacaggcaatgtggcagagaattctccacctgggacttcagtgcacaagttttctgtgaagttatcagcatcattgtcacctgtgatcccaggatttccccagatagtcaactcaaatcccctcactgaagcttttagggtgaattggctgtcaggcacctactttgaggttgtcaccactgggatggaacaactagattttgaaacaggaccaaacatatttgatttgcagatttatgtgaaggatgaggttggtgtcacagacctgcaagtcctgactgtccaggtaacagatgtgaacgagccacctcagtttcaaggcaacttggcagaaggtctacacctctacatagtagaaagagcaaaccctggattcatttaccaggttgaggccttcgatccagaagacacaagccgaaacattcccctcagttatttcctgatttctcccccaaagagcttcagaatgtctgctaatggcaccctcttctccacaacagaattggactttgaagcaggacacagaagtttccatctcatcgtggaggtgagggacagtggaggcctcaaagcctccacagagctccaggtgaacatcgtgaacctcaacgacgaagtccctcgctttaccagcccgacacgagtgtacacagtcctggaggaactgagtccaggaaccatcgtggccaatatcacagcggaggatcctgatgatgaaggttttcccagccacctcctctacagcattaccactgttagcaaatatttcatgataaatcagttgactggtacaatccaagtggcccaaaggatagaccgagatgcaggtgaattgagacaaaatcccaccatttccctggaagttctagtgaaggacagaccatatgggggtcaggagaatcgcatccagataaccttcattgtggaagacgtcaacgacaatcctgccacatgccaaaagttcaccttcagcattatggtgccggaaagaacagccaaggggacgttgcttcttgacctaaacaagttctgctttgatgatgacagtgaggcaccaaacaacagattcaacttcaccatgccatctggagtggggagcggcagcagatttttacaggatccagctggctctgggaagattgtgctgattggtgatctagactacgaaaatccaagtaacctagcagccggcaataaatatacggtgataatccaggtgcaggatgtggcccccccttactataaaaataacgtctacgtttatatcctaacaagcccagaaaatgagtttcctctcatttttgataggccatcctatgtatttgatgtgtcagaaagaaggcccgccagaacccgagtgggacaggtgcgagccactgataaagacctcccccagagcagcctcctgtactccatctccactggaggggccagcctccagtatccaaatgtattttggattaatcccaagacaggagaactccagctggtaactaaagtggactgtgaaacaacccccatctatattctcagaatccaggccaccaacaacgaagacacaagctctgtcactgttactgtgaacatccttgaagaaaatgatgaaaagccaatttgtactccaaactcttatttcctggccctcccagtggatctgaaagttggcacaaatattcagaatttcaagctgacatgtaccgaccttgattccagccccagatctttccgttattccattggcccaggtaacgtcaacaatcatttcaccttctctcccaatgctggttccaatgtcacacgcctgctgcttacgtctcgctttgactatgctggtgggtttgataagatctgggactacaagctacttgtctacgtaactgatgacaacttgatgtctgacaggaagaaagcggaggctcttgttgagacaggaacagtgacactgagtattaaagtcattccccacccaaccactatcatcaccacgacccccaggcccagggtcacctatcaggtcctgaggaaaaacgtttactctccatctgcatggtacgtgccgtttgtcatcactttgggctccatattgcttctgggtctcctcgtgtacctggtcgtcctattggccaaagccatccacagacactgcccctgcaagactgggaagaacaaggaacctctgacaaagaaaggagaaacgaagactgcagagagagacgtcgtggtggaaactatccagatgaacactatctttgatggagaagccatagatccagtgaccggggaaacatatgaattcaactcaaaaactggagccagaaagtggaaagatccactaacccaaatgccaaaatggaaagagtccagccaccagggagctgccccacgcagagtcactgctggggaagggatggggtcactgagaagtgccaactgggaagaagatgagctgagtggcaaagcgtgggctgaggatgctggtctgggttccagaaatgagggtggcaagctgggcaacccaaagaacagaaatccagccttcatgaacagggcttaccccaaaccacacccaggaaagtaaacggggtctaaggaggggcctgtcaatcactgagatgctgcctcaccctaaattctatggggatggtgtgggcatggtgtaggggggaaaatgtgggctgaggggattcagacatccagggtcaaacatgggatgtttgacaaatttttaaacaaatagaaaggggtttgatcacatagttgcgtgttctgaaatgatacaggaacattttctatcagatttcagaactacctgtgcttctgataagcaagactgttaactttggggtgtggaattgttgtgtttcttctttgcattgactgctaggaagctctattctgttcaccatagaaagtttgtaggaattcctgacataaatagtgaagactatccttacatctggtttccaccttattttcctgccctcgttttaacatcacccagatttcttcagttataaatatgccatacacctttgtaagtcacctcaaatcttcttcaaaagaagcagaacagtgaaaaaaacagatgagtaagttaagagttggtcatctggaaagaagaaaactcagtaggcaccttcttttgttttttcttgtggtgtccggatcagcatcctgcatgtgagattcatccacgttgtcctgtctagcagtagttcagttctcttcatggttatgtctggtttcattctatgattatatcacaatttatctattctacacttgggtggcagctgcttcagatttttacttttaaaaaatatacttaaaagtgaactacaggcagggcatgatggctcatgcctgtaatgccagcactttgccaaggtgggcagatcacctaaggtcaggagttcaagatcagcctggcctagatggcaaaaccctgtctctactaaaaaatacaaaaattagcttggtgtggtggtgggcacatgtaatcccagctacttgggaggctgaggtagggagaactgcttaaacctgagaggtggaggttacagtgagttgagattgtgccactgcactctagcctgggtgacaaagcaagactccatctcagaaaaaaaaaataaaagtgaattacaacact

SEQ ID NO: 65224 - DNA, 2946 bp, Homo sapiens
agcggcggtgggaggagtgggggacctggagggaggtggtgaaatagaatggtcctgggggacgggactccaggggtttgacaattaggcgtcaagactgacttagacctgggaagaaaaccagaggcagtcgagcagagaggccaaacgccaggcagggcgaagtcagccggagatggagtggaaactggagcgcaccgcgcctcggagggtccgcacggaagaggagatgctgtgggaaagtatcatgcgtgtgctctccaaagacttgaagcagaagagaagtcaagattccgccaacgtactcgattcagttaatgctacgtattctgactttaagagcaactttgcgaagaggctgtccgcagaggttcctgttgcgagtagccccattaccacaaggtggcagcaaagtcaaactagggctctgtcctctgattcctttggggaagagcagtcaaccacctacctcccagaagcttccggatcagtgctgaagacaccgcctgagaaagagaccttgactctaggatcctgcaaagaacaactgaagacccccagcaaaggaatttctgaaacaagtaactctgctctccatttttgcaaggcacctcatgcaatggacagagactggaaagaaagtgttgcctcaaaagggcagaaatgcctaaaacaactctttgtaacccagaacgtggttcagcaggctaatggaaaaatgcagctctgtgagcaatccgaatgtgtttggaaaggctgcaaagatggagtcagagatgaatccttccatcttaaaagttctggtgatataaacgattccatactccaaccagaggtgaagattcatattactggtcttcgaaatgactactatctgaatatcctagattggagttttcagaatcttgttgccatagccctgggctctgctgtatacatctggaatggggagaaccacaatgggattgaaaacatagacttaagtctcacttgtaactatatctcttctgtgtcctggataaaagagggaacttgcctggcagttggcaccagcgagggagaagtgcaattatgggatgtggtaactaaaaagcggctgagaaatatgcttggtcatttgtcagtagttggggctctgagctggaatcactttatcctcagcagtgggtcaagactggggcgtgtttatcatcacgatgttcgggtagcccagcatcatgttggaacacttcgccacaagcaagctgtgtgtgctctgaagtggtcaccggatggcaggctgctttccagcggctgcagtgatggactgctgacaatatggccccacgatccaggtgccagtgcacagggccaaccgctgaaagtcataacccagtctacggcagtcaaggccatggattggtgtccctggcagtctggggtccttgccattggaggaggaatgaaggatggacgcttacacatcttggatataaatgctgggaagagcatccagaccccaagcacaaactcacagatttgttccttaatctggctacctaagacaaaggagattgcaactggtcaaggtactcccaagaatgatgtgactgtgtggacctgtcccactgtgtccaggtcaggccacaggggcagagtgctgcacctggctttgagtccagaccagacccgggtgttttctgctgcagctgatgggacggcctctgtatggaattgctactagcacccagcccctctaggtttcagtttccttatttctgagtgaagatgatgatgttggctatgtcttctccatggggtttttatgagtatcaaacaagttgaaatactcttcttgatgtgaatgcctgttctcctgttcttcttttgcagattgctttacttgctctgcttcccagagatccgcttcttttcttctctgctttcttctttctgcccctcttcctccccctcctcttcttcctcccattcttacccctttctagagattcattttcactactttattcagaataacatctatagcaaagatttctacttctttcccgtatgacttttctccccagctccaaacctcatatttctgattgcctcaggatagttcccttttgagatactttcctgtctttagctcaatctcaacacattgaaaacacaactcattcacttgaaaaacacttactaaaatctcactatatgctaggcagtatgttaagcatgcatattgctctctctaaaaatcagttctgtaggaatccctttcccctcctgatggtctcatccttatcctggtctcccactcagggaacctcctgattattctgctctgtgcttcctcagttcaccctttgctctcttttcttttgcttcacctagtcacatcctgtgtgcctgacagccagtctgctgtaattgtcttagaactgatcctcttgactccacaccactgctaggttgaacatctaaaagtcctgtgctgatcctctcagtcccctgctcatcaactctcaaggacaacctattaccaaacacctttgacctcaacctctggagtcctcagcccaggacttgaagttaggagatctttttttgccttggctctgccataaatacaccctgtaaccttggatgtgttgcaacatctgcaaggataggaatttgatcactgctaaggttccttcaaacttgatcagttcgctgttctgtcttttggatgttaattcacattcatctcctatattaagactttggctaagtcttgtgatttcttgccttattggagcttttcttctaatctgaattcttgcttctctctccttttcctttacacacccacacaagtcctaacctctccaggaagtgttttgaaatgatgttacctgggtttgagttcttggcattagcctgtatcatctatttggtattattatactattatagctgttt

SEQ ID NO: 65225 - DNA, 3099 bp, Homo sapiens
atggaaacgggacccagcgaagaacctagcggccgaaaagagtcccaggaaatgtgccccccgggattactggtatttgctggctcctcggaacaagatgccaacttggctaagcagttctggatctcggcgtcgatgtatccccctagcgaatctcagctggtgctgcgcagagacagcagtcagcgtctgccggtggcgcggcccaggaggagcagagggtctgaaaacagccactcctcgcagtcttttcaccttgcgagtaacaaaaatagagacatctttgccgaagccctaaagatacaggaatctgaggagaaagtaaagtatctccaaaagacaaggtctcactctgtcacccagaatgaagtgcagtggcatgatcatggctcactgcagcctcaactttctcggattcaggctaaaacaagagaagagattctccaactcttaagaaaacaaagagaagaaaggatctcgaaagaactgatttcccttccgtataaaccaaaagccaaagaacacaaagcagagtaagtttacctatgtcaaaaatattctctcacctttcaacttactgtgtagggaagcatttcttttttcttactttgccacttacccttaaatcttctagaaacccacccgtgtattacagatttcttgccttgaataaactttcttctccgcacagctattaaagcctgtgtacgaacttgtctgtctgtggaatatgcaagcataagttagtgcaaaatggaaagcagctcagccttgaagctctgtgcacattctctgtccctctcttctcaccctgggctatataatcacccatcatcatgccctcctgactccactgtcccctatccacacctggcccacttctttagtgaatcagcacgtgtttgtggctcaccagctctgagtgggctaaggttgctaaaactaagttcatgtagcaaactctcaatgataagggagtagccttatctctggaataatgttagagcaggactaggaacagtttaacagtctagaagagtttaaaggaaataagtaagcaacagttaatcactaacgcacccctaataagaaatctgtccgtttttgtattatgactaaaaaccaatgtggccaactcaacattaatatgacaaatatttattttcataccacattctgggagaaacagaaagtgatagaattttgatttttctctcattggtattgaggctaactgcctttaatgctgtcaaagtaacacccttaaggaagaaagaatatgtctactctaattttgtaaacttctggaaaaaaaaatagaaagatcatttaatcacctagctatattatctacacaatgctcagcaacctaatttctcgctttttagccagacgatttgacttagcttccacagatgaagcaaaactagcccaatcaagagtgacttaacgataccaatagtggatgaagactgctacttaaatagcatcaatagatacgtctgggtgccttagatttccgcatgtatttttacagaacattcctgctactacccatgctgactcacctaataataaaacatttcccggcttggacagataattctcttaataatttaaatgcttacttaattccttttgtaaactaactttgtcctacatcctgaagccttgaatttcattctattctgttgtgattatcttcctactattaacttcttctagctactcttctttttttttttgagacggagtctcgctctgtcacctaggctggagtgcagtggcgcgatctcagctcactgcaacctctgccacccaggttcaagcaattctcctgcctcagccttccaagtagctgggattacaggcgcccaccaccatgcccagctaatttttgtagttttagtagatacagggtttcaccgtcttggccaagctggtcttgaactcctgctcgtgatccacccatctcagcttcccaaagtgctgggattacaggcgtgagccaccatgcctggcctctagttactctttgtacattctttgggcaactaatcatgcattactctgtgcccatattttataattatttaactcttattattgctttcattatttaacttttctcatattttttgtattgtctgtaactatactgtaagctccatgaggaattgggtcacccaaagtgccagcatactgcttacatgttggacttcagaaaatatttataacaaaaagtttagttgaaaaatatcatgtaattcagtgttagccaatttagaaagtgatgtttgcatactatacattaatttataaactttaaaaactattctattagacacaattgtaaaataactcccctacatacacagactcccccttaccattcctccttcaacaggtcttcttagtataatccaggtccccttctgttagaaagaaggaaccggaaaatgtgttcatagtaaggttttagtagcaatatatttattatccatcccagaatatttgcattttaaaagaagtctgaataaataaaataatgggtaaaccaaagaaatcaattaccaatgatgaaatctcaggagtctgactctagaataaacaaaacatatttggggtaggagggctcctgtacctccaaaccacacttcacaatatcataaccacttctctcacatacaagtttatacttggttgcaaaacccaacacatagaatctacaacagtgaatttttattgggagaattttcaaaagttgttttcatgctacatcatgttcacaatggcggagttctgtgtattggaactgactgatattactaccaacaggaaagtggtatcagagtcagataaagaggaccaagaagaagtcaaaactttggactaatttgcttgacacatggcagaggatggctcacttataccttcactttggaaacaaccttctcttagatcaggatcattgagatcactggcaacattatagtagacaaagaaatacaagttaaatacgcagacttccaggaattttaccagttagtgagtacttgtgttaaaataaagaaataaaggttaaatatgcaggcttct

SEQ ID NO: 65226 - DNA, 2401 bp, Homo sapiens
ctgcgggactcagcgggccagagagcgcggcgggccacccccggctcagcccgtggatgctgaccgccccctcggagagtccccgcagacatggcggagagctggctgcgcctctcgggagccgggccggcggaggaggccgggccggagggcggcctggaggagcccgacgccctggatgacagcctgaccagcctgcagtggctgcaggaattctccattctcaacgccaaggcccccgccctgcccccggggggcaccgacccccacggctaccaccaggtgccaggttcagcggcgcccgggtcccccctggcggccgaccccgcctgcctggggcagccacacacgccgggcaagcccacgtcgtcgtgcacgtcgcggagcgcgcccccggggctgcaggccccaccccccgacgacgtggactacgccaccaatccgcacgtgaagcctccctactcgtatgccacgctcatctgcatggccatgcaggccagcaaggccaccaagatcaccctgtcggccatctacaagtggatcacggacaacttctgctacttccgccacgcagatcccacctggcagaattcaatccgccacaacctgtctctgaacaagtgcttcatcaaagtgcctcgggagaaggacgaaccaggcaaggggggcttctggcgcattgacccccagtacgcggagcggctactgagcggcgctttcaagaagcggcgactgccccctgtccacatccacccagcctttgcccgccaggccgcgcaggagcccagcgctgtcccccgggccgggccgctgacggtgaataccgaggcccagcagctgctgcgggagttcgaggaggccaccggggaggcgggctggggtgcaggcgagggcaggctggggcataagcgcaaacagccgctgcccaagcgggtggccaaggtcccgcggccccccagcaccctgctgcccaccccggaggagcagggtgagctggaacccctcaaaggcaactttgactgggaggccatcttcgacgccggcactctgggcggggagctgggtgcactggaggccctggagctgagcccgcctctgagccccgcctcacacgtggacgtggacctcaccatccacggccgccacatcgactgccctgccacctgggggccttcggtggagcaggctgccgacagcctggacttcgatgagaccttcctggccacatccttcctgcagcacccctgggacgagagcggcagtggctgcctgcccccggagcccctctttgaggctggggatgccaccctggcctccgacctgcaggactgggccagcgtgggggccttcttgtaagaggccaggccctgccccacctctggacagtgcccaagtcagggtccagaactgccccccaacacaggtccacagacaccccaccacctaggcaggggctgggccagggctccaaggcttgccccagaggccacatggccaccagccccagctgccatcagattcaagcccaggaggctgaaaacgagggcccaggaccagaatcgctgcctcctctccccagccccaccttgtacacacagtgtttcattgctccgcgtcttcccagccccagaaaccggctaaaggaccctgcaccatgagagccgaggcctggaggagcccgggtcaggctggggaggaacagaactgggccctcccagagcacctccgcttcccccctgcttccccaggtctctatccagagagagtccccaggtacaacaaatgctaattagatgacagcaaattaaccccctggaggcttctcctggcagagcctccctggggccggggcaggctgtggatggggcggagcagggcagaagatggactgggggagggggcagagagaggagaccaaaatgaggtggtggcacagggtggggcaaggagatcctctctaaggcctctggggtctttgcctggccccatccctagggggcggggaggggacgtaaatccctaatctttaagcccgacttgaggctgagagcagctggaagtttgggtttggtggtttgggggccggggcagccaagctgtatggggcaggacagacagactaatgtagtgagtgtagctgtagctgaggcttaactgggagggatgccgagcttgctggaactactgggaccaagaagcggggtaccccacgcccctgcctgcactcctcgggggcgtggggcgtgccttgctccacccggactccctgggctgcgtcccacatccaccctcctgccccgtggggcaatttaacctttttcatgaaagttatttacaatgaaaagtttttaaaaataaaatttttaaaaatctaaaaaaaaaaaaaaaaaaaaaaaaaaaa

SEQ ID NO: 65227 - DNA, 4639 bp, Homo sapiens
atgctgctaaacatcctgcaatgcataggacggcccccacagcaaagaatgatccggtccaagagtcaaagtgttgaagttgagaaagctttatcttgttcaccattgaaaataagcattgggtgttttgcaatggctacacaaactagtcatgtcttccatggtcaagaaaatatgtttctggaaaaccattgcattaggagaaacactggcagagattcaaagaagccactaaagcagaagaatatgaatggacttgggcaaaattcggacaatggattattggttacacatgttaaccagacacaggacttactgggaacctcttccttccctctctttccacttcacggtttgactctggcttttgtcttgcagaggctgcaggggagtgagacccagtcttcagattgggaggactctgaagactggctttcggctcacagtttaaaatgtcagaaactcaccttggctgacctgataagccagggcacagaagtgctggaggagggcaccaatgtcgtgcagaaaatatgtttctccacccagatcatccgccattttgagtcaaagctttctgacactattgaagtctatcaagagagaattcagtggctcacagaaaacagcaagaaggcatttggcctcatcaaaggggccagagtcagcatcctcatagatgtgtcagccatcagcagtggccctcagaaagaagagttccaaaaggacctcatgagcctcatcgatgagcagctgagccacaaggagaagctgtttgtcctgtcctttggcaccaatgccgggtccctctggccagaccccatggaagtcagcgcctccaccctccaggaacttaagctctgggtaaagacgctgcagcctgatggaggcagcaacctgctacaagctctgaagaagatcttcactctcaagggactggattccctggtggccatcatgagaagctgcccagatcagccttctgaaatcctgtctgactacatccagcagtccaccatgggaagagacctcatcatccacttcatcacctacagatgcgatgatcagatgccccctgctgtcctgaagaaccttgcagaagctgttaggggctactaccactgctacagcccaaagatggagcactacaccagccgggacatggatgagctcctggcagaaattcagaaggcccagagcctcctcagccacgtgcaagccctgcagcacagcagcccctgtgaggcgctcacctgcaccatggaggagatttccacagagattacaaatgggccactcataagcctcttgcctaaacccccaaagcatgacgctcctctcaccattgagtttccaaacttggacaagacttctgcagagtggcttaaggtcaatggtctgaaagccaagaaattaagtctatatcaggtcctggcacccaatgcattctctcctgtggaggaatttgtacctattctccagaaaacagtatcatcgaccatccatgagaaggcaatgatacaatttgaatggcacgacgggacagtgaagaacattcatgtggacccacccttcctctataagtaccagcaacagctcagcagagctatgcggatgtatgagaggcggattgagtggctctccctggccagcagaagaatctggggcacagtctgtgaaaaaagggtggttgtactgctcgatatctctgcgaccaattccatgtacattattcatatccagcactccctgcggctgctgctggaggagcagttatccaacaaggactgtttcaacctcatcgcgtttggaagcacaattgaaagctggaggcctgagatggttcccgtgagtcacaacaatttacaaagtgcctggcggtgggccctgaacctgcggtgtcggggcagcaggaacgttctcagcgccctgcggaaggctgtggaagtagacttcaaggacaaagacaaacaccaatcgcagggaatctacctcttcactgggggcatccccgaccaggacatgcctacactcagtgcctacatggctgaggcctgtggcggctgcgacctccagctgaacgtgtgtctcttctacgtgggcgagccaaagatggacaccacaccccctgcccgctatgccagtcacactgacacagccgccgcctacaaggaggtcacccgggctgcaggtggccgcttccactggtttggagacacaggcatttatgagagcgatgacatcaactccatcatgtctgagatggaaaaggctctcaactactcccaaaagtgtgccttcctcatggcctccctgaagaaccattcaggaaaagtactgggaagttcagccctcccgaaagaaaaaccaaagacacttcagctaagaagtcagcccaagaagctctgccctcccaggcccaccgtccccctgggggccagaatgagcattaaagatgaccctgacagagagaagagccccccgctgaaatctctgaaatggcgtccactcagtactgcggcccagccaacgaaagaagggatgatggaactgaggaggaagaccaagtcaagggaagcagagacatctcttttactgttctacacagagaaagggaatgacgtgggctcagtgtacaagaagtaccctcaaggaaggggcttgagaaggactagctcttctattgacttacccagaaaggatacagtttgctcaagccaagagtgggtggcaaaatatgggctcaaaaaattgaagctggagatttccagatgcatgggtcccaactgcactcatcaaaagtcaggacagaggtcagcatccgccaaacactgcagcatcttccccagcgttgagatccatggagtggtgagacacatccagtggacgcccagggagatggaggtgtacatcaggcacttggagaaggtgttaaggcgctatgtccagaggctgcagtggctgctgtccgggagccgccgactgtttggcaccgttttggagagcaaagtatgcatattgctggacacgtcagggtccatgggcccctacctgcagcaggtgaagacagagctggttttgctgatttgggaacagctgcggaagtgctgtgacagttttaacctgctcagctttgcagagagctttcagtcatggcaggacacgctggtggagaccacagatgcagcgtgtcatgaggctatgcaatgggtgacccacctgcaagctcagggcagcacctccatcttgcaagcattgctgaaagctttcagtttccatgatctggaaggattgtacctcctgaccgacggaaagccagacacaagctgcagccttgtcctaaatgaagtccaaaaactcagggagaaaagagatgtgaaagtgcacaccatttccttgaactgctcagacagagcggcggttgagttcctgagaaagctggcttccttcaccggcggacgctatcactgccctgtgggtgaggacacactctccaaaattcacagcctgctgaccaaaggcttcatcaatgaaaaggatcccacattgccaccatttgaaggagatgatttaaggatcctggcccaggagatcaccaaggccagaagcttcctctggcaggcccaatccttcagatcccaactccagaagaaaaatgatgcagaaccaaaggtcactctttcctagagaagtgttctcagaaaagtcatcctgcaaaggaccactcactgagcaaatctcagccccgagggcaggatgggatgaaatgctgtgacctgcaggaaacatgattcctggtaccaggactctctggaagctgaggaaggaaagactttgtcttttgtgtgaggggccattcccgggtcttaatctaactctccagccctgtcccgcagcgcactctactctccagccactagattgtccctctctgggaagccctaaaccaaccccctgcctaaatggtggtgcttcttgcaaaccaaccccctgcctgaacggtgcttcttgccccctctgcctggagactcctgctcatccatcaaggcacagctcaaatgacatcagctccctgggacctatctagagcgaggggcctccagtctttctcttgcagcatcctgaccacgcagacctctcgcactcagcactctatgtcacgccaccttgctcgctgatctaactcttctccttgatggtgagctccttcgggatgagactggtgtcccaggatctgcaggtccccagaagctgccacataggagacacatggtgaacagtgagcaggcggctgagctgtgagagcctagctctggaaagcagctgatggggtggtctccaccctggttcataagaggctaatgcagagtcacagtcagcccatcctgggggaagaagaaacaagtgagcctcagcaccaccctccatccctgcccaaccaaactgaagtgaaggctgctcatctgggttcattttctaaaattaaaaacaattaattttattctactaataggatcaacatgactttaactgtttgaagtgatcattggcgtgtgtgtgtgtgcataaatttttagtgacataaaactttattaaaagactcataccataataaagaatttcaataagaaaaagataa

SEQ ID NO: 65228 - DNA, 4639 bp, Homo sapiens
atgctgctaaacatcctgcaatgcataggacggcccccacagcaaagaatgatccggtccaagagtcaaagtgttgaagttgagaaagctttatcttgttcaccattgaaaataagcattgggtgttttgcaatggctacacaaactagtcatgtcttccatggtcaagaaaatatgtttctggaaaaccattgcattaggagaaacactggcagagattcaaagaagccactaaagcagaagaatatgaatggacttgggcaaaattcggacaatggattattggttacacatgttaaccagacacaggacttactgggaacctcttccttccctctctttccacttcacggtttgactctggcttttgtcttgcagaggctgcaggggagtgagacccagtcttcagattgggaggactctgaagactggctttcggctcacagtttaaaatgtcagaaactcaccttggctgacctgataagccagggcacagaagtgctggaggagggcaccaatgtcgtgcagaaaatatgtttctccacccagatcatccgccattttgagtcaaagctttctgacactattgaagtctatcaagagagaattcagtggctcacagaaaacagcaagaaggcatttggcctcatcaaaggggccagagtcagcatcctcatagatgtgtcagccatcagcagtggccctcagaaagaagagttccaaaaggacctcatgagcctcatcgatgagcagctgagccacaaggagaagctgtttgtcctgtcctttggcaccaatgccgggtccctctggccagaccccatggaagtcagcgcctccaccctccaggaacttaagctctgggtaaagacgctgcagcctgatggaggcagcaacctgctacaagctctgaagaagatcttcactctcaagggactggattccctggtggccatcatgagaagctgcccagatcagccttctgaaatcctgtctgactacatccagcagtccaccatgggaagagacctcatcatccacttcatcacctacagatgcgatgatcagatgccccctgctgtcctgaagaaccttgcagaagctgttaggggctactaccactgctacagcccaaagatggagcactacaccagccgggacatggatgagctcctggcagaaattcagaaggcccagagcctcctcagccacgtgcaagccctgcagcacagcagcccctgtgaggcgctcacctgcaccatggaggagatttccacagagattacaaatgggccactcataagcctcttgcctaaacccccaaagcatgacgctcctctcaccattgagtttccaaacttggacaagacttctgcagagtggcttaaggtcaatggtctgaaagccaagaaattaagtctatatcaggtcctggcacccaatgcattctctcctgtggaggaatttgtacctattctccagaaaacagtatcatcgaccatccatgagaaggcaatgatacaatttgaatggcacgacgggacagtgaagaacattcatgtggacccacccttcctctataagtaccagcaacagctcagcagagctatgcggatgtatgagaggcggattgagtggctctccctggccagcagaagaatctggggcacagtctgtgaaaaaagggtggttgtactgctcgatatctctgcgaccaattccatgtacattattcatatccagcactccctgcggctgctgctggaggagcagttatccaacaaggactgtttcaacctcatcgcgtttggaagcacaattgaaagctggaggcctgagatggttcccgtgagtcacaacaatttacaaagtgcctggcggtgggccctgaacctgcggtgtcggggcagcaggaacgttctcagcgccctgcggaaggctgtggaagtagacttcaaggacaaagacaaacaccaatcgcagggaatctacctcttcactgggggcatccccgaccaggacatgcctacactcagtgcctacatggctgaggcctgtggcggctgcgacctccagctgaacgtgtgtctcttctacgtgggcgagccaaagatggacaccacaccccctgcccgctatgccagtcacactgacacagccgccgcctacaaggaggtcacccgggctgcaggtggccgcttccactggtttggagacacaggcatttatgagagcgatgacatcaactccatcatgtctgagatggaaaaggctctcaactactcccaaaagtgtgccttcctcatggcctccctgaagaaccattcaggaaaagtactgggaagttcagccctcccgaaagaaaaaccaaagacacttcagctaagaagtcagcccaagaagctctgccctcccaggcccaccgtccccctgggggccagaatgagcattaaagatgaccctgacagagagaagagccccccgctgaaatctctgaaatggcgtccactcagtactgcggcccagccaacgaaagaagggatgatggaactgaggaggaagaccaagtcaagggaagcagagacatctcttttactgttctacacagagaaagggaatgacgtgggctcagtgtacaagaagtaccctcaaggaaggggcttgagaaggactagctcttctattgacttacccagaaaggatacagtttgctcaagccaagagtgggtggcaaaatatgggctcaaaaaattgaagctggagatttccagatgcatgggtcccaactgcactcatcaaaagtcaggacagaggtcagcatccgccaaacactgcagcatcttccccagcgttgagatccatggagtggtgagacacatccagtggacgcccagggagatggaggtgtacatcaggcacttggagaaggtgttaaggcgctatgtccagaggctgcagtggctgctgtccgggagccgccgactgtttggcaccgttttggagagcaaagtatgcatattgctggacacgtcagggtccatgggcccctacctgcagcaggtgaagacagagctggttttgctgatttgggaacagctgcggaagtgctgtgacagttttaacctgctcagctttgcagagagccttcagtcatggcaggacacgctggtggagaccacagatgcagcgtgtcatgaggctatgcaatgggtgacccacctgcaagctcagggcagcacctccatcttgcaagcattgctgaaagctttcagtttccatgatctggaaggattgtacctcctgaccgacggaaagccagacacaagctgcagccttgtcctaaatgaagtccaaaaactcagggagaaaagagatgtgaaagtgcacaccatttccttgaactgctcagacagagcggcggttgagttcctgagaaagctggcttccttcaccggcggacgctatcactgccctgtgggtgaggacacactctccaaaattcacagcctgctgaccaaaggcttcatcaatgaaaaggatcccacattgccaccatttgaaggagatgatttaaggatcctggcccaggagatcaccaaggccagaagcttcctctggcaggcccaatccttcagatcccaactccagaagaaaaatgatgcagaaccaaaggtcactctttcctagagaagtgttctcagaaaagtcatcctgcaaaggaccactcactgagcaaatctcagccccgagggcaggatgggatgaaatgctgtgacctgcaggaaacatgattcctggtaccaggactctctggaagctgaggaaggaaagactttgtcttttgtgtgaggggccattcccgggtcttaatctaactctccagccctgtcccgcagcgcactctactctccagccactagattgtccctctctgggaagccctaaaccaaccccctgcctaaatggtggtgcttcttgcaaaccaaccccctgcctgaacggtgcttcttgccccctctgcctggagactcctgctcatccatcaaggcacagctcaaatgacatcagctccctgggacctatctagagcgaggggcctccagtctttctcttgcagcatcctgaccacgcagacctctcgcactcagcactctatgtcacgccaccttgctcgctgatctaactcttctccttgatggtgagctccttcgggatgagactggtgtcccaggatctgcaggtccccagaagctgccacataggagacacatggtgaacagtgagcaggcggctgagctgtgagagcctagctctggaaagcagctgatggggtggtctccaccctggttcataagaggctaatgcagagtcacagtcagcccatcctgggggaagaagaaacaagtgagcctcagcaccaccctccatccctgcccaaccaaactgaagtgaaggctgctcatctgggttcattttctaaaattaaaaacaattaattttattctactaataggatcaacatgactttaactgtttgaagtgatcattggcgtgtgtgtgtgtgcataaatttttagtgacataaaactttattaaaagactcataccataataaagaatttcaataagaaaaagataa

SEQ ID NO: 65229 - DNA, 918 bp, Homo sapiens
atggcggtgccctgggaggaatatttccgactggctttgcaagagaaactgtctacaaagctgccagagcaggctgaggatcatgtcccaccagtactgcgtctcctggagaagaggcaagagctggtagatgcagaccaggccctgcaggcccagaaggaggtgttccgcaccaagacggcagccctgaaacagcgttgggaacagctggaacaaaaggagcgggagctaaagggatcgttcatccgctttgacaagtttttgcaggactccgaggcccggcgcaatcgcgcgctgcggagggcggcggaggagaggcaccaggcgggccgtcgggaggtggaggcgctgcgtctgtggacccagctccaggagctacggcgggaacacgcgcggctgcagcgccggcttaagcgcctggagccctgcgcgcgcctgctggagcaagcgctggagctgctgcccgggttccaagaggttccggagctggtggcgcgcttcgacggcctggccgagacgcaggcggcgctgaggctcagggagcgcgagcagctcgcggagctggaggcggcgcgagcgcggctgcagcagctgcgggacgcctggccggacgaggtgctcgcacagggccagcggcgggcacagctgcaggagcgcctggaggctgccagggagcgtacgctgcagtgggaatccaagtggattcagattcagaacacagcagcggagaagactctgctcctgggacgcagcaggatggctgtgctcaacctgttccagctagtgtgccagcatcaggggcagcctcccaccctggacatcgaggacacggagggacagctagagcacgaccagaccatctcttttcaaaatcaactctctgcccgtcaaggagaaaggctccacggagggacatga

SEQ ID NO: 65230 - DNA, 918 bp, Homo sapiens; identical to SEQ ID NO: 65229

SEQ ID NO: 65231 - DNA, 2572 bp, Homo sapiens
atggtcggacccagagaggttgtggaccctcggggcctgacccacgggacccattctcgcgagtccagcggcgacgcgcgaccgtcggcattccctttgccggtcatcatggtgctgctcaggctcctcgtgttcctctttgctccggtggtctctgacctctgcagcctgccctgctttataaatgtctctgagagccagggccctggcacagtccttcagtttttatccttcaactgctcctcctacacgcccacacccaccctggagttgctcaatgtccagccacccaccaccttcttcaacccacccagcttggctaggtggcaagggacctatgtgggcaagttgaccttgagcagctctgctcagttggatgccctgatggtgaaccactacaaggtgcagctgaagttcacatgtggcaaccatgtgatggagggctcactctctgtggatgtgcagcgggaccttagccatatccagtgtgctggtcaatttgccagcccagctggggaaatgattcaggtgccagagacagtcacacctggggctcggctgtacactctgctcctcccaggcctagaactccacggagcgcagatgagcattatcagtgcccaggacctgccacacttccctggacctttctccatcaatgagcaaggttggctgcaggcaccatcccagggcctcctaggccaggctcaaaaggtcttccagctgcaaatctcagtgtcctttggacaaaggcaaagctgccaagggatggtgatagtgaaggttttgcctgttccctccagccaggtctccttcctcgagcaggctcagaatatcaccatccctgagaatctggcccccggtagtgaggtggttcaggtccaggcccggggtgtcgacctgcgctatgaaatcctgtctccggtgcccagcccactcttctccattggtcgtgcagacggtgtggtccggaccaccacgcccctagagttagctcgcacctcaggcaccgcggtctccaggctgcaggtgaaggcctttgagcagggccagctgtgggccagtgccaagctcaatctcaccatgaatgtgcagctggtcaacctctggcctccacgctgcctcccagcgcttctggtgtcccaaatcccggagactgcacccgtgggcaccgtgctgaatactctcacttgcgaagatccggactctgttggtgccaccctggactacaagctgtggttccgcagctcttccaaccctgccagcctctgcctttatgacagagtccttgaggtgaatgccacactggactgtgacactcctggagcctgcttccagcatgcagcctccatcctggtgctcgatggtggccagccccagatgaccactgaggtgccggtactggtgatggtgacacccatcaacgagttctccccagcctgtgcccctcgcacgttccgggttcaggaggatgcggcgccccacactctactgggctccgtggtgggcacggatatggattaccctcatgacaacattgagtactacacctctggtggtcctaccacctttgctgtggaccgtctcagcggggaagttcacctcctgggacctttggactatgagcagcagaggctgtacaggctcactgtccttgtgattgaccatggccaagaccagaaccccaaccatcacctctcaggctcctgtaccattaccatcgaggttgaggatgtgaatgaccatgcccccgagtgtgagcccccatttcaggaactcaccatctatgctcctctgggccgtagcgtggaggtgaccaagatgtcatgccagatccctcaggagccacagcgcctgatctactcctatagcatcgtgggagggaatagccagaaccgattcatcctgcaaggggccatcctggtgcacagtgaccttgtgttggggccgttctggccagagcagccccgtacctatgagctactgatctgtgtggccgatgcaggcccctccaccccccacctcagcaccacagccaccattattgtgcatctagttccccggagggccagcacagtggccaccagcacccacagaaccacagtgccctcaacgatgacacccatgctcgtgacagacacagaggctttctggcagccacagccctggtttgtggtggtgttgacagcaactggtgctcttctcctcttggccctaggctggcttcttggcaggctcctccaggggttggcccagctgctgcaagcacccagcaaaccagcccaggctttgctgctaaacagcatccagggaactgagggatccatcgagggtttcctggaggcaccgaagatggagatgtcccaggcacccagcagtgtcatgagtctgcagcattttgatggcagagcacaggactcccgtaccggaagagactacctgtttaacacacacacaggagcccggcgctggctctgaggccaagtagctgtcttactatgtgtggaatttctttttcacaccatcatgggctgtattttcaagttgattcataataaacaaaattacaaaa

SEQ ID NO: 65232 - DNA, 1416 bp, Homo sapiens
atgcaactttttaccatcgtcccttattacaagctctttgaggttgagaacagctgccacatccttactccctcctcagctctccaattttgcttccagccagtctataccttacttttcagccacaaagatattgctactcagagtgtgggctgttctcacatttcaatgcactcacctggagggcttaccacaacaaagatggccggacccctgcccagagtttcagattctttgttttctgccatggaattggccaaaatgtcagacatgacaaagcttcaccaagctgtggctgcaggagactacagcttagtgaagaagattttgaagaaaggtctctgtgacccaaactacaaagatgtagactggaatgaccggaccccacttcactgggctgcaatcaaagggcaaatggaggtgatacggctcctgatagaatatggagccaggccctgcctggttactagtgtgggctggaccccagctcattttgcagcagaagcaggccatctgaatatactcaaaactctccatgcattgcacgctgccatcgacgcccctgacttctttggagacacaccgaagaggattgcacagatctatggacagaaagcctgtgtggcatttctggaaaaggcagagcccgagtgccaggaccaccgttgcgctgcccagcagaaggggctgcctctggatgagcgtgatgaagactgggatgccaagaaaagggagctggagctgtctcttccttccctaaatcaaaacatgaataaaaagaataagaaaagtcgaggccccaccaggcccagcaataccaaggggaggagagtatgagaactcaaccttatgttttctggcaaggaactttccctggtgccagaaatgaggctgttaggcatggtggcctttccatgactttactcatagacccttacccacctggcttctgcccatggacctgtcattaggtgctgtccacatgggctgttgtttcctggctagcacctactgtgtacaataattaccgggaaaggacaaaacctgcttgcattttgtcatcagtggtttgcacagtcagcatcttttgacccctgccccccaacaataatagaatttcaggagacaaggaaactctggcatgaattaacttcatccctgataacgatcgagagataatgtaaaataatgaacatgtgattataggtctactttttcaactgtaaatttgggaaaattaaattcagatcagataattccaataaaaaattgcatccaaattgagatgcaaaatacacattagatttcaaacacttagtacaaaaatataaaatgtctccttaataatacttaatattgattccacattgaaatgataatattttggatattgcgttgaataagatatattaccaa

SEQ ID NO: 65233 - DNA, 1416 bp, Homo sapiens; identical to SEQ ID NO: 65232

SEQ ID NO: 65234 - DNA, 553 bp, Homo sapiens
agggcgcgtggcagcccaaggccatggcgggacacccaaaagagaaggtgattccagatgaggtccatcagaaccagatcttgcgggaactgtacctcaaggagctacgaacccagaaactctacacgcagtatcacgtgaatcccctccgcaagattcatacagtcaccaggaagcccatgtcttggcatgataacctggaggaacctgcagatgccaggtttctgaatctcattcaccatgctgcccagggaccaaggaagaagtacccagagacacagactgaaaaccaggaagttggatgggacttagagcccttggtaagcgtggctccttcctcaggaaatacgaggaaacacagcagcaatatcaacccagaacgccatgaccgcaggctgaatcacttcagggtctgcagtgacatcactctgtacaaggctaaaacgtggggcttaggagatgatcaccacaagtagcatcccagcggatgagcccatctgtggatctaatgccttaagtgtgcacagcccagagaaataaaatactactttaa

SEQ ID NO: 65235 - DNA, 485 bp, Homo sapiens
tgcatgaggttctctacgtttgagactggcttctccacggaacttggtctgtagccacagagcaaactgcagggccattgacagagaatgaagaggagagtgaagagtggaacacatctaatgtgttctctggaggttcatacagtcaccaggaagcccatgtcttggcatgataacctggaggaacctgcagatgccaggtttctgaatctcattcaccatgctgcccagggaccaaggaagaagtacccagagacacagactgaaaaccaggaagttggatgggacttagagcccttgatcaacccagaacgccatgaccgcaggctgaatcacttcagggtctgcagtgacatcactctgtacaaggctaaaacgtggggcttaggagatgatcaccacaagtagcatcccagcggatgagcccatctgtggatctaatgccttaagtgtgcacagcccagagaaataaaatactactttaa

SEQ ID NO: 65236 - DNA, 553 bp, Homo sapiens; identical to SEQ ID NO: 65234

SEQ ID NO: 65237 - DNA, 485 bp, Homo sapiens
tgcatgaggttctctacgtttgagactggcttctccacggaacttggtctgtagccacagagcaaactgcagggccagtgacagagaatgaagaggagagtgaagagtggaacacatctaatgtgttctctggaggttcatacagtcaccaggaagcccatgtcttggcatgataacctggaggaacctgcagatgccaggtttctgaatctcattcaccatgctgcccagggaccaaggaagaagtacccagagacacagactgaaaaccaggaagttggatgggacttagagcccttgatcaacccagaacgccatgaccgcaggctgaatcacttcagggtctgcagtgacatcactctgtacaaggctaaaacgtggggcttaggagatgatcaccacaagtagcatcccagcggatgagcccatctgtggatctaatgccttaagtgtgcacagcccagagaaataaaatactactttaa

SEQ ID NO: 65238 - DNA, 1727 bp, Homo sapiens
atgctgagtgccagggctactgttccacagggaggggctggggagggctgcctgtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaaggagaagctgatgccatgagtttggatggaggatatgtgtacactgcaggcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttgatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgcctggctgagaatgctggagacgttgcatttgtgaaagatgtcactgtcttgcagaacactgatggaaataacaatgacgcatgggctaaggatttgaagctggcagactttgcgctgctgtgcctcgatggcaaacggaagcctgtgactgaggctagaagctgccatcttgccatggccccgaatcatgccgtggtgtctcggatggataaggtggaacgcctgaaacaggtgttgctccaccaacaggctaaatttgggagaaatggatctgactgcccggacaagttttgcttattccagtctgaaaccaaaaaccttctgttcaatgacaacactgagtgtctggccagactccatggcaaaacaacatatgaaaaatatttgggaccacagtatgtcgcaggcattactaatctgaaaaagtgctcaacctcccccctcctggaagcctgtgaattcctcaggaagtaaaaccgaagaagatggcccagctccccaagaaagcctcagccattcactgcccccagctcttctccccaggtgtgttggggccttggcctcccctgctgaaggtggggattgcccatccatctgcttacaattccctgctgtcgtcttagcaagaagtaaaatgagaaattttgttgatattctctcct

SEQ ID NO: 65239 - DNA, 1246 bp, Homo sapiens
gcctaggagggagcccgccggggcggggcggggccgggtgcccatgaacagcggggtcccggccacgctggccgtgcggagagtgaaattcttcggccagcacggcggggaggtcaactcttctgccttctcccctgatggccagatgctgctcacaggctcagaagatggctgcgtgtatggctgggagacccggagtgggcagctgctgtggaggctgggtggccacacaggccccgtgaagttctgccgcttctcccctgatggccacctcttcgccagcgcctcctgtgactgcactgtccgcctgtgggatgtggcaagagcgaagtgtctgcgggtcctgaagggtcaccaacggagtgtggagacggtcagcttcagccctgactcgagacagctggcatcaggtggctgggacaagcgggtgatgctctgggatgtgcagtccggccagatgctgcgcctcttagttgggcaccgtgactccatccagagcagcgacttctcacccacggtgaactgcctggccaccggctcctgggactccaccgtacacatctgggacctgcggatggtgaccccagcagtctcccaccaggcgctagagggacacagtgccaacatcagctgcctgtgctattcagcatccggcctcctggcatccggctcctgggacaagaccatccacatctggaagcccacaaccagcagcctgcttatccaactgaagggccatgtcacctgggtgaagagcatagccttctctcccgacgagctgtggctggccagcgccggctattcccgcatggtcaaagtctgggactgcaacacaggaaagtgccttgagaccctgaagcagggagtcctggatgtggcccacacctgtgccttcaccccagatgggaaaatcttagtgtctggagctgccgatcagactagacgtcaaatatcccgcacgtccaaatcacccagggaccctcaaacctaacaccaaccaccttagatggtgccgacctcacccgctcccctcagtggcgcacaggcatgccgcttctccccacagacgcaaagtgactgtgctggcatccagcagatccccatggccaggactctccaggccccaccagagcagacaactgtggtgggcaggacgcttgctggaacccatcagacacctggtccccaaaaccagacccacccacctccacccaatcagtggaagtgccaggaaacaaagcagtct

SEQ ID NO: 65240 - DNA, 1448 bp, Homo sapiens
gacccggagtgggcagctgctgtggaggctgggtggccacacaggccccgtgaagttctgccgcttctcccctgatggccacctcttcgccagcgcctcctgtgactgcactgtccgcctgtgggatgtggcaagagcgaagtgtctgcgggtcctgaagggtgagtgagctgggagccaagcagccaggccagcgttccctttcagatggtgctgtgtcctgtgtcacgtcacctttccaccttccccgaccccgggctggtgcctgcaggtcaccaacggagtgtggagacggtcagcttcagccctgactcgagacagctggcatcaggtggctgggacaagcgggtgatgctctgggatgtgcaggtacgttgaggggctggggccaccagtctgggattcaaggaccagttccagagaggatgtcaccagtcttgccctcccagctcaaaccctccactggttcccatggcccatgcccacagcaggcaaccaaggctgcccccacctggccacagccgcctctccaggcttccttgcacacagcagccctcaggctttttgcacgaggtccccctttcctggactgtcaaggccaggtagccggctgccctctgctgccttctgcagctcagggctctctctagtccggccagatgctgcgcctcttagttgggcaccgtgactccatccagagcagcgacttctcacccacggtgaactgcctggccaccggctcctgggactccaccgtacacatctgggacctgcggatggtgaccccagcagtctcccaccaggcgctagagggacacagtgccaacatcagctgcctgtgctattcagcatccggcctcctggcatccggctcctgggacaagaccatccacatctggaagcccacaaccagcagcctgcttatccaactgaagggccatgtcacctgggtgaagagcatagccttctctcccgacgagctgtggctggccagcgccggctattcccgcatggtcaaagtctgggactgcaacacaggaaagtgccttgagaccctgaagcagggagtcctggatgtggcccacacctgtgccttcaccccagatgggaaaatcttagtgtctggagctgccgatcagactagacgtcaaatatcccgcacgtccaaatcacccagggaccctcaaacctaacaccaaccaccttagatggtgccgacctcacccgctcccctcagtggcgcacaggcatgccgcttctccccacagacgcaaagtgactgtgctggcatccagcagatccccatggccaggactctccaggccccaccagagcagacaactgtggtgggcaggacgcttgctggaacccatcagacacctggtccccaaaaccagacccacccacctccacccaatcagtggaagtgccaggaaacaaagcagtct

SEQ ID NO: 65241 - DNA, 2096 bp, Homo sapiens
aagagttctggtatttactgaagttaactattgaattaccaaaaccaaccacaatgccagaaatacagtgcgaccttggcaagcatgtcactcagatcattcctttagttaattgtacgcatgaaaccttaaaattgcaagtaacaaacagtaatcctgaaaattttgtcctggatattaacagaaaatcacaactgatcatatctcctcactccaccacagaattacctgttctcttttatccttctgcacttggaagagctgatcatcaagcttgcatcaacttctactgtactcagtttacagaatggaaattctacttatctggagtaggactatttccccagcctctagacacggaaagaataaccacacgcattggtcttcagtcaactattgttatacctttcaaaaatcccacaatggaagatgtcctcattgatataatactgacaagtgtggaacatcccaggaatcttgtcatggatcattgctgggatagcttcatctatgagagttctgccttcagatttagttctccgagtgaaatacaaggaattgcactgcctcctaaaggaaatatagatatctcattgttatttatacctcaaattatgaaattacacaaaacaatggttattattgagatgacgaaagcaaatggaaaatattggcctattgacaattttgatgagttggatataaaatttaaaagtattgtgggaatcgacagcgaagaaatccaagcaatacactggatataccctattgttggactcccacaagcaccacctcctaaatctcccccagttgtcatacaatgtcagtccaggaagcgggcagaagagaaggtagaaatcatactgaatgctggttttttcggatttagtcttactccagatctgacagaagttttagtgattccaaaaagaaattcacataatttttgtgaggatcccaatgaaattcctaaaatacatgaattcgagtatgaaattcaatttgaatctgaagctatgaagtctaagttggaatcctgtgtagctttatatatgattgaaaaatcttatgatattatggctaaaaggataacatttatcttcaatctggtattcacaccaaagaaaccattaaggtctcacataacactgaaaatagagtgcgtaacagaagggatctggaagtttcccataatgttgatcgctactgaacctgatacggatgctgtcattgacattgaaggagttggtttatttaaggaatctgtttttgaacttaggctgaaaagtcagacaagaaatcctgagccgttcaccgcacacttcctacctggcagcgatctggagttttttgtaaaacctcaggctggagaacttcttccttttaacacaaacggaactctcatcactgtaggatttaaacctaaaatgtactgtaggaaatataaagcaacattagtaatacagacagaagaaatgtactggaagtatgagatcaatggattaactccaactaccgtgccaccaaaaaatgcaaaagccaaaattgatgctactcacaagacacatgacaacatgccagtccgtccacataattttgtccgtgaaaatactaaactcataagaacaggggtgtcttccaccatcaagggtgctcctttggtgaagaatcaataaaatttttttccaaaatatttcttggtctcaggtagaactttgatgactattatttcatcttttggaatatttctgaggaataatggtttaattataataggccttctatatttccttgtcttttaaaattcaatctgttctctgaatatattatacttcatttgtgagttatgaatgttttttggttgcgaacattggaattggttcacttttaaagtgcaggtgtatatttgtggtaaaacgaaatataatttaaatgacaacagtatttccaataacagcgttgctaataaagctaaatgtctcatgtagatattccttgttagtctttatgttttaattgacaactaaacattgtatatatttatggtatacaacatattttgaaatatgcatacattgcagcatggttagcctgag

SEQ ID NO: 65242 - DNA, 965 bp, Homo sapiens
ctaaaatacatgaattcgagtatgaaattcaatttgaatctgaagctatgaagtctaagttggaatcctgtgtagctttatatatgattgaaaaatcttatgatattatggctaaaaggataacatttatcttcaatctggtattcacaccaaagaaaccattaagaaatcctgagccgttcaccgcacacttcctacctggcagcgatctggagttttttgtaaaacctcaggctggagaacttcttccttttaacacaaacggaactctcatcactgtaggatttaaacctaaaatgtactgtaggaaatataaagcaacattagtaatacagacagaagaaatgtactggaagtatgagatcaatggattaactccaactaccgtgccaccaaaaaatgcaaaagccaaaattgatgctactcacaagacacatgacaacatgccagtccgtccacataattttgtccgtgaaaatactaaactcataagaacaggggtgtcttccaccatcaagggtgctcctttggtgaagaatcaataaaatttttttccaaaatatttcttggtctcaggtagaactttgatgactattatttcatcttttggaatatttctgaggaataatggtttaattataataggccttctatatttccttgtcttttaaaattcaatctgttctctgaatatattatacttcatttgtgagttatgaatgttttttggttgcgaacattggaattggttcacttttaaagtgcaggtgtatatttgtggtaaaacgaaatataatttaaatgacaacagtatttccaataacagcgttgctaataaagctaaatgtctcatgtagatattccttgttagtctttatgttttaattgacaactaaacattgtatatatttatggtatacaacatattttgaaatatgcatacattgcagcatggttagcctgag

SEQ ID NO: 65243 - DNA, 1186 bp, Homo sapiens
cagtctctggggtggtgaggcccacccagtgtggagctcaaaggtgccactgttctgctcctctttataaagggagctgccatggttctcccagcacagagttgggagtgactccagagcctccagcaagatgctactgattctgctgtcggtggccctgctggccctgagctcagctcagagcttaaatgaagatgtcagccaggaagaatctccctccgtaatatcaggaaagccagaaggacgacgcccacaaggaggaaaccagccccaacgtaccccacctcctccaggaaagccagaaggacgacccccacaaggaggcaaccagtcccaaggtcccccacctcgtccaggaaagccagaaggaccacccccacaaggaggaaaccagtcccaaggtcccccacctcgtccgggaaagccagaaggacaacccccacaaggaggaaaccagtcccaaggtcccccacctcgtccgggaaagccagaaggaccacccccacaaggaggaaaccagtcccaaggtcccccgcctcgtccgggaaagccagaaggaccacccccacaaggaggaaaccagtcccaaggtcccccgcctcgtccgggaaagccagaaggaccacccccacaaggaggaaaccagtcccaaggtcccccacctcgtccgggaaagccagaaggaccacccccacaaggaggaaaccagtcccaaggtcccccacctcgtccgggaaagccagaaggaccacccccacaaggaggaaaccagtcccaaggtcccccacctcgtccaggaaagccagaaggatcaccttcacaaggaggcaacaaacctcaaggtcccccacctcatccaggaaagccacaaggaccacccccacaagaaggtaacaaacctcaacgtccccctcctccaggaaggccacaaggaccacccccaccaggaggcaatccccagcagcctctgccacctcccgctggaaagccccagggaccacctccacctcctcaagggggcagaccacacagacctccccagggacagcctccccagtaatcaaggttcaatgacaggaagtgaacaagaagatgacagtgattcaaatgattcaaatgccatgacattggaagaaggtggtcatagctctacctttaatataccaataaaataaacagcttacaa

SEQ ID NO: 65244 - DNA, 745 bp, Homo sapiens
cagtctctggggtggtgaggcccacccagtgtggagctcaaaggtgccactgttctgctcctctttataaagggagctgccatggttctcccagcacagagttgggagtgactccagagcctccagcaagatgctactgattctgctgtcggtggccctgctggccctgagctcagctcagagcttaaatgaagatgtcagccaggaagaatctccctccgtaatatcaggaaagccagaaggacgacgcccacaaggaggaaaccagccccaacgtaccccacctcctccaggaaagccagaaggacgacccccacaaggaggcaaccagtcccaaggtcccccacctcgtccaggaaagccagaaggatcaccttcacaaggaggcaacaaacctcaaggtcccccacctcatccaggaaagccacaaggaccacccccacaagaaggtaacaaacctcaacgtccccctcctccaggaaggccacaaggaccacccccaccaggaggcaatccccagcagcctctgccacctcccgctggaaagccccagggaccacctccacctcctcaagggggcagaccacacagacctccccagggacagcctccccagtaatcaaggttcaatgacaggaagtgaacaagaagatgacagtgattcaaatgattcaaatgccatgacattggaagaaggtggtcatagctctacctttaatataccaataaaataaacagcttacaa

SEQ ID NO: 65245 - DNA, 9172 bp, Homo sapiens
atggaaacttttgaaaacatcagggctgctgggggcaagatgtgctgggcaccaaagagcatagagtgccgggcggagaactaccccgaggtaagcatcgaccaggtcgggcaggtgctgacctgcagcctggagacggggctgacctgcaagaacgaagaccagacaggcaggttcaacatgtgcttcaactacaacgtgcgtgtgctttgctgtgacgactacagccactgccccagtaccccagccaccagctccacggccacgccctcctcaactccggggacgacctggatcctcacaaagccgaccacaacagccactacgactgcgtccactggatccacggccaccccgacctccaccctgagaacagctccccctcccaaagtgctgaccaccacggccaccacacccacagtcaccagctccaaagccactccctcctccagtccagggactgcaaccgcccttccagcactgagaagcacagccaccacacccacagctaccagcgttacacccatcccctcttcctccctgggcaccacctggacccgcctatcacagaccaccacacccacggccaccatgtccacagccacaccctcctccactccagagactgcccacacctccacagtgcttaccaccacggccaccacaactggggccaccggctctgtggccaccccctcctccaccccaggaacagctcacactaccaaagtgctgactaccacaaccacgggcttcacagccaccccctcctccagcccagggagggcacgcacgcttccagtgtggatcagcacaaccaccacacccacaaccagaggctccacggtgaccccctcctccatcccggggaccacccacacccccacagtgctgaccaccaccaccacaactgtggccactggttctatggcaacaccctcctctagcacacagaccagtggtactcccccatcactgaccaccacggccactacgatcacggccaccggctccaccaccaacccctcctcaactccagggacaacacctatccccccagtgctgaccaccaccgccaccacacctgcagccaccagcagcacagtgactccctcctctgccctagggaccacccacacacccccagtgccgaacaccacggccaccacacacgggcgatccctgtcccccagcagtccccacacggtgcgcacagcctggacttcggccacctcaggcaccttgggcaccacccacatcacagagccttccacggggacttcccacaccccagcagcaaccaccggtaccacccagcactcgactccagccctgtccagccctcaccctagcagcaggaccaccgagtcacccccttctccagggacgaccaccccgggccacaccagggccacctccaggaccacggccacggccacacccagcaagacccgcacctcgaccctgctgcccagcagccccacatcggcccccataaccacggtggtgaccatgggctgtgagccccagtgtgcctggtcagagtggctggactacagctaccccatgccggggccctctggcggggactttgacacctactccaacatccgtgcggccggaggggccgtctgtgagcagcccctgggcctcgagtgccgtgcccaggcccagcctggtgtccccctgcgggagttgggccaggtcgtggaatgcagcctggactttggcctggtctgcaggaaccgtgagcaggtggggaagttcaagatgtgcttcaactatgaaatccgtgtgttctgctgcaactacggccactgccccagcaccccggccaccagctctacggccacgccctcctccactccagggacgacctggatcctcacagagcagaccacagcagccactacgaccgcaaccactggatccacggccatcccgtcctccaccccgggaacagctccccctcccaaagtgctgaccagcacggccaccacacccacagccaccagttccaaagccacttcctcctccagtccaaggactgcaaccacccttccagtgctgacaagcacagccaccaaatccacagctaccagctttacacccatcccctccttcacccttgggaccaccgggaccctcccagaacagaccaccacacccatggccaccatgtccacaatccacccctcctccactccggagaccacccacacctccacagtgctgaccacgaaggccaccacgacaagggccaccagttccatgtccaccccctcctccactccggggacgacctggatcctcacagagctgaccacagcagccactacaactgcagccactggccccacggccatgccctcctccactccggggacgacctggatcctcacagagctgaccacaacagccactacgactgagtccactggatccacggccaccccgtcctccaccccagggaccacctggatcctcacagagccgagcactacagccaccgtgacggtgcccaccggatccacggccaccgcctcctccacccaggcaactgctggcaccccacatgtgagcaccacggccacgacacccacagtcaccagctccaaagccactcccttctccagtccagggactgcaaccgcccttccagcactgagaagcacagccaccacacccacagctaccagctttacagccatcccctcctcctccctgggcaccacctggacccgcctatcacagaccaccacacccacggccaccatgtccacagccacaccctcctccactccagagactgcccacacctccacagtgcttaccaccacggccaccacaaccagggccaccggctctgtggccaccccctcttccaccccaggaacagctcacactaccaaagtgccgactaccacaaccacgggcttcacagtcaccccctcctccagcccagggacggcacgcacgcctccagtgtggatcagcacaaccaccacacccacaaccagtggctccacggtgaccccctcctccgtcccggggaccacccacacccccacagtgctgaccaccaccaccacaactgtggccactggttctatggcaacaccctcctctagcacacagaccagtggtactcccccatcactgatcaccacggccactacgatcacggccaccggctccaccaccaacccctcctcaactccagggacaacacctatccccccagtgctgaccaccaccgccaccacacctgcagccaccagcagcacagtgactccctcctctgccctagggaccacccacacacccccagtgccgaacaccacggccaccacacacgggcgatccctgtcccccagcagtccccacacggtgcgcacagcctggacttcggccacctcaggcaccttgggcaccacccacatcacagagccttccacggggacttcccacaccccagcagcaaccaccggtaccacccagcactcgactccagccctgtccagccctcaccctagcagcaggaccaccgagtcacccccttctccagggacgaccaccccgggccacaccagggccacctccaggaccacggccacggccacacccagcaagacccgcacctcgaccctgctgcccagcagccccacatcggcccccataaccacggtggtgaccatgggctgtgagccccagtgtgcctggtcagagtggctggactacagctaccccatgccggggccctctggcggggactttgacacctactccaacatccgtgcggccggaggggccgtctgtgagcagcccctgggcctcgagtgccgtgcccaggcccagcctggtgtccccctgggggagttgggccaggtcgtggaatgcagcctggactttggcctggtctgcaggaaccgtgagcaggtggggaagttcaagatgtgcttcaactatgaaatccgtgtgttctgctgcaactacggccactgccccagcaccccggccaccagctctacggccatgccctcctccactccggggacgacctggatcctcacagagctgaccacaacagccactacgactgcatccactggatccacggccaccccgtcctccaccccgggaacagctccccctcccaaagtgctgaccagcccggccaccacacccacagccaccagttccaaagccacttcctcctccagtccaaggactgcaaccacccttccagtgctgacaagcacagccaccaaatccacagctaccagcgttacacccatcccctcctccacccttgggaccaccgggaccctcccagaacagaccaccacacccgtggccaccatgtccacaatccacccctcctccactccggagaccacccacacctccacagtgctgaccacgaaggccaccacgacaagggccaccagttccacgtccaccccctcctccactccggggacgacctggatcctcacagagctgaccacagcagccactacaactgcagccactggccccacggccaccccgtcctccaccccagggaccacctggatcctcacagagctgaccacaacagccactacgactgcgtccactggatccacggccaccccgtcctccaccccagggaccacctggatcctcacagagccgagcactacagccaccgtgacggtgcccaccggatccacggccaccgcctcctccacccaggcaactgctggcaccccacatgtgagcaccacggccacgacacccacagtcaccagctccaaagccactccctcctccagtccagggactgcaactgcccttccagcactgagaagcacagccaccacacccacagctaccagctttacagccatcccctcctcctccctgggcaccacctggacccgcctatcacagaccaccacacccacggccaccatgtccacagccacaccctcctccactccagagactgtccacacctccacagtgcttaccgccacggccaccacaaccggggccaccggctctgtggccaccccctcctccaccccaggaacagctcacactaccaaagtgccgactaccacaaccacgggcttcacagccaccccctcctccagcccagggacggcactcacgcctccagtgtggatcagcacaaccaccacacccacaaccaccacacccacaaccagtggctccacggtgaccccctcctccatcccggggaccacccacaccgccagagtgctgaccaccaccaccacaactgtggccactggttctatggcaacaccctcctctagcacacagaccagtggtactcccccatcactgaccaccacggccactacgatcacggccaccggctccaccaccaacccctcctcaactccagggacaacacccatcaccccagtgctgaccagcacggccaccacacccgcagccaccagctccaaagccacttcctcctccagtccaaggactgcaaccacccttccagtgctgacaagcacagccacaaaatccacagctaccagctttacacccatcccctcctccaccctgtggaccacgtggaccgtcccagcacagaccaccacacccatgtccaccatgtccacaatccacacctcctctactccagagaccacccacacctccacagtgctgaccaccacagccaccatgacaagggccaccaattccacggccacaccctcctccactctggggacgacccggatcctcactgagctgaccacaacagccactacaactgcagccactggatccacggccaccctgtcctccaccccagggaccacctggatcctcacagagccgagcactatagccaccgtgatggtgcccaccggttccacggccaccgcctcctccactctgggaacagctcacacccccaaagtggtgaccaccatggccactatgcccacagccactgcctccacggttcccagctcgtccaccgtggggaccacccgcacccctgcagtgctccccagcagcctgccaaccttcagcgtgtccactgtgtcctcctcagtcctcaccaccctgagacccactggcttccccagctcccacttctctactccctgcttctgcagggcatttggacagtttttctcgcccggggaagtcatctacaataagaccgaccgagccggctgccatttctacgcagtgtgcaatcagcactgtgacattgaccgcttccagggcgcctgtcccacctccccaccgccagtgtcctccgccccgctgtcctcgccctcccctgcccctggctgtgacaatgccatccctctccggcaggtgaatgagacctggaccctggagaactgcacggtggccaggtgcgtgggtgacaaccgtgtcgtcctgctggacccaaagcctgtggccaacgtcacctgcgtgaacaagcacctgcccatcaaagtgtcggacccgagccagccctgtgacttccactatgagtgcgagtgcatctgcagcatgtggggcggctcccactattccacctttgacggcacctcttacaccttccggggcaactgcacctatgtcctcatgagagagatccatgcacgctttgggaatctcagcctctacctggacaaccactactgcacggcctctgccactgccgctgccgcccgctgcccccgcgccctcagcatccactacaagtccatggatatcgtcctcactgtcaccatggtgcatgggaaggaggagggcctgatcctgtttgaccaaattccggtgagcagcggtttcagcaagaacggcgtgcttgtgtctgtgctggggaccaccaccatgcgtgtggacattcctgccctgggcgtgagcgtcaccttcaatggccaagtcttccaggcccggctgccctacagcctcttccacaacaacaccgagggccagtgcggcacctgcaccaacaaccagagggacgactgtctccagcgggacggaaccactgccgccagttgcaaggacatggccaagacgtggctggtccccgacagcagaaaggatggctgctgggccccgactggcacaccccccactgccagccccgcagccccggtgtctagcacacccacccccaccccatgcccaccacagccgctctgtgatctgatgctgagccaggtctttgctgagtgccacaaccttgtgcccccgggcccattcttcaacgcctgcatcagcgaccactgcaggggccgccttgaggtgccctgccagagcctggaggcttacgcagagctctgccgcgcccggggagtgtgcagtgactggcgaggtgcaaccggtggcctgtgcgacctcacctgcccacccaccaaagtgtacaagccatgcggccccatacagcctgccacctgcaactctaggaaccagagcccacagctggaggggatggcggagggctgcttctgccctgaggaccagatcctcttcaacgcacacatgggcatctgcgtgcaggcctgcccctgcgtgggacccgatgggtttcctaaatttcccggggagcggtgggtcagcaactgccagtcctgcgtgtgtgacgagggttcagtgtcggtgcagtgcaagcccctgccctgtgacgcccagggtcagcccccgccgtgcaaccgtcccggcttcgtaaccgtgaccaggccccgggccgagaacccctgctgccccgagacggtgtgcgtgtgcaacacaaccacctgcccccagagcctgcctgtgtgcccgccagggcaggagtccatctgcacccaggaggagggcgactgctgtcccaccttccgctgcagacctcagctgtgttcgtacaatggcaccttctacggggttggtgcaaccttcccaggcgcccttccctgccacatgtgtacctgcctctctggggacacccaggacccaacggtgcaatgtcaggaggatgcctgcaacaatactacctgtccccagggctttgagtacaagagagtggccgggcagtgctgtggggagtgcgtccagaccgcctgcctcacgcccgatggccagccagtccagctgaatgaaacctgggtcaacagccatgtggacaactgcaccgtgtacctctgtgaggctgagggtggagtccatttgctgaccccacagcctgcatcctgcccagatgtgtccagctgcagggggagcctcaggaaaaccggctgctgctactcctgtgaggaggactcctgtcaagtccgcatcaacacgaccatcctgtggcaccagggctgcgagaccgaggtcaacatcaccttctgcgagggctcctgccccggagcgtccaagtactcagcagaggcccaggccatgcagcaccagtgcacctgctgccaggagaggcgggtccacgaggagacggtgcccttgcactgtcctaacggctcagccatcctgcacacctacacccacgtggatgagtgtggctgcacgcccttctgtgtccctgcgcccatggctcccccacacacccgtggcttcccggcccaggaggccactgctgtctgagaacgttctgcctccatccccatgctctgtccacctggagccaggatgtgcattgtctgatcatgaaaaccttgggcctcctctgcggagccccccggcctgtgtgtggcaccccgcgctccgtgctcctgctgcccaccccgtgggtgaaaccggccccagaagggtgaggggccagcaggacccctttcgggagggcgccactcaggagtcctaccctgggagagcctgtggcccaccttggccttgcccctccctgatgtcactgggacgccctggaacaaactaagcatgtgcgggcctatgtgtccctgccacggccggagcgcccgcgcagcacggattccagctggccacgtccggccgctggggcagacaggctggtccaggcaaggccagctgctgccaggaagctgcgacaggcaaggcggccgcctgtccatgcctgctgcagggtaactcagggctgaggtcgcaacggccaggtcagagaggggtcagcatcccaaagccccctctgctcaacccagcccagttttgcaaataaaccctgagcattgag

SEQ ID NO: 65246 - DNA, 1246 bp, Homo sapiens
gcctaggagggagcccgccggggcggggcggggccgggtgcccatgaacagcggggtcccggccacgctggccgtgcggagagtgaaattcttcggccagcacggcggggaggtcaactcttctgccttctcccctgatggccagatgctgctcacaggctcagaagatggctgcgtgtatggctgggagacccggagtgggcagctgctgtggaggctgggtggccacacaggccccgtgaagttctgccgcttctcccctgatggccacctcttcgccagcgcctcctgtgactgcactgtccgcctgtgggatgtggcaagagcgaagtgtctgcgggtcctgaagggtcaccaacggagtgtggagacggtcagcttcagccctgactcgagacagctggcatcaggtggctgggacaagcgggtgatgctctgggatgtgcagtccggccagatgctgcgcctcttagttgggcaccgtgactccatccagagcagcgacttctcacccacggtgaactgcctggccaccggctcctgggactccaccgtacgcatctgggacctgcggatggtgaccccagcagtctcccaccaggcgctagagggacacagtggcaacatcagctgcctgtgctattcagcatccggcctcctggcatccggctcctgggacaagaccatccacatctggaagcccacaaccagcagcctgcttatccaactgaagggccatgtcacctgggtgaagagcatagccttctctcccgacgagctgtggctggccagcgccggctattcccgcatggtcaaagtctgggactgcaacacaggaaagtgccttgagaccctgaagcagggagtcctggatgtggcccacacctgtgccttcaccccagatgggaaaatcttagtgtctggagctgccgatcagactagacgtcaaatatcccgcacgtccaaatcacccagggaccctcaaacctaacaccaaccacctcagatggtgccgacctcacccgctcccctcagtggcgcacaggcatgccgcttctccccacagacgcaaagtgactgtgctggcatccagcagatccccatggccaggactctccaggccccaccagagcagacaactgtggtgggcaggacgcttgctggaacccatcagacacctggtccccaaaaccagacccacccacctccacccaatcagtggaagtgccaggaaacaaagcagtct

SEQ ID NO: 65247 - DNA, 1448 bp, Homo sapiens
gacccggagtgggcagctgctgtggaggctgggtggccacacaggccccgtgaagttctgccgcttctcccctgatggccacctcttcgccagcgcctcctgtgactgcactgtccgcctgtgggatgtggcaagagcgaagtgtctgcgggtcctgaagggtgagtgagctgggagccaagcagccaggccagcgttccctttcagatggtgctgtgtcctgtgtcacgtcacctttccaccttccccgaccccgggctggtgcctgcaggtcaccaacggagtgtggagacggtcagcttcagccctgactcgagacagctggcatcaggtggctgggacaagcgggtgatgctctgggatgtgcaggtacgttgaggggctggggccaccagtctgggattcaaggaccagttccagagaggatgtcaccagtcttgccctcccagctcaaaccctccactggttcccatggcccatgcccacagcaggcaaccaaggctgcccccacctggccacagccgcctctccaggcttccttgcacacagcagccctcaggctttttgcacgaggtccccctttcctggactgtcaaggccaggtagccggctgccctctgctgccttctgcagctcagggctctctctagtccggccagatgctgcgcctcttagttgggcaccgtgactccatccagagcagcgacttctcacccacggtgaactgcctggccaccggctcctgggactccaccgtacgcatctgggacctgcggatggtgaccccagcagtctcccaccaggcgctagagggacacagtggcaacatcagctgcctgtgctattcagcatccggcctcctggcatccggctcctgggacaagaccatccacatctggaagcccacaaccagcagcctgcttatccaactgaagggccatgtcacctgggtgaagagcatagccttctctcccgacgagctgtggctggccagcgccggctattcccgcatggtcaaagtctgggactgcaacacaggaaagtgccttgagaccctgaagcagggagtcctggatgtggcccacacctgtgccttcaccccagatgggaaaatcttagtgtctggagctgccgatcagactagacgtcaaatatcccgcacgtccaaatcacccagggaccctcaaacctaacaccaaccacctcagatggtgccgacctcacccgctcccctcagtggcgcacaggcatgccgcttctccccacagacgcaaagtgactgtgctggcatccagcagatccccatggccaggactctccaggccccaccagagcagacaactgtggtgggcaggacgcttgctggaacccatcagacacctggtccccaaaaccagacccacccacctccacccaatcagtggaagtgccaggaaacaaagcagtct

SEQ ID NO: 65248 - DNA, 593 bp, Homo sapiens
ggggtctggggaggtgacatgttgggctgtgggatcccagcgctgggcctgctcctgctgctgcagggctcggcagacggaaatggaatccagggattcttctacccatggagctgtgagggtgacatatgggaccgggagagctgtgggggccaggcggccatcgatagccccaacctctgcctgcgtctccggtgctgctaccgcaatggggtctgctaccaccagcgtccagacgaaaacgtgcggaggaagcacatgtgggcgctggtctggacgtgcagcggcctcctcctcctgagctgcagcatctgcttgttctggtgggccaagcgccgggacgtgctgcatatgcccggtttcctggcgggtccgtgtgacatgtccaagtccgtctcgctgctctccaagcaccgagggaccaagaagacgccgtccacgggcagcgtgccagtcgccctgtccaaagagtccagggatgtggagggaggcaccgagggggaagggacggaggagggtgaggagacagagggcgaggaagaggaggattaggggagtccccgggggactgctcaatacagatacggtggacg

SEQ ID NO: 65249 - DNA, 1828 bp, Homo sapiens
ctacaaggaggcaggcaagacagcaaggcatagagacaacatagagctaagtaaagccagtggaaatgaagagtcttccaatcctactgttgctgtgcgtggcagtttgctcagcctatccattggatggagctgcaaggggtgaggacaccagcatgaaccttgttcagaaatatctagaaaactactacgacctcaaaaaagatgtgaaacagtttgttaggagaaaggacagtggtcctgttgttaaaaaaatccgagaaatgcagaagttccttggattggaggtgacggggaagctggactccgacactctggaggtgatgcgcaagcccaggtgtggagttcctgatgttggtcacttcagaacctttcctggcatcccgaagtggaggaaaacccaccttacatacaggattgtgaattatacaccagatttgccaaaagatgctgttgattctgctgttgagaaagctctgaaagtctgggaagaggtgactccactcacattctccaggctgtatgaaggagaggctgatataatgatctcttttgcagttagagaacatggagacttttacccttttgatggacctggaaatgttttggcccatgcctatgcccctgggccagggattaatggagatgcccactttgatgatgatgaacaatggacaaaggatacaacagggaccaatttatttctcgttgctgctcatgaaattggccactccctgggtctctttcactcagccaacactgaagctttgatgtacccactctatcactcactcacagacctgactcggttccgcctgtctcaagatgatataaatggcattcagtccctctatggacctccccctgactcccctgagacccccctggtacccacggaacctgtccctccagaacctgggacgccagccaactgtgatcctgctttgtcctttgatgctgtcagcactctgaggggagaaatcctgatctttaaagacaggcacttttggcgcaaatccctcaggaagcttgaacctgaattgcatttgatctcttcattttggccatctcttccttcaggcgtggatgccgcatatgaagttactagcaaggacctcgttttcatttttaaaggaaatcaattctgggctatcagaggaaatgaggtacgagctggatacccaagaggcatccacaccctaggtttccctccaaccgtgaggaaaatcgatgcagccatttctgataaggaaaagaacaaaacatatttctttgtagaggacaaatactggagatttgatgagaagagaaattccatggagccaggctttcccaagcaaatagctgaagactttccagggattgactcaaagattgatgctgtttttgaagaatttgggttcttttatttctttactggatcttcacagttggagtttgacccaaatgcaaagaaagtgacacacactttgaagagtaacagctggcttaattgttgaaagagatatgtagaaggcacaatatgggcactttaaatgaagctaataattcttcacctaagtctctgtgaattgaaatgttcgttttctcctgcctgtgctgtgactcgagtcacactcaagggaacttgagcgtgaatctgtatcttgccggtcatttttatgttattacagggcattcaaatgggctgctgcttagcttgcaccttgtcacatagagtgatctttcccaagagaaggggaagcactcgtgtgcaacagacaagtgactgtatctgtgtagactatttgcttatttaataaagacgatttgtcagttattttatctt

SEQ ID NO: 65250 - DNA, 17689 bp, Homo sapiens
atgggtgccccgagcgcgtgccggacgctggtgttggctctggcggccatgctcgtggtgccgcaggcagagacccagggccctgtggagccgagctgggagaatgcagggcacaccatggatggcggtgccccgacgtcctcgcccacccggcgcgtgagctttgttccacccgtcactgtcttccccagcctgagccccctgaacccggcgcacaatgggcgggtgtgcagcacctggggtgacttccactacaagaccttcgacggcgacgtcttccgcttccctggcctttgcaactacgtgttctctgagcactgccgcgccgcctacgaggacttcaacgtccagctacgccgaggcctagtgggctccaggcctgtggtcacccgtgttgtcatcaaggcccaggggctggtgctggaggcgtccaacggctccgtcctcatcaatgggcagcgggaggagctgccttacagccgcactggcctcctggtggagcagagcggggactacatcaaggtcagcatccggctggtgctgacattcctgtggaacggagaggacagtgccctgctggagctggatcccaaatacgccaaccagacctgtggcctgtgtggggacttcaacggcctcccggccttcaacgagttctatgcccacaacgccaggctgaccccgctccagtttgggaacctgcagaagttggatgggcccacggagcagtgcccggacccgctgcccttgccggccggcaactgcacggacgaggagggcatctgccaccgcaccctgctggggccggcctttgcggagtgccacgcactggtggacagcactgcgtacctggccgcctgcgcccaggacctgtgccgctgccccacctgcccgtgtgccacctttgtggaatactcacgccagtgcgcccacgcggggggccagccgcggaactggaggtgccctgagctctgcccccggacctgccccctcaacatgcagcaccaggagtgtggctcaccctgcacggacacctgctccaacccccagcgcgcgcagctctgcgaggaccactgtgtggacggctgcttctgccccccaggcaggtcttgcacggtgctggatgacatcacgcactctggctgcctgcccctcgggcagtgcccctgcacccacggcggccgcacctacagcccgggcacctccttcaacaccacctgcagctcctgcacctgctccggggggctatggcagtgccaggacctgccgtgccctggcacctgctctgtgcagggcggggcccacatctccacctatgatgagaaactctacgacctgcatggtgactgcagctacgttctgtccaagaaatgtgccgacagcagcttcaccgtgctggctgagctgcggaagtgcggcctgacggacaacgagaactgcctgaaagcggtgacgctcagcctggacggcggggacacggccatccgggtccaagcggacggcggcgtgttcctcaactccatctacacgcagctgcccctgtcggcagccaacatcaccctgttcacaccctcgagcttcttcatcgtggtgcagacaggcctggggctgcagctgctggtgcagctggtgccactcatgcaggtgtttgtcaggctggaccccgcccaccagggccagatgtgcggcctgtgtgggaacttcaaccagaaccaggctgacgacttcacggccctcagcggggtggtggaggccacgggcgcagccttcgccaacacctggaaggcccaggctgcctgtgccaatgccaggaacagctttgaggacccctgctccctcagtgtggagaatgagaactacgcccggcactggtgctcgcgcctgaccgatcccaacagtgccttctcgcgctgccactccatcatcaaccccaagcccttccactcgaactgcatgtttgacacctgcaactgtgagcggagcgaggactgcctgtgcgccgcgctgtcctcctatgtgcacgcctgtgccgccaagggcgtacagctcagcgactggagggacggcgtctgcaccaagtacatgcagaactgccccaagtcccagcgctacgcctacgtggtggatgcctgccagcccacttgccgcggcctgagtgaggccgacgtcacctgcagcgtttccttcgtgcctgtggacggctgcacctgccccgcgggcaccttcctcaatgacgcgggcgcctgtgtgcccgcccaggagtgcccctgctacgctcacggcaccgtgctggctcctggagaggtggtgcacgacgagggcgccgtgtgttcatgtacgggtgggaagctaagctgcctgggagcctctctgcagaaaagcacagggtgtgcagcccccatggtgtacctggactgcagcaacagctcggcgggcacccctggggccgagtgcctccggagctgccacacgctggacgtgggctgtttcagcacacactgcgtgtccggctgtgtctgtcccccggggctggtgtcggatgggagtgggggctgcattgccgaggaggactgcccctgtgtgcacaacgaggccacctacaagcctggagagaccatcagggtcgactgcaacacctgcacctgcaggaaccggaggtgggagtgcagccaccggctctgcctgggcacctgcgtggcctacggggatggccacttcatcacctttgatggcgatcgctacagctttgaaggcagctgcgagtacatcttggcccaggactactgtggggacaacaccacccacgggaccttccgcatcgtcaccgagaacatcccctgtgggaccaccggcaccacctgctccaaggccatcaagctcttcgtggagagctacgagctgatcctccaagaggggacctttaaggcggtggcgagagggccgggtggggacccaccctacaagatacgctacatggggatcttcctggtcatcgagacccacgggatggccgtgtcctgggaccggaagaccagcgtgttcatccgactgcaccaggactacaagggcagggtctgcggcctgtgcgggaacttcgacgacaatgccatcaatgactttgccacgcgtagccggtccgtggtgggggacgcactggagtttgggaacagctggaagctctccccctcctgcccggacgccctggcacccaaggacccctgcacggccaaccccttccgcaagtcctgggcccagaagcagtgcagcatcctccacggccccaccttcgccgcctgccgctcccaggttgactccaccaagtactacgaggcctgcgtgaacgacgcgtgtgcctgcgactcgggtggcgactgcgagtgtttctgcacggctgtggctgcctacgcccaggcctgccacgacgcgggcctgtgtgtgtcctggcggactccggacacctgccccttgttctgtgacttctacaacccacatgggggctgtgagtggcactaccagccctgcggggcaccctgcctaaaaacctgccggaaccccagtgggcactgcctggtggacctgcctggcctggaaggctgctacccgaagtgcccacccagccagcccttcttcaatgaggaccagatgaagtgcgtggcccagtgtggctgctacgacaaggacggaaactactatgacgtcggtgcaagggtccccacagcggagaactgccagagctgtaactgcacacccagtggcatccagtgcgctcacagccttgaggcctgcacctgcacctatgaggacaggacctacagctaccaggacgtcatctacaacaccaccgatgggcttggcgcctgcttgatcgccatctgcggaagcaacggcaccatcatcaggaaggctgtggcatgtcctggaactccagccacaacgccattcaccttcaccaccgcctgggtcccccactccacgacaagcccggccctcccggtctccaccgtgtgtgtccgcgaggtctgccgctggtccagctggtacaatgggcaccgcccagagcccggcctgggaggcggagactttgagacgtttgaaaacctgaggcagagagggtaccaggtatgccctgtgctggctgacatcgagtgccgggcggcgcagcttcccgacatgccgctggaggagctgggccagcaggtggactgtgaccgcatgcgggggctgatgtgcgccaacagccaacagagtcccccgctctgtcacgactacgagctgcgggttctctgctgcgaatacgtgccctgtggcccctccccggccccaggcaccagccctcagccctccctcagtgccagcacggagcctgctgtgcctaccccaacccagaccacagcaaccgaaaagaccaccctatgggtgaccccgagcatccggtcgacggcggccctcacctcgcagactgggtccagctcaggccccgtgacggtcaccccctcggccccaggtaccaccacctgccagccccggtgtcagtggacagagtggtttgatgaggactaccccaagtctgaacaacttggaggggacgttgagtcctacgataagatcagggccgctggagggcacttatgccagcagcctaaggacatagagtgccaggccgagagcttccccaactggaccctggcacaggtggggcagaaggtgcactgtgacgtccacttcggcctggtgtgcaggaactgggagcaggagggcgtcttcaagatgtgctacaactacaggatccgggtcctctgctgcagtgacgaccactgcaggggacgtgccacaaccccgccaccgaccacagagctggagacggccaccaccaccaccacccaggccctgttctcaacgccgcagcctacgagtagcccggggctgaccagggctcccccggccagcaccacagcagtccccaccctctcagaaggactgacatcccccagatacacaagcacccttggtacagccaccacgggaggccccacgacgcctgcaggctccacagaacccactgtcccaggggtggccacatccacccttccaacacgctcagcccttccagggacgacggggagcttgggcacatggcgcccctcacagccacccacgctggccccaacaacaatggcaacctccagagctcgcccgacaggcacagccagcaccgcttccaaagagccgctgaccacgagcctggcgccaacactcacgagcgagctgtccacctctcaggccgagaccagcacgcccaggacagagacgacaatgagccccttgactaacaccaccaccagccagggcacgacccgctgtcaaccgaagtgtgagtggacagagtggtttgacgtggacttcccaacctcaggggttgcaggcggggacatggaaacttttgaaaacatcagggctgctgggggcaagatgtgctgggcaccaaagagcatagagtgccgggcggagaactaccccgaggtaagcatcgaccaggtcgggcaggtgctgacctgcagcctggagacggggctgacctgcaagaacgaagaccagacaggcaggttcaacatgtgcttcaactacaacgtgcgtgtgctttgctgtgacgactacagccactgccccagtaccccagccaccagctccacggccacgccctcctcaactccggggacgacctggatcctcacaaagccgaccacaacagccactacgactgcgtccactggatccacggccaccccgacctccaccctgagaacagctccccctcccaaagtgctgaccaccacggccaccacacccacagtcaccagctccaaagccactccctcctccagtccagggactgcaaccgcccttccagcactgagaagcacagccaccacacccacagctaccagcgttacacccatcccctcttcctccctgggcaccacctggacccgcctatcacagaccaccacacccacggccaccatgtccacagccacaccctcctccactccagagactgcccacacctccacagtgcttaccgccacggccaccacaactggggccaccggctctgtggccaccccctcctccaccccaggaacagctcacactaccaaagtgccaactaccacaaccacgggcttcacagccaccccctcctccagcccagggacggcactcacgcctccagtgtggatcagcacaaccaccacacccacaaccagaggctccacggtgaccccctcctccatcccggggaccacccacaccgccacagtgctgaccaccaccaccacaactgtggccactggttctatggcaacaccctcctctagcacacagaccagtggtactcccccatcactgaccaccacggccactacgatcacggccaccggctccaccaccaacccctcctcaactcctgggacaactcccatccccccagtgctgaccaccaccgccaccacacctgcagccaccagcaacacagtgactccctcctctgccctagggaccacccacacacccccagtgccgaacaccatggccaccacacacgggcgatccctgccccccagcagtccccacacggtgcgcacagcctggacttcggccacctcgggcatcttgggcaccacccacatcacagagccttccacggtgacttcccacaccctagcagcaaccaccggtaccacccagcactcgactccagccctttccagccctcaccctagcagcagaaccaccgagtcacccccttctccagggacgaccaccccgggccacaccacggccacctccaggaccacagccacggccacacccagcaagacccgcacctcgaccctgctgcccagcagccccacatcggcccccataaccacggtggtgaccatgggctgtgagccccagtgtgcctggtcagagtggctggactacagctaccccatgccggggccctctggcggggactttgacacctactccaacatccgtgcggccggaggggccgtctgtgagcagcccctgggcctcgagtgccgtgcccaggcccagcctggtgtccccctgcgggagttgggccaggtcgtggaatgcagcctggactttggcctggtctgcaggaaccgtgagcaggtggggaagttcaagatgtgcttcaactatgaaatccgtgtgttctgctgcaactacggccactgccccagcaccccggccaccagctctacggccatgccctcctccactccggggacgacctggatcctcacagagctgaccacaacagccactacgactgagtccactggatccacggccacccccactacagccaccgcaactgctggcaccccacatgtgagcaccacggccacgacacccacagtcaccagctccaaagccactcccttctccagtccagggactgcaaccgcccttccagcactgagaagcacagccaccacacccacagctaccagctttacagccatcccctcctcctccctgggcaccacctggacccgcctatcacagaccaccacacccacggccaccatgtccacagccacaccctcctccactccagagactgtccacacctccacagtgcttaccaccacggccaccacaaccggggccaccggctctgtggccaccccctcctccaccccaggaacagctcacactaccaaagtgctgactaccacaaccacgggcttcacagccaccccctcctccagcccagggacggcacgcacgcttccagtgtggatcagcacaaccaccacacccacaaccagaggttccacggtgaccccctcctccatcccggggaccacccacacccccacagtgctgaccaccaccaccacaactgtggccactggttctatggcaacaccctcctctagcacacagaccagtggtactcccccatcactgaccaccacggccactacgatcacggccaccggctccaccaccaacccctcctcaactccagggacaacacctatccccccagtgctgaccaccaccgccaccacacctgcagccaccagcagcacagtgactccctcctctgccctagggaccacccacacacccccagtgccgaacaccacggccaccacacacgggcgatccctgtcccccagcagtccccacacggtgcgcacagcctggacttcggccacctcaggcaccttgggcaccacccacatcacagagccttccacggggacttcccacaccccagcagcaaccaccggtaccacccagcactcgactccagccctgtccagccctcaccctagcagcaggaccaccgagtcacccccttctccagggacgaccaccccgggccacaccagggccacctccaggaccacggccacggccacacccagcaagacccgcacctcgaccctgctgcccagcagccccacatcggccccaataaccacggtggtgaccatgggctgtgagccccagtgtgcctggtcagagtggctggactacagctaccccatgccggggccctctggcggggactttgacacctactccaacatccgtgcggccggaggggccgtctgtgagcagcccctgggcctcgagtgccgtgcccaggcccagcctggtgtccccctgcgggagttgggccaggtcgtggaatgcagcctggactttggcctggtctgcaggaaccgtgagcaggtggggaagttcaagatgtgcttcaactatgaaatccgtgtgttctgctgcaactacggccactgccccagcaccccggccaccagctctacggccacgccctcctccactccagggacgacctggatcctcacagagcagaccacagcagccactacgaccgcaaccactggatccacggccatcccgtcctccaccccgggaacagctccccctcccaaagtgctgaccagcacggccaccacacccacagccaccagttccaaagccacttcctcctccagtccaaggactgcaaccacccttccagtgctgacaagcacagccaccaaatccacagctaccagctttacacccatcccctccttcacccttgggaccaccgggaccctcccagaacagaccaccacacccatggccaccatgtccacaatccacccctcctccactccggagaccacccacacctccacagtgctgaccacgaaggccaccacgacaagggccaccagttccatgtccaccccctcctccactccggggacgacctggatcctcacagagctgaccacagcagccactacaactgcagccactggccccacggccaccccgtcctccaccccagggaccacctggatcctcacagagcccagcactacagccaccgtgacggtgcccaccggatccacggccaccgcctcctccacccgggcaactgctggcaccctcaaagtgctgaccagcacggccaccacacccacagtcatcagctccagagccactccctcctccagtccagggactgcaaccgcccttccagcactgagaagcacagccaccacacccacagctaccagcgttacagccatcccctcttcctccctgggcaccgcctggacccgcctatcacagaccaccacacccacggccaccatgtccacagccacaccctcctctactccagagactgtccacacctccacagtgcttaccaccacgaccaccacaaccagggccaccggctctgtggccaccccctcctccaccccaggaacagctcacactaccaaagtgccgactaccacaaccacgggcttcacagccaccccctcctccagcccagggacggcactcacgcctccagtgtggatcagcacaaccaccacacccacaaccagaggctccacggtgaccccctcctccatcccggggaccacccacaccgccacagtgctgaccaccaccaccacaactgtggccactggttctatggcaacaccctcctctagcacacagaccagtggtactcccccatcactgaccaccacggccactacgatcacagccaccggctccaccaccaacccctcctcaactccagggacaactcccatccccccagtgctgaccaccaccgccaccacacctgcagccaccagcagcacagtgactccctcctctgccctagggaccacccacacacccccagtgccgaacaccacggccaccacacacgggcggtccctgccccccagcagtccccacacggtgcgcacagcctggacttcggccacctcgggcatcttgggcaccacccacatcacagagccttccacggtgacttcccacaccccagcagcaaccaccagtaccacccagcactcgactccagccctgtccagccctcaccctagcagcaggaccaccgagtcacccccttctccagggacgaccaccccgggccacaccaggggcacctccaggaccacagccacagccacacccagcaagacccgcacctcgaccctgctgcccagcagccccacatcggcccccataaccacggtggtgaccacgggctgtgagccccagtgtgcctggtcagagtggctggactacagctaccccatgccggggccctctggcggggactttgacacctactccaacatccgtgcggccggaggggcagtctgtgagcagcccctgggcctcgagtgccgtgcccaggcccagcctggtgtccccctgcgggagttgggccaggtcgtggaatgcagcctggactttggcctggtctgcaggaaccgtgagcaggtggggaagttcaagatgtgcttcaactatgaaatccgtgtgttctgctgcaactacggccactgccccagcaccccggccaccagctctacggccacgccctcctcaactccggggacgacctggatcctcacaaagctgaccacaacagccactacgactgagtccactggatccacggccaccccgtcctccaccccaggggcaactgctggcaccccacatgtgagcaccacggccacgacacccacagtcaccagctccaaagccactcccttctccagtccagggactgcaaccgcccttccagcactgagaagcacagccaccacacccacagctaccagctttacagccatcccctcctcctccctgggcaccacctggacccgcctatcacagaccaccacacccacggccaccatgtccacagccacaccctcctccactccagagactgcccacacctccacagtgcttaccaccacggccaccacaaccagggccaccggctctgtggccaccccctcttccaccccaggaacagctcacactaccaaagtgccgactaccacaaccacgggcttcacagtcaccccctcctccagcccagggacggcacgcacgcctccagtgtggatcagcacaaccaccacacccacaaccagtggctccacggtgaccccctcctccgtcccggggaccacccacacccccacagtgctgaccaccaccaccacaactgtggccactggttctatggcaacaccctcctctagcacacagaccagtggtactcccccatcactgatcaccacggccactacgatcacggccaccggctccaccaccaacccctcctcaactccagggacaacacctatccccccagtgctgaccaccaccgccaccacacctgcagccaccagcagcacagtgactccctcctctgccctagggaccacccacacacccccagtgccgaacaccacggccaccacacacgggcgatccctgtcccccagcagtccccacacggtgcgcacagcctggacttcggccacctcaggcaccttgggcaccacccacatcacagagccttccacggggacttcccacaccccagcagcaaccaccggtaccacccagcactcgactccagccctgtccagccctcaccctagcagcaggaccaccgagtcacccccttccccagggacgaccaccccgggccacaccacggccacctccaggaccacggccacggccacacccagcaagacccgcacctcgaccctgctgcccagcagccccacatcggcccccataaccacggtggtgaccacgggctgtgagccccagtgtgcctggtcagagtggctggactacagctaccccatgccggggccctctggcggggactttgacacctactccaacatccgtgcggccggaggggccgtctgtgagcagcccctgggcctcgagtgccgtgcccaggcccagcctggtgtccccctgggggagttgggccaggtcgtggaatgcagcctggactttggcctggtctgcaggaaccgtgagcaggtggggaagttcaagatgtgcttcaactatgaaatccgtgtgttctgctgcaactacggccactgccccagcaccccggccaccagctctacggccatgccctcctccactccggggacgacctggatcctcacagagctgaccacaacagccactacgactgcatccactggatccacggccaccccgtcctccaccccgggaacagctccccctcccaaagtgctgaccagcccggccaccacacccacagccaccagttccaaagccacttcctcctccagtccaaggactgcaaccacccttccagtgctgacaagcacagccaccaaatccacagctaccagcgttacacccatcccctcctccacccttgggaccaccgggaccctcccagaacagaccaccacacccgtggccaccatgtccacaatccacccctcctccactccggagaccacccacacctccacagtgctgaccacgaaggccaccacgacaagggccaccagttccacgtccaccccctcctccactccggggacgacctggatcctcacagagctgaccacagcagccactacaactgcagccactggccccacggccaccccgtcctccaccccagggaccacctggatcctcacagagctgaccacaacagccactacgactgcgtccactggatccacggccaccccgtcctccaccccagggaccacctggatcctcacagagccgagcactacagccaccgtgacggtgcccaccggatccacggccaccgcctcctccacccaggcaactgctggcaccccacatgtgagcaccacggccacgacacccacagtcaccagctccaaagccactccctcctccagtccagggactgcaactgcccttccagcactgagaagcacagccaccacacccacagctaccagctttacagccatcccctcctcctccctgggcaccacctggacccgcctatcacagaccaccacacccacggccaccatgtccacagccacaccctcctccactccagagactgtccacacctccacagtgcttaccgccacggccaccacaaccggggccaccggctctgtggccaccccctcctccaccccaggaacagctcacactaccaaagtgccgactaccacaaccacgggcttcacagccaccccctcctccagcccagggacggcactcacgcctccagtgtggatcagcacaaccaccacacccacaaccaccacacccacaaccagtggctccacggtgaccccctcctccatcccggggaccacccacaccgccagagtgctgaccaccaccaccacaactgtggccactggttctatggcaacaccctcctctagcacacagaccagtggtactcccccatcactgaccaccacggccactacgatcacggccaccggctccaccaccaacccctcctcaactccagggacaacacccatcaccccagtgctgaccagcacggccaccacacccgcagccaccagctccaaagccacttcctcctccagtccaaggactgcaaccacccttccagtgctgacaagcacagccacaaaatccacagctaccagctttacacccatcccctcctccaccctgtggaccacgtggaccgtcccagcacagaccaccacacccatgtccaccatgtccacaatccacacctcctctactccagagaccacccacacctccacagtgctgaccaccacagccaccatgacaagggccaccaattccacggccacaccctcctccactctggggacgacccggatcctcactgagctgaccacaacagccactacaactgcagccactggatccacggccaccctgtcctccaccccagggaccacctggatcctcacagagccgagcactatagccaccgtgatggtgcccaccggttccacggccaccgcctcctccactctgggaacagctcacacccccaaagtggtgaccaccatggccactatgcccacagccactgcctccacggttcccagctcgtccaccgtggggaccacccgcacccctgcagtgctccccagcagcctgccaaccttcagcgtgtccactgtgtcctcctcagtcctcaccaccctgagacccactggcttccccagctcccacttctctactccctgcttctgcagggcatttggacagtttttctcgcccggggaagtcatctacaataagaccgaccgagccggctgccatttctacgcagtgtgcaatcagcactgtgacattgaccgcttccagggcgcctgtcccacctccccaccgccagtgtcctccgccccgctgtcctcgccctcccctgcccctggctgtgacaatgccatccctctccggcaggtgaatgagacctggaccctggagaactgcacggtggccaggtgcgtgggtgacaaccgtgtcgtcctgctggacccaaagcctgtggccaacgtcacctgcgtgaacaagcacctgcccatcaaagtgtcggacccgagccagccctgtgacttccactatgagtgcgagtgcatctgcagcatgtggggcggctcccactattccacctttgacggcacctcttacaccttccggggcaactgcacctatgtcctcatgagagagatccatgcacgctttgggaatctcagcctctacctggacaaccactactgcacggcctctgccactgccgctgccgcccgctgcccccgcgccctcagcatccactacaagtccatggatatcgtcctcactgtcaccatggtgcatgggaaggaggagggcctgatcctgtttgaccaaattccggtgagcagcggtttcagcaagaacggcgtgcttgtgtctgtgctggggaccaccaccatgcgtgtggacattcctgccctgggcgtgagcgtcaccttcaatggccaagtcttccaggcccggctgccctacagcctcttccacaacaacaccgagggccagtgcggcacctgcaccaacaaccagagggacgactgtctccagcgggacggaaccactgccgccagttgcaaggacatggccaagacgtggctggtccccgacagcagaaaggatggctgctgggccccgactggcacaccccccactgccagccccgcagccccggtgtctagcacacccacccccaccccatgcccaccacagccgctctgtgatctgatgctgagccaggtctttgctgagtgccacaaccttgtgcccccgggcccattcttcaacgcctgcatcagcgaccactgcaggggccgccttgaggtgccctgccagagcctggaggcttacgcagagctctgccgcgcccggggagtgtgcagtgactggcgaggtgcaaccggtggcctgtgcgacctcacctgcccacccaccaaagtgtacaagccatgcggccccatacagcctgccacctgcaactctaggaaccagagcccacagctggaggggatggcggagggctgcttctgccctgaggaccagatcctcttcaacgcacacatgggcatctgcgtgcaggcctgcccctgcgtgggacccgatgggtttcctaaatttcccggggagcggtgggtcagcaactgccagtcctgcgtgtgtgacgagggttcagtgtcggtgcagtgcaagcccctgccctgtgacgcccagggtcagcccccgccgtgcaaccgtcccggcttcgtaaccgtgaccaggccccgggccgagaacccctgctgccccgagacggtgtgcgtgtgcaacacaaccacctgcccccagagcctgcctgtgtgcccgccagggcaggagtccatctgcacccaggaggagggcgactgctgtcccaccttccgctgcagacctcagctgtgttcgtacaatggcaccttctacggggttggtgcaaccttcccaggcgcccttccctgccacatgtgtacctgcctctctggggacacccaggacccaacggtgcaatgtcaggaggatgcctgcaacaatactacctgtccccagggctttgagtacaagagagtggccgggcagtgctgtggggagtgcgtccagaccgcctgcctcacgcccgatggccagccagtccagctgaatgaaacctgggtcaacagccatgtggacaactgcaccgtgtacctctgtgaggctgagggtggagtccatttgctgaccccacagcctgcatcctgcccagatgtgtccagctgcagggggagcctcaggaaaaccggctgctgctactcctgtgaggaggactcctgtcaagtccgcatcaacacgaccatcctgtggcaccagggctgcgagaccgaggtcaacatcaccttctgcgagggctcctgccccggagcgtccaagtactcagcagaggcccaggccatgcagcaccagtgcacctgctgccaggagaggcgggtccacgaggagacggtgcccttgcactgtcctaacggctcagccatcctgcacacctacacccacgtggatgagtgtggctgcacgcccttctgtgtccctgcgcccatggctcccccacacacccgtggcttcccggcccaggaggccactgctgtctgagaacgttctgcctccatccccatgctctgtccacctggagccaggatgtgcattgtctgatcatgaaaaccttgggcctcctctgcggagccccccggcctgtgtgtggcaccccgcgctccgtgctcctgctgcccaccccgtgggtgaaaccggccccagaagggtgaggggccagcaggacccctttcgggagggcgccactcaggagtcctaccctgggagagcctgtggcccaccttggccttgcccctccctgatgtcactgggacgccctggaacaaactaagcatgtgcgggcctatgtgtccctgccacggccggagcgcccgcgcagcacggattccagctggccacgtccggccgctggggcagacaggctggtccaggcaaggccagctgctgccaggaagctgcgacaggcaaggcggccgcctgtccatgcctgctgcagggtaactcagggctgaggtcgcaacggccaggtcagagaggggtcagcatcccaaagccccctctgctcaacccagcccagttttgcaaataaaccctgagcattgag

SEQ ID NO: 65251 - DNA, 1630 bp, Homo sapiens
cccaggtggggagctagcctgaaagagacagcggaaggagtttcctggactgcgctgtcgctcaccgacccgcaccaatcaccatgcagcttgccctcggacccgccccttttagggcgtgtccccagtgagtgatagacggagccgccctgccctgctcagcccagcccacgttgctgcttagattgaaatgcagaactcaagcctctttcatcggggcacagacttccttttacttcttccttttgccctctcgcctcctcctcctgggaagaagcggaggcgccggccggtcggccgggatagcaacaggccgggccactgaggcggtgcggaaagtttctgtctgggagtgcggaactggggccgggttggtgtactgctcggagcaatggagccagccttcggggaggtgaaccagctgggaggagtgttcgtgaacgggaggccgctgcccaacgccatccggcttcgcatcgtggaactggcccaactgggcatccgaccgtgtgacatcagccgccagctacgggtctcgcacggctgcgtcagcaagatcctggcgcgatacaacgagacgggctcgatcttgccaggagccatcgggggcagcaagccccgggtcactacccccaccgtggtgaaacacatccggacctacaagcagagagaccccggcatcttcgcctgggagatccgggaccgcctgctggcggacggcgtgtgcgacaagtacaatgtgccctccgtgagctccatcagccgcattctgcgcaacaagatcggcaacttggcccagcagggtcattacgactcatacaagcagcaccagccgacgccgcagccagcgctgccctacaaccacatctactcgtaccccagccctatcacggcggcggccgccaaggtgcccacgccacccggggtgcctgccatccccggttcggtggccatgccgcgcacctggccctcctcgcactccgtcaccgacatcctgggcatccgctccatcaccgaccaagtgagcgacagctccccctaccacagccccaaggtggaggagtggagcagcctgggccgcaacaacttccccgccgccgccccgcacgcggtgaacgggttggagaagggagccctggagcaggaagccaagtacggtcaggcaccaaatggtctcccagctgtgggcagttttgtgtcagcatccagcatggctccttaccctaccccagcccaagtgtcgccttacatgacctacagtgctgctccttctggttatgttgctggacatgggtggcaacatgctgggggcacctcattgtctccccacaactgtgacattccggcatcgctggcgttcaagggaatgcaggcagccagagaaggtagtcattctgtcacggcttccgcgctctgatgggaaattccgtctccagcagcttcacccgggtctccctgtctcagcacctcctcccccaattcccaggtctcacatcccacccctcctgccctccaacccttctgccttgaaagctggctgtacggactcacatcctttgtgctaatgacacttacatatttcttgccataacttttctcttgcagaaaaactgacatgactttaggattt

SEQ ID NO: 65252 - DNA, 1278 bp, Homo sapiens
agaactgattctggaggaagtgggatcagaggccaaaggcagaaggtggaagggggcttcatgagtcatctgccctcagcctgggccaggtgtaggggagatctttgtgccagccaccctagagtagatctgggtggaagatgactggattcaacacccccagggctggaaggatctgtggggttgaaggagctgagtctgtcagtccttcctggttaggggttggaggctctgcctccacagtccaggctgaggcagaggcctgcctctccttccagagaagtcgggtggaagggagaaatggcagtctctaagactccgagcgtacctggctaacttccatagtgcccagagaaggagctcagtcggcaaggactagccgaggatcccagtcctagcagcctcctgtcccctgctcatgtgtctaacagcctttaaccttctcagcacctaggaacccaggcagcctgggactatctgatccacttgttctaaaacacagcaggtccatggccagcaggcctctgcccccgggacgccaggaggaggagaatgccaaagactccgggcggaaaccctcaccggtgcggccccgaggctgcctgcccagcattgatgaggcccgaccggcaggtccaggtccagccccggcctcgcgccggggctccatgctgggcctggccgcgtccttctcccgccgcaactcgctggtcgggccaggcgcgggtcctgggggtcagcggccatccctgggcccggtgccccctctgggctcaagggtcagcttctcagggttgcccctggcgcccgcccgttgggtggcgccctcctaccgcacggagccagtgcccggggagcgctgggaggctgcgcgtgcacagcgtgccctggaggcggcgctggccgcagggctgcacgacgcgtgctactccagcgacgaggccgcgcggctggtgcgggagctctgcgagcaggtgcacgttcgcctgcgcgagctcagcccgccacgctacaagctggtatgcagtgtggtgctggggccgcgcgcgggccagggcgttcacgtggtcagccgtgcgctctgggacgtggcgcgcgatgggctggcctcggtctcctacaccaacacctcgctcttcgcggtggccacggtccacgggctctactgcgagtgagggggagtccaattctgcaaaattgtttattatcctaggaggaggcccccctggggctcacatcccaataaataagtgtctgacagtaaaaaaaaaaaaaaaa

SEQ ID NO: 65253 - DNA, 2825 bp, Homo sapiens
aggacgcagcaactcacagagcaaccaggacccagaaatcgcttaagagaccgcggcaaagtaacttaactgagttgccttcttccatattttcacgcccctttcatccagaacattttttttcttgaactgcttccatggaggactcaacctccccgaagcaagaaaaagaaaaccaagaagaactaggggaaacaaggcggccatgggaaggaaagacagcagcttctccccaatattctgagcctgagtcgtctgagcccttggaggcgaagcaggggccagaaactggacgccagtcccgaagcagccgtccttggagcccgcagtctagagccaagacgcctctgggtggccccgcgggaccagaaacatcatcacctgctcctgtctctccgcgggagccctcttcctctccttctcccctggctccggccagacaagacctcgcggcaccacctcagtcggacaggaccacgagtgtgattcctgaagctgggacaccttatcctgatcctttggaacaatcatctgataaaagagaatcaactcctcatcacacaagccagtcagaaggaaacacctttcaacagtctcagcaacccaaaccccacctgtgtggacgaagggacgtgagctataacaacgctaaacagaaagagctgagatttgacgtttttcaggaggaagactcaaacagtgactatgatttacagcagccggcgcctgggggctctgaagtggcccccagcatgcttgagatcaccattcagaatgctaaggcttacctgctgaagactagcagcaattcgggctttaatctatatgatcatctttctaatatgttgaccaagatattaaatgagcgtcctgaaaatgctgttgacatctttgaaaatattagccaagatgtgaagatggcacattttagtaaaaaatttgatgcactacaaaatgagaatgagttgcttccaacatatgaaatagcagaaaagcaaaaggctctttttctccagggacatttggaaggagttgaccaagaattggaagatgaaatagcagaaaacgctcttccaaatgtaatggagtcagctttttattttgaacaagctggagttggtttgggcacagatgagacataccgcatatttcttgccctcaagcagcttactgatacccacccaatccaaagatgccgcttctggggaaagatcttgggtctggaaatgaattatattgtagctgaagtggaatttcgtgagggggaagatgaagaggaagtggaagaggaagatgtagctgaagagagggacaatggagaaagtgaagctcatgaagatgaggaagatgaattaccaaagtccttttacaaggccccacaggctataccaaaagaagaaagtagaacaggtgccaacaaatatgtctattttgtttgcaatgaaccaggaagaccatgggtgaagttaccaccagttatacctgcacaaattgttattgcaagaaaaatcaagaaatttttcactgggcgattggatgctcccatcataagctacccacctttcccaggaaatgagagtaattatttacgagcacaaattgcccgaatttcagcaggaacccacgtcagtcctctaggattttatcagtttggtgaagaggaaggagaggaggaggaagaggcagaaggtgggcgaaatagctttgaggaaaaccctgattttgaaggcatccaagtgattgatctagtagaatccctatccaattgggttcatcatgtacagcatattctctctcagggtcgctgtaattggttcaactccatacaaaaaaatgaggaagaagaagaggaagaagatgaagaaaaagacgattctgactacatagaacaggaagtggggcttcctcttttgacaccaatctctgaagatttagagattcagaatatacccccctggacaacacggttatcctcaaatctcattccacaatatgctattgcagtccttcaatccaacctttggcctggagcatatgccttctccaatggcaaaaagtttgaaaatttctacataggctggggtcataagtatagtccagacaattatacacccccagttccaccaccagtttatcaagaataccccagtggaccagaaattacagaaatggatgatcctagtgtggaggaggagcaggctttcagggctgcacaagaagcagttctactcgcagctgagaatgaagaatctgaggaagatgaagatgaggaagatgattatgactaataaacataaaattagcctggttttatgtgacactgatacacacacaccccttatatgggactaattttacacttttctgtgttatgtgtgtatatacatacacatgtaagaaattattcaactgcaaaatctcaatcttgaaaatcaagcttgaaatttcataggtagaaatattagcatttttattgaaagatactcacaggattttccagaggctaaataacatgcaattgcataattgttctgagggttatggataatggaatatgtgtttgtacattcctgtttttaaaagggctcaggtttcacatggtccaggtgaggtaaaacaattaaaataaataaataaatggtctcaggtttaatttgtaatacgacaaacactggaagatataacccacaggaaattcttggaaacatcaatactttttaaagagtgtcaaggggtatgaagacaaaaaatattgatagtcactagagtaatgtattcttaacctttgtaagaactgatctcagcatgtattcttaaacctttgt

SEQ ID NO: 65254 - DNA, 1782 bp, Homo sapiens
gggagacacacacagcctctctgcccacctctgcttcctctaggaacacaggagttccagatcacatcgagttcaccatgaattcactcagtgaagccaacaccaagttcatgttcgatctgttccaacagttcagaaaatcaaaagagaacaacatcttctattcccctatcagcatcacatcagcattagggatggtcctcttaggagccaaagacaacactgcacaacaaattagcaaggttcttcactttgatcaagtcacagagaacaccacagaaaaagctgcaacatatcatgttgataggtcaggaaatgttcatcaccagtttcaaaagcttctgactgaattcaacaaatccactgatgcatatgagctgaagatcgccaacaagctcttcggagaaaagacgtatcaatttttacaggaatatttagatgccatcaagaaattttaccagaccagtgtggaatctactgattttgcaaatgctccagaagaaagtcgaaagaagattaactcctgggtggaaagtcaaacgaatgaaaaaattaaaaacctatttcctgatgggactattggcaatgatacgacactggttcttgtgaacgcaatctatttcaaagggcagtgggagaataaatttaaaaaagaaaacactaaagaggaaaaattttggccaaacaagaatacatacaaatctgtacagatgatgaggcaatacaattcctttaattttgccttgctggaggatgtacaggccaaggtcctggaaataccatacaaaggcaaagatctaagcatgattgtgctgctgccaaatgaaatcgatggtctgcagaagcttgaagagaaactcactgctgagaaattgatggaatggacaagtttgcagaatatgagagagacatgtgtcgatttacacttacctcggttcaaaatggaagagagctatgacctcaaggacacgttgagaaccatgggaatggtgaatatcttcaatggggatgcagacctctcaggcatgacctggagccacggtctctcagtatctaaagtcctacacaaggcctttgtggaggtcactgaggagggagtggaagctgcagctgccaccgctgtagtagtagtcgaattatcatctccttcaactaatgaagagttctgttgtaatcaccctttcctattcttcataaggcaaaataagaccaacagcatcctcttctatggcagattctcatccccatagatgcaattagtctgtcactccatttagaaaatgttcacctagaggtgttctggtaaactgattgctggcaacaacagattctcttggctcatatttcttttctatctcatcttgatgatgatagtcatcatcaagaatttaatgattaaaatagcatgcctttctctctttctcttaataagcccacatataaatgtacttttccttccagaaaaatttcccttgaggaaaaatgtccaagataagatgaatcatttaataccgtgtcttctaaatttgaaatataattctgtttctgacctgttttaaatgaaccaaaccaaatcatactttctcttcaaatttagcaacctagaaacacacatttctttgaatttaggtgatacctaaatccttcttatgtttctaaattttgtgattctataaaacacatcatcaataaaataatgactaaaaaaaaaaaaaaaaaaaaaaaaaaaaaaaaaaaaaaaaaaaaaaaaaacccaaaaaaaaaaaaaaaaaaaaaaaaaaa

SEQ ID NO: 65255 - DNA, 3983 bp, Homo sapiens
gtgtagattcgctggaagcagctggaggctccagttctcatctgctcaggtgtccccggcgccttggcgaactcggccactccagttcctcacgtggtgagcactcagggcagcgggtcgattttccgaggtcccatacctgggtttgaggggcgcggctcgcagcggcgggtgcaggggcgactgccagccctcaccccgcctcggggtgcgttcggaggccgacacctggaggacgcctccagtccccgcgggacgccacgcctgcgcgccagggatccgggataagaagtgcgcgccgggctccggctgcgcgccgcggggccaccagtttgcgcgcagggctcaggcgaccgtgcggccatggacacgccacggggcatcggcaccttcgtggtgtgggactacgtggtgttcgcgggcatgctggtcatctcggccgccatcggcatctactacgccttcgctgggggcggccagcagacctccaaggacttcctgatgggcggccgcagaatgaccgcagtgcccgtggcgctgtccctcaccgctagcttcatgtcagccgtcactgtcctgggcaccccctccgaggtctaccgttttggggccatttttagcatctttgccttcacctacttctttgtggtggtcatcagcgcggaggtcttcctcccggtgttctacaaactgggaattaccagcacctacgagtatttagaacttcgatttaacaaatgtgttcgtctctgtggaacagtcctcttcattgttcaaacaattctgtatactggaattgttatttatgcccctgccctggctttgaatcaagtcacaggatttgatctgtggggcgcggtagtggcaacgggggtggtctgcacattctactgcacactgggtggtcttaaagcagttatctggacagatgtttttcaaattgggatcatggtggctggatttgcatccgtgattatacaggctgtggtgatgcaaggtggaatcagcactattttaaatgatgcctatgatggtggaagattaaatttctggaattttaatcctaaccctttgcaaagacacaccttctggacaattattataggagggaccttcacatggaccagcatctacggtgtcaaccaatcccaggtgcagagatatatttcttgtaaaagcagattccaggcaaaactgtctctctacatcaatcttgtgggactctgggcaatcctcacatgctcagtgttttgtgggctcgccctatattccaggtaccatgactgtgatccttggacagccaagaaagtgtctgcaccagaccagctcatgccttatttggtactggacattctgcaagattatccaggacttcctggactttttgtggcctgtgcttacagtgggacattaagcacagtgtcctccagtattaatgccttagcagcagtaactgtggaagatctaatcaaaccttacttcagatcgctctcagaaaggtctctgtcttggatttcccaaggaatgagtgtggtgtatggagccctgtgtattggaatggctgcgctggcgtcacttatgggagctttgttgcaggcagcactcagcgtatttggtatggttggtggaccacttatgggcctgttcgctttgggcattttggttccctttgccaactcaattggagcacttgttggtctgatggctggatttgccatttctctatgggttggaattggagctcaaatatatcctccacttcctgagagaacattgccattgcaccttgatatccaaggctgtaacagcacctacaatgagacaaatttgattacaaccacagaaatgccatttactactagtgtttttcaaatatacaatgttcaaaggactccactgatggataactggtattctttatcatatctgtacttcagcactgttggaactttggtaacattattagtggggatacttgtcagtttatcaacaggaggaagaaaacagaacttagaccccagatatatactaaccaaagaggactttttatccaattttgatatttttaagaaaaagaagcatgttttgagctataaatcacatccagtggaagatggtggaactgataatcctgctttcaaccacattgaattgaactcagatcagagtggcaagagcaatgggactcgtttgtgaagctgctctgatactagatatccttaaatgatgtttcaattttatatgttttctaagataattggatcaggttttctttgtgtgtgtgtgtgtgtgttgtatcatgagtgtttgggggataagtttttgttaaaacaaagtctggactatcttcatttactacatcattaattgatgttactctggagtttagaattctggcattgacatttccctctctttcctttatttcgatgaagctataattgtgaaaattgtaactacatagatgctgaaaggctaatacacacatatgcacatgtatttgattgtcaaaggtatattcttaaatttgggtattattgaaaatattttccatgccttggtgctagcatataagtttggaagtttgccaacatcacaattcatcttgaaaagagcttttttccctcctaccacatacaccattcttagggagcaatgaggtaacaggtctgtgttgtctagatctttgctttttatccccctatcagtccagggcatatactaacctgcaaactgattctgaatcaggaaggtggtaatcaataagtattctggctgggaaagaccgtgggcccaatgatcaaagtcttcttggtgctgttcattaattcttgtgccttttggcttgttttctagagtttctgggctttggctgctgatactgcctttcttagactgtaatttttatctgcatgcccagtttctgacctatcaacttgggttttattgtgcactctaactgagcttgtcttcataattttctgtttattgccctgggcttggatatgtctcaagacactcatgtgaatcatgccaccccaaatcctggcttatcaagtcccagactataaattatgaactcccattagcttggtactaacatatacttgatgtaggtatttatggacttgatgatccaagaatattatattcttcaaaatggttaagctccatggagttagatgactacacttaatgctattaagttgaacttttgaatgtcaactaatttgcaatcaattaaagatacatatgcctagaaattttgaaatttcggtatatttatccagttaaagggctaaattatataagcaaacactactttttttaaaacgtctggactcaaaaaatgctttgttccatgttttaaaatttttaagtagcagtctcaaagttgcttagctgtttattttgctatgttcctagctaagagtttggttataggagttcatcaataacttattttttgtacagttcccacattagatactgtttaaaagttcttttttaaactcaattttttttagaaacataagagaaatatttagatacatacaaatgtttttatgattaaataattttatgcttattttctgatacgtgttatttaggtaatcatgccctgtacatttagaggttgctaactgacaatgttaagaaatttaaaaaaaaaaaaagcctgggcatgatggctcatgcttgtaatctgaacatttgggaggctgaggcaggaagatcgcttgaggtccagagtttaagtccagcctggaaacatagttagacctcatctctacaaaaataaaaaataaaaataaaaaaaacttagctaggcatgttgccacatacttgtagtcccagttattagggaagctgaggtgggaggatagcttaagcccaggatttcaaggctgcattgagctatgattacaccactgcactccagcctgggtaacagagtgaaatcttgtctctgggaaaaaaaa

SEQ ID NO: 65256 - DNA, 4520 bp, Homo sapiens
taggaacaggggagagtgcacctgctaccagtcaagctcagccagactgcaagaggaggcgaggcggagccagccgagggagtgaaccatggacaagttgaaatgcccgagtttcttcaagtgcagggagaaggagaaagtgtcggcttcatcagagaatttccatgttggtgaaaatgatgagaatcaggaccgtggtaactggtccaaaaaatcggattatcttctatctatgattggatacgcagtgggattaggaaatgtgtggagatttccatatctgacctacagcaatggtggaggcgccttcttgataccttatgcaattatgttagcattggctggtttacctttgttctttctggagtgttcactgggacaatttgctagcttaggtccagtttcagtttggaggattcttccattgtttcaaggtgtgggaattacaatggtcctgatctccatttttgtgacaatctattacaatgtcataattgcctatagtctttactacatgtttgcttcttttcaaagtgaactaccatggaaaaattgttcttcgtggtcagataaaaactgtagcagatcaccaatagtaactcactgtaatgtgagtacagtgaataaaggaatacaagagatcatccaaatgaataaaagctgggtagacatcaacaattttacctgcatcaacggcagtgaaatttatcagccagggcagcttcccagtgaacaatattggaataaagtggcgctccaacggtcaagtggaatgaatgagactggagtaattgtttggtatttagcactttgtcttcttctggcttggctcatagttggagcagcactatttaaaggaatcaaatcgtctggcaaggtggtatattttacagctcttttcccctatgtggtcctactcatcctgttagtacgaggtgcaactctggagggtgcttcaaaaggcatttcatactatattggagcccagtcaaattttacaaaacttaaggaagctgaggtatggaaagatgctgccactcagatattttactccctttcagtggcttggggtggcttagttgctctatcatcttacaataagttcaaaaacaactgcttctctgatgccattgtggtttgtttgacaaactgtctcactagcgtgtttgctggatttgctattttttctatattgggacacatggcccatatatctggaaaggaagtttctcaagttgtaaaatcaggttttgatttggcattcattgcctatccagaggctctagcccaactcccaggtggtccattttggtccatattattttttttcatgcttttaactttgggtctcgattctcagtttgcttcgattgaaacgatcacaacaacaattcaagatttatttcccaaagtgatgaagaaaatgagggttcccataactttgggctgctgcttggttttgtttctccttggtctcgtctgtgtgactcaggctggaatttactgggttcatctgattgaccacttctgtgctggatggggcattttaattgcagctatactggagctagttggaatcatctggatttatggagggaacagattcattgaggatacagaaatgatgattggagcaaagaggtggatattctggctatggtggagagcttgctggtttgtaattacgcctatccttttgattgcaatatttatctggtcattggtgcaatttcatagacctaattatggcgcaattccataccctgactggggagttgctttaggctggtgtatgattgttttctgcattatttggataccaattatggctatcataaaaataattcaggctaaaggaaacatctttcaacgccttataagttgctgcagaccagcttctaactggggtccatacctggaacaacatcgtggggaaagatataaagacatggtagatcctaaaaaagaggctgaccatgaaatacctactgttagtggcagcagaaaaccggaatgagatctcattgaaaaaaatatatgattgtataatgtgattttttttagaatagggggaaccttatttatttgtgtgttaactgaataggaaaatgtacatactatgttcatgatagtgtgatttttttcacatttaagcaggaatgcaatataaaaatgtgaatctcttaattctcagccatgtgcttattatatttctttttagattgtctatctgtataacacacacacacacacctaagagtctctatttcacaattatatttttgtaaatagtatatgcatttttaatacattggaggctttattttgaactaatttcttagagaatagttatattttctattacacaagtttaaaaatattattaacttgtattttcttaatatacaatctatcttttccacaaatatgagtgggaaataaatcagcacatttgaaagaaagtgttaaaactgaaggcctcacttaattagaaacgtgataaatatatggacaaatggactatacatactataagaggactgtagtttaatactttttacccaaatatgtttaaaaacatcgtgcatttgttacagctcatgttttctatatgaacttagtcattaatgttctttataaaaagtgaaataagatggaaaaattaggatcctacagccagtacgtgataaatctagaaaattgagttttgagtacctcttttcccatatacaatcttccttccttaggtaatttggaagaaaactatgacccatttaatttctattgtgtttcaccaaattcagtgttgttcattatacctctctgaaatataggtttaatttcaaatagaatatggacttaaatgttaatgagaaactggctttaatcaattctagcattttattactgtaatacagggctgatagagtgattttgtcttatatgagtcagttactacttacaggtgataacttgcatactattggaagataaagttgtcaaacttgtcaagaatgagaaaagccaaattagaaaatcctatgtcctagtttccttaccaaggataattaaatatatcactaagagctttatatattgattatatattgttgacaactggtttaagcatcatagcctatgatgataaacactgcctatatatgtaaatagcttttcatcaattcttaaatttcttaacctaggcttcagggagcatatgaaaccaaaattatatggaacattttctgtgtgtacatgtacatgcatttttctagggagagagtccgtaggtttatcagaatatcaaggaaaactgtgacccaaagaagtttaagaatcacatacagtgctgctggctttttgtgcttggcaaatgagtgacaatagaagaaataatttttcttacacattttaaaacgttttctcttccttgtgattgaagatgaaaggagtaagaaattaaggcatttgtttaatttatactggtaacttatttaggggggaggggacatgaaggtaggtaaataggtaggcctctaattgaaccacctctctaagttatgtacgtatatataagctgaaattgtgtttgacattctgagggttttctttttctttttcctttttttttttttttggtggggggctgggggtcagagtcttgttctgttgcctgggctggagtgcagtggcatgatctcagctcactgcaacctctgccttctggattcaagtgattctcctgcctcagcctcttgagtagctgggactacaggtgcccgccaccacaccagctaatttttgtatttttagtagaggcgaagtttccccatgttggccaggctggtcttgaactcccgacctcaagtgatctgtctacctcggcctcctaaagtgctgagattacaggtgtgagccaccgtgcccggcccattctaagggttttctttgaagacaggtcaaatgctgttagtaagtttcaggagattgttaattcctcagttataccagattttataaaatatttgagaatagatggctaacaagaggttagaaatacttttccttaattttaatccacagtatgttacatgcattctaccactacattttggtgctatttaaggtgtgcaattttctataggtgacttttgcaattcagggaagatttgggcatattaaatgaaagaatatctaattgggggaggtgtgaagggaaagaaattcttttcaaaagctgaccacaaagagtagttaaaagtttttgtcactatcttcacaagtgtgtaaagcacagatttcaacagagtgcttggcatattgtagggtgctcaatggtggtttttattattattactcagattccacagtggcaagaaacatcattctacataatggaaaacatttacatcaaatcccacttactttaatgcgaacttggagataatttatggtattgtattgtaaaccattaatgaaaactttttcacagttgagtgaaattaaaatcactatatctc

SEQ ID NO: 65257 - DNA, 1954 bp, Homo sapiens
gtctttcactctctcatactttctcctctcccctctcccaagcacatctgagttgctgcctgttcttcacacttagctccaaacccatgaaaaattgccaagtataaaagcttctcaagaatgagatggattctagggtgtcttcacctgagaagcaagataaagagaatttcgtgggtgtcaacaataaacggcttggtgtatgtggctggatcctgttttccctctctttcctgttggtgatcattaccttccccatctccatatggatgtgcttgaagatcattaaggagtatgaacgtgctgttgtattccgtctgggacgcatccaagctgacaaagccaaggggccaggtttgatcctggtcctgccatgcatagatgtgtttgtcaaagttgacctccgaacagttacttgcaacattcctccacaagagatcctcaccagagactccgtaactactcaggtagatggagttgtctattacagaatctatagtgctgtctcagcagtggctaatgtcaacgatgtccatcaagcaacatttctgctggctcaaaccactctgagaaatgtcttagggacacagaccttgtcccagatcttagctggacgagaagagatcgcccatagcatccagactttacttgatgatgccaccgaactgtgggggatccgggtggcccgagtggaaatcaaagatgttcggattcccgtgcagttgcagagatccatggcagccgaggctgaggccacccgggaagcgagagccaaggtccttgcagctgaaggagaaatgaatgcttccaaatccctgaagtcagcctccatggtgctggctgagtctcccatagctctccagctgcgctacctgcagaccttgagcacggtagccaccgagaagaattctacgattgtgtttcctctgcccatgaatatactagagggcattggtggcgtcagctatgataaccacaagaagcttccaaataaagcctgaggtcctcttgcggtagtcagctattgcatagagagtggtgtctattcctatggagaagccagtagttagaaacggtgagaattccaacactgttcatgtaacagtaactccatagatggaagagcattggcaggaaaaagctctagaggctatacagagaagaaaaaaagagcaaaaatgagacctgtatattacttttatttttaggaccataatcaactttgtaatattcttatataattaattagtggtggtctccgactttatagcaggaactttctggtagtatgagaagaaatcattgggtgactatgactaatgtttcagaattactttttaattgttttaaaaagcactccagataatttataagtaacataggcctcatatttacactatatgttcgctttataattccgaagttgttatttgctaaatctccaatggttgcaatcaaaccccacaatgctgaaaacagagattgattttgatgttaagaacaaaagaagtatggaaacttccaggcttaaacatgtcccccgtgccacaaggcaaactgcgatgagctcacagtccaggtctcttgctgtgtgtcctgcagggagtggccaactctccaccttccagcaccattatcagagggtgggaaaaggcacatgaaagtggccagctcctgtcaatttatttgcttacaagggagaatgcttggaaaggttgcattggttgaaaccactgaggagcatcaccctggggatttcatgttttcactctgttcttagtcccaggagccacaggtaatcgagaatgtttgtgaactctatccacatcccctcccccacctgccaaataacctgttcaaaacaaagaaggcatagaatataaatgaatttcaaaagttaaaaaaaaaaaaaaaaaaaaaaaaaaaaaaaaaaaaaaaaaaaaaaaaaaaaaaa

SEQ ID NO: 65258 - DNA, 2426 bp, Homo sapiens
acgcggggattctgtgtaattcctatccacagtcacttctgttcatttttaatgaaaacctattgctgttattttctattatgagttaacggtgatgtgtgttttttaaattttgtatacttgctctcaccctaaaatataccttaagagacttttcccctgtttttctttctgctttccaagactccaggaaaaacagcttccatggcacattttgtacagggcacatctagaatgattgccgcagaaagttctacggagcataaagagtgtgctgaaccatcaacaagaaagaacttgatgaattctcttgaacaaaagataaggtgtttggaaaaacaaagaaaagagctcctggaagttaaccagcaatgggatcagcaatttagaagtatgaaagagttatatgaaagaaaggtagcagagctgaagacgaaactggacgccgcggaaagattcctcagcacgcgggagaaggatccgcatcagaggcagagaaaggacgacaggcagagagaggacgacaggcagcgcgacctgacccgggaccggctgcagcgggaggagaaggaaaaggaacgcctaaatgaagaattacatgaattgaaagaagagaataaacttttaaagggaaaaaatactcttgcgaacaaggaaaaggaacattacgaatgtgaaataaaacgcctcaataaggctcttcaggatgccttgaatatcaagtgttcattttccgaggactgtttgaggaagtctcgagtggaattctgccatgaggagatgagaacagaaatggaagttctgaagcagcaggtgcaaatatacgaagaagacttcaaaaaggaacgatcggatcgagagagacttaatcaagagaaagaggagctacagcaaattaatgaaacttcccaatcccagttgaacaggctgaattcccagataaaagcttgtcagatggagaaagaaaaactagaaaagcaattaaaacagatgtattgcccaccctgtaactgcggcttggttttccacctgcaagatccatgggtaccaacaggccctggagctgtgcagaagcaacgggagcacccaccagactgtcagtggtatgctcttgaccagcttccgccagatgtacaacacaaggcaaatggtttatcctcagtaaagaaagtccatccgtagaagtacacactaacagagagagacaacaggcaacgagggagcgtggctgaggaccctcttctttgtttatactgaggcttgtttctgccacaaaggcacatcatctaccctgttatttgtgcctggtcatgttttcctttggtatgaatacaggaaaaggcttctgacagctaagatcctgatcaaattggaggagccagttattatacaaccaaatacaacttccagtttccttgaaatgagacttggcagatggatgatgcacgactccctgaaaatctcttcagcatattgctgttggatgcacaaaaatgattctatgatttaggcaactcagtgtttgctgcagggatattgtatgttgatttaaagtgcatatgtgtgtgtgtgtgtgtgtgtgtgtgtgtgtttcctggggtaaaaatttctgcagttgtaaacgtttaacattgctcccattcttcttccacagggccttagttctttagctatttgactacatattgttgacctcagtgatcctaaacgtagaattgaagaggtgtatatacctcgttaaattaaataagtggttcaatctgaataagatggttaattggaagctattccttagacagatcatttctttaagatggtgagaaattgtgcgcctgcatcacaagacttgattatgaaagataaagtcttgggctgggtgcagtggctcatgcctataatcccagcactttgggaggctgaggcaggtggattgctttgaggccaggagttctagaccagcctggccagcatggtgaaaccccatctctactataaatacaaaaattagccaggctcgtggcacacacctataaacccagctactcaggaggcttgaggcgggaggatcacttgagcccagggaggcagaggttgctgtaagttgagatcgccactgcactccagcctgggaaatagagtgagcaagactcagtgccccctacccacccactccacaccaccaaaaaaaaaaaaaaaaaaaaaaggaagacaaagtcctgatgggatgatgatggctatatggctatgctgtgtccatatatacttacagaaatatttcagacatatggatttatagttaaatctgtgtttttccttcctatggatttgattaattttaatgaaaaacttaattctgactcctcaagccaattaaaatgaaaatggaatttatttaaaaaaaaaaaaaaaaaaaaaaaaaaaaaaaa

SEQ ID NO: 65259 - DNA, 1382 bp, Homo sapiens
gcgggaccggccgcgtctccatggcgacgcgggacgcggcggtggaggcggttgctacccacctgctagaggcgctgcggctgtgatccaggctggggcgagaccatgtcggacctgggctcggaggagttggaggaggagggagagaatgatattggggaatatgaggggggtcggaatgaggcaggcgaaaggcacggacgtgggagggcacggctacccaacggggacacctacgaagggagctacgaattcggtaaaagacatggccaggggatctacaaatttaaaaatggtgctcgatatatcggagaatatgttagaaataaaaagcacggtcaaggcacttttatatatccagatggatccagatatgaaggagagtgggcaaatgacctgcggcacggccatggcgtatactactacatcaataatgacacctacactggagagtggtttgctcatcaaaggcatgggcaaggcacctatttatacgcggagacgggcagtaagtatgttggcacctgggtgaacggacagcaggagggcacggccgagctcattcacctgaaccacaggtaccagggcaagttcttgaacaaaaatcctgttggccctggaaagtatgtatttgatgttgggtgtgaacaacatggtgaatatcgtttaacagatatggaaagaggagaagaggaagaggaggaagaattagtaactgttgttccaaaatggaaagctacccaaatcactgaattggccctgtggacaccaactctccccaaaaagccgacctctacggatggacctggccaagacgctccaggagctgagagtgcaggagaacccggggaggaggcccaggctctgctggagggcttcgagggtgagatggacatgaggcctggagatgaagatgcagacgtcctccgggaagagagccgggagtatgaccaggaggagttccgctatgacatggatgagggaaacattaattctgaagaagaagaaactagacagtcagacctccaggactaagatgaagtgagccgagaggagatcgtatcataagaatgcttctgtcgttagccgggtgcagtgctgtgtgtatctagttccagctacttgagaggctgaggcaggaggattgcttgagtccagaaagtggcagttgcagtgagtggagatcgcgccactgctctccagcctgggtggcagagcgagaccctgtctcaaaaaataaacaaaaacaaaatgcttctgtcagttaacaatctttattagagggtttttagtctttctttctcagctgtatgttaagttgattgacaaatgcaaataaacgtctttattatcctttctttctgaaaaaaaaaaaaaaaaaa

SEQ ID NO: 65260 - DNA, 1741 bp, Homo sapiens
cactttcgagtgcgcgtttgctgcccgccgcagcccgggcgttgaaggtagtaaagcggccacccggccgcatcatggtgaccccctgtcccaccagcccctcgagccccgccgcccgagcggggaggcgggacaacgaccagaaccttcgcgccccggtgaagaagagcaggcgtccgcgcctccggaggaagcagccgctgcatcccctgaacccgtgcccgctcccgggagactccggcatttgcgacctgttcgagtcccccagctccggctcagacggcgcagagagcccctctgcggcgcggggtggtagccccctgcccggcccggcccagcccgtggcgcagctagatctacagaccttccgcgactacggccagagctgctacgccttccgcaaggcgcaggagagccacttccacccgcgggaggcgctggcacggcagccacaagtgaggtgctggtagagccagctccacgccgccgctcttcctctcctcccaggctctctcctctcctgccggctcggccctccgagcgcccgggcccgcgacagcccaggtcccgccccgagtcgaagcacaaggggccgtggaggggcgtcaccggcctcattttacagatggagaaaagtggggcgtagacggcttgagggacttgccccgtcccaagctggctactggggcacggtagagaggaattcgtttccgggttgagtctggactcctaccgaactcgggcaagttatttaacacccctgagcttctttcttcatctgcaaaatggaacccctccccttcctttgaattgctgagcccattacgcgaggtgacggcggaatcccgctgtaagctgctcagctggctgatcccggtgcaccgccaattcggcctctccttcgagtcgctgtgcctgacggtgaacactctggaccgcttcctcaccaccacgccggtggctgcagactgcttccagctgcttggggtcacctccttgctcatcgcttgcaaacaggtggaggtgcacccgccgcgcgtgaagcagcttctggccctctgctgcggcgccttctcccggcagcagctctgcaacctcgagtgcatcgtgctgcacaagctgcacttcaccctgggtgcgcccaccattagcttcttcctggagcatttcacgcacgctcgcgtggaggcggggcaggctgaggcctccgaagctctggaagcgcaagccctggcgcggggggtggcagagctgagtctggccgactatgccttcaccagctactccccttccctcctggcgatctgctgcctggcgctggcggaccgcatgctgcgggtctcgcggcccgtggacttgcgactgggagaccacccggaggcggcgctggaggactgtatgggcaagttgcagctgctggtggccataaacagtacttccttgactcacatgctgcccgttcagatctgcgagaagtgcagcctgcccccgagctcgaaataaaacagatccttcgtttccttttagtccctggcccggctgctggacctctcccgtagcctcagaagagtgcagtactggtccacagagaaggcttcaggacctgcttggtcagctgcaggttgtaaatagtgtacgatactagcatctggtattttatttattttgcagcgagcacatgaggaagctgagtctttcaccaataaacagttgtggtttgtctaaaaaaaaaaaaaaaaaa

SEQ ID NO: 65261 - DNA, 1448 bp, Homo sapiens
agtgagaggccgggggtgtggtagagagaaggagccggccgggtacttaggaccgcgccagcctctgagcccggcctccttcgcactttcgagtgcgcgtttgctgcccgccgcagcccgggcgttgaaggtagtaaagcggccacccggccgcatcatggtgaccccctgtcccaccagcccctcgagccccgccgcccgagcggggaggcgggacaacgaccagaaccttcgcgccccggtgaagaagagcaggcgtccgcgcctccggaggaagcagccgctgcatcccctgaacccgtgcccgctcccgggagactccggcatttgcgacctgttcgagtcccccagctccggctcagacggcgcagagagcccctctgcggcgcggggtggtagccccctgcccggcccggcccagcccgtggcgcagctagatctacagaccttccgcgactacggccagagctgctacgccttccgcaaggcgcaggagagccacttccacccgcgggaggcgctggcacggcagccacaagtgacggcggaatcccgctgtaagctgctcagctggctgatcccggtgcaccgccaattcggcctctccttcgagtcgctgtgcctgacggtgaacactctggaccgcttcctcaccaccacgccggtggctgcagactgcttccagctgcttggggtcacctccttgctcatcgcttgcaaacaggtggaggtgcacccgccgcgcgtgaagcagcttctggccctctgctgcggcgccttctcccggcagcagctctgcaacctcgagtgcatcgtgctgcacaagctgcacttcaccctgggtgcgcccaccattagcttcttcctggagcatttcacgcacgctcgcgtgggggcggggcaggctgaggcctccgaagctctggaagcgcaagccctggcgcggggggtggcagagctgagtctggccgactatgccttcaccagctactccccttccctcctggcgatctgctgcctggcgctggcggaccgcatgctgcgggtctcgcggcccgtggacttgcgactgggagaccacccggaggcggcgctggaggactgtatgggcaagttgcagctgctggtggccataaacagtacttccttgactcacatgctgcccgttcagatctgcgagaagtgcagcctgcccccgagctcgaaataaaacagatccttcgtttccttttagtccctggcccggctgctggacctctcccgtagcctcagaagagtgcagtactggtccacagagaaggcttcaggacctgcttggtcagctgcaggttgtaaatagtgtacgatactagcatctggtattttatttattttgcagcgagcacatgaggaagctgagtctttcaccaataaacagttgtggtttgtctaaaaaaaaaaaaaaaaaa

SEQ ID NO: 65262 - DNA, 2060 bp, Homo sapiens
acctgggtcgggtgcagactgcggagcgggccctaccgtgtgcgcagaaagaggaggcgcttgccttcagcttgtgggaaatcccgaagatggccaaagacaactcaactgttcgttgcttccagggcctgctgatttttggaaatgtgattattggttgttgcggcattgccctgactgcggagtgcatcttctttgtatctgaccaacacagcctctacccactgcttgaagccaccgacaacgatgacatctatggggctgcctggatcggcatatttgtgggcatctgcctcttctgcctgtctgttctaggcattgtaggcatcatgaagtccagcaggaaaattcttctggcgtatttcattctgatgtttatagtatatgcctttgaagtggcatcttgtatcacagcagcaacacaacaagactttttcacacccaacctcttcctgaagcagatgctagagaggtaccaaaacaacagccctccaaacaatgatgaccagtggaaaaacaatggagtcaccaaaacctgggacaggctcatgctccaggacaattgctgtggcgtaaatggtccatcagactggcaaaaatacacatctgccttccggactgagaataatgatgctgactatccctggcctcgtcaatgctgtgttatgaacaatcttaaagaacctctcaacctggaggcttgtaaactaggcgtgcctggtttttatcacaatcagggctgctatgaactgatctctggtccaatgaaccgacacgcctggggggttgcctggtttggatttgccattctctgctggactttttgggttctcctgggtaccatgttctactggagcagaattgaatattaagcataaagtgttgccaccatacctccttccccgagtgactctggatttggtgctggaaccagctctctcctaatattccacgtttgtgccccacactaacgtgtgtgtcttacattgccaagtcagatggtacggacttcctttaggatctcaggcttctgcagttctcatgactcctacttttcatcctagtctagcattctgcaacatttatatagactgttgaaaggagaatttgaaaaatgcataataactacttccatccctgcttatttttaatttgggaaaataaatacattcgaaggaacctgtgttatcacagtaacccagagctgtatttggctagcaatctgcctgtatctctcactattatctaaaagaaaccttccaatgcttctgttgatctcagtattgtcaggggaacagagaagttgggaaaagattactgaaatataccttttgcatttctttctagagtagctcccatatatggagatgggtgattctcttgatgccaccttcagatccttttattctccagaataattcttaacagtggttcaaatttcctttcataccttgaagtatgtgtttagtagcctcaattctccattaattaaaagtgtgggctgggcgtgggggctcatgcctgtaatcccagcactttgggaggccgaggtgggcagatcacctgaggtcaggagttcaagaccagcctggccaacatggtgaaaccccgtctctacaaaaatacaaaaattagccaggcgtgatggcaggtgcctgtaatcctagctacttggcaggctaacgcaggagaatcacttgaccgggagacagaggttgcagtgagctgagatcgtacctattgcactccatcctggatgaaagagccagactctgtctcaaaacaaacaaaaaagcgtggggacttctggggacagacaaggtgcctgttatatatttactcagtctttgccctgaatggtctcagcttgagaccatttcaaactggagagaagcaagccagccaatagaatggggtgatttacagggatttctgtttactgtcaaaatatttctcatctgcactatgtttccatttgtggtcctgaaggaaattcttataactcaacatttgtctggtcttataagtaaagacagctttaaaatctgttcactttcaaa

SEQ ID NO: 65263 - protein, 453 aa, Homo sapiens
MSKISEAVKRARAAFSSGRTRPLQFRIQQLEALQRLIQEQEQELVGALAADLHKNEWNAYYEEVVYVLEEIEYMIQKLPEWAADEPVEKTPQTQQDELYIHSEPLGVVLVIGTWNYPFNLTIQPMVGAIAAGNSVVLKPSELSENMASLLATIIPQYLDKDLYPVINGGVPETTELLKERFDHILYTGSTGVGKIIMTAAAKHLTPVTLELGGKSPCYVDKNCDLDVACRRIAWGKFMNSGQTCVAPDYILCDPSIQNQIVEKLKKSLKEFYGEDAKKSRDYGRIISARHFQRVMGLIEGQKVAYGGTGDAATRYIAPTILTDVDPQSPVMQEEIFGPVLPIVCVRSLEEAIQFINQREKPLALYMFSSNDKVIKKMIAETSSGGVAANDVIVHITLHSLPFGGVGNSGMGSYHGKKSFETFSHRRSCLVRPLMNDEGLKVRYPPSPAKMTQH

SEQ ID NO: 65264 - protein, 662 aa, Homo sapiens
MGLYRIRVSTGASLYAGSNNQVQLWLVGQHGEAALGKRLWPARGKETELKVEVPEYLGPLLFVKLRKRHLLKDDAWFCNWISVQGPGAGDEVRFPCYRWVEGNGVLSLPEGTGRTVGEDPQGLFQKHREEELEERRKLYRWGNWKDGLILNMAGAKLYDLPVDERFLEDKRVDFEVSLAKGLADLAIKDSLNVLTCWKDLDDFNRIFWCGQSKLAERVRDSWKEDALFGYQFLNGANPVVLRRSAHLPARLVFPPGMEELQAQLEKELEGGTLFEADFSLLDGIKANVILCSQQHLAAPLVMLKLQPDGKLLPMVIQLQLPRTGSPPPPLFLPTDPPMAWLLAKCWVRSSDFQLHELQSHLLRGHLMAEVIVVATMRCLPSIHPIFKLIIPHLRYTLEINVRARTGLVSDMGIFDQIMSTGGGGHVQLLKQAGAFLTYSSFCPPDDLADRGLLGVKSSFYAQDALRLWEIIYRYVEGIVSLHYKTDVAVKDDPELQTWCREITEIGLQGAQDRGFPVSLQARDQVCHFVTMCIFTCTGQHASVHLGQLDWYSWVPNAPCTMRLPPPTTKDATLETVMATLPNFHQASLQMSITWQLGRRQPVMVAVGQHEEEYFSGPEPKAVLKKFREELAALDKEIEIRNAKLDMPYEYLRPSVVENSVAI

SEQ ID NO: 65265 - protein, 458 aa, Homo sapiens
MAWASRLGLLLALLLPVVGASTPGTVVRLNKAALSYVSEIGKAPLQRALQVTVPHFLDWSGEALQPTRIRILNVHVPRLHLKFIAGFGVRLLAAANFTFKVFRAPEPLELTLPVELLADTRVTQSSIRTPVVSISACSLFSGHANEFDGSNSTSHALLVLVQKHIKAVLSNKLCLSISNLVQGVNVHLGTLIGLNPVGPESQIRYSMVSVPTVTSDYISLEVNAVLFLLGKPIILPTDATPFVLPRHVGTEGSMATVGLSQQLFDSALLLLQKAGALNLDITGQLRSDDNLLNTSALGRLIPEVARQFPEPMPVVLKVRLGATPVAMLHTNNATLRLQPFVEVLATASNSAFQSLFSLDVVVNLRLQLSVSKVKLQGTTSVLGDVQLTVASSNVGFIDTDQVRTLMGTVFEKPLLDHLNALLAMGIALPGVVNLHYVAPEIFVYEGYVVISSGLFYQS

SEQ ID NO: 65266 - protein, 256 aa, Homo sapiens
MDPTCSSECIYNLIPSDLKEPPQPPRYISIFKATVKDDMQKAKTAMKTMGPAKVEVPSPKDFLKKHSKEKTLPPKKNFDRNVPKKPAVPLKTDHPVMGIQSGKNFINTNAADIIMGVAKKPKPIYVDKRTGDKHDLEPSGLVPKYINKKDYGVTPEYICKRNEEIKKAQEDYDRYIQENLKKAAMKRLSDEEREAVLQGLKKNWEEVHKEFQSLSVFIDSIPKKIRKQRLEEEMKQLEHDIGIIEKHKIIYIANNA

SEQ ID NO: 65267 - protein, 467 aa, Homo sapiens
MESSTGPRMPLLKYCSVATSLKAPGWDGAAPPWDLSFTYPFALQAPWLTGHKPLARHASSCPCLHVADPAWQGPGWLGRAGDAANTWVLARREADGFYYRAQIKATPELERQGVLLVEFEAPLVAGPKLPAQQQRVVLEEDVIPLSPSVGYSLRPGDKVLALWEPGQQQYGPGTVLLGLEMRDPQRASKEKEITVHFWNGKAAKVPLGGVQSVSLTIWKKAVERLHKSFTREHPRPLHWAPCCSLLGPITGRITNELPPDAPFLCPLCHHHACCQLLCQGCLCGCPPCGTTWWPLTRTSEVMARELPELEPTAQLLPLEGPKEEKVAMHAPLAVSSSSSSSCEQDGVENDLEMGPPQRLMVNSAVNTDPIFLEMPLRQSGLCQPEWRYWKRNGPEPCPGKPGTRYSNICKEEKDHKQQRAQTVVVGTTKELVSKATHMKPPQTPPGEAEHRKRSQSLAICQWNKNSR

SEQ ID NO: 65268 - protein, 199 aa, Homo sapiens
MKDFLEKRDKGKLLIQRSRRLKQNLLRPMQLSVTEDGYIHYGDKVMLVNPDDPDTEADVFLRGDLSLCMTPDEIQSHLKDELEVPCGLSAVQAKTPIGRNTFIILSVHRDATGQVLRYGQDFCLGITGGFDNKMLYLSSDHRTLLKSSKRSWLQEVYLTDEVSHVNCWNMKASPSRQMLKFSSITVTQIGDWQPTGIFS

SEQ ID NO: 65269 - protein, 191 aa, Homo sapiens
MCFSRADAADNYPFGTCQQRKLFPHFHPPNLIGNKFVPLRGSPHRGPGCYFSDGYGLAYDLSRIPTSIKGYTLGARTAVRFKPIQKEMTPHAGRYQKVSPQQEKHKQNFAPFNVLVPRFKNYPKDTYYPSPGAYNPEKKPPPKIAWPMKFGSPDWAQVPCLQKRTLKAELSTDKDFRKHRNRVAYLSLYYN

SEQ ID NO: 65270 - protein, 137 aa, Homo sapiens
MAQKPLSTAAAERMNLVGQDEIWKYRLKAESEARQNWPQNWGFLTTPFEELIKCEEDLPTPKPKIELPERFRIRPVTPVEKYIKVFPSPPVPQTTQGFIGWRSAVPGLNKCLELDDAIRSCKGAFARELCWPKQGVH

SEQ ID NO: 65271 - protein, 132 aa, Homo sapiens
MLCSQPGLANSSRVRGRVGTIRPVRCPSSSLHMSQRERTWPPPAMSPYWRTWMTITQSWQVSVRVQPRGRAHLLPNPYQQDFLGLPEELRRLSGLSSVGHNWRKRMGTRRGRHEQSPTSRPRKVSSLPPRSC

SEQ ID NO: 65272 - protein, 715 aa, Homo sapiens
MSLDCTSHIALGAASPAPEETYDHLSEVPVTREQLNHYRNVAQNARSELAATLVKFECAQSELQDLRSKMLSKEVSCQELKAEMESYKENNARKSSLLTSLRDRVQELEEESAALSTSKIRTEITAHAAIKENQELKKKVVELNEKLQKCSKENEENKKQVSKNCRKHEEFLTQLRDCLDPDERNDKASDEDLILKLRDLRKENEFVKGQIVILEETINVHEMEAKASRETIMRLASEVNREQKKAASCTEEKEKLNQDLLSAVEAKEALEREVKIFQERLLAGQQVWDASKQEVSLLKKSSSELEKSLKASQDAVTTSQSQYFSFREKIAALLRGRLSMTGSTEDTILEKIREMDSREESRDRMVSQLEAQISELVEQLGKESGFHQKALQRAQKAENMLETLQGQLTHLEAELVSGGVLRDNLNFEKQKYLKFLDQLSQKMKLDQMAAELGFDMRLDVVLARTEQLVRLESNAVIENKTIAHNLQRKLKTQKERLESKELHMSLLRQKIAQLEEEKQARTALVVERDNAHLTIRNLQKKVERLQKELNTCRDLHTELKAKLADTNELKIKTLEQTKAIEDLNKSRDQLEKMKEKAEKKLMSVKSELDTTEHEAKENKERARNMIEVVTSEMKTLKKSLEEAEKREKQLADFREVVSQMLGLNVTSLALPDYEIIKCLERLVHSHQHHFVTCACLKDVTTGQERHPQGHLQLLH

SEQ ID NO: 65273 - protein, 198 aa, Homo sapiens
MAIQAKKKLTTATNPIERLRLQCLARGSAGIKGLGRVFRIMDDDNNRTLDFKEFMKGLNDYAVVMEKEEVEELFRRFDKDGNGTIDFNEFLLTLRPPMSRARKEVIMQAFRKLDKTGDGVITIEDLREVYNAKHHPKYQNGEWSEEQVFRKFLDNFDSPYDKDGLVTPEEFMNYYAGVSASIDTDVYFIIMMRTAWKL

SEQ ID NO: 65274 - protein, 438 aa, Homo sapiens
MEHAATTGPRPGPPSRRVENVVLRAKDWLPGAPGGTAVWATSLEAEVPPDLALNKEQQLQISKELVDIQITTHHLHEQHEAEIFQLKSEILRLESRVLELELRGDGTSQGCAVPVESDPRHPRAAAQELRHKAQVPGHSDDHRFQVQPKNTMNPENEQHRLGSGLQGEVKWALEHQEARQQALVTRVATLGRQLQGAREEARAAGQRLATQAVVLCSCQGQLRQAEAENARLQLQLKKLKDEYVLRLQHCARQAVEHADGAGQAPATTALRTFLEATLEDIRAAHRSREQQLARAARSYHKRLVDLSRRHEELLVAYRAPGNPQAIFDIASLDLEPLPVPLVTDFSHREDQHGGPGALLSSPKKRPGGASQGGTSEPQGLDAASWAQIHQKLRDFSRSTQSWNGSGHSCWSGPRWLKSNFLSYRSTWTSTWAGTSTKS

SEQ ID NO: 65275 - protein, 347 aa, Homo sapiens
MEHAATTGPRPGPPSRRVENVSPLGLAAPAMGLKSARSPKGQEGAGSCTLGLISARRGTFTAQPGREAGLVTAWEWGHSPAWDPPGEWVAVPPQVVLRAKDWLPGAPGGTAVWATSLEAEVPPDLALNKEQQLQISKELVDIQITTHHLHEQHEAEIFQLKSEILRLESRVLELELRGDGTSQGCAVPVESDPRHPRAAAQELRHKAQVPGHSDDHRFQVQPKNTMDPENEQHRLGSGVSVQPPSSGERAAPETPSLGSHPASPVCPTAAGGSEVGAGASGGPAAGTGDACVSGHLTWGPILEQREPLIVGLLSLTPVSSGQPWAGSCREPERRPGQPGSDWPHRLW

SEQ ID NO: 65276 - protein, 383 aa, Homo sapiens
MGVKASQTGFVVLVLLQCCSAYKLVCYYTSWSQYREGDGSCFPDALDRFLCTHIIYSFANISNDHIDTWEWNDVTLYGMLNTLKNRNPNLKTLLSVGGWNFGSQRFSKIASNTQSRRTFIKSVPPFLRTHGFDGLDLAWLYPGRRDKQHFTTLIKEMKAEFIKEAQPGKKQLLLSAALSAGKVTIDSSYDIAKISQHLDFISIMTYDFHGAWRGTTGHHSPLFRGQEDASPDRFSNTDYAVGYMLRLGAPASKLVMGIPTFGRSFTLASSETGVGAPISGPGIPGRFTKEAGTLAYYEICDFLRGATVHRTLGQQVPYATKGNQWVGYDDQESVKSKVQYLKDRQLAGAMVWALDLDDFQGSFCGQDLRFPLTNAIKDALAAT

SEQ ID NO: 65277 - protein, 207 aa, Homo sapiens
MAGPATQSPMKLMALQLLLWHSALWTVQEATPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 65278 - protein, 204 aa, Homo sapiens
MAGPATQSPMKLMALQLLLWHSALWTVQEATPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 65279 - protein, 200 aa, Homo sapiens
MSPEPALSPALQLLLWHSALWTVQEATPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 65280 - protein, 107 aa, Homo sapiens
MARAALSAAPSNPRLLRVALLLLLLVAAGRRAAGASVATELRCQCLQTLQGIHPKNIQSVNVKSPGPHCAQTEVIATLKNGRKACLNPASPIVKKIIEKMLNSDKSN

SEQ ID NO: 65281 - protein, 214 aa, Homo sapiens
MESENMDSENMKTENMESQNVDFESVSSVTALEALSKLLNPEEEDDSDYGQTNGLSTIGAMGPGNIGPPQIEELKVIPETSEENNEDIWNSEEIPEGAEYDDMWDVREIPEYEIIFRQQVGTEDIFLGLSKKDSSTGCCSELVAKIKLPNTNPSDIQIDIQETILDLRTPQKKLLITLPELVECTSAKAFYIPETETLEITMTMKRELDIANFF

SEQ ID NO: 65282 - protein, 319 aa, Homo sapiens; identical to SEQ ID NO: 62701

SEQ ID NO: 65283 - protein, 885 aa, Homo sapiens
MQEAIILLALLGAMSGGEALHLILLPATGNVAENSPPGTSVHKFSVKLSASLSPVIPGFPQIVNSNPLTEAFRVNWLSGTYFEVVTTGMEQLDFETGPNIFDLQIYVKDEVGVTDLQVLTVQVTDVNEPPQFQGNLAEGLHLYIVERANPGFIYQVEAFDPEDTSRNIPLSYFLISPPKSFRMSANGTLFSTTELDFEAGHRSFHLIVEVRDSGGLKASTELQVNIVNLNDEVPRFTSPTRVYTVLEELSPGTIVANITAEDPDDEGFPSHLLYSITTVSKYFMINQLTGTIQVAQRIDRDAGELRQNPTISLEVLVKDRPYGGQENRIQITFIVEDVNDNPATCQKFTFSIMVPERTAKGTLLLDLNKFCFDDDSEAPNNRFNFTMPSGVGSGSRFLQDPAGSGKIVLIGDLDYENPSNLAAGNKYTVIIQVQDVAPPYYKNNVYVYILTSPENEFPLIFDRPSYVFDVSERRPARTRVGQVRATDKDLPQSSLLYSISTGGASLQYPNVFWINPKTGELQLVTKVDCETTPIYILRIQATNNEDTSSVTVTVNILEENDEKPICTPNSYFLALPVDLKVGTNIQNFKLTCTDLDSSPRSFRYSIGPGNVNNHFTFSPNAGSNVTRLLLTSRFDYAGGFDKIWDYKLLVYVTDDNLMSDRKKAEALVETGTVTLSIKVIPHPTTIITTTPRPRVTYQVLRKNVYSPSAWYVPFVITLGSILLLGLLVYLVVLLAKAIHRHCPCKTGKNKEPLTKKGETKTAERDVVVETIQMNTIFDGEAIDPVTGETYEFNSKTGARKWKDPLTQMPKWKESSHQGAAPRRVTAGEGMGSLRSANWEEDELSGKAWAEDAGLGSRNEGGKLGNPKNRNPAFMNRAYPKPHPGK

SEQ ID NO: 65284 - protein, 515 aa, Homo sapiens
MEWKLERTAPRRVRTEEEMLWESIMRVLSKDLKQKRSQDSANVLDSVNATYSDFKSNFAKRLSAEVPVASSPITTRWQQSQTRALSSDSFGEEQSTTYLPEASGSVLKTPPEKETLTLGSCKEQLKTPSKGISETSNSALHFCKAPHAMDRDWKESVASKGQKCLKQLFVTQNVVQQANGKMQLCEQSECVWKGCKDGVRDESFHLKSSGDINDSILQPEVKIHITGLRNDYYLNILDWSFQNLVAIALGSAVYIWNGENHNGIENIDLSLTCNYISSVSWIKEGTCLAVGTSEGEVQLWDVVTKKRLRNMLGHLSVVGALSWNHFILSSGSRLGRVYHHDVRVAQHHVGTLRHKQAVCALKWSPDGRLLSSGCSDGLLTIWPHDPGASAQGQPLKVITQSTAVKAMDWCPWQSGVLAIGGGMKDGRLHILDINAGKSIQTPSTNSQICSLIWLPKTKEIATGQGTPKNDVTVWTCPTVSRSGHRGRVLHLALSPDQTRVFSAAADGTASVWNCY

SEQ ID NO: 65285 - protein, 178 aa, Homo sapiens
METGPSEEPSGRKESQEMCPPGLLVFAGSSEQDANLAKQFWISASMYPPSESQLVLRRDSSQRLPVARPRRSRGSENSHSSQSFHLASNKNRDIFAEALKIQESEEKVKYLQKTRSHSVTQNEVQWHDHGSLQPQLSRIQAKTREEILQLLRKQREERISKELISLPYKPKAKEHKAE

SEQ ID NO: 65286 - protein, 421 aa, Homo sapiens
MAESWLRLSGAGPAEEAGPEGGLEEPDALDDSLTSLQWLQEFSILNAKAPALPPGGTDPHGYHQVPGSAAPGSPLAADPACLGQPHTPGKPTSSCTSRSAPPGLQAPPPDDVDYATNPHVKPPYSYATLICMAMQASKATKITLSAIYKWITDNFCYFRHADPTWQNSIRHNLSLNKCFIKVPREKDEPGKGGFWRIDPQYAERLLSGAFKKRRLPPVHIHPAFARQAAQEPSAVPRAGPLTVNTEAQQLLREFEEATGEAGWGAGEGRLGHKRKQPLPKRVAKVPRPPSTLLPTPEEQGELEPLKGNFDWEAIFDAGTLGGELGALEALELSPPLSPASHVDVDLTIHGRHIDCPATWGPSVEQAADSLDFDETFLATSFLQHPWDESGSGCLPPEPLFEAGDATLASDLQDWASVGAFL

SEQ ID NO: 65287 - protein, 1228 aa, Homo sapiens
MLLNILQCIGRPPQQRMIRSKSQSVEVEKALSCSPLKISIGCFAMATQTSHVFHGQENMFLENHCIRRNTGRDSKKPLKQKNMNGLGQNSDNGLLVTHVNQTQDLLGTSSFPLFPLHGLTLAFVLQRLQGSETQSSDWEDSEDWLSAHSLKCQKLTLADLISQGTEVLEEGTNVVQKICFSTQIIRHFESKLSDTIEVYQERIQWLTENSKKAFGLIKGARVSILIDVSAISSGPQKEEFQKDLMSLIDEQLSHKEKLFVLSFGTNAGSLWPDPMEVSASTLQELKLWVKTLQPDGGSNLLQALKKIFTLKGLDSLVAIMRSCPDQPSEILSDYIQQSTMGRDLIIHFITYRCDDQMPPAVLKNLAEAVRGYYHCYSPKMEHYTSRDMDELLAEIQKAQSLLSHVQALQHSSPCEALTCTMEEISTEITNGPLISLLPKPPKHDAPLTIEFPNLDKTSAEWLKVNGLKAKKLSLYQVLAPNAFSPVEEFVPILQKTVSSTIHEKAMIQFEWHDGTVKNIHVDPPFLYKYQQQLSRAMRMYERRIEWLSLASRRIWGTVCEKRVVVLLDISATNSMYIIHIQHSLRLLLEEQLSNKDCFNLIAFGSTIESWRPEMVPVSHNNLQSAWRWALNLRCRGSRNVLSALRKAVEVDFKDKDKHQSQGIYLFTGGIPDQDMPTLSAYMAEACGGCDLQLNVCLFYVGEPKMDTTPPARYASHTDTAAAYKEVTRAAGGRFHWFGDTGIYESDDINSIMSEMEKALNYSQKCAFLMASLKNHSGKVLGSSALPKEKPKTLQLRSQPKKLCPPRPTVPLGARMSIKDDPDREKSPPLKSLKWRPLSTAAQPTKEGMMELRRKTKSREAETSLLLFYTEKGNDVGSVYKKYPQGRGLRRTSSSIDLPRKDTVCSSQEWVAKYGLKKLKLEISRCMGPNCTHQKSGQRSASAKHCSIFPSVEIHGVVRHIQWTPREMEVYIRHLEKVLRRYVQRLQWLLSGSRRLFGTVLESKVCILLDTSGSMGPYLQQVKTELVLLIWEQLRKCCDSFNLLSFAESFQSWQDTLVETTDAACHEAMQWVTHLQAQGSTSILQALLKAFSFHDLEGLYLLTDGKPDTSCSLVLNEVQKLREKRDVKVHTISLNCSDRAAVEFLRKLASFTGGRYHCPVGEDTLSKIHSLLTKGFINEKDPTLPPFEGDDLRILAQEITKARSFLWQAQSFRSQLQKKNDAEPKVTLS

SEQ ID NO: 65288 - protein, 1228 aa, Homo sapiens
MLLNILQCIGRPPQQRMIRSKSQSVEVEKALSCSPLKISIGCFAMATQTSHVFHGQENMFLENHCIRRNTGRDSKKPLKQKNMNGLGQNSDNGLLVTHVNQTQDLLGTSSFPLFPLHGLTLAFVLQRLQGSETQSSDWEDSEDWLSAHSLKCQKLTLADLISQGTEVLEEGTNVVQKICFSTQIIRHFESKLSDTIEVYQERIQWLTENSKKAFGLIKGARVSILIDVSAISSGPQKEEFQKDLMSLIDEQLSHKEKLFVLSFGTNAGSLWPDPMEVSASTLQELKLWVKTLQPDGGSNLLQALKKIFTLKGLDSLVAIMRSCPDQPSEILSDYIQQSTMGRDLIIHFITYRCDDQMPPAVLKNLAEAVRGYYHCYSPKMEHYTSRDMDELLAEIQKAQSLLSHVQALQHSSPCEALTCTMEEISTEITNGPLISLLPKPPKHDAPLTIEFPNLDKTSAEWLKVNGLKAKKLSLYQVLAPNAFSPVEEFVPILQKTVSSTIHEKAMIQFEWHDGTVKNIHVDPPFLYKYQQQLSRAMRMYERRIEWLSLASRRIWGTVCEKRVVVLLDISATNSMYIIHIQHSLRLLLEEQLSNKDCFNLIAFGSTIESWRPEMVPVSHNNLQSAWRWALNLRCRGSRNVLSALRKAVEVDFKDKDKHQSQGIYLFTGGIPDQDMPTLSAYMAEACGGCDLQLNVCLFYVGEPKMDTTPPARYASHTDTAAAYKEVTRAAGGRFHWFGDTGIYESDDINSIMSEMEKALNYSQKCAFLMASLKNHSGKVLGSSALPKEKPKTLQLRSQPKKLCPPRPTVPLGARMSIKDDPDREKSPPLKSLKWRPLSTAAQPTKEGMMELRRKTKSREAETSLLLFYTEKGNDVGSVYKKYPQGRGLRRTSSSIDLPRKDTVCSSQEWVAKYGLKKLKLEISRCMGPNCTHQKSGQRSASAKHCSIFPSVEIHGVVRHIQWTPREMEVYIRHLEKVLRRYVQRLQWLLSGSRRLFGTVLESKVCILLDTSGSMGPYLQQVKTELVLLIWEQLRKCCDSFNLLSFAESLQSWQDTLVETTDAACHEAMQWVTHLQAQGSTSILQALLKAFSFHDLEGLYLLTDGKPDTSCSLVLNEVQKLREKRDVKVHTISLNCSDRAAVEFLRKLASFTGGRYHCPVGEDTLSKIHSLLTKGFINEKDPTLPPFEGDDLRILAQEITKARSFLWQAQSFRSQLQKKNDAEPKVTLS

SEQ ID NO: 65289 - protein, 305 aa, Homo sapiens
MAVPWEEYFRLALQEKLSTKLPEQAEDHVPPVLRLLEKRQELVDADQALQAQKEVFRTKTAALKQRWEQLEQKERELKGSFIRFDKFLQDSEARRNRALRRAAEERHQAGRREVEALRLWTQLQELRREHARLQRRLKRLEPCARLLEQALELLPGFQEVPELVARFDGLAETQAALRLREREQLAELEAARARLQQLRDAWPDEVLAQGQRRAQLQERLEAARERTLQWESKWIQIQNTAAEKTLLLGRSRMAVLNLFQLVCQHQGQPPTLDIEDTEGQLEHDQTISFQNQLSARQGERLHGGT

SEQ ID NO: 65290 - protein, 305 aa, Homo sapiens; identical to SEQ ID NO: 65289

SEQ ID NO: 65291 - protein, 825 aa, Homo sapiens
MVGPREVVDPRGLTHGTHSRESSGDARPSAFPLPVIMVLLRLLVFLFAPVVSDLCSLPCFINVSESQGPGTVLQFLSFNCSSYTPTPTLELLNVQPPTTFFNPPSLARWQGTYVGKLTLSSSAQLDALMVNHYKVQLKFTCGNHVMEGSLSVDVQRDLSHIQCAGQFASPAGEMIQVPETVTPGARLYTLLLPGLELHGAQMSIISAQDLPHFPGPFSINEQGWLQAPSQGLLGQAQKVFQLQISVSFGQRQSCQGMVIVKVLPVPSSQVSFLEQAQNITIPENLAPGSEVVQVQARGVDLRYEILSPVPSPLFSIGRADGVVRTTTPLELARTSGTAVSRLQVKAFEQGQLWASAKLNLTMNVQLVNLWPPRCLPALLVSQIPETAPVGTVLNTLTCEDPDSVGATLDYKLWFRSSSNPASLCLYDRVLEVNATLDCDTPGACFQHAASILVLDGGQPQMTTEVPVLVMVTPINEFSPACAPRTFRVQEDAAPHTLLGSVVGTDMDYPHDNIEYYTSGGPTTFAVDRLSGEVHLLGPLDYEQQRLYRLTVLVIDHGQDQNPNHHLSGSCTITIEVEDVNDHAPECEPPFQELTIYAPLGRSVEVTKMSCQIPQEPQRLIYSYSIVGGNSQNRFILQGAILVHSDLVLGPFWPEQPRTYELLICVADAGPSTPHLSTTATIIVHLVPRRASTVATSTHRTTVPSTMTPMLVTDTEAFWQPQPWFVVVLTATGALLLLALGWLLGRLLQGLAQLLQAPSKPAQALLLNSIQGTEGSIEGFLEAPKMEMSQAPSSVMSLQHFDGRAQDSRTGRDYLFNTHTGARRWL

SEQ ID NO: 65292 - protein, 278 aa, Homo sapiens
MQLFTIVPYYKLFEVENSCHILTPSSALQFCFQPVYTLLFSHKDIATQSVGCSHISMHSPGGLTTTKMAGPLPRVSDSLFSAMELAKMSDMTKLHQAVAAGDYSLVKKILKKGLCDPNYKDVDWNDRTPLHWAAIKGQMEVIRLLIEYGARPCLVTSVGWTPAHFAAEAGHLNILKTLHALHAAIDAPDFFGDTPKRIAQIYGQKACVAFLEKAEPECQDHRCAAQQKGLPLDERDEDWDAKKRELELSLPSLNQNMNKKNKKSRGPTRPSNTKGRRV

SEQ ID NO: 65293 - protein, 278 aa, Homo sapiens; identical to SEQ ID NO: 65292

SEQ ID NO: 65294 - protein, 150 aa, Homo sapiens
MAGHPKEKVIPDEVHQNQILRELYLKELRTQKLYTQYHVNPLRKIHTVTRKPMSWHDNLEEPADARFLNLIHHAAQGPRKKYPETQTENQEVGWDLEPLVSVAPSSGNTRKHSSNINPERHDRRLNHFRVCSDITLYKAKTWGLGDDHHK

SEQ ID NO: 65295 - protein, 106 aa, Homo sapiens
MKRRVKSGTHLMCSLEVHTVTRKPMSWHDNLEEPADARFLNLIHHAAQGPRKKYPETQTENQEVGWDLEPLINPERHDRRLNHFRVCSDITLYKAKTWGLGDDHHK

SEQ ID NO: 65296 - protein, 150 aa, Homo sapiens; identical to SEQ ID NO: 65294

SEQ ID NO: 65297 - protein, 106 aa, Homo sapiens; identical to SEQ ID NO: 65295

SEQ ID NO: 65298 - protein, 512 aa, Homo sapiens
MLSARATVPQGGAGEGCLCLRDGAGDVAFIRESTVFEDLSDEAERDEYELLCPDNTRKPVDKFKDCHLARVPSHAVVARSVNGKEDAIWNLLRQAQEKFGKDKSPKFQLFGSPSGQKDLLFKDSAIGFSRVPPRIDSGLYLGSGYFTAIQNLRKSEEEVAARRARVVWCAVGEQELRKCNQWSGLSEGSVTCSSASTTEDCIALVLKGEADAMSLDGGYVYTAGKCGLVPVLAENYKSQQSSDPDPNCVDRPVEGYLAVAVVRRSDTSLTWNSVKGKKSCHTAVDRTAGWNIPMGLLFNQTGSCKFDEYFSQSCAPGSDPRSNLCALCIGDEQGENKCVPNSNERYYGYTGAFRCLAENAGDVAFVKDVTVLQNTDGNNNDAWAKDLKLADFALLCLDGKRKPVTEARSCHLAMAPNHAVVSRMDKVERLKQVLLHQQAKFGRNGSDCPDKFCLFQSETKNLLFNDNTECLARLHGKTTYEKYLGPQYVAGITNLKKCSTSPLLEACEFLRK

SEQ ID NO: 65299 - protein, 315 aa, Homo sapiens
MNSGVPATLAVRRVKFFGQHGGEVNSSAFSPDGQMLLTGSEDGCVYGWETRSGQLLWRLGGHTGPVKFCRFSPDGHLFASASCDCTVRLWDVARAKCLRVLKGHQRSVETVSFSPDSRQLASGGWDKRVMLWDVQSGQMLRLLVGHRDSIQSSDFSPTVNCLATGSWDSTVHIWDLRMVTPAVSHQALEGHSANISCLCYSASGLLASGSWDKTIHIWKPTTSSLLIQLKGHVTWVKSIAFSPDELWLASAGYSRMVKVWDCNTGKCLETLKQGVLDVAHTCAFTPDGKILVSGAADQTRRQISRTSKSPRDPQT

SEQ ID NO: 65300 - protein, 177 aa, Homo sapiens
MLRLLVGHRDSIQSSDFSPTVNCLATGSWDSTVHIWDLRMVTPAVSHQALEGHSANISCLCYSASGLLASGSWDKTIHIWKPTTSSLLIQLKGHVTWVKSIAFSPDELWLASAGYSRMVKVWDCNTGKCLETLKQGVLDVAHTCAFTPDGKILVSGAADQTRRQISRTSKSPRDPQT

SEQ ID NO: 65301 - protein, 540 aa, Homo sapiens
MPEIQCDLGKHVTQIIPLVNCTHETLKLQVTNSNPENFVLDINRKSQLIISPHSTTELPVLFYPSALGRADHQACINFYCTQFTEWKFYLSGVGLFPQPLDTERITTRIGLQSTIVIPFKNPTMEDVLIDIILTSVEHPRNLVMDHCWDSFIYESSAFRFSSPSEIQGIALPPKGNIDISLLFIPQIMKLHKTMVIIEMTKANGKYWPIDNFDELDIKFKSIVGIDSEEIQAIHWIYPIVGLPQAPPPKSPPVVIQCQSRKRAEEKVEIILNAGFFGFSLTPDLTEVLVIPKRNSHNFCEDPNEIPKIHEFEYEIQFESEAMKSKLESCVALYMIEKSYDIMAKRITFIFNLVFTPKKPLRSHITLKIECVTEGIWKFPIMLIATEPDTDAVIDIEGVGLFKESVFELRLKSQTRNPEPFTAHFLPGSDLEFFVKPQAGELLPFNTNGTLITVGFKPKMYCRKYKATLVIQTEEMYWKYEINGLTPTTVPPKNAKAKIDATHKTHDNMPVRPHNFVRENTKLIRTGVSSTIKGAPLVKNQ

SEQ ID NO: 65302 - protein, 165 aa, Homo sapiens
MKSKLESCVALYMIEKSYDIMAKRITFIFNLVFTPKKPLRNPEPFTAHFLPGSDLEFFVKPQAGELLPFNTNGTLITVGFKPKMYCRKYKATLVIQTEEMYWKYEINGLTPTTVPPKNAKAKIDATHKTHDNMPVRPHNFVRENTKLIRTGVSSTIKGAPLVKNQ

SEQ ID NO: 65303 - protein, 309 aa, Homo sapiens [sequence omitted]

SEQ ID NO: 65304 - protein, 162 aa, Homo sapiens
MLLILLSVALLALSSAQSLNEDVSQEESPSVISGKPEGRRPQGGNQPQRTPPPPGKPEGRPPQGGNQSQGPPPRPGKPEGSPSQGGNKPQGPPPHPGKPQGPPPQEGNKPQRPPPPGRPQGPPPPGGNPQQPLPPPAGKPQGPPPPPQGGRPHRPPQGQPPQ

SEQ ID NO: 65305 - protein, 2869 aa, Homo sapiens
METFENIRAAGGKMCWAPKSIECRAENYPEVSIDQVGQVLTCSLETGLTCKNEDQTGRFNMCFNYNVRVLCCDDYSHCPSTPATSSTATPSSTPGTTWILTKPTTTATTTASTGSTATPTSTLRTAPPPKVLTTTATTPTVTSSKATPSSSPGTATALPALRSTATTPTATSVTPIPSSSLGTTWTRLSQTTTPTATMSTATPSSTPETAHTSTVLTTTATTTGATGSVATPSSTPGTAHTTKVLTTTTTGFTATPSSSPGRARTLPVWISTTTTPTTRGSTVTPSSIPGTTHTPTVLTTTTTTVATGSMATPSSSTQTSGTPPSLTTTATTITATGSTTNPSSTPGTTPIPPVLTTTATTPAATSSTVTPSSALGTTHTPPVPNTTATTHGRSLSPSSPHTVRTAWTSATSGTLGTTHITEPSTGTSHTPAATTGTTQHSTPALSSPHPSSRTTESPPSPGTTTPGHTRATSRTTATATPSKTRTSTLLPSSPTSAPITTVVTMGCEPQCAWSEWLDYSYPMPGPSGGDFDTYSNIRAAGGAVCEQPLGLECRAQAQPGVPLRELGQVVECSLDFGLVCRNREQVGKFKMCFNYEIRVFCCNYGHCPSTPATSSTATPSSTPGTTWILTEQTTAATTTATTGSTAIPSSTPGTAPPPKVLTSTATTPTATSSKATSSSSPRTATTLPVLTSTATKSTATSFTPIPSFTLGTTGTLPEQTTTPMATMSTIHPSSTPETTHTSTVLTTKATTTRATSSMSTPSSTPGTTWILTELTTAATTTAATGPTAMPSSTPGTTWILTELTTTATTTESTGSTATPSSTPGTTWILTEPSTTATVTVPTGSTATASSTQATAGTPHVSTTATTPTVTSSKATPFSSPGTATALPALRSTATTPTATSFTAIPSSSLGTTWTRLSQTTTPTATMSTATPSSTPETAHTSTVLTTTATTTRATGSVATPSSTPGTAHTTKVPTTTTTGFTVTPSSSPGTARTPPVWISTTTTPTTSGSTVTPSSVPGTTHTPTVLTTTTTTVATGSMATPSSSTQTSGTPPSLITTATTITATGSTTNPSSTPGTTPIPPVLTTTATTPAATSSTVTPSSALGTTHTPPVPNTTATTHGRSLSPSSPHTVRTAWTSATSGTLGTTHITEPSTGTSHTPAATTGTTQHSTPALSSPHPSSRTTESPPSPGTTTPGHTRATSRTTATATPSKTRTSTLLPSSPTSAPITTVVTMGCEPQCAWSEWLDYSYPMPGPSGGDFDTYSNIRAAGGAVCEQPLGLECRAQAQPGVPLGELGQVVECSLDFGLVCRNREQVGKFKMCFNYEIRVFCCNYGHCPSTPATSSTAMPSSTPGTTWILTELTTTATTTASTGSTATPSSTPGTAPPPKVLTSPATTPTATSSKATSSSSPRTATTLPVLTSTATKSTATSVTPIPSSTLGTTGTLPEQTTTPVATMSTIHPSSTPETTHTSTVLTTKATTTRATSSTSTPSSTPGTTWILTELTTAATTTAATGPTATPSSTPGTTWILTELTTTATTTASTGSTATPSSTPGTTWILTEPSTTATVTVPTGSTATASSTQATAGTPHVSTTATTPTVTSSKATPSSSPGTATALPALRSTATTPTATSFTAIPSSSLGTTWTRLSQTTTPTATMSTATPSSTPETVHTSTVLTATATTTGATGSVATPSSTPGTAHTTKVPTTTTTGFTATPSSSPGTALTPPVWISTTTTPTTTTPTTSGSTVTPSSIPGTTHTARVLTTTTTTVATGSMATPSSSTQTSGTPPSLTTTATTITATGSTTNPSSTPGTTPITPVLTSTATTPAATSSKATSSSSPRTATTLPVLTSTATKSTATSFTPIPSSTLWTTWTVPAQTTTPMSTMSTIHTSSTPETTHTSTVLTTTATMTRATNSTATPSSTLGTTRILTELTTTATTTAATGSTATLSSTPGTTWILTEPSTIATVMVPTGSTATASSTLGTAHTPKVVTTMATMPTATASTVPSSSTVGTTRTPAVLPSSLPTFSVSTVSSSVLTTLRPTGFPSSHFSTPCFCRAFGQFFSPGEVIYNKTDRAGCHFYAVCNQHCDIDRFQGACPTSPPPVSSAPLSSPSPAPGCDNAIPLRQVNETWTLENCTVARCVGDNRVVLLDPKPVANVTCVNKHLPIKVSDPSQPCDFHYECECICSMWGGSHYSTFDGTSYTFRGNCTYVLMREIHARFGNLSLYLDNHYCTASATAAAARCPRALSIHYKSMDIVLTVTMVHGKEEGLILFDQIPVSSGFSKNGVLVSVLGTTTMRVDIPALGVSVTFNGQVFQARLPYSLFHNNTEGQCGTCTNNQRDDCLQRDGTTAASCKDMAKTWLVPDSRKDGCWAPTGTPPTASPAAPVSSTPTPTPCPPQPLCDLMLSQVFAECHNLVPPGPFFNACISDHCRGRLEVPCQSLEAYAELCRARGVCSDWRGATGGLCDLTCPPTKVYKPCGPIQPATCNSRNQSPQLEGMAEGCFCPEDQILFNAHMGICVQACPCVGPDGFPKFPGERWVSNCQSCVCDEGSVSVQCKPLPCDAQGQPPPCNRPGFVTVTRPRAENPCCPETVCVCNTTTCPQSLPVCPPGQESICTQEEGDCCPTFRCRPQLCSYNGTFYGVGATFPGALPCHMCTCLSGDTQDPTVQCQEDACNNTTCPQGFEYKRVAGQCCGECVQTACLTPDGQPVQLNETWVNSHVDNCTVYLCEAEGGVHLLTPQPASCPDVSSCRGSLRKTGCCYSCEEDSCQVRINTTILWHQGCETEVNITFCEGSCPGASKYSAEAQAMQHQCTCCQERRVHEETVPLHCPNGSAILHTYTHVDECGCTPFCVPAPMAPPHTRGFPAQEATAV

SEQ ID NO: 65306 - protein, 315 aa, Homo sapiens [sequence omitted]

SEQ ID NO: 65307 - protein, 177 aa, Homo sapiens [sequence omitted]

SEQ ID NO: 65308 - protein, 177 aa, Homo sapiens
MLGCGIPALGLLLLLQGSADGNGIQGFFYPWSCEGDIWDRESCGGQAAIDSPNLCLRLRCCYRNGVCYHQRPDENVRRKHMWALVWTCSGLLLLSCSICLFWWAKRRDVLHMPGFLAGPCDMSKSVSLLSKHRGTKKTPSTGSVPVALSKESRDVEGGTEGEGTEEGEETEGEEEED

SEQ ID NO: 65309 - protein, 477 aa, Homo sapiens
MKSLPILLLLCVAVCSAYPLDGAARGEDTSMNLVQKYLENYYDLKKDVKQFVRRKDSGPVVKKIREMQKFLGLEVTGKLDSDTLEVMRKPRCGVPDVGHFRTFPGIPKWRKTHLTYRIVNYTPDLPKDAVDSAVEKALKVWEEVTPLTFSRLYEGEADIMISFAVREHGDFYPFDGPGNVLAHAYAPGPGINGDAHFDDDEQWTKDTTGTNLFLVAAHEIGHSLGLFHSANTEALMYPLYHSLTDLTRFRLSQDDINGIQSLYGPPPDSPETPLVPTEPVPPEPGTPANCDPALSFDAVSTLRGEILIFKDRHFWRKSLRKLEPELHLISSFWPSLPSGVDAAYEVTSKDLVFIFKGNQFWAIRGNEVRAGYPRGIHTLGFPPTVRKIDAAISDKEKNKTYFFVEDKYWRFDEKRNSMEPGFPKQIAEDFPGIDSKIDAVFEEFGFFYFFTGSSQLEFDPNAKKVTHTLKSNSWLNC

SEQ ID NO: 65310 - protein, 5708 aa, Homo sapiens
MGAPSACRTLVLALAAMLVVPQAETQGPVEPSWENAGHTMDGGAPTSSPTRRVSFVPPVTVFPSLSPLNPAHNGRVCSTWGDFHYKTFDGDVFRFPGLCNYVFSEHCRAAYEDFNVQLRRGLVGSRPVVTRVVIKAQGLVLEASNGSVLINGQREELPYSRTGLLVEQSGDYIKVSIRLVLTFLWNGEDSALLELDPKYANQTCGLCGDFNGLPAFNEFYAHNARLTPLQFGNLQKLDGPTEQCPDPLPLPAGNCTDEEGICHRTLLGPAFAECHALVDSTAYLAACAQDLCRCPTCPCATFVEYSRQCAHAGGQPRNWRCPELCPRTCPLNMQHQECGSPCTDTCSNPQRAQLCEDHCVDGCFCPPGRSCTVLDDITHSGCLPLGQCPCTHGGRTYSPGTSFNTTCSSCTCSGGLWQCQDLPCPGTCSVQGGAHISTYDEKLYDLHGDCSYVLSKKCADSSFTVLAELRKCGLTDNENCLKAVTLSLDGGDTAIRVQADGGVFLNSIYTQLPLSAANITLFTPSSFFIVVQTGLGLQLLVQLVPLMQVFVRLDPAHQGQMCGLCGNFNQNQADDFTALSGVVEATGAAFANTWKAQAACANARNSFEDPCSLSVENENYARHWCSRLTDPNSAFSRCHSIINPKPFHSNCMFDTCNCERSEDCLCAALSSYVHACAAKGVQLSDWRDGVCTKYMQNCPKSQRYAYVVDACQPTCRGLSEADVTCSVSFVPVDGCTCPAGTFLNDAGACVPAQECPCYAHGTVLAPGEVVHDEGAVCSCTGGKLSCLGASLQKSTGCAAPMVYLDCSNSSAGTPGAECLRSCHTLDVGCFSTHCVSGCVCPPGLVSDGSGGCIAEEDCPCVHNEATYKPGETIRVDCNTCTCRNRRWECSHRLCLGTCVAYGDGHFITFDGDRYSFEGSCEYILAQDYCGDNTTHGTFRIVTENIPCGTTGTTCSKAIKLFVESYELILQEGTFKAVARGPGGDPPYKIRYMGIFLVIETHGMAVSWDRKTSVFIRLHQDYKGRVCGLCGNFDDNAINDFATRSRSVVGDALEFGNSWKLSPSCPDALAPKDPCTANPFRKSWAQKQCSILHGPTFAACRSQVDSTKYYEACVNDACACDSGGDCECFCTAVAAYAQACHDAGLCVSWRTPDTCPLFCDFYNPHGGCEWHYQPCGAPCLKTCRNPSGHCLVDLPGLEGCYPKCPPSQPFFNEDQMKCVAQCGCYDKDGNYYDVGARVPTAENCQSCNCTPSGIQCAHSLEACTCTYEDRTYSYQDVIYNTTDGLGACLIAICGSNGTIIRKAVACPGTPATTPFTFTTAWVPHSTTSPALPVSTVCVREVCRWSSWYNGHRPEPGLGGGDFETFENLRQRGYQVCPVLADIECRAAQLPDMPLEELGQQVDCDRMRGLMCANSQQSPPLCHDYELRVLCCEYVPCGPSPAPGTSPQPSLSASTEPAVPTPTQTTATEKTTLWVTPSIRSTAALTSQTGSSSGPVTVTPSAPGTTTCQPRCQWTEWFDEDYPKSEQLGGDVESYDKIRAAGGHLCQQPKDIECQAESFPNWTLAQVGQKVHCDVHFGLVCRNWEQEGVFKMCYNYRIRVLCCSDDHCRGRATTPPPTTELETATTTTTQALFSTPQPTSSPGLTRAPPASTTAVPTLSEGLTSPRYTSTLGTATTGGPTTPAGSTEPTVPGVATSTLPTRSALPGTTGSLGTWRPSQPPTLAPTTMATSRARPTGTASTASKEPLTTSLAPTLTSELSTSQAETSTPRTETTMSPLTNTTTSQGTTRCQPKCEWTEWFDVDFPTSGVAGGDMETFENIRAAGGKMCWAPKSIECRAENYPEVSIDQVGQVLTCSLETGLTCKNEDQTGRFNMCFNYNVRVLCCDDYSHCPSTPATSSTATPSSTPGTTWILTKPTTTATTTASTGSTATPTSTLRTAPPPKVLTTTATTPTVTSSKATPSSSPGTATALPALRSTATTPTATSVTPIPSSSLGTTWTRLSQTTTPTATMSTATPSSTPETAHTSTVLTATATTTGATGSVATPSSTPGTAHTTKVPTTTTTGFTATPSSSPGTALTPPVWISTTTTPTTRGSTVTPSSIPGTTHTATVLTTTTTTVATGSMATPSSSTQTSGTPPSLTTTATTITATGSTTNPSSTPGTTPIPPVLTTTATTPAATSNTVTPSSALGTTHTPPVPNTMATTHGRSLPPSSPHTVRTAWTSATSGILGTTHITEPSTVTSHTLAATTGTTQHSTPALSSPHPSSRTTESPPSPGTTTPGHTTATSRTTATATPSKTRTSTLLPSSPTSAPITTVVTMGCEPQCAWSEWLDYSYPMPGPSGGDFDTYSNIRAAGGAVCEQPLGLECRAQAQPGVPLRELGQVVECSLDFGLVCRNREQVGKFKMCFNYEIRVFCCNYGHCPSTPATSSTAMPSSTPGTTWILTELTTTATTTESTGSTATPTTATATAGTPHVSTTATTPTVTSSKATPFSSPGTATALPALRSTATTPTATSFTAIPSSSLGTTWTRLSQTTTPTATMSTATPSSTPETVHTSTVLTTTATTTGATGSVATPSSTPGTAHTTKVLTTTTTGFTATPSSSPGTARTLPVWISTTTTPTTRGSTVTPSSIPGTTHTPTVLTTTTTTVATGSMATPSSSTQTSGTPPSLTTTATTITATGSTTNPSSTPGTTPIPPVLTTTATTPAATSSTVTPSSALGTTHTPPVPNTTATTHGRSLSPSSPHTVRTAWTSATSGTLGTTHITEPSTGTSHTPAATTGTTQHSTPALSSPHPSSRTTESPPSPGTTTPGHTRATSRTTATATPSKTRTSTLLPSSPTSAPITTVVTMGCEPQCAWSEWLDYSYPMPGPSGGDFDTYSNIRAAGGAVCEQPLGLECRAQAQPGVPLRELGQVVECSLDFGLVCRNREQVGKFKMCFNYEIRVFCCNYGHCPSTPATSSTATPSSTPGTTWILTEQTTAATTTATTGSTAIPSSTPGTAPPPKVLTSTATTPTATSSKATSSSSPRTATTLPVLTSTATKSTATSFTPIPSFTLGTTGTLPEQTTTPMATMSTIHPSSTPETTHTSTVLTTKATTTRATSSMSTPSSTPGTTWILTELTTAATTTAATGPTATPSSTPGTTWILTEPSTTATVTVPTGSTATASSTRATAGTLKVLTSTATTPTVISSRATPSSSPGTATALPALRSTATTPTATSVTAIPSSSLGTAWTRLSQTTTPTATMSTATPSSTPETVHTSTVLTTTTTTTRATGSVATPSSTPGTAHTTKVPTTTTTGFTATPSSSPGTALTPPVWISTTTTPTTRGSTVTPSSIPGTTHTATVLTTTTTTVATGSMATPSSSTQTSGTPPSLTTTATTITATGSTTNPSSTPGTTPIPPVLTTTATTPAATSSTVTPSSALGTTHTPPVPNTTATTHGRSLPPSSPHTVRTAWTSATSGILGTTHITEPSTVTSHTPAATTSTTQHSTPALSSPHPSSRTTESPPSPGTTTPGHTRGTSRTTATATPSKTRTSTLLPSSPTSAPITTVVTTGCEPQCAWSEWLDYSYPMPGPSGGDFDTYSNIRAAGGAVCEQPLGLECRAQAQPGVPLRELGQVVECSLDFGLVCRNREQVGKFKMCFNYEIRVFCCNYGHCPSTPATSSTATPSSTPGTTWILTKLTTTATTTESTGSTATPSSTPGATAGTPHVSTTATTPTVTSSKATPFSSPGTATALPALRSTATTPTATSFTAIPSSSLGTTWTRLSQTTTPTATMSTATPSSTPETAHTSTVLTTTATTTRATGSVATPSSTPGTAHTTKVPTTTTTGFTVTPSSSPGTARTPPVWISTTTTPTTSGSTVTPSSVPGTTHTPTVLTTTTTTVATGSMATPSSSTQTSGTPPSLITTATTITATGSTTNPSSTPGTTPIPPVLTTTATTPAATSSTVTPSSALGTTHTPPVPNTTATTHGRSLSPSSPHTVRTAWTSATSGTLGTTHITEPSTGTSHTPAATTGTTQHSTPALSSPHPSSRTTESPPSPGTTTPGHTTATSRTTATATPSKTRTSTLLPSSPTSAPITTVVTTGCEPQCAWSEWLDYSYPMPGPSGGDFDTYSNIRAAGGAVCEQPLGLECRAQAQPGVPLGELGQVVECSLDFGLVCRNREQVGKFKMCFNYEIRVFCCNYGHCPSTPATSSTAMPSSTPGTTWILTELTTTATTTASTGSTATPSSTPGTAPPPKVLTSPATTPTATSSKATSSSSPRTATTLPVLTSTATKSTATSVTPIPSSTLGTTGTLPEQTTTPVATMSTIHPSSTPETTHTSTVLTTKATTTRATSSTSTPSSTPGTTWILTELTTAATTTAATGPTATPSSTPGTTWILTELTTTATTTASTGSTATPSSTPGTTWILTEPSTTATVTVPTGSTATASSTQATAGTPHVSTTATTPTVTSSKATPSSSPGTATALPALRSTATTPTATSFTAIPSSSLGTTWTRLSQTTTPTATMSTATPSSTPETVHTSTVLTATATTTGATGSVATPSSTPGTAHTTKVPTTTTTGFTATPSSSPGTALTPPVWISTTTTPTTTTPTTSGSTVTPSSIPGTTHTARVLTTTTTTVATGSMATPSSSTQTSGTPPSLTTTATTITATGSTTNPSSTPGTTPITPVLTSTATTPAATSSKATSSSSPRTATTLPVLTSTATKSTATSFTPIPSSTLWTTWTVPAQTTTPMSTMSTIHTSSTPETTHTSTVLTTTATMTRATNSTATPSSTLGTTRILTELTTTATTTAATGSTATLSSTPGTTWILTEPSTIATVMVPTGSTATASSTLGTAHTPKVVTTMATMPTATASTVPSSSTVGTTRTPAVLPSSLPTFSVSTVSSSVLTTLRPTGFPSSHFSTPCFCRAFGQFFSPGEVIYNKTDRAGCHFYAVCNQHCDIDRFQGACPTSPPPVSSAPLSSPSPAPGCDNAIPLRQVNETWTLENCTVARCVGDNRVVLLDPKPVANVTCVNKHLPIKVSDPSQPCDFHYECECICSMWGGSHYSTFDGTSYTFRGNCTYVLMREIHARFGNLSLYLDNHYCTASATAAAARCPRALSIHYKSMDIVLTVTMVHGKEEGLILFDQIPVSSGFSKNGVLVSVLGTTTMRVDIPALGVSVTFNGQVFQARLPYSLFHNNTEGQCGTCTNNQRDDCLQRDGTTAASCKDMAKTWLVPDSRKDGCWAPTGTPPTASPAAPVSSTPTPTPCPPQPLCDLMLSQVFAECHNLVPPGPFFNACISDHCRGRLEVPCQSLEAYAELCRARGVCSDWRGATGGLCDLTCPPTKVYKPCGPIQPATCNSRNQSPQLEGMAEGCFCPEDQILFNAHMGICVQACPCVGPDGFPKFPGERWVSNCQSCVCDEGSVSVQCKPLPCDAQGQPPPCNRPGFVTVTRPRAENPCCPETVCVCNTTTCPQSLPVCPPGQESICTQEEGDCCPTFRCRPQLCSYNGTFYGVGATFPGALPCHMCTCLSGDTQDPTVQCQEDACNNTTCPQGFEYKRVAGQCCGECVQTACLTPDGQPVQLNETWVNSHVDNCTVYLCEAEGGVHLLTPQPASCPDVSSCRGSLRKTGCCYSCEEDSCQVRINTTILWHQGCETEVNITFCEGSCPGASKYSAEAQAMQHQCTCCQERRVHEETVPLHCPNGSAILHTYTHVDECGCTPFCVPAPMAPPHTRGFPAQEATAV

SEQ ID NO: 65311 - protein, 341 aa, Homo sapiens
MEPAFGEVNQLGGVFVNGRPLPNAIRLRIVELAQLGIRPCDISRQLRVSHGCVSKILARYNETGSILPGAIGGSKPRVTTPTVVKHIRTYKQRDPGIFAWEIRDRLLADGVCDKYNVPSVSSISRILRNKIGNLAQQGHYDSYKQHQPTPQPALPYNHIYSYPSPITAAAAKVPTPPGVPAIPGSVAMPRTWPSSHSVTDILGIRSITDQVSDSSPYHSPKVEEWSSLGRNNFPAAAPHAVNGLEKGALEQEAKYGQAPNGLPAVGSFVSASSMAPYPTPAQVSPYMTYSAAPSGYVAGHGWQHAGGTSLSPHNCDIPASLAFKGMQAAREGSHSVTASAL

SEQ ID NO: 65312 - protein, 221 aa, Homo sapiens
MASRPLPPGRQEEENAKDSGRKPSPVRPRGCLPSIDEARPAGPGPAPASRRGSMLGLAASFSRRNSLVGPGAGPGGQRPSLGPVPPLGSRVSFSGLPLAPARWVAPSYRTEPVPGERWEAARAQRALEAALAAGLHDACYSSDEAARLVRELCEQVHVRLRELSPPRYKLVCSVVLGPRAGQGVHVVSRALWDVARDGLASVSYTNTSLFAVATVHGLYCE

SEQ ID NO: 65313 - protein, 716 aa, Homo sapiens
MEDSTSPKQEKENQEELGETRRPWEGKTAASPQYSEPESSEPLEAKQGPETGRQSRSSRPWSPQSRAKTPLGGPAGPETSSPAPVSPREPSSSPSPLAPARQDLAAPPQSDRTTSVIPEAGTPYPDPLEQSSDKRESTPHHTSQSEGNTFQQSQQPKPHLCGRRDVSYNNAKQKELRFDVFQEEDSNSDYDLQQPAPGGSEVAPSMLEITIQNAKAYLLKTSSNSGFNLYDHLSNMLTKILNERPENAVDIFENISQDVKMAHFSKKFDALQNENELLPTYEIAEKQKALFLQGHLEGVDQELEDEIAENALPNVMESAFYFEQAGVGLGTDETYRIFLALKQLTDTHPIQRCRFWGKILGLEMNYIVAEVEFREGEDEEEVEEEDVAEERDNGESEAHEDEEDELPKSFYKAPQAIPKEESRTGANKYVYFVCNEPGRPWVKLPPVIPAQIVIARKIKKFFTGRLDAPIISYPPFPGNESNYLRAQIARISAGTHVSPLGFYQFGEEEGEEEEEAEGGRNSFEENPDFEGIQVIDLVESLSNWVHHVQHILSQGRCNWFNSIQKNEEEEEEEDEEKDDSDYIEQEVGLPLLTPISEDLEIQNIPPWTTRLSSNLIPQYAIAVLQSNLWPGAYAFSNGKKFENFYIGWGHKYSPDNYTPPVPPPVYQEYPSGPEITEMDDPSVEEEQAFRAAQEAVLLAAENEESEEDEDEEDDYD

SEQ ID NO: 65314 - protein, 390 aa, Homo sapiens
MNSLSEANTKFMFDLFQQFRKSKENNIFYSPISITSALGMVLLGAKDNTAQQISKVLHFDQVTENTTEKAATYHVDRSGNVHHQFQKLLTEFNKSTDAYELKIANKLFGEKTYQFLQEYLDAIKKFYQTSVESTDFANAPEESRKKINSWVESQTNEKIKNLFPDGTIGNDTTLVLVNAIYFKGQWENKFKKENTKEEKFWPNKNTYKSVQMMRQYNSFNFALLEDVQAKVLEIPYKGKDLSMIVLLPNEIDGLQKLEEKLTAEKLMEWTSLQNMRETCVDLHLPRFKMEESYDLKDTLRTMGMVNIFNGDADLSGMTWSHGLSVSKVLHKAFVEVTEEGVEAAAATAVVVVELSSPSTNEEFCCNHPFLFFIRQNKTNSILFYGRFSSP

SEQ ID NO: 65315 - protein, 610 aa, Homo sapiens
MDTPRGIGTFVVWDYVVFAGMLVISAAIGIYYAFAGGGQQTSKDFLMGGRRMTAVPVALSLTASFMSAVTVLGTPSEVYRFGAIFSIFAFTYFFVVVISAEVFLPVFYKLGITSTYEYLELRFNKCVRLCGTVLFIVQTILYTGIVIYAPALALNQVTGFDLWGAVVATGVVCTFYCTLGGLKAVIWTDVFQIGIMVAGFASVIIQAVVMQGGISTILNDAYDGGRLNFWNFNPNPLQRHTFWTIIIGGTFTWTSIYGVNQSQVQRYISCKSRFQAKLSLYINLVGLWAILTCSVFCGLALYSRYHDCDPWTAKKVSAPDQLMPYLVLDILQDYPGLPGLFVACAYSGTLSTVSSSINALAAVTVEDLIKPYFRSLSERSLSWISQGMSVVYGALCIGMAALASLMGALLQAALSVFGMVGGPLMGLFALGILVPFANSIGALVGLMAGFAISLWVGIGAQIYPPLPERTLPLHLDIQGCNSTYNETNLITTTEMPFTTSVFQIYNVQRTPLMDNWYSLSYLYFSTVGTLVTLLVGILVSLSTGGRKQNLDPRYILTKEDFLSNFDIFKKKKHVLSYKSHPVEDGGTDNPAFNHIELNSDQSGKSNGTRL

SEQ ID NO: 65316 - protein, 642 aa, Homo sapiens
MDKLKCPSFFKCREKEKVSASSENFHVGENDENQDRGNWSKKSDYLLSMIGYAVGLGNVWRFPYLTYSNGGGAFLIPYAIMLALAGLPLFFLECSLGQFASLGPVSVWRILPLFQGVGITMVLISIFVTIYYNVIIAYSLYYMFASFQSELPWKNCSSWSDKNCSRSPIVTHCNVSTVNKGIQEIIQMNKSWVDINNFTCINGSEIYQPGQLPSEQYWNKVALQRSSGMNETGVIVWYLALCLLLAWLIVGAALFKGIKSSGKVVYFTALFPYVVLLILLVRGATLEGASKGISYYIGAQSNFTKLKEAEVWKDAATQIFYSLSVAWGGLVALSSYNKFKNNCFSDAIVVCLTNCLTSVFAGFAIFSILGHMAHISGKEVSQVVKSGFDLAFIAYPEALAQLPGGPFWSILFFFMLLTLGLDSQFASIETITTTIQDLFPKVMKKMRVPITLGCCLVLFLLGLVCVTQAGIYWVHLIDHFCAGWGILIAAILELVGIIWIYGGNRFIEDTEMMIGAKRWIFWLWWRACWFVITPILLIAIFIWSLVQFHRPNYGAIPYPDWGVALGWCMIVFCIIWIPIMAIIKIIQAKGNIFQRLISCCRPASNWGPYLEQHRGERYKDMVDPKKEADHEIPTVSGSRKPE

SEQ ID NO: 65317 - protein, 291 aa, Homo sapiens
MDSRVSSPEKQDKENFVGVNNKRLGVCGWILFSLSFLLVIITFPISIWMCLKIIKEYERAVVFRLGRIQADKAKGPGLILVLPCIDVFVKVDLRTVTCNIPPQEILTRDSVTTQVDGVVYYRIYSAVSAVANVNDVHQATFLLAQTTLRNVLGTQTLSQILAGREEIAHSIQTLLDDATELWGIRVARVEIKDVRIPVQLQRSMAAEAEATREARAKVLAAEGEMNASKSLKSASMVLAESPIALQLRYLQTLSTVATEKNSTIVFPLPMNILEGIGGVSYDNHKKLPNKA

SEQ ID NO: 65318 - protein, 325 aa, Homo sapiens
MAHFVQGTSRMIAAESSTEHKECAEPSTRKNLMNSLEQKIRCLEKQRKELLEVNQQWDQQFRSMKELYERKVAELKTKLDAAERFLSTREKDPHQRQRKDDRQREDDRQRDLTRDRLQREEKEKERLNEELHELKEENKLLKGKNTLANKEKEHYECEIKRLNKALQDALNIKCSFSEDCLRKSRVEFCHEEMRTEMEVLKQQVQIYEEDFKKERSDRERLNQEKEELQQINETSQSQLNRLNSQIKACQMEKEKLEKQLKQMYCPPCNCGLVFHLQDPWVPTGPGAVQKQREHPPDCQWYALDQLPPDVQHKANGLSSVKKVHP

SEQ ID NO: 65319 - protein, 309 aa, Homo sapiens
MSDLGSEELEEEGENDIGEYEGGRNEAGERHGRGRARLPNGDTYEGSYEFGKRHGQGIYKFKNGARYIGEYVRNKKHGQGTFIYPDGSRYEGEWANDLRHGHGVYYYINNDTYTGEWFAHQRHGQGTYLYAETGSKYVGTWVNGQQEGTAELIHLNHRYQGKFLNKNPVGPGKYVFDVGCEQHGEYRLTDMERGEEEEEEELVTVVPKWKATQITELALWTPTLPKKPTSTDGPGQDAPGAESAGEPGEEAQALLEGFEGEMDMRPGDEDADVLREESREYDQEEFRYDMDEGNINSEEEETRQSDLQD

SEQ ID NO: 65320 - protein, 131 aa, Homo sapiens
MVTPCPTSPSSPAARAGRRDNDQNLRAPVKKSRRPRLRRKQPLHPLNPCPLPGDSGICDLFESPSSGSDGAESPSAARGGSPLPGPAQPVAQLDLQTFRDYGQSCYAFRKAQESHFHPREALARQPQVRCW

SEQ ID NO: 65321 - protein, 350 aa, Homo sapiens
MVTPCPTSPSSPAARAGRRDNDQNLRAPVKKSRRPRLRRKQPLHPLNPCPLPGDSGICDLFESPSSGSDGAESPSAARGGSPLPGPAQPVAQLDLQTFRDYGQSCYAFRKAQESHFHPREALARQPQVTAESRCKLLSWLIPVHRQFGLSFESLCLTVNTLDRFLTTTPVAADCFQLLGVTSLLIACKQVEVHPPRVKQLLALCCGAFSRQQLCNLECIVLHKLHFTLGAPTISFFLEHFTHARVGAGQAEASEALEAQALARGVAELSLADYAFTSYSPSLLAICCLALADRMLRVSRPVDLRLGDHPEAALEDCMGKLQLLVAINSTSLTHMLPVQICEKCSLPPSSK

SEQ ID NO: 65322 - protein, 260 aa, Homo sapiens
MAKDNSTVRCFQGLLIFGNVIIGCCGIALTAECIFFVSDQHSLYPLLEATDNDDIYGAAWIGIFVGICLFCLSVLGIVGIMKSSRKILLAYFILMFIVYAFEVASCITAATQQDFFTPNLFLKQMLERYQNNSPPNNDDQWKNNGVTKTWDRLMLQDNCCGVNGPSDWQKYTSAFRTENNDADYPWPRQCCVMNNLKEPLNLEACKLGVPGFYHNQGCYELISGPMNRHAWGVAWFGFAILCWTFWVLLGTMFYWSRIEY

SEQ ID NO: 65323 - DNA, 20 bp, Homo sapiens
gatcaaaggcatatacttcc

SEQ ID NO: 65324 - DNA, 20 bp, Homo sapiens
gatcgagatttgttttcctg

SEQ ID NO: 65325 - DNA, 20 bp, Homo sapiens
gatcatcatgacggctgctg

SEQ ID NO: 65326 - DNA, 20 bp, Homo sapiens
gatcatttgagcccaggacg

SEQ ID NO: 65327 - DNA, 20 bp, Homo sapiens
gatctttgtctatgagggct

SEQ ID NO: 65328 - DNA, 20 bp, Homo sapiens
gatcagattctctctctctt

SEQ ID NO: 65329 - DNA, 20 bp, Homo sapiens
gatcctgccctggggctccc

SEQ ID NO: 65330 - DNA, 20 bp, Homo sapiens
gatcagtaacctattatttt

SEQ ID NO: 65331 - DNA, 20 bp, Homo sapiens
gatcatcaaacaaggatgga

SEQ ID NO: 65332 - DNA, 20 bp, Homo sapiens
gatccagacagtcagaagaa

SEQ ID NO: 65333 - DNA, 20 bp, Homo sapiens
gatcataacatgatttatag

SEQ ID NO: 65334 - DNA, 20 bp, Homo sapiens
gatcacgggacacagctggt

SEQ ID NO: 65335 - DNA, 20 bp, Homo sapiens
gatcagagctgatgttattc

SEQ ID NO: 65336 - DNA, 20 bp, Homo sapiens
gatcagcccgatgcttgact

SEQ ID NO: 65337 - DNA, 20 bp, Homo sapiens
gatcagttgggccaccttgg

SEQ ID NO: 65338 - DNA, 20 bp, Homo sapiens
gatcatccactccatcctgc

SEQ ID NO: 65339 - DNA, 20 bp, Homo sapiens
gatccaagccaccctcagtc

SEQ ID NO: 65340 - DNA, 20 bp, Homo sapiens
gatccagctgatgaactctg

SEQ ID NO: 65341 - DNA, 20 bp, Homo sapiens
gatccccctggacatggtgg

SEQ ID NO: 65342 - DNA, 20 bp, Homo sapiens
gatcctaactcaggacactc

SEQ ID NO: 65343 - DNA, 20 bp, Homo sapiens
gatcgaggcttccttcaatg

SEQ ID NO: 65344 - DNA, 20 bp, Homo sapiens
gatcgtgctggaagtgtttc

SEQ ID NO: 65345 - DNA, 20 bp, Homo sapiens
gatctcagtgatgatgtttt

SEQ ID NO: 65346 - DNA, 20 bp, Homo sapiens
gatctggggtcccagtgtca

SEQ ID NO: 65347 - DNA, 20 bp, Homo sapiens
gatcttaatttgccattctg

SEQ ID NO: 65348 - DNA, 20 bp, Homo sapiens
gatcagaagctgcaaaggtg

SEQ ID NO: 65349 - DNA, 20 bp, Homo sapiens
gatcaccgactaatgcctct

SEQ ID NO: 65350 - DNA, 20 bp, Homo sapiens
gatcatttttagtctcttac

SEQ ID NO: 65351 - DNA, 20 bp, Homo sapiens
gatcaaaggacttggcagag

SEQ ID NO: 65352 - DNA, 20 bp, Homo sapiens
gatcaaacaacagtctgagc

SEQ ID NO: 65353 - DNA, 20 bp, Homo sapiens
gatccaccagaagctccggg

SEQ ID NO: 65354 - DNA, 20 bp, Homo sapiens
gatcctgaggttctgagacc

SEQ ID NO: 65355 - DNA, 20 bp, Homo sapiens
gatcaagcagagaaaataat

SEQ ID NO: 65356 - DNA, 20 bp, Homo sapiens
gatcacatcgacacctggga

SEQ ID NO: 65357 - DNA, 20 bp, Homo sapiens
gatccccaagcctggcaagg

SEQ ID NO: 65358 - DNA, 20 bp, Homo sapiens
gatctgcgcttccctctcac

SEQ ID NO: 65359 - DNA, 20 bp, Homo sapiens
gatctgtaaacatttccatt

SEQ ID NO: 65360 - DNA, 20 bp, Homo sapiens
gatctcccccgagttgggtc

SEQ ID NO: 65361 - DNA, 20 bp, Homo sapiens
gatcattgtgaaggcagggg

SEQ ID NO: 65362 - DNA, 20 bp, Homo sapiens
gatcatgaaatggttggtcc

SEQ ID NO: 65363 - DNA, 20 bp, Homo sapiens
gatccagttacaagaaaata

SEQ ID NO: 65364 - DNA, 20 bp, Homo sapiens
gatcattttgaatgggcaag

SEQ ID NO: 65365 - DNA, 20 bp, Homo sapiens
gatcgtgcttatttggattg

SEQ ID NO: 65366 - DNA, 20 bp, Homo sapiens
gatctctggattctacttca

SEQ ID NO: 65367 - DNA, 20 bp, Homo sapiens
gatcaagcgcggggttgctt

SEQ ID NO: 65368 - DNA, 20 bp, Homo sapiens
gatcccccagagcaacctgt

SEQ ID NO: 65369 - DNA, 20 bp, Homo sapiens
gatcgctgtgcctggcatat

SEQ ID NO: 65370 - DNA, 20 bp, Homo sapiens
gatcagcctggcctagatgg

SEQ ID NO: 65371 - DNA, 20 bp, Homo sapiens
gatcagttcgctgttctgtc

SEQ ID NO: 65372 - DNA, 20 bp, Homo sapiens
gatcactggcaacattatag

SEQ ID NO: 65373 - DNA, 20 bp, Homo sapiens
gatcagataaatggagtatc

SEQ ID NO: 65374 - DNA, 20 bp, Homo sapiens
gatcccacctggcagaattc

SEQ ID NO: 65375 - DNA, 20 bp, Homo sapiens
gatcctctctaaggcctctg

SEQ ID NO: 65376 - DNA, 20 bp, Homo sapiens
gatctccttgccccaccctg

SEQ ID NO: 65377 - DNA, 20 bp, Homo sapiens
gatctgtgtattacttaagc

SEQ ID NO: 65378 - DNA, 20 bp, Homo sapiens
gatcaccctctacgggagaa

SEQ ID NO: 65379 - DNA, 20 bp, Homo sapiens
gatcaggacttttgttccag

SEQ ID NO: 65380 - DNA, 20 bp, Homo sapiens
gatcaggtctgaggtggagt

SEQ ID NO: 65381 - DNA, 20 bp, Homo sapiens
gatccagtagtcacacttct

SEQ ID NO: 65382 - DNA, 20 bp, Homo sapiens
gatcccagccccacctctga

SEQ ID NO: 65383 - DNA, 20 bp, Homo sapiens
gatcttgaagtactccctgt

SEQ ID NO: 65384 - DNA, 20 bp, Homo sapiens
gatctacacatcatttctga

SEQ ID NO: 65385 - DNA, 20 bp, Homo sapiens
gatccaatgtaactccaaat

SEQ ID NO: 65386 - DNA, 20 bp, Homo sapiens
gatccgcccacagcctccca

SEQ ID NO: 65387 - DNA, 20 bp, Homo sapiens
gatcggagttcaaaggtcag

SEQ ID NO: 65388 - DNA, 20 bp, Homo sapiens
gatctgctacaaaatatacg

SEQ ID NO: 65389 - DNA, 20 bp, Homo sapiens
gatcattggcgtgtgtgtgt

SEQ ID NO: 65390 - DNA, 20 bp, Homo sapiens
gatcgttcatccgctttgac

SEQ ID NO: 65391 - DNA, 20 bp, Homo sapiens
gatccatcgagggtttcctg

SEQ ID NO: 65392 - DNA, 20 bp, Homo sapiens
gatcagataattccaataaa

SEQ ID NO: 65393 - DNA, 20 bp, Homo sapiens
gatcttgtacatgtattaaa

SEQ ID NO: 65394 - DNA, 20 bp, Homo sapiens
gatcacgtgtcgcatgaccg

SEQ ID NO: 65395 - DNA, 20 bp, Homo sapiens
gatcagccctgccagcgtct

SEQ ID NO: 65396 - DNA, 20 bp, Homo sapiens
gatctaatgccttaagtgtg

SEQ ID NO: 65397 - DNA, 20 bp, Homo sapiens
gatcagacactagccttacc

SEQ ID NO: 65398 - DNA, 20 bp, Homo sapiens
gatcagggtcactgctttgt

SEQ ID NO: 65399 - DNA, 20 bp, Homo sapiens
gatctaatctctgtgctctg

SEQ ID NO: 65400 - DNA, 20 bp, Homo sapiens
gatctgctgttcaaggactc

SEQ ID NO: 65401 - DNA, 20 bp, Homo sapiens
gatctttctgcccactaggg

SEQ ID NO: 65402 - DNA, 20 bp, Homo sapiens
gatccccatggccaggactc

SEQ ID NO: 65403 - DNA, 20 bp, Homo sapiens
gatcaatggattaactccaa

SEQ ID NO: 65404 - DNA, 20 bp, Homo sapiens
gatcaccttcacaaggaggc

SEQ ID NO: 65405 - DNA, 20 bp, Homo sapiens
gatcagacaatgcacatcct

SEQ ID NO: 65406 - DNA, 20 bp, Homo sapiens
gatcatgaaaaccttgggcc

SEQ ID NO: 65407 - DNA, 20 bp, Homo sapiens
gatcctcttcaacgcacaca

SEQ ID NO: 65408 - DNA, 20 bp, Homo sapiens
gatctgatgctgagccaggt

SEQ ID NO: 65409 - DNA, 20 bp, Homo sapiens
gatcccagcgctgggcctgc

SEQ ID NO: 65410 - DNA, 20 bp, Homo sapiens
gatctttgcaactctggcct

SEQ ID NO: 65411 - DNA, 20 bp, Homo sapiens
gatcatcacagtttgagttt

SEQ ID NO: 65412 - DNA, 20 bp, Homo sapiens
gatccactgaagaagtagaa

SEQ ID NO: 65413 - DNA, 20 bp, Homo sapiens
gatcggccatcaagggaaga

SEQ ID NO: 65414 - DNA, 20 bp, Homo sapiens
gatctctaaagagcatctga

SEQ ID NO: 65415 - DNA, 20 bp, Homo sapiens
gatcactctatgtgacaagg

SEQ ID NO: 65416 - DNA, 20 bp, Homo sapiens
gatccccgcctggccaggag

SEQ ID NO: 65417 - DNA, 20 bp, Homo sapiens
gatctgcaatgactggaact

SEQ ID NO: 65418 - DNA, 20 bp, Homo sapiens
gatcaaacatgcatggatgg

SEQ ID NO: 65419 - DNA, 20 bp, Homo sapiens
gatctccaactgtgacggag

SEQ ID NO: 65420 - DNA, 20 bp, Homo sapiens
gatcctacagagatagccta

SEQ ID NO: 65421 - DNA, 20 bp, Homo sapiens
gatctaatgtacctgattct

SEQ ID NO: 65422 - DNA, 20 bp, Homo sapiens
gatcggcaacttggcccagc

SEQ ID NO: 65423 - DNA, 20 bp, Homo sapiens
gatcgtggtggtgttcctca

SEQ ID NO: 65424 - DNA, 20 bp, Homo sapiens
gatcagcatgttaacaatgt

SEQ ID NO: 65425 - DNA, 20 bp, Homo sapiens
gatccacctggtccttggtg

SEQ ID NO: 65426 - DNA, 20 bp, Homo sapiens
gatccacggactacagtttg

SEQ ID NO: 65427 - DNA, 20 bp, Homo sapiens
gatccctgtgaggctgtcca

SEQ ID NO: 65428 - DNA, 20 bp, Homo sapiens
gatcctctcctgcttatctc

SEQ ID NO: 65429 - DNA, 20 bp, Homo sapiens
gatcttgaataaagtcctgc

SEQ ID NO: 65430 - DNA, 20 bp, Homo sapiens
gatcacattatgtttcaagg

SEQ ID NO: 65431 - DNA, 20 bp, Homo sapiens
gatcagttctgtccctgcct

SEQ ID NO: 65432 - DNA, 20 bp, Homo sapiens
gatcatgctctaacttcaat

SEQ ID NO: 65433 - DNA, 20 bp, Homo sapiens
gatcagggaccccagagacc

SEQ ID NO: 65434 - DNA, 20 bp, Homo sapiens
gatctggtctctgacttgag

SEQ ID NO: 65435 - DNA, 20 bp, Homo sapiens
gatccacttgttctaaaaca

SEQ ID NO: 65436 - DNA, 20 bp, Homo sapiens
gatctcagcatgtattctta

SEQ ID NO: 65437 - DNA, 20 bp, Homo sapiens
gatcatcacctacttcaact

SEQ ID NO: 65438 - DNA, 20 bp, Homo sapiens
gatcatcatcaagatgagaa

SEQ ID NO: 65439 - DNA, 20 bp, Homo sapiens
gatccgaatcctactacagc

SEQ ID NO: 65440 - DNA, 20 bp, Homo sapiens
gatcgccaacaagctcttcg

SEQ ID NO: 65441 - DNA, 20 bp, Homo sapiens
gatcgtcatcatcaagaatt

SEQ ID NO: 65442 - DNA, 20 bp, Homo sapiens
gatctaagcatgattgtgtt

SEQ ID NO: 65443 - DNA, 20 bp, Homo sapiens
gatctttgcctttgtatggt

SEQ ID NO: 65444 - DNA, 20 bp, Homo sapiens
gatctaagcatgattgtgct

SEQ ID NO: 65445 - DNA, 20 bp, Homo sapiens
gatcaccatgtaaggtcaca

SEQ ID NO: 65446 - DNA, 20 bp, Homo sapiens
gatcggtttagacacaaaat

SEQ ID NO: 65447 - DNA, 20 bp, Homo sapiens
gatcaggttttctttgtgtg

SEQ ID NO: 65448 - DNA, 20 bp, Homo sapiens
gatctgtctacctcggcctc

SEQ ID NO: 65449 - DNA, 20 bp, Homo sapiens
gatcaactggcacttcttga

SEQ ID NO: 65450 - DNA, 20 bp, Homo sapiens
gatcaatgaataaataaacg

SEQ ID NO: 65451 - DNA, 20 bp, Homo sapiens
gatccaggcatttgatgcca

SEQ ID NO: 65452 - DNA, 20 bp, Homo sapiens
gatcctgttgacaccccaaa

SEQ ID NO: 65453 - DNA, 20 bp, Homo sapiens
gatccatggcagccgaggct

SEQ ID NO: 65454 - DNA, 20 bp, Homo sapiens
gatcgacaagctagaaaata

SEQ ID NO: 65455 - DNA, 20 bp, Homo sapiens
gatcatctatgcgtcagagc

SEQ ID NO: 65456 - DNA, 20 bp, Homo sapiens
gatctagtgcaacaagtgca

SEQ ID NO: 65457 - DNA, 20 bp, Homo sapiens
gatcctaaacgtagaattga

SEQ ID NO: 65458 - DNA, 20 bp, Homo sapiens
gatctcctctcggctcactt

SEQ ID NO: 65459 - DNA, 20 bp, Homo sapiens
gatcaccactaggcctaggg

SEQ ID NO: 65460 - DNA, 20 bp, Homo sapiens
gatccttcgtttccttttag

SEQ ID NO: 65461 - DNA, 20 bp, Homo sapiens
gatcctaaaggaagtccgta

SEQ ID NO: 65462 - DNA, 20 bp, Homo sapiens
gatcgtacctattgcactcc

SEQ ID NO: 65463 - DNA, 20 bp, Homo sapiens
gatctcaggcttctgcagtt

SEQ ID NO: 65464 - DNA, 20 bp, Homo sapiens
gatcctatggagtcattaac

SEQ ID NO: 65465 - DNA, 20 bp, Homo sapiens
gatcgccctgtacaacctgc

SEQ ID NO: 65466 - DNA, 909 bp, Homo sapiens
ggaggactcagactctgctcttcagatccacacactgatcccaactacaaccagtgacctgaacttggagtctgagtagggcggccccggtgactgagatggcatcatctctaaagatctggggcacactcttggccctactttgcatcctatgcacactgcttgtacagagcaaagaagtttcttggagagaattcatgaaacagcactacttaagtccaagtcgagaattcagagagtacaaatgtgatgtcctcatgagagaaaatgaagctctgaaagacaagagctctcacatgtttatctatatctcatggtacaaaatcgagcatatatgcactagtgacaactggatggatcgcttccgaaatgcatatgtatgggtccagaatcctctcaaagtactcaagtgtcaccaggagaattccaaaaatagctacacagagagcaggagcttcaactacattgaattccattgtagcatggacgggtatgttgatagcatagaagacctaaagatggtagaacctatcggcaactagaaagtctatgcacatcctcaggtattggtagagtattcagtgctctctaagtagcagcccctgcctccatcaatagtcctaccactcccctcttgcatttatttgtcaatgttttccaaatacttagagttatgaatagcataatttcttgataccataactttgcctgtgttgtttctctgcctggaatacacttttgtcttcatttacctaatttactcttatacttttgtcgacattcagctcatatggcatctgttcttgattaacccaagactttcctgatattgactctcttgatacatacccaagctgaacaatcttcccttccctaaataaattatatgactgcaaaaaaaaaaaaaaa

SEQ ID NO: 65467 - DNA, 784 bp, Homo sapiens
gccgggagccttcggggcgacagctccgaggatggacgtaggggccagctgctgccccagagtcctgccccctgcagccctgtgtggagccctgggactcctgtgggtgggcctcaccctgctggggacggtccagccacagcgccagggcccccagaggggcctgaacttgcctttccacaagatctgtctccagcctggcctcagaaaggagcggggacccaccctgcaaacgctgggccaggacccctgtcccggagaagcagccagctcagaacccccttggaggccgggaggaagtggggttggaaaatgacgagatggaggctacgccgagaccaagcgccaggagaagggacccaggccaagctgctcggtgaggccctgagcacggcgggaaggggccatgcaggaccccctgagggctgggctggggagggaggggtctccccagggctcaccccccttcttggcacagggcaggggaaggagctggatttagacctgagggagaaatttatcagatttgaccagatcctgggcatcagccttgaccacattcccttcctgccccagactggccccggcaggccttgggggtgtggggtaggcaagcagagaccacactgatgcggggaggttggcccagagccctgcaggccaaagcctggggccgggcagcagtgtccgccgaggagagggtgtctggtgcctgaatgacacaacctgagaggcaccagccccaatcctgtccgtgcagcccagcggggaggactgcccagga

SEQ ID NO: 65468 - DNA, 999 bp, Homo sapiens
cgcaggaggcggcatgagcagcgcgcgacagagctgacgccgcgcccccgccggccccatgtccttcgccacgctgcgcccggcgccgccgggccgctacctgtaccccgaggtgagcccgctgtcggaggacgaggaccgcggcagcgacagctcgggctccgacgagaaaccctgtcgcgtgcacgcggcgcgctgcggcctccagggcgcccggcggagggcggggggccggcgggccgggggcggggggccagggggccggccaggccgtgagccccggcagcggcacacggcgaacgcgcgcgagcgagaccgcaccaacagcgtgaacacggccttcacggcgctgcgcacgctgatccccaccgagcccgccgaccgcaagctctccaagattgagacgctgcgcctggcctccagctacatctcgcacctgggcaacgtgctgctggcgggcgaggcctgcggcgacggacagccctgccactccgggcccgccttcttccacgcggcgcgcgccggcagccccccgccgccgcccccgccgcctcccgcccgcgacggcgagaacacccagcccaaacagatctgcaccttctgcctcagcaaccagagaaagttgagcaaggaccgcgacagaaagacagcgattcgcagttaggaggtggccggcagcagccaggaggcagacgctgctgggggaggtggacgcccggggtgactgcagacagcccccaccttggacctgagctgggcaaggcccaccgcaagcatgcccccaggccagccctggctgcgagcggggccgagggacagacggacgtacagacaggcgccggcagcgggactctgcgctggccccagcacctgcccgggcccactggaactttctgcgctggcttttcttccggccactgtgtgatggcatcttgtgtttttgatatgataatataaagtctgaaaattttgtataattaaaaacaaaacagtatcttc

SEQ ID NO: 65469 - DNA, 999 bp, Homo sapiens; identical to SEQ ID NO: 65468

SEQ ID NO: 65470 - DNA, 399 bp, Homo sapiens
catctctcaccaggaggctcgaggaccctcatttaagatctgcgtgggctttttagggcctagatgggccaggggatgttccactgggaattagaaataccatctgccgtatgcagcaagggatctgcagactttttttctgccattctggtgagaaaaagcgtgacatttgctctgatccctggaataggtgttgcgtatcaaatacagatgaagaaggaaaagagaaaccagagatggatggcagatctgggatctaaaatataagctcccggaaggcagggatgttgaagtatcccaagggcttaaaggaatgtgtggcttatagtaggtgttcaataaatatttgttgaatgaatttagcaccaaaggtgaagagctgataaaagacattttttt

SEQ ID NO: 65471 - DNA, 554 bp, Homo sapiens
ccaggtgagcattcataaaacacaccctatcatcctcctggcaacatttcagatataaattatcgttcctgttttaaagctaagaggccaaagttcggttaaactggggcttgtccaaaaatacttagccttgtcagaatatataacccttggcagtgggctgggttcatcttctattctctgcactatatgagttaaatgtcaactctcttctgttgtatccataggggatgttccactgggaattagaaataccatctgccgtatgcagcaagggatctgcagactttttttctgccattctggtgagaaaaagcgtgacatttgctctgatccctggaataggtgttgcgtatcaaatacagatgaagaaggaaaagagaaaccagagatggatggcagatctgggatctaaaatataagctcccggaaggcagggatgttgaagtatcccaagggcttaaaggaatgtgtggcttatagtaggtgttcaataaatatttgttgaatgaatttagcaccaaaggtgaagagctgataaaagacattttttt

SEQ ID NO: 65472 - DNA, 784 bp, Homo sapiens
gccgggagccttcggggcgacagctctgaggatggacgtaggggccagctgctgccccagagtcctgccccctgcagccctgtgtggagccctgggactcctgtgggtgggcctcaccctgctggggacggtccagccacagcgccagggcccccagaggggcctgaacttgcctttccacaagatctgtctccagcctggcctcagaaaggagcggggacccaccctgcaaacgctgggccaggacccctgtcccggagaagcagccagctcagaacccccttggaggccgggaggaagtggggttggaaaatgacgagatggaggctacgccgagaccaagcgccaggagaagggacccaggccaagctgctcggtgaggccctgagcacggcgggaaggggccatgcaggaccccctgagggctgggctggggagggaggggtctccccagggctcaccccccttcttggcacagggcaggggaaggagctggatttagacctgagggagaaatttatcagatttgaccagatcctgggcatcagccttgaccacattcccttcctgccccagactggccccggcaggcctggggggtgtggggtaggcaagcagagaccacactgatgcggggaggttggcccagagccctgcaggccaaagcctggggccgggcagcagtgtccgccgaggagagggtgtctggtgcctgaatgacacaacctgagaggcaccagccccaatcctgtccgtgcagcccagcggggaggactgcccagga

SEQ ID NO: 65473 - DNA, 706 bp, Homo sapiens
tagtagcgtgtccacattgtcctttgagaatgagaagtcatcctggagcacagctcttcccacgctccgggcccacacacccagcctcactccatcaaaggagccccgctgcctgcccacccaccctgggtgctttctggcttgcagtgctcttggcagacatgaggcaacgattgctcccgtccgtcaccagccttctccttgtggccctgctgtttccaggatcgtctcaagccagacatgtgaaccactcagccactgaggctctcggagaactcagggaaagagcccctgggcaaggcacaaacgggtttcagctgctacgccacgcagtgaaacgggacctcttaccaccgcgcaccccaccttaccaaggggatgttccactgggaattagaaataccatctgccgtatgcagcaagggatctgcagactttttttctgccattctggtgagaaaaagcgtgacattagctctgatccctggaataggtgttgcgtatcaaatacagatgaagaaggaaaagagaaaccagagatggatggcagatctgggatctaaaatataagctcccggaaggcagggatgttgaagtatcccaagggcttaaaggaatgtgtggcttatagtaggtgttcaataaatatttgttgaatgaatttagcaccaaaggtgaagagctgataaaagacatttttttaact

SEQ ID NO: 65474 - DNA, 782 bp, Homo sapiens
tagtagcgtgtccacattgtcctttgagaatgagaagtcatcctggagcacagctcttcccacgctccgggcccacacacccagcctcactccatcaaaggagccccgctgcctgcccacccaccctgggtgctttctggcttgcagtgctcttggcagacatgaggcaacgattgctcccgtccgtcaccagccttctccttgtggccctgctgtttccaggatcgtctcaagccagacatgtgaaccactcagccactgaggctctcggagaactcagggaaagagcccctgggcaaggcacaaacgggtttcagctgctacgccacgcagtgaaacgggacctcttaccaccgcgcaccccaccttaccaagtgcacatctctcaccaggaggctcgaggaccctcatttaagatctgcgtgggctttttagggcctagatgggccaggggatgttccactgggaattagaaataccatctgccgtatgcagcaagggatctgcagactttttttctgccattctggtgagaaaaagcgtgacattagctctgatccctggaataggtgttgcgtatcaaatacagatgaagaaggaaaagagaaaccagagatggatggcagatctgggatctaaaatataagctcccggaaggcagggatgttgaagtatcccaagggcttaaaggaatgtgtggcttatagtaggtgttcaataaatatttgttgaatgaatttagcaccaaaggtgaagagctgataaaagacatttttttaact

SEQ ID NO: 65475 - DNA, 508 bp, Homo sapiens
tgtgctccttcacgggagggcagggaggttcaacggaccttaaaacatgaaggtcttttttctgtttgctgttctcttttgtttggtccaaacaaactcagtgcacatctctcaccaggaggctcgaggaccctcatttaagatctgcgtgggctttttagggcctagatgggccaggggatgttccactgggaattagaaataccatctgccgtatgcagcaagggatctgcagactttttttctgccattctggtgagaaaaagcgtgacattagctctgatccctggaataggtgttgcgtatcaaatacagatgaagaaggaaaagagaaaccagagatggatggcagatctgggatctaaaatataagctcccggaaggcagggatgttgaagtatcccaagggcttaaaggaatgtgtggcttatagtaggtgttcaataaatatttgttgaatgaatttagcaccaaaggtgaagagctgataaaagacatttttttaact

SEQ ID NO: 65476 - DNA, 1797 bp, Homo sapiens
ccggcgccgggggcggcggggaaccccaaacgcaaccgggtctggagggatccccgcgccgagccagccgccgtcaccgcctccgcgccgcccctgcgggcttggcaggcgcccggcgcgcccgcactgcgcccggccgccggctcccgcggtcccaccgtgagctcgccggcccgtcgcccgctcgccatgcaaccgccgccggcctcgcgcgcgtaggcgcccgccgcaggccatgctgcccctgctcgccgcgctcctggccgccgcctgcccgctgccgcccgtccgcggcggggccgcggacgcgcccggcctcctcggggtgccctccaatgcttcagtcaacgcgtcctccgcggacgagcccatcgccccgcggctgctggcctcggcggcccccgggccccccgagcgcccgggcccggaggagacggcggcggcagcggcgccgtgcaacatcagcgtgcagcggcagatgctgagctcgctgctcgtgcgctggggccgcccgcggggcttccagtgcgacctactgctcttctccaccaacgcgcacggccgcgctttcttcgccgccgccttccaccgcgtcgggccgccgctgctcatcgagcacctggggctggcggcgggcggcgcgcagcaggacctgcgcctctgcgtgggctgcggctgggtgcgcggtcgccgcactggccgcctccggcccgccgccgcccccagcgccgccgccgccaccgccggggcgcccaccgcgctgccagcctaccccgcggccgagccgcccgggccgctgtggctgcagggcgagccgctgcatttctgctgcctagacttcagcctggaggagctgcagggcgagccgggctggcggctgaaccgtaagcccattgagtccacgctggtggcctgcttcatgaccctggtcatcgtggtgtggagcgtggccgccctcatctggccggtgcccatcatcgccggcttcctgcccaacggcatggaacagcgccggaccaccgccagcaccaccgcagccacccccgccgcagtgcccgcagggaccaccgcagccgccgccgccgccgccgctgccgccgccgccgcggccgtcacttcgggggtggcgaccaagtgacccgctccgctcctccctgtgtccgtcctgtgtccgcgcgcgcgggtgcctttcccgccggggactcggccggtgtgcttcgtgctgtagttatcgttagttcctcttcccgagatggggccgccgagagaccccagcgcctttgaaaagcaaggtttgtgctgcgcttccagttccgaaaagcagatgtttaagcccttggactgagggtgggatcgcagctccgaagacggagaggagggaaatggggccctttcccctctattgcatccccctgcccgactccttccccgcacccacgtgccctagattcatggcagaaaatgaccaaatcctgtgtatttgttttatatatttaataactgttttaaatgaaagttttagtaaaaaaaatacaaaacaaaaagattaaattgctattgctgtagtaagagaagctctttgtatctgaacatagttgtatttgaaatttgtggttttttaatttatttaaaattggggggagggcatgggaaggatttaacaccgatatattgttaccgctgaaaatgaactttatgaaccttttccaagttgatctatccagtgacgtggcctggtgggcgtttcttcttgtacttatgtggttttttggcttttaatacagacattttcctcca

SEQ ID NO: 65477 - DNA, 3889 bp, Homo sapiens
aaaaactcagggaagcccagggcccgtgttgtgcttttggcccaggtaggtggacagacatgtcccaggcgggggacgtagaaggccccagcacaggagaccctgtgctcagtccccaacacaactgtgagcttttacagaacatggaaggagccagctccatgccaggcctgtcaccagatgggccgggagcaagctctgggcccggagtcagggctggcagcagaaggaagatccccaggaaggaggcccttcgaggtggcagctcccgggctgcaggtgctgctgaggtccggccaggggtcttggagctgctagctgtggtacagagccggggctcgatgctggctcctgggctccacatgcagctgccctcggtgcctactcaggggagagctctgacctccaagaggctccaggtttctctgtgtgacatcttagatgacagttgccccaggaaactttgtagcaggtctgctggcctcccagagagagctctggcctgcagggagaggcttgcaggagtggaggaggtgagctgcctcaggcccagggaggccagagacggtggaatgagttctccagggtgtgacagaagaagccccacactcagcaaagaggagccccctggaaggcccctgacatcctcaccagacccagtccctgtgagggtaagaaagaaatggaggaggcaaggggctcattcagagtgtgaggaaggggctggtgacttcctgtggcttgatcagagccctcgtggggacaacctcctgtctgtgggagaccctccccaagttgctgacctggagtccttgggaggcccttgcagacctccctctccaaaagacactgggtctgggcctggagagccaggtggaagtggggcaggatgtgcctcagggactgagaaatttggatatttgcccgctacaggggatgggccccagccaggcagcccctgtggccctgtcgggttcccagtgcccagtggaggggagtccctcagttcagctgcacaggctcctccacagagcgcagcactgtgcctgggggcgtcagcacaggcctctgcagagcagcaagaagctgtgtgtgtcgtgcggactggcagcgatgaaggccaggctccagcacaggaccaggaggagctggaggccaaggctcagccagcttccaggggaaggctggagcaaggactcgctgcccccgctgacacctgtgccagctcccgggagcccttgggcggcctcagctcctccctggatactgaagccagcagggcctgctcaggcccattcatggagcagagaagatccaagggcactaagaacctgaagaaaggtccagtgccctgtgcccaagaccggggcacagacagaagctcagacaactcccaccaggacaggccagaggaacccagcccaggaggctgccccagactggaggaagtgaaaataccccatggagtgaagcttgtgtgctacctgggttccgggccagtgatccagctcctgggggccatcagccacggccaggcaggggggcagctgccaccaaagctggaggttctagaggacttgatggaggtcagctcaccctcacctgcccagaggctcagaaggaagaaaaggcccatggtgcagggccctgctgggtgccaggttttccagccttctccttcaggaggcacagcaggggaccctggtggcctctctgaccccttctaccctccaagaagcggttccctggcccttggcgaccccagctcggaccctgcatgttcccagagtggcccaatggaggctgaagaggattctcttccggagcagccagaggactcagctcagctccaacaggagaagccatccctgtatattggggtgcggggcactgttgtccgttccatgcaggaggtactatggactcgccttcgggagctcccagacccagtgctgagtgaggaggtggtggagggcattgctgctggcattgaggcagccctctgggacctgacacaaggcaccaatggccggtacaagaccaagtatcgcagcctgctgttcaacctgcgggaccccaggaacctggacttgtttctcaaagtggttcatggagatgtcaccccctacgacctggtgcggatgagctcgatgcagctggccccccaggagctggcccgctggcgggaccaggaggagaaaaggggcctgaatatcattgagcagcaacagaaggagccgtgcagacttccagcctccaaaatgacccacaagggcgaagtggagattcagcgggacatggaccagacactgaccctggaggatctggtgggaccgcagatgttcatggactgcagcccacaggccctgcccatcgcatcagaggacaccacggggcagcatgaccaccacttcttagaccccaactgccacatctgcaaggactgggagccctcgaatgagctgctaggctccttcgaagccgccaagagctgcggggacaatatcttccagaaagccctaagccaaactcctatgcctgctccagagatgcccaaaaccagggagttgtctcccacggaaccacaggacagggtccctccatctgggctccatgtgcctgctgcacccacaaaggccctgccctgcctgccaccctgggaaggtgttctggacatgttctccatcaagcggttccgggccagggcccagctggtctcgggacacagctgtcggcttgtccaggctctgcccaccgtgatccgctcggcaggctgcatcccctccaacattgtctgggaccttctggccagcatctgcccagccaaggccaaggacgtctgcgtggtcagactgtgcccacatggggcccgggacacccagaactgccgcctgctctactcatacctcaatgataggcagcgccacgggctggcctctgtggagcacatggggatggtcctgctgcccctgcctgccttccagcccctgcccaccaggctgcgccctttggggggcccaggcctttgggctcttcctgtctcccctctcctttccccaggtctggaggtcactcactcaagtctgttgctggctgtgctgctccccaaggaagggcttccagacacagcagggtccagcccctggttggggaaggttcaaaagatggtctccttcaacagtaaggtggagaagagatactatcagccagatgacaggaggccgaatgtgcccctgaagggcacccctcccccaggaggtgcctggcagcagagccagggcaggggcagtatagctccaaggggaatctctgcttggcagaggccccccagaggcagggggaggctctggccagagcctgaaaactggcagcatcctgggcgagggcagtggcccccagagccaggcttgcgccagtcccagcatccctattcagtagcaccagctggtcatggctttggccgtggccagcacttccacagggactcctgtccccaccaagccctgctccggcacctcgaatccctggcgaccatgagtcaccagctccaagccttactgtgcccccagaccaagagctccatcccccgccctctgcagcgtttgtctagcgcccttgcagctccagagccccctggcccagcccgtgactcctctttggggcctacagatgaagctggctctgagtgtcccttccctagaaaggcctgaccctccttacccaccagaacaggggttttgatgccctcactagtgttgaagcctgttccagagagaggtgggactgcaaggagaggatggtcagccctacccacctgccctgtttgagcttcctgtttgacaatgtttgctgttgattttttgttcaataaagaatttggtaaaattgg

SEQ ID NO: 65478 - DNA, 1574 bp, Homo sapiens
tcaccacggcggcagccctttaaacccctcacccagccagcgccccatcctgtctgtccgaacccagacacaagtcttcactccttcctgcgagccctgaggaagccttgtgagtgcattggctggggcttggagggaagttgggctggagctggacaggagcagtgggtgcatttcaggcaggctctcctgaggtcccaggcgccagctccagctccctggctagggaaacccaccctctcagtcagcatgggggcccaagctccaggcagggtgggctggatcactagcgtcctggatctctctcagactgggcagccccgggctcattgaaatgccccggatgacttggctagtgcagaggaattgatggaaaccaccggggtgagagggaggctccccatctcagccagccacatccacaaggtgtgtgtaagggtgcaggcgccggccggttaggccaaggctctactgtctgttgcccctccaggagaacttccaaggagctttccccagacatggccaacaagggtccttcctatggcatgagccgcgaagtgcagtccaaaatcgagaagaagtatgacgaggagctggaggagcggctggtggagtggatcatagtgcagtgtggccctgatgtgggccgcccagaccgtgggcgcttgggcttccaggtctggctgaagaatggcgtgattctgagcaagctggtgaacagcctgtaccctgatggctccaagccggtgaaggtgcccgagaacccaccctccatggtcttcaagcagatggagcaggtggctcagttcctgaaggcggctgaggactatggggtcatcaagactgacatgttccagactgttgacctctttgaaggcaaagacatggcagcagtgcagaggaccctgatggctttgggcagcttggcagtgaccaagaatgatgggcactaccgtggagatcccaactggtttatgaagaaagcgcaggagcataagagggaattcacagagagccagctgcaggagggaaagcatgtcattggccttcagatgggcagcaacagaggggcctcccaggccggcatgacaggctacggacgacctcggcagatcatcagttagagcggagagggctagccctgagcccggccctcccccagctccttggctgcagccatcccgcttagcctgcctcacccacacccgtgtggtaccttcagccctggccaagctttgaggctctgtcactgagcaatggtaactgcacctgggcagctcctccctgtgcccccagcctcagcccaacttcttacccgaaagcatcactgccttggcccctccctcccggctgcccccatcacctctactgtctcctccctgggctaagcaggggagaagcgggctgggggtagcctggatgtgggccaagtccactgtcctccttggcggcaaaagcccattgaagaagaaccagcccagcctgccccctatcttgtcctggaatatttttggggttggaactcaaaaaaaaaaaaaaaaaatcaatcttttctcaaaaaaaaaaaaaaaaaa

SEQ ID NO: 65479 - DNA, 1177 bp, Homo sapiens
tcaccacggcggcagccctttaaacccctcacccagccagcgccccatcctgtctgtccgaacccagacacaagtcttcactccttcctgcgagccctgaggaagccttctttccccagacatggccaacaagggtccttcctatggcatgagccgcgaagtgcagtccaaaatcgagaagaagtatgacgaggagctggaggagcggctggtggagtggatcatagtgcagtgtggccctgatgtgggccgcccagaccgtgggcgcttgggcttccaggtctggctgaagaatggcgtgattctgagcaagctggtgaacagcctgtaccctgatggctccaagccggtgaaggtgcccgagaacccaccctccatggtcttcaagcagatggagcaggtggctcagttcctgaaggcggctgaggactatggggtcatcaagactgacatgttccagactgttgacctctttgaaggcaaagacatggcagcagtgcagaggaccctgatggctttgggcagcttggcagtgaccaagaatgatgggcactaccgtggagatcccaactggtttatgaagaaagcgcaggagcataagagggaattcacagagagccagctgcaggagggaaagcatgtcattggccttcagatgggcagcaacagaggggcctcccaggccggcatgacaggctacggacgacctcggcagatcatcagttagagcggagagggctagccctgagcccggccctcccccagctccttggctgcagccatcccgcttagcctgcctcacccacacccgtgtggtaccttcagccctggccaagctttgaggctctgtcactgagcaatggtaactgcacctgggcagctcctccctgtgcccccagcctcagcccaacttcttacccgaaagcatcactgccttggcccctccctcccggctgcccccatcacctctactgtctcctccctgggctaagcaggggagaagcgggctgggggtagcctggatgtgggccaagtccactgtcctccttggcggcaaaagcccattgaagaagaaccagcccagcctgccccctatcttgtcctggaatatttttggggttggaactcaaaaaaaaaaaaaaaaaatcaatcttttctcaaaaaaaaaaaaaaaaaa

SEQ ID NO: 65480 - DNA, 2338 bp, Homo sapiens
gtcctgagtatcgttcttcatgcttcagtcacacaggcctctattccatgggaaagttcattggccatttttaaccggggctatttcttttctcttatggactatatcacgccacggtggtctccaagggcatgatactcaaaggttgtgtcctgtatcctttgtgctctccgaggaataagcaaaggtgttccaggctgtggaaaatatcctatggaggattactgaagatagtgactggctccctcttaacatttaatgtggtactctgtcttgatagcgggatggtgcttatgaggaagcaagtgccatcaaggttcatgtaccccaaagagtggcagcacctcaccatgttcatcctcctcactcttaatggctgtgtggacttcatgagcaagaatgtgctgcctcagaggtgtgtgggcctagaaaaaggtaccctggtcctgatcatctacgagctcctgctgctgatggtgtcacatgttaaagattcagaaggggtggagctgcacgtttattctctgctcatcttggtggtgttcctgctgttgctggtgttgactgcagagctgtgggctcccaacatgtgtcatctccagctgatggagacctttctgattctgatgatgggctcctggctgatgcaggcaggctttattctatacagacccgtctctggctacccatggcaggacgatgacatcagtgacatcatgtttgtcaccaccttcttctgctggcatgtgatgatcaatgcctcattcctgttgggaatctatggcttctcttccttttggtatcattgtttcagacccagcttgaagctgactgggcccaaagaagctccatattatgcaagcactccaggacccctctacaagttgctacaggaagtggagcagtcagagaaagaggaccaggctctcctccttccaaagagctccccctgagacagggcctacagtggctggcacatcgtccacctcatcttcctcctgttggctcctcagccacgagcatggtaccctccttggtaaaggtaatggccttgaaggctagcagttggtcccgtctgctggttcattttcttttcttctcttttcttttttttttttttgagacagagtctcgctctgttgcccagcctggagtgcaatggcacaatctcagctcagtgcaacctccgcctcccgagttcaagcgattctcctgcctcagcctcccgagtagctgcaattacaggagcctgccaccatgcccgtgctggtgcattttctgtccctgagcctctaattactgagaagataaggggagagggattgagaaagagacgctgatgggatttgcgggagggagggaaaaggacgaggagaacacttcttcttagtgtgcaagaaaagccactgggggaagagaatgcaacaaaaggaagagctgtgaagggaggagaacagagtctagcagttatgctgtcattagcgtcatcaggcacaagggattgccttttacctgagggaataaagacttctcacaactcaaactggacccattcaatctcatcttgataaagaaaagtgggtactttacgtgctcaccaaagtggtgccaccatgtggaaatagcatgatagaattataattattctacaggctgaaattatgctcgctttgcctccttctctctccgcagctttcaagaattggcttcatttcaaactttacatataaagtgagactttttaaatacttaataacatttcaaatttccataatttaaatttgtatagaattcaactgctatagcatttttatagcattcaaatgcttggtacttccctgacttctcatttcattactcttattctagcccaaactttccttttcaccatgaccacccttgcacatgcaatttagcagataccattcttgggtctttgcaaatttcttttccttgcaaatcacagccagtcatcctacagtcacatattaccatgttattcgattcccagaataaacctacatccacccccacaccgcaccaagtatccccaaggtggccttctccagaactcttactgattcccttgttttggaactctcgggcacttacattaaatctgctttgttagtttgctcatacaggtgacccactttcttttatactgctgctgaaatcattttctttcagaaggtttttcctcacccactaaagtacaggctcctaaagggaaaagactttgccttatccaagttaccaaatttcctatgtatactccagctatggatcatggttatgtttaataaagccttctttgcttccaaaaaaaaaaaaaaaa

SEQ ID NO: 65481 - protein, 147 aa, Homo sapiens
MASSLKIWGTLLALLCILCTLLVQSKEVSWREFMKQHYLSPSREFREYKCDVLMRENEALKDKSSHMFIYISWYKIEHICTSDNWMDRFRNAYVWVQNPLKVLKCHQENSKNSYTESRSFNYIEFHCSMDGYVDSIEDLKMVEPIGN

SEQ ID NO: 65482 - protein, 94 aa, Homo sapiens
MDVGASCCPRVLPPAALCGALGLLWVGLTLLGTVQPQRQGPQRGLNLPFHKICLQPGLRKERGPTLQTLGQDPCPGEAASSEPPWRPGGSGVGK

SEQ ID NO: 65483 - protein, 201 aa, Homo sapiens
MSFATLRPAPPGRYLYPEVSPLSEDEDRGSDSSGSDEKPCRVHAARCGLQGARRRAGGRRAGGGGPGGRPGREPRQRHTANARERDRTNSVNTAFTALRTLIPTEPADRKLSKIETLRLASSYISHLGNVLLAGEACGDGQPCHSGPAFFHAARAGSPPPPPPPPPARDGENTQPKQICTFCLSNQRKLSKDRDRKTAIRS

SEQ ID NO: 65484 - protein, 201 aa, Homo sapiens; identical to SEQ ID NO: 65483

SEQ ID NO: 65485 - protein, 67 aa, Homo sapiens
MGQGMFHWELEIPSAVCSKGSADFFSAILVRKSVTFALIPGIGVAYQIQMKKEKRNQRWMADLGSKI

SEQ ID NO: 65486 - protein, 63 aa, Homo sapiens [sequence omitted]

SEQ ID NO: 65487 - protein, 94 aa, Homo sapiens; identical to SEQ ID NO: 65482

SEQ ID NO: 65488 - protein, 133 aa, Homo sapiens
MRQRLLPSVTSLLLVALLFPGSSQARHVNHSATEALGELRERAPGQGTNGFQLLRHAVKRDLLPPRTPPYQGDVPLGIRNTICRMQQGICRLFFCHSGEKKRDISSDPWNRCCVSNTDEEGKEKPEMDGRSGI

SEQ ID NO: 65489 - protein, 103 aa, Homo sapiens
MRQRLLPSVTSLLLVALLFPGSSQARHVNHSATEALGELRERAPGQGTNGFQLLRHAVKRDLLPPRTPPYQVHISHQEARGPSFKICVGFLGPRWARGCSTGN

SEQ ID NO: 65490 - protein, 50 aa, Homo sapiens
MKVFFLFAVLFCLVQTNSVHISHQEARGPSFKICVGFLGPRWARGCSTGN

SEQ ID NO: 65491 - protein, 300 aa, Homo sapiens
MLPLLAALLAAACPLPPVRGGAADAPGLLGVPSNASVNASSADEPIAPRLLASAAPGPPERPGPEETAAAAAPCNISVQRQMLSSLLVRWGRPRGFQCDLLLFSTNAHGRAFFAAAFHRVGPPLLIEHLGLAAGGAQQDLRLCVGCGWVRGRRTGRLRPAAAPSAAAATAGAPTALPAYPAAEPPGPLWLQGEPLHFCCLDFSLEELQGEPGWRLNRKPIESTLVACFMTLVIVVWSVAALIWPVPIIAGFLPNGMEQRRTTASTTAATPAAVPAGTTAAAAAAAAAAAAAAVTSGVATK

SEQ ID NO: 65492 - protein, 1216 aa, Homo sapiens
MSQAGDVEGPSTGDPVLSPQHNCELLQNMEGASSMPGLSPDGPGASSGPGVRAGSRRKIPRKEALRGGSSRAAGAAEVRPGVLELLAVVQSRGSMLAPGLHMQLPSVPTQGRALTSKRLQVSLCDILDDSCPRKLCSRSAGLPERALACRERLAGVEEVSCLRPREARDGGMSSPGCDRRSPTLSKEEPPGRPLTSSPDPVPVRVRKKWRRQGAHSECEEGAGDFLWLDQSPRGDNLLSVGDPPQVADLESLGGPCRPPSPKDTGSGPGEPGGSGAGCASGTEKFGYLPATGDGPQPGSPCGPVGFPVPSGGESLSSAAQAPPQSAALCLGASAQASAEQQEAVCVVRTGSDEGQAPAQDQEELEAKAQPASRGRLEQGLAAPADTCASSREPLGGLSSSLDTEASRACSGPFMEQRRSKGTKNLKKGPVPCAQDRGTDRSSDNSHQDRPEEPSPGGCPRLEEVKIPHGVKLVCYLGSGPVIQLLGAISHGQAGGQLPPKLEVLEDLMEVSSPSPAQRLRRKKRPMVQGPAGCQVFQPSPSGGTAGDPGGLSDPFYPPRSGSLALGDPSSDPACSQSGPMEAEEDSLPEQPEDSAQLQQEKPSLYIGVRGTVVRSMQEVLWTRLRELPDPVLSEEVVEGIAAGIEAALWDLTQGTNGRYKTKYRSLLFNLRDPRNLDLFLKVVHGDVTPYDLVRMSSMQLAPQELARWRDQEEKRGLNIIEQQQKEPCRLPASKMTHKGEVEIQRDMDQTLTLEDLVGPQMFMDCSPQALPIASEDTTGQHDHHFLDPNCHICKDWEPSNELLGSFEAAKSCGDNIFQKALSQTPMPAPEMPKTRELSPTEPQDRVPPSGLHVPAAPTKALPCLPPWEGVLDMFSIKRFRARAQLVSGHSCRLVQALPTVIRSAGCIPSNIVWDLLASICPAKAKDVCVVRLCPHGARDTQNCRLLYSYLNDRQRHGLASVEHMGMVLLPLPAFQPLPTRLRPLGGPGLWALPVSPLLSPGLEVTHSSLLLAVLLPKEGLPDTAGSSPWLGKVQKMVSFNSKVEKRYYQPDDRRPNVPLKGTPPPGGAWQQSQGRGSIAPRGISAWQRPPRGRGRLWPEPENWQHPGRGQWPPEPGLRQSQHPYSVAPAGHGFGRGQHFHRDSCPHQALLRHLESLATMSHQLQALLCPQTKSSIPRPLQRLSSALAAPEPPGPARDSSLGPTDEAGSECPFPRKA

SEQ ID NO: 65493 - protein, 201 aa, Homo sapiens
MANKGPSYGMSREVQSKIEKKYDEELEERLVEWIIVQCGPDVGRPDRGRLGFQVWLKNGVILSKLVNSLYPDGSKPVKVPENPPSMVFKQMEQVAQFLKAAEDYGVIKTDMFQTVDLFEGKDMAAVQRTLMALGSLAVTKNDGHYRGDPNWFMKKAQEHKREFTESQLQEGKHVIGLQMGSNRGASQAGMTGYGRPRQIIS

SEQ ID NO: 65494 - protein, 201 aa, Homo sapiens; identical to SEQ ID NO: 65493

SEQ ID NO: 65495 - protein, 273 aa, Homo sapiens
MILKGCVLYPLCSPRNKQRCSRLWKISYGGLLKIVTGSLLTFNVVLCLDSGMVLMRKQVPSRFMYPKEWQHLTMFILLTLNGCVDFMSKNVLPQRCVGLEKGTLVLIIYELLLLMVSHVKDSEGVELHVYSLLILVVFLLLLVLTAELWAPNMCHLQLMETFLILMMGSWLMQAGFILYRPVSGYPWQDDDISDIMFVTTFFCWHVMINASFLLGIYGFSSFWYHCFRPSLKLTGPKEAPYYASTPGPLYKLLQEVEQSEKEDQALLLPKSSP

SEQ ID NO: 65496 - DNA, 20 bp, Homo sapiens
gatcccaatcaaagtgccaa

SEQ ID NO: 65497 - DNA, 20 bp, Homo sapiens
gatcaagaaagtcaggaagc

SEQ ID NO: 65498 - DNA, 20 bp, Homo sapiens
gatctacctctggaagctgg

SEQ ID NO: 65499 - DNA, 20 bp, Homo sapiens
gatcgcttccgaaatgcata

SEQ ID NO: 65500 - DNA, 20 bp, Homo sapiens
gatcagacagcccctaccta

SEQ ID NO: 65501 - DNA, 20 bp, Homo sapiens
gatctgtctccagcctggcc

SEQ ID NO: 65502 - DNA, 20 bp, Homo sapiens
gatctgcaccttctgcctca

SEQ ID NO: 65503 - DNA, 20 bp, Homo sapiens
gatctgtttgggctgggtgt

SEQ ID NO: 65504 - DNA, 20 bp, Homo sapiens
gatctaaaatataagctccc

SEQ ID NO: 65505 - DNA, 20 bp, Homo sapiens
gatcaacttggaaaaggttc

SEQ ID NO: 65506 - DNA, 20 bp, Homo sapiens
gatccgctcggcaggctgca

SEQ ID NO: 65507 - DNA, 20 bp, Homo sapiens
gatctggtgggaccgcagat

SEQ ID NO: 65508 - DNA, 20 bp, Homo sapiens
gatccactccaccagccgct

SEQ ID NO: 65509 - DNA, 20 bp, Homo sapiens
gatcttgactccaccacagc

SEQ ID NO: 65510 - DNA, 20 bp, Homo sapiens
gatcatggttatgtttaata

SEQ ID NO: 65511 - DNA, 2478 bp, Homo sapiens
ggcagcggcaacggcagagacagcaacgtgcccgccgcagtcagcccggcctcgtcggacccgcaccggcccgcccgcccgcccgcaccgcgtcggggcgccctctccactgcgcgcggtacaaggaaatggtagaactagtgatctcacccagcctcactgtaaacagcgattgtctggataaactgaagtttaaccgtgctgacgctgctgtgtggactctgagtgacagacaaggcatcaccaaatcggcccccctgagagtgtcccagctcttctccagatcttgcccacgtgtcctcccccgccagccttccacagccatggcagcctacggccagacgcagtacagtgcggggatccagcaggctaccccctatacagcttacccacctccagcacaagcctatggaatcccttcctacagcatcaagacagaagacagcttgaaccattcccctggccagagtggattcctcagctatggctccagcttcagcacctcacccactggacagagcccatacacctaccagatgcacggcacaacagggttctatcaaggaggaaatggactgggcaacgcagccggtttcgggagtgtgcaccaggactatccttcctaccccggcttcccccagagccagtacccccagtattacggctcatcctacaaccctccctacgtcccggccagcagcatctgcccttcgcccctctccacgtccacctacgtcctccaggaggcatctcacaacgtccccaaccagagttccgagtcacttgctggtgaatacaacacacacaatggaccttccacaccagcgaaagagggagacacagacaggccgcaccgggcctccgacgggaagctccgaggccggtctaagaggagcagtgacccgtccccggcaggggacaatgagattgagcgtgtgttcgtgtgggacttggatgagacaataattatttttcactccttactcacggggacatttgcatccagatacgggaaggacaccacgacgtccgtgcgcattggccttatgatggaagagatgatcttcaaccttgcagatacacatctgttcttcaatgacctggaggattgtgaccagatccacgttgatgacgtctcatcagatgacaatggccaagatttaagcacatacaacttctccgctgacggcttccacagttcggccccaggagccaacctgtgcctgggctctggcgtgcacggcggcgtggactggatgaggaagctggccttccgctaccggcgggtgaaggagatgtacaatacctacaagaacaacgttggtgggttgataggcactcccaaaagggagacctggctacagctccgagctgagctggaagctctcacagacctctggctgacccactccctgaaggcactaaacctcatcaactcccggcccaactgtgtcaatgtgctggtcaccaccactcaactaattcctgccctggccaaagtcctgctatatggcctggggtctgtgtttcctattgagaacatctacagtgcaaccaagacagggaaggagagctgcttcgagaggataatgcagagattcggcagaaaagctgtctacgtggtgatcggtgatggtgtggaagaggagcaaggagcgaaaaagcacaacatgcctttctggcggatatcctgccacgcagacctggaggcactgaggcacgccctggagctggagtatttatagcaggatcagcagcatctccacctgccatctcaccctcagaccccctcgccttccccacctccccaccgagaactccagagacccagatgttggacaccaggaaggggccccacagccgagacgacgtgtccagtgaccatctcagaagccgtccatcagtccaaatgggggttctgagaaggaaagtacccaacattggcttcggagtatttgactttggggaaaagggctggctcggagtctagactcttctgtaagactcacagaacaaaagcaaggaattgctgatttggggggtgcctggtgatgaggaggggatgggtttgtcttgtcttctttttaatttatggactagtctcattactccggaattatgctcttgtacctgtgtggctgggtttcttagtcgttggtttggtttggttttttgaactggtatgtggggtggttcacagttctaatgtaagcactctattctccaagttgtgctttgtggggacaatcattctttgaacattagagaggaaggcagttcaagctgttgaaaagactattgcttatttttgtttttaaagacctacttgacgtcatgtggacagtgcacgtgccttacgctacatcttgttttctaggaagagggggatgctgggaaggaatgggtgctttgtgatggataaaaggcattaaataaaaccacgtttacattttgaaaaaaaaaaaaaaaaaaaaaaaa

SEQ ID NO: 65512 - DNA, 2406 bp, Homo sapiens
ggcagcggcaacggcagagacagcaacgtgcccgccgcagtcagcccggcctcgtcggacccgcaccggcccgcccgcccgcccgcaccgcgtcggggcgccctctccactgcgcgcggtacaaggaaatggtagaactagtgatctcacccagcctcactgtaaacagcgattgtctggataaactgaagtttaaccgtgctgacgctgctgtgtggactctgagtgacagacaaggcatcaccaaatcggcccccctgagagtgtcccagctcttctccagatcttgcccacgtgtcctcccccgccagccttccacagccatggcagcctacggccagacgcagtacagtgcggggatccagcaggctaccccctatacagcttacccacctccagcacaagcctatggaatcccttccttcagcacctcacccactggacagagcccatacacctaccagatgcacggcacaacagggttctatcaaggaggaaatggactgggcaacgcagccggtttcgggagtgtgcaccaggactatccttcctaccccggcttcccccagagccagtacccccagtattacggctcatcctacaaccctccctacgtcccggccagcagcatctgcccttcgcccctctccacgtccacctacgtcctccaggaggcatctcacaacgtccccaaccagagttccgagtcacttgctggtgaatacaacacacacaatggaccttccacaccagcgaaagagggagacacagacaggccgcaccgggcctccgacgggaagctccgaggccggtctaagaggagcagtgacccgtccccggcaggggacaatgagattgagcgtgtgttcgtgtgggacttggatgagacaataattatttttcactccttactcacggggacatttgcatccagatacgggaaggacaccacgacgtccgtgcgcattggccttatgatggaagagatgatcttcaaccttgcagatacacatctgttcttcaatgacctggaggattgtgaccagatccacgttgatgacgtctcatcagatgacaatggccaagatttaagcacatacaacttctccgctgacggcttccacagttcggccccaggagccaacctgtgcctgggctctggcgtgcacggcggcgtggactggatgaggaagctggccttccgctaccggcgggtgaaggagatgtacaatacctacaagaacaacgttggtgggttgataggcactcccaaaagggagacctggctacagctccgagctgagctggaagctctcacagacctctggctgacccactccctgaaggcactaaacctcatcaactcccggcccaactgtgtcaatgtgctggtcaccaccactcaactaattcctgccctggccaaagtcctgctatatggcctggggtctgtgtttcctattgagaacatctacagtgcaaccaagacagggaaggagagctgcttcgagaggataatgcagagattcggcagaaaagctgtctacgtggtgatcggtgatggtgtggaagaggagcaaggagcgaaaaagcacaacatgcctttctggcggatatcctgccacgcagacctggaggcactgaggcacgccctggagctggagtatttatagcaggatcagcagcatctccacctgccatctcaccctcagaccccctcgccttccccacctccccaccgagaactccagagacccagatgttggacaccaggaaggggccccacagccgagacgacgtgtccagtgaccatctcagaagccgtccatcagtccaaatgggggttctgagaaggaaagtacccaacattggcttcggagtatttgactttggggaaaagggctggctcggagtctagactcttctgtaagactcacagaacaaaagcaaggaattgctgatttggggggtgcctggtgatgaggaggggatgggtttgtcttgtcttctttttaatttatggactagtctcattactccggaattatgctcttgtacctgtgtggctgggtttcttagtcgttggtttggtttggttttttgaactggtatgtggggtggttcacagttctaatgtaagcactctattctccaagttgtgctttgtggggacaatcattctttgaacattagagaggaaggcagttcaagctgttgaaaagactattgcttatttttgtttttaaagacctacttgacgtcatgtggacagtgcacgtgccttacgctacatcttgttttctaggaagagggggatgctgggaaggaatgggtgctttgtgatggataaaaggcattaaataaaaccacgtttacattttgaaaaaaaaaaaaaaaaaaaaaaaa

SEQ ID NO: 65513 - DNA, 2508 bp, Homo sapiens
taaatgaattccatgcttttccttcctttcccttccctgccttcgtgaaagggaagctaagtctttctcctaccccagattccttgaaggctgtctgagttctctcttccttcccctgcatagagaataagctggtctccaatttcaggtacaaggaaatggtagaactagtgatctcacccagcctcactgtaaacagcgattgtctggataaactgaagtttaaccgtgctgacgctgctgtgtggactctgagtgacagacaaggcatcaccaaatcggcccccctgagagtgtcccagctcttctccagatcttgcccacgtgtcctcccccgccagccttccacagccatggcagcctacggccagacgcagtacagtgcggggatccagcaggctaccccctatacagcttacccacctccagcacaagcctatggaatcccttcctacagcatcaagacagaagacagcttgaaccattcccctggccagagtggattcctcagctatggctccagcttcagcacctcacccactggacagagcccatacacctaccagatgcacggcacaacagggttctatcaaggaggaaatggactgggcaacgcagccggtttcgggagtgtgcaccaggactatccttcctaccccggcttcccccagagccagtacccccagtattacggctcatcctacaaccctccctacgtcccggccagcagcatctgcccttcgcccctctccacgtccacctacgtcctccaggaggcatctcacaacgtccccaaccagagttccgagtcacttgctggtgaatacaacacacacaatggaccttccacaccagcgaaagagggagacacagacaggccgcaccgggcctccgacgggaagctccgaggccggtctaagaggagcagtgacccgtccccggcaggggacaatgagattgagcgtgtgttcgtgtgggacttggatgagacaataattatttttcactccttactcacggggacatttgcatccagatacgggaaggacaccacgacgtccgtgcgcattggccttatgatggaagagatgatcttcaaccttgcagatacacatctgttcttcaatgacctggaggattgtgaccagatccacgttgatgacgtctcatcagatgacaatggccaagatttaagcacatacaacttctccgctgacggcttccacagttcggccccaggagccaacctgtgcctgggctctggcgtgcacggcggcgtggactggatgaggaagctggccttccgctaccggcgggtgaaggagatgtacaatacctacaagaacaacgttggtgggttgataggcactcccaaaagggagacctggctacagctccgagctgagctggaagctctcacagacctctggctgacccactccctgaaggcactaaacctcatcaactcccggcccaactgtgtcaatgtgctggtcaccaccactcaactaattcctgccctggccaaagtcctgctatatggcctggggtctgtgtttcctattgagaacatctacagtgcaaccaagacagggaaggagagctgcttcgagaggataatgcagagattcggcagaaaagctgtctacgtggtgatcggtgatggtgtggaagaggagcaaggagcgaaaaagcacaacatgcctttctggcggatatcctgccacgcagacctggaggcactgaggcacgccctggagctggagtatttatagcaggatcagcagcatctccacctgccatctcaccctcagaccccctcgccttccccacctccccaccgagaactccagagacccagatgttggacaccaggaaggggccccacagccgagacgacgtgtccagtgaccatctcagaagccgtccatcagtccaaatgggggttctgagaaggaaagtacccaacattggcttcggagtatttgactttggggaaaagggctggctcggagtctagactcttctgtaagactcacagaacaaaagcaaggaattgctgatttggggggtgcctggtgatgaggaggggatgggtttgtcttgtcttctttttaatttatggactagtctcattactccggaattatgctcttgtacctgtgtggctgggtttcttagtcgttggtttggtttggttttttgaactggtatgtggggtggttcacagttctaatgtaagcactctattctccaagttgtgctttgtggggacaatcattctttgaacattagagaggaaggcagttcaagctgttgaaaagactattgcttatttttgtttttaaagacctacttgacgtcatgtggacagtgcacgtgccttacgctacatcttgttttctaggaagagggggatgctgggaaggaatgggtgctttgtgatggataaaaggcattaaataaaaccacgtttacattttgaaaaaaaaaaaaaaaaaaaaaaaa

SEQ ID NO: 65514 - DNA, 2458 bp, Homo sapiens
gcagagctcaactctgcccctcaaaccacaataggaaccagtggtttccgggtgatcctgatgacagtttccagtgtctacctggaatgaaacgaatggtacaaggaaatggtagaactagtgatctcacccagcctcactgtaaacagcgattgtctggataaactgaagtttaaccgtgctgacgctgctgtgtggactctgagtgacagacaaggcatcaccaaatcggcccccctgagagtgtcccagctcttctccagatcttgcccacgtgtcctcccccgccagccttccacagccatggcagcctacggccagacgcagtacagtgcggggatccagcaggctaccccctatacagcttacccacctccagcacaagcctatggaatcccttcctacagcatcaagacagaagacagcttgaaccattcccctggccagagtggattcctcagctatggctccagcttcagcacctcacccactggacagagcccatacacctaccagatgcacggcacaacagggttctatcaaggaggaaatggactgggcaacgcagccggtttcgggagtgtgcaccaggactatccttcctaccccggcttcccccagagccagtacccccagtattacggctcatcctacaaccctccctacgtcccggccagcagcatctgcccttcgcccctctccacgtccacctacgtcctccaggaggcatctcacaacgtccccaaccagagttccgagtcacttgctggtgaatacaacacacacaatggaccttccacaccagcgaaagagggagacacagacaggccgcaccgggcctccgacgggaagctccgaggccggtctaagaggagcagtgacccgtccccggcaggggacaatgagattgagcgtgtgttcgtgtgggacttggatgagacaataattatttttcactccttactcacggggacatttgcatccagatacgggaaggacaccacgacgtccgtgcgcattggccttatgatggaagagatgatcttcaaccttgcagatacacatctgttcttcaatgacctggaggattgtgaccagatccacgttgatgacgtctcatcagatgacaatggccaagatttaagcacatacaacttctccgctgacggcttccacagttcggccccaggagccaacctgtgcctgggctctggcgtgcacggcggcgtggactggatgaggaagctggccttccgctaccggcgggtgaaggagatgtacaatacctacaagaacaacgttggtgggttgataggcactcccaaaagggagacctggctacagctccgagctgagctggaagctctcacagacctctggctgacccactccctgaaggcactaaacctcatcaactcccggcccaactgtgtcaatgtgctggtcaccaccactcaactaattcctgccctggccaaagtcctgctatatggcctggggtctgtgtttcctattgagaacatctacagtgcaaccaagacagggaaggagagctgcttcgagaggataatgcagagattcggcagaaaagctgtctacgtggtgatcggtgatggtgtggaagaggagcaaggagcgaaaaagcacaacatgcctttctggcggatatcctgccacgcagacctggaggcactgaggcacgccctggagctggagtatttatagcaggatcagcagcatctccacctgccatctcaccctcagaccccctcgccttccccacctccccaccgagaactccagagacccagatgttggacaccaggaaggggccccacagccgagacgacgtgtccagtgaccatctcagaagccgtccatcagtccaaatgggggttctgagaaggaaagtacccaacattggcttcggagtatttgactttggggaaaagggctggctcggagtctagactcttctgtaagactcacagaacaaaagcaaggaattgctgatttggggggtgcctggtgatgaggaggggatgggtttgtcttgtcttctttttaatttatggactagtctcattactccggaattatgctcttgtacctgtgtggctgggtttcttagtcgttggtttggtttggttttttgaactggtatgtggggtggttcacagttctaatgtaagcactctattctccaagttgtgctttgtggggacaatcattctttgaacattagagaggaaggcagttcaagctgttgaaaagactattgcttatttttgtttttaaagacctacttgacgtcatgtggacagtgcacgtgccttacgctacatcttgttttctaggaagagggggatgctgggaaggaatgggtgctttgtgatggataaaaggcattaaataaaaccacgtttacattttgaaaaaaaaaaaaaaaaaaaaaaaa

SEQ ID NO: 65515 - DNA, 2762 bp, Homo sapiens
tcagtcccagccaagccacgtggactgagagtcatggggagacctagggaaattaaataactcacaaacacctgtaaaaactgttacagtgactggtgtgtgtgatagagggccatgggcctgtgaaagctgcaggagggaaatcgcttactcagggagagcctggggaaatcctgccggaactgaggcctctgcagggtgagcaggagggactggagttccaggcagagggaacagcatgtacaaaggccctgtggcaagagggagtgtggagcgagagaaaggccagcgtgctggaatcagatattggacaaggagaagccagatcaaggctgtgttcggaactctttgctttatcttaagagcaatggaaagccgtcagaggttataagcaaggatgaggtacaaggaaatggtagaactagtgatctcacccagcctcactgtaaacagcgattgtctggataaactgaagtttaaccgtgctgacgctgctgtgtggactctgagtgacagacaaggcatcaccaaatcggcccccctgagagtgtcccagctcttctccagatcttgcccacgtgtcctcccccgccagccttccacagccatggcagcctacggccagacgcagtacagtgcggggatccagcaggctaccccctatacagcttacccacctccagcacaagcctatggaatcccttcctacagcatcaagacagaagacagcttgaaccattcccctggccagagtggattcctcagctatggctccagcttcagcacctcacccactggacagagcccatacacctaccagatgcacggcacaacagggttctatcaaggaggaaatggactgggcaacgcagccggtttcgggagtgtgcaccaggactatccttcctaccccggcttcccccagagccagtacccccagtattacggctcatcctacaaccctccctacgtcccggccagcagcatctgcccttcgcccctctccacgtccacctacgtcctccaggaggcatctcacaacgtccccaaccagagttccgagtcacttgctggtgaatacaacacacacaatggaccttccacaccagcgaaagagggagacacagacaggccgcaccgggcctccgacgggaagctccgaggccggtctaagaggagcagtgacccgtccccggcaggggacaatgagattgagcgtgtgttcgtgtgggacttggatgagacaataattatttttcactccttactcacggggacatttgcatccagatacgggaaggacaccacgacgtccgtgcgcattggccttatgatggaagagatgatcttcaaccttgcagatacacatctgttcttcaatgacctggaggattgtgaccagatccacgttgatgacgtctcatcagatgacaatggccaagatttaagcacatacaacttctccgctgacggcttccacagttcggccccaggagccaacctgtgcctgggctctggcgtgcacggcggcgtggactggatgaggaagctggccttccgctaccggcgggtgaaggagatgtacaatacctacaagaacaacgttggtgggttgataggcactcccaaaagggagacctggctacagctccgagctgagctggaagctctcacagacctctggctgacccactccctgaaggcactaaacctcatcaactcccggcccaactgtgtcaatgtgctggtcaccaccactcaactaattcctgccctggccaaagtcctgctatatggcctggggtctgtgtttcctattgagaacatctacagtgcaaccaagacagggaaggagagctgcttcgagaggataatgcagagattcggcagaaaagctgtctacgtggtgatcggtgatggtgtggaagaggagcaaggagcgaaaaagcacaacatgcctttctggcggatatcctgccacgcagacctggaggcactgaggcacgccctggagctggagtatttatagcaggatcagcagcatctccacctgccatctcaccctcagaccccctcgccttccccacctccccaccgagaactccagagacccagatgttggacaccaggaaggggccccacagccgagacgacgtgtccagtgaccatctcagaagccgtccatcagtccaaatgggggttctgagaaggaaagtacccaacattggcttcggagtatttgactttggggaaaagggctggctcggagtctagactcttctgtaagactcacagaacaaaagcaaggaattgctgatttggggggtgcctggtgatgaggaggggatgggtttgtcttgtcttctttttaatttatggactagtctcattactccggaattatgctcttgtacctgtgtggctgggtttcttagtcgttggtttggtttggttttttgaactggtatgtggggtggttcacagttctaatgtaagcactctattctccaagttgtgctttgtggggacaatcattctttgaacattagagaggaaggcagttcaagctgttgaaaagactattgcttatttttgtttttaaagacctacttgacgtcatgtggacagtgcacgtgccttacgctacatcttgttttctaggaagagggggatgctgggaaggaatgggtgctttgtgatggataaaaggcattaaataaaaccacgtttacattttgaaaaaaaaaaaaaaaaaaaaaaaa

SEQ ID NO: 65516 - DNA, 381 bp, Homo sapiens
atgccggagccagcgaagtccgctcccgcgcccaagaagggctcgaagaaagccgtgactaaggcgcagaagaaggacggcaggaagcgcaagcgcagccgcaaggagagctactccgtatacgtgtacaaggtgctgaagcaggtccaccccgacaccggcatctcctctaaggccatgggaatcatgaactccttcgtcaacgacatcttcgaacgcatcgcaggtgaggcttcccgcctgccgcattacaacaagcgctcgaccatcacctccagggagatccagacggccgtgcgcctgctgctgcccggggagttggccaagcacgccgtgtccgagggcaccaaggccgtcaccaagtacaccagcgctaagtaa

SEQ ID NO: 65517 - DNA, 438 bp, Homo sapiens
atgcctgagccagccaagtctgctcccgccccgaagaagggctccaagaaggcagtgaccaaagcgcagaagaaagatggcaagaagcgcaagcgcagccgcaaggagagttactctgtgtacgtgtacaaggtgctgaaacaggtccatcccgacactggcatctcttccaaggccatgggcatcatgaattctttcgttaacgacatatttgagcgcatcgcgggcgaggcttcccgcctggcgcattacaacaagcgctcgaccatcacctccagggagatccagacggccgtgcgcctgctgcttcccggagagctggccaagcacgccgtgtcggagggcaccaaggccgtcaccaagtacaccagctccaagtaaacattccaagtaagcgtcttaacacctaaccccaaaggctcttttaagagccaccca

SEQ ID NO: 65518 - DNA, 435 bp, Homo sapiens
atgcctgagccagcgaaatccgctcccgccccgaagaagggctccaagaaggccgtgaccaaggcgcagaagaaggacggcaagaagcgcaagcgcagccgcaaggagagctactccgtatacgtgtacaaggtgctgaaacaggtccaccccgacaccggcatctcctctaaagccatggggatcatgaattcctttgtcaacgacatcttcgagcgcatcgccggcgaggcttcccgcctggcgcattacaacaagcgctcgaccatcacctccagggagatccagacggccgtgcgcctgctgcttcccggggagctggccaagcacgctgtgtcagagggcaccaaggccgttaccaagtacaccagctccaagtaaacttgtccctgcaactgccttagtaaacccaaaggctcttttcagagccactca

SEQ ID NO: 65519 - DNA, 481 bp, Homo sapiens
cacgctgtttttccttttcgttggcgctttatagctacacagtgctatgccagagccagcgaagtctgctcccgccccgaaaaagggctccaagaaggcggtgactaaggcgcagaagaaagacggcaagaagcgcaagcgcagccgcaaggagagctattccatctatgtgtacaaggttctgaagcaggtccaccctgacaccggcatttcgtccaaggccatgggcatcatgaattcgtttgtgaacgacattttcgagcgcatcgcaggtgaggcttcccgcctggcgcattacaacaagcgctcgaccatcacctccagggagatccagacggccgtgcgcctgctgctgcctggggagttggccaagcacgccgtgtccgagggtactaaggccgtcaccaagtacaccagcgctaagtaaacagtgagttggttgcaaactctcaaccctaacggctcttttaagagccaccca

SEQ ID NO: 65520 - DNA, 446 bp, Homo sapiens
atgcctgaaccagtcaaatctgctccagtccctaaaaaaggctccaagaaggccattaacaaggctcagaagaaggatggaaagaagcgcaaacgcagccgcaaggagagctactctgtgtatgtgtacaaggtgctgaagcaggtccaccccgacaccggcatctcttccaaggctatgggaatcatgaactccttcgtcaacgacatctttgagcgtatcgccggagaagcgtcacgcctggcgcattacaacaagcgctcgaccatcacttcgagggagatccagacggccgtgcgcctactgctacccggggaattggccaagcacgccgtgtccgagggcaccaaggccgtcaccaagtataccagctccaagtgagcctctcgctgcagtaacagttccgccgtgacccacaccccaaaggctcttttcagagccgtcca

SEQ ID NO: 65521 - DNA, 449 bp, Homo sapiens
atgcccgagccctcaaagtccgctcctgccccgaagaaaggctccaagaaggcagtgacaaaggcccagaagaaggacggcaagaagcgcaagcgcagccgcaaggagagctactccgtgtacgtgtacaaggtgctgaagcaggtccaccccgacaccggtatctcgtccaaggccatgggcatcatgaactccttcgtcaatgacatcttcgagcgcatcgccggcgaggcttcccgcctggcgcattacaacaagcgctcgaccatcacctccagggagatccagacggccgtgcgcctgctgctgccaggggagctggccaagcacgcggtgtcggagggcaccaaggccgtcaccaagtacaccagttccaagtgagcccgcccaccgcggaacgttcggtcagtctcggcccacaccccaaaggctcttttcagagccactca

SEQ ID NO: 65522 - DNA, 467 bp, Homo sapiens
attcttgttatttgagtgctctttcactctcctccgccatgcccgacccggctaaatctgctcctgcccccaaaaagggctccaagaaagccgtaaccaaggcccagaaaaaggacggcaagaagcgcaagcgcagccgcaaagagagttactctatctacgtgtacaaggtgctgaagcaagtccaccccgacaccggcatctcatcgaaggccatgggcatcatgaactccttcgtcaatgacatctttgagcgcatcgctggcgaggcttcccgcctggcgcattacaacaagcgctcgaccatcacctccagggagatccagacggccgtgcgcctgctgctgcccggggagctggccaagcacgccgtgtccgagggcacaaaggccgtcaccaagtacaccagctccaagtgagctctcgcagctgccagcaatccaaaggctcttttcagagccactcac

SEQ ID NO: 65523 - DNA, 4956 bp, Homo sapiens
aagaaaaaagaagaaaacaaacctccatacgagaatgggtctaaaggaacttcccaaacctccatgattttgcaggaaacaagataaagagctacaggcaggaggatcacttgaggccaggagttagagaacagtccgggcaacacagtgagacaccccccactacaaaaaacaagaagacccctctttttacccctaattgagaggcgtgactagaaggcagaaagctggctgttgaggtgggagtctctctcttcaggcagaggtagggccgcttcctggggcagaggcgtggatggtgtgtctggctctgcagttcctgatgaagacatactggggtgcccaggctaacctttggcaaaactaggagctgaactcaggagtccctgatgccagcctttctgatgcggtcccccctcccctcccccatgtgtctcgctccatagctccaggccaggagccccaactggctggtggaggatgtcttgctcctcagcagctgggatttgtaagtatttgtaggaacatggaacagatcagtggctgacaggcccaggaagcagacagtccccttcccataggtcaccagcttcacttccccttcctgcaccccatcctgatttgagggagcccaggatgacaaagagggagtagttgagcaaggtatggagtggcagtctctacaggagctcaaaggatgcatttgtccatctgccctgggctcagcttccacactcagagtcactcacatccctccaccgtcgccacagctcacctgtgtgcccacacagacaaggtcacactgaccccaaacgcacactgtttcaactctcagcacttcactgtcacactcgcgtgtgtacacacatgctttctaatttccacagccacatggatgctcacacactcacacctttgcacacacacacaagctggctcacagacacactgggggcccagatcctggtcattccccacaggtcttaataaaggttcatggaaggaaacctgtttcctaaggtagggtgggagtgtgtgtgagtgtgtgggggggagagggtgagagtgagtgtgtgcgtgtgttagtgtgtgtgtgtatgtaaggagcaggagtgactgggtcctgagtttagggagttgggaagaggaaggagagatggagacaagcctggaccaagagccactcagagctgcctggaagggaagccaggctgagataaaggcaaggcaaagaaataagacactgacaaggatcaagccagggttgggtagggactgggaacagagtctgcctccatgagaagctgtcacattgctgctctggtgccctgtgacagcggcaccatctccagctggagactcccctctctggatcttgtcattgtgactttgctttgttggacaaccaggagtggtgacaggcagggaatatggtgcccagggcagctagccatgccacgccagtccagctgccaacccacccgtcactggccatctcatcacctgccagagggagtggggtggtgcagatgaaaccagcgatcagcttggctgcccttgcttcgtagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgagacaggggctgttaagtaggaggttggagaacacacgtttttggtctaaaccgggggcccctctctttgcccactgagcccgcggcctgcgtggtgctgagactgcctctggccgcgtccgcttgggacaaggcctgagcggtggctgatcccacctggatgtcccgggccggctcccacccgaagcccgccatcccgggacgcggtggggagaagctggcgctgctccttgccatgcttggcggccgctgctgcccggctgggggtcccgagtcgcacacgccccgcaagccctggccaccgatccggagggaacgccctgggctgcggtccccgaagccaagagaagaagcaggtcccagggccgactccaaagccgcatctccagctttgttcatgggtccgggaagcagaggccgccgccggccaccgtcgtgggcgagaagaagggcacgaggcggccggggctcctgcccggaaccacatgtgcgcgccgggccccgcttcttcatcgcacttgcggcccaggctgcccggggcctgcgagtttccagccagggcccgggactctggcgcggtccggccgcgaggaaggaaggcgtggcccgggtgggggtagcggcaggcctgcggctccggccacggggcaggggcagaaaaacgaccccggcgctgtccgggcatccagctcggttcccgctgcagccaggagactcccgggagcgctctaggaaccacagagccctggaactcacctggcagcctcgcggcgctaaagccggcggagcctgagacagcgcgcggcgaggcggtcacgctccacccccgcgtggcggcaggactcggatttcgcccctggttttaaaattgtgccggtggagcccgggacgctgggaagagcgttctgcgcccctccagtcgcggtctccgccctaaaccgacttccagagccgcctctgctccctggaggggcgcagtggcggacaccggcgtcccacgaagtcgcaggtcctcagtctgagggctgccccgcacgctcggaatgcaggagggtctccgcctcgctgcgctgcccctgggggcggaggcgtgcgctgcaggcgagagaggcggcccggtatcgatggagaagcacagagggctttgaggtcgcaacctcccggttgctgagcggagtcgggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcccaggtgcccgccccacctgtccctcggtcaccccaaccctgtttcctcgacccccagcactcctccaggcctagttcgcttcagaggcgcaagacccggaaaacaaggaagaagcgagctcagcctcaatccccgtccccaccccactttcgggaccgctaagctggagaattgaagggggcggaccccggattaaagccgctcccttcccagcctcgccccgctttcctaatgtccgtgatgatttcgttattggcagggaagagccagactccctgcgctcccaagacggggcgattgggagggggttctggagctgcctggggtcggcccggcggggggtgaccccgggccctcgccggtgcaaggagaacaggtggttcccgccggggcagggaagcgtggacggtgtgggctcaggcgcctggcaggcacacggggcctctaaagcttggtcactgtcacagatcgtgtggttgtttcttccgtccccgccacgccttcctcctgggatggggattcattccctagcaggtgtcggagaactggcgcccttgcagggtaggcgccccggagcctgaggcgggaactttaaaatcagacgcttgggggccgggctgggaaaaactggcggaaaatattataactgaactctcaatgccagctgttgtagaagctcctgggacaagccgtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcggggcgcaggaggtgggctcagggttctccagagaatccccatgagctaacccgcagggcggccgggccagtaggcaccgggcccccgcggtgacctgcggacccgaagctggagcagccactgcaaatgctgtgctgaccccaaatgctgtgtcctttaaatgttttaattaagaataattaataggtccgggtgtggaggctcaagccttaatccccagcacctggcgaggccgaggagggaggatcccttgagtccagaggttcgagactagcctgggcaacacagtcagactccatccttccaaaacaaacaaacgaaaataaaacaaacagaaaacgaaattagccgggtgtggtggtgcgggcctgtggtcccagctcctcgggaggctgaggcaggaagatggcttgcgactgcaccactgcattccagccttcgcgacagagcaagaccctgtctcgaaaaatgtgtatgtctgggtaagtgtatagattttacaactattttgaaggcgacctttttaactttaaacagaccactctggaggagacccctgacccagagcgctttacctaaagttcggtgcctaaaatgcatccttcctctggctggtgtctcccttctgccaagctgtgcctcctgcagaggtaggctccgtggtgtctcccactccgccccaactggagaacggtgtaaagaactgtcagccgggtgcagtggctcacgcctgtaatctcagcactttgtgaggccgagaggggcggatcacttgaggtcagaagttcaaaaccagcctggccaacatggtgaaaccccgtctctgctacaaaaattagccaggcgtgatggtggatgcctgtaatcccagctactcaggaggctgaggcaggagaattgcttgaacccgggaggcggaggttgcagtgagcagagatggcgccactgcactccagcctgggtgacaagagcaactccg

SEQ ID NO: 65524 - DNA, 5306 bp, Homo sapiens
agcagcagcggcgtggtcagagcgagcttcggagaagcagtggtgggttccatgtgatggtggagtaggaggcaggtctccgcggttcatctgtgttgctctaaatgacactgcttcattattttgatggctggagaatatttcctagtgtatgtatatgagagtttcttgatctctttatctgtggatgaacagctactttgaaacatatggtacatttgtgttaaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggttcaacagtatggctccaaatgatgaaatttcattctgattttctggctgaagactattctctttgtgtatgtccaccacagttactttatcccttcatctgtggatgggcagtctcgctgtattgcccaggctggagtgcagtggcatgatctcagctcactgcaagctctgcttcctgggttcacgccattctcctgcctcagcctcctgagtagctgggattacaggcacccgccaccacgcccaggaaagaaaaaagaagaaaacaaacctccatacgagaatgggtctaaaggaacttcccaaacctccatgattttgcaggaaacaagataaagctccaggccaggagccccaactggctggtggaggatgtcttgctcctcagcagctgggatttgtaagtatttgtaggaacatggaacagatcagtggctgacaggcccaggaagcagacagtccccttcccataggtcaccagcttcacttccccttcctgcaccccatcctgatttgagggagcccaggatgacaaagagggagtagttgagcaaggtatggagtggcagtctctacaggagctcaaaggatgcatttgtccatctgccctgggctcagcttccacactcagagtcactcacatccctccaccgtcgccacagctcacctgtgtgcccacacagacaaggtcacactgaccccaaacgcacactgtttcaactctcagcacttcactgtcacactcgcgtgtgtacacacatgctttctaatttccacagccacatggatgctcacacactcacacctttgcacacacacacaagctggctcacagacacactgggggcccagatcctggtcattccccacaggtcttaataaaggttcatggaaggaaacctgtttcctaaggtagggtgggagtgtgtgtgagtgtgtgggggggagagggtgagagtgagtgtgtgcgtgtgttagtgtgtgtgtgtatgtaaggagcaggagtgactgggtcctgagtttagggagttgggaagaggaaggagagatggagacaagcctggaccaagagccactcagagctgcctggaagggaagccaggctgagataaaggcaaggcaaagaaataagacactgacaaggatcaagccagggttgggtagggactgggaacagagtctgcctccatgagaagctgtcacattgctgctctggtgccctgtgacagcggcaccatctccagctggagactcccctctctggatcttgtcattgtgactttgctttgttggacaaccaggagtggtgacaggcagggaatatggtgcccagggcagctagccatgccacgccagtccagctgccaacccacccgtcactggccatctcatcacctgccagagggagtggggtggtgcagatgaaaccagcgatcagcttggctgcccttgcttcgtagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgagacaggggctgttaagtaggaggttggagaacacacgtttttggtctaaaccgggggcccctctctttgcccactgagcccgcggcctgcgtggtgctgagactgcctctggccgcgtccgcttgggacaaggcctgagcggtggctgatcccacctggatgtcccgggccggctcccacccgaagcccgccatcccgggacgcggtggggagaagctggcgctgctccttgccatgcttggcggccgctgctgcccggctgggggtcccgagtcgcacacgccccgcaagccctggccaccgatccggagggaacgccctgggctgcggtccccgaagccaagagaagaagcaggtcccagggccgactccaaagccgcatctccagctttgttcatgggtccgggaagcagaggccgccgccggccaccgtcgtgggcgagaagaagggcacgaggcggccggggctcctgcccggaaccacatgtgcgcgccgggccccgcttcttcatcgcacttgcggcccaggctgcccggggcctgcgagtttccagccagggcccgggactctggcgcggtccggccgcgaggaaggaaggcgtggcccgggtgggggtagcggcaggcctgcggctccggccacggggcaggggcagaaaaacgaccccggcgctgtccgggcatccagctcggttcccgctgcagccaggagactcccgggagcgctctaggaaccacagagccctggaactcacctggcagcctcgcggcgctaaagccggcggagcctgagacagcgcgcggcgaggcggtcacgctccacccccgcgtggcggcaggactcggatttcgcccctggttttaaaattgtgccggtggagcccgggacgctgggaagagcgttctgcgcccctccagtcgcggtctccgccctaaaccgacttccagagccgcctctgctccctggaggggcgcagtggcggacaccggcgtcccacgaagtcgcaggtcctcagtctgagggctgccccgcacgctcggaatgcaggagggtctccgcctcgctgcgctgcccctgggggcggaggcgtgcgctgcaggcgagagaggcggcccggtatcgatggagaagcacagagggctttgaggtcgcaacctcccggttgctgagcggagtcgggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcccaggtgcccgccccacctgtccctcggtcaccccaaccctgtttcctcgacccccagcactcctccaggcctagttcgcttcagaggcgcaagacccggaaaacaaggaagaagcgagctcagcctcaatccccgtccccaccccactttcgggaccgctaagctggagaattgaagggggcggaccccggattaaagccgctcccttcccagcctcgccccgctttcctaatgtccgtgatgatttcgttattggcagggaagagccagactccctgcgctcccaagacggggcgattgggagggggttctggagctgcctggggtcggcccggcggggggtgaccccgggccctcgccggtgcaaggagaacaggtggttcccgccggggcagggaagcgtggacggtgtgggctcaggcgcctggcaggcacacggggcctctaaagcttggtcactgtcacagatcgtgtggttgtttcttccgtccccgccacgccttcctcctgggatggggattcattccctagcaggtgtcggagaactggcgcccttgcagggtaggcgccccggagcctgaggcgggaactttaaaatcagacgcttgggggccgggctgggaaaaactggcggaaaatattataactgaactctcaatgccagctgttgtagaagctcctgggacaagccgtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcggggcgcaggaggtgggctcagggttctccagagaatccccatgagctaacccgcagggcggccgggccagtaggcaccgggcccccgcggtgacctgcggacccgaagctggagcagccactgcaaatgctgtgctgaccccaaatgctgtgtcctttaaatgttttaattaagaataattaataggtccgggtgtggaggctcaagccttaatccccagcacctggcgaggccgaggagggaggatcccttgagtccagaggttcgagactagcctgggcaacacagtcagactccatccttccaaaacaaacaaacgaaaataaaacaaacagaaaacgaaattagccgggtgtggtggtgcgggcctgtggtcccagctcctcgggaggctgaggcaggaagatggcttgcgactgcaccactgcattccagccttcgcgacagagcaagaccctgtctcgaaaaatgtgtatgtctgggtaagtgtatagattttacaactattttgaaggcgacctttttaactttaaacagaccactctggaggagacccctgacccagagcgctttacctaaagttcggtgcctaaaatgcatccttcctctggctggtgtctcccttctgccaagctgtgcctcctgcagaggtaggctccgtggtgtctcccactccgccccaactggagaacggtgtaaagaactgtcagccgggtgcagtggctcacgcctgtaatctcagcactttgtgaggccgagaggggcggatcacttgaggtcagaagttcaaaaccagcctggccaacatggtgaaaccccgtctctgctacaaaaattagccaggcgtgatggtggatgcctgtaatcccagctactcaggaggctgaggcaggagaattgcttgaacccgggaggcggaggttgcagtgagcagagatggcgccactgcactccagcctgggtgacaagagcaactccg

SEQ ID NO: 65525 - DNA, 4957 bp, Homo sapiens
aagaaaaaagaagaaaacaaacctccatacgagaatgggtctaaaggaacttcccaaacctccatgattttgcaggaaacaagataaagagctacaggcaggaggatcacttgaggccaggagttagagaacagtccgggcaacacagtgagacaccccccactacaaaaaacaagaagacccctctttttacccctaactgagaggcgtgactagaaggcagaaagctggctgttgaggtgggagtctctctcttcaggcagaggtagggccgcttcctggggcagaggcgtgggtggtgtgtctggctctgcagttcctgatgaagacatactggggtgcccaggctaacctttggcaaaactaggagctgaactcaggagtccctgatgccagcctttctgatgcggtcccccctcccctcccccatgtgtctcgctccatagctccaggccaggagccccaactggctggtggaggatgtcttgctcctcagcagctgggatttgtaagtatttgtaggaacatggaacagatcagtggctgacaggcccaggaagcagacagtccccttcccataggtcaccagcttcacttccccttcctgcaccccatcctgatttgagggagcccaggatgacaaagagggagtagttgagcaaggtatggagtggcagcctctacaggagctcaaaggatgcatttgtccatctgccctgggctcagcttccacactcagagtcactcacatccctccaccgtcgccacagctcacctgtgtgcccacacggccaaggtcacactgaccccaaacgcacactgtttcaactctcagcacttcactgtcacactcgcgtgtgtacacacatgctttctaatttccacagccacatggatgctcacacactcacacctttgcacacacacacaagctggctcacagacacactgggggcccagatcctggtcattccccacaggtcttaataaaggttcatggaaggaaacctgtttcctaaggtagggtgggagtgtgtgtgagtgtgtgggggggagagggtgagagtgtgtgcgtgtgttagtgtgagtgtgtgtgtatgtaaggagcaggagtgactgggtcctgagtttagggagttgggaagaggaaggagagatggagacaagcctggaccaagagccactcagagctgcctggaagggaagccaggctgagaaaaaggcaaggcaaagaaataagacactgacaaggatcaagccagggttgagtagggactgggaacagagtctgcctccatgagaagctgtcacattgctgctctggtgccctgtgacagcggcaccatctccagctggagactcccctctctggatcttgtcattgtgactttgctttgttggacaaccaggagtggtgataggcagggaatatggtgcccaggtcagctagccatgccacgccagtccagctgccaacccacccgtcactggccatctcatcacctgctggagggagtggggtggtgcagatgaaaccagcgatcagcttggctgcccttgcttcctagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgagacaggggcttttaagtaggaggttggagaacacacgtttttggtctaaaccgggggcccctctctttgcccactgaacccgcggcctgcgtggtgctgagactgcctctggccgcgtccgcttgggacagggcctgagcggtggctgatcccacctggatgtcctgggccggctcccacccgacgcccaccatcccgggacgtggtggggagaggctggcgctgctccttgccatgcttggcggccgctgctgcccggctgggggtcccgagtcgcacacgccccgcaagccctggccaccgacccggagggaacgccctgggctacggtccccaaagccaagagaagaagcaggtcccagggccgactccaaagccgcatctccagctttgttcatgggtccgggaagcagaggccgccgccggccaccgtcgtgggcgagaagaagggcacgaggcggccggggctcctgcccggaaccacatgtgcgcgccgggcccgcttcttcatcgcacttgcggccccggctgcccggggcctgcgagtttccagccagggcccgggactctggcgcggtccggccgcgaggaaggaaggcgcggcccgggtgggggtagcggcaggcctgcggctccggccacggggcgggggcagaaaaacgaccccggcgctgtccgggcatccagctcggttcccgctgcagccaggagactcccgggagcgctctaggaaccacagagccctggaagtcacctggcagcctcgcggcgctaaagccggcggagcctgagacagcgcgcggcgaggcggtcacgctccacccccgcgtggcagcaggactcggatttcgcccctggttttaaaattgtgccggtggagcccgggacgctgggaagagcgttctgcgcccctccagtcgcggtctccgccctaaaccgacttccagagccgcctctgctccctggaggggcgcagtggcggacaccggcgtcccacgaagtcgcaggtcctcagtctgagggctgccccgcacgctcggaatgcaggagggtctccgcctcgctgcgctgcccctgggggcggaggcgtgcgctgcaggcgagagaggcggcccggtatcgatggagaagcacagagggctttgaggtcgcaacgtcccggttgctgagcggagtcgggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcccaggtgcccgccccacctgtccctcggtcaccccaaccctgtttcctcgacccccagcactcctccaggcctagttcgcttcagaagcgcaagacccggaaaacaaggaagaagcgagctcagcctcaatccccgtccccaccccactttcgggaccgctacgctggagaattgaagggggcggaccccggattaaagccgctcccttcccagcctcgccccgctttcctaatgtccgtgatgatttcgttattggcagggaagagccaggctccctgcgctcccaagacggggcgattgggagggggttctggagctcacgcctggggtcggcccggcgggggtgaccccgcgccctcgccggtgcaaggagaacaggtggttcccgccggggcagggaagcgtggacggtgtgggctcaggcgcctggcaggcacgcggggcctctaaagcttggtcgctgtcacagatcgtgtggttgtttcttccgtccccgccacgccttcctcctgggatggggattcattccctagcaggtgtcggagaactggcgcccttgcagggtaggcgccccggagcctgaggcgggaactttaaaatcagacgcttgggggccgggctgggaaaaactggcggaaaatattataactgaactctcaatgccagctgttgtagaacctcctgggacaagcggtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcgaggcgcaggagatgggctcagggttctccagagaatccccatgagctgacccgcagggcggccgggccagtaggcaccgggcccccgcggtgacctgcggccccgaagctggagcagccactgcaaatgctgcgctgaccccaaatgctgtgtcctttaaatgttttaattaagaataattaataggtccgggtgtggaggctcaagccttaatccccagcacctggcgaggccgaggagggaggatcccttgagcccagaggttcgagactagcctgggcaacacagtcagactccatccttccaaaacaaacaaacgaaaataaaacaaacagaaaacgaaattagccgggtgtggtggtgcgggcctgtggtcccagctcctcgggaggctgaggcaggaagatggcttgcgactgcaccactgcattccagccttcgcgacagagcaagaccctgtctcgaaaaatgtgtatgtctgggtaagtgtatagattttacaactattttgaaggcgacctttttaactttaaacagaccactctggaggagacgcctgacccagagcgctttacctaaagttcggtgcctaaagtgcacccttcctctggctggtgtctcccttctgccaagctatgcctcctgcagaggtaggctccgtggtgtctcccactccgccccaactggagaacggtgtaaagaactgtcagccgggtgcagtggctcacgcctgtaatctcagcactttgtgaggccgagaggggcggatcacttgaggtcagaagttcaaaaccagcctggccaacatggtgaaaccccgtctctgctacaaaaattagccaggcgtgatggtggatgcctgtaatcccagctactcaggaggctgaggcaggagaattgcttgaacccgggaggcggaggttgcagtgagcagagatggcgccactgcactccagcctgggtgacaagagcaactccg

SEQ ID NO: 65526 - DNA, 5307 bp, Homo sapiens
agcagcagcggcgtggtcagagcgagcttcggagaagcagtggtgggttccatgtgatggtggagtaggaggcaggtctccgcggttcatctgtgttgctctaaatgacactgtttcattattttgatggctggagaatatttcctagtgtatgtatatgagagtttcttgatctctttatctgtggatgaacagctactttgaaacatatgatacatttgtgttaaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggttcaacagtatggctccaaaggatgaaatttcattctgattttctggctgaagactattctctttgtgtatgtccaccacagttactttatcccttcatctgtggatgggcagtctcgctgtattgcccaggctggagtgcagtggcatgatctcagctcactgcaagctctgcttcctgggttcacgccattctcctgcctcagcctcctgagtagctgggattacaggcacccgccaccacgcccaggaaagaaaaaagaagaaaacaaacctccatacgagaatgggtctaaaggaacttcccaaacctccatgattttgcaggaaacaagataaagctccaggccaggagccccaactggctggtggaggatgtcttgctcctcagcagctgggatttgtaagtatttgtaggaacatggaacagatcagtggctgacaggcccaggaagcagacagtccccttcccataggtcaccagcttcacttccccttcctgcaccccatcctgatttgagggagcccaggatgacaaagagggagtagttgagcaaggtatggagtggcagcctctacaggagctcaaaggatgcatttgtccatctgccctgggctcagcttccacactcagagtcactcacatccctccaccgtcgccacagctcacctgtgtgcccacacggccaaggtcacactgaccccaaacgcacactgtttcaactctcagcacttcactgtcacactcgcgtgtgtacacacatgctttctaatttccacagccacatggatgctcacacactcacacctttgcacacacacacaagctggctcacagacacactgggggcccagatcctggtcattccccacaggtcttaataaaggttcatggaaggaaacctgtttcctaaggtagggtgggagtgtgtgtgagtgtgtgggggggagagggtgagagtgtgtgcgtgtgttagtgtgagtgtgtgtgtatgtaaggagcaggagtgactgggtcctgagtttagggagttgggaagaggaaggagagatggagacaagcctggaccaagagccactcagagctgcctggaagggaagccaggctgagaaaaaggcaaggcaaagaaataagacactgacaaggatcaagccagggttgagtagggactgggaacagagtctgcctccatgagaagctgtcacattgctgctctggtgccctgtgacagcggcaccatctccagctggagactcccctctctggatcttgtcattgtgactttgctttgttggacaaccaggagtggtgataggcagggaatatggtgcccaggtcagctagccatgccacgccagtccagctgccaacccacccgtcactggccatctcatcacctgctggagggagtggggtggtgcagatgaaaccagcgatcagcttggctgcccttgcttcctagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgagacaggggcttttaagtaggaggttggagaacacacgtttttggtctaaaccgggggcccctctctttgcccactgaacccgcggcctgcgtggtgctgagactgcctctggccgcgtccgcttgggacagggcctgagcggtggctgatcccacctggatgtcctgggccggctcccacccgacgcccaccatcccgggacgtggtggggagaggctggcgctgctccttgccatgcttggcggccgctgctgcccggctgggggtcccgagtcgcacacgccccgcaagccctggccaccgacccggagggaacgccctgggctacggtccccaaagccaagagaagaagcaggtcccagggccgactccaaagccgcatctccagctttgttcatgggtccgggaagcagaggccgccgccggccaccgtcgtgggcgagaagaagggcacgaggcggccggggctcctgcccggaaccacatgtgcgcgccgggcccgcttcttcatcgcacttgcggccccggctgcccggggcctgcgagtttccagccagggcccgggactctggcgcggtccggccgcgaggaaggaaggcgcggcccgggtgggggtagcggcaggcctgcggctccggccacggggcgggggcagaaaaacgaccccggcgctgtccgggcatccagctcggttcccgctgcagccaggagactcccgggagcgctctaggaaccacagagccctggaagtcacctggcagcctcgcggcgctaaagccggcggagcctgagacagcgcgcggcgaggcggtcacgctccacccccgcgtggcagcaggactcggatttcgcccctggttttaaaattgtgccggtggagcccgggacgctgggaagagcgttctgcgcccctccagtcgcggtctccgccctaaaccgacttccagagccgcctctgctccctggaggggcgcagtggcggacaccggcgtcccacgaagtcgcaggtcctcagtctgagggctgccccgcacgctcggaatgcaggagggtctccgcctcgctgcgctgcccctgggggcggaggcgtgcgctgcaggcgagagaggcggcccggtatcgatggagaagcacagagggctttgaggtcgcaacgtcccggttgctgagcggagtcgggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcccaggtgcccgccccacctgtccctcggtcaccccaaccctgtttcctcgacccccagcactcctccaggcctagttcgcttcagaagcgcaagacccggaaaacaaggaagaagcgagctcagcctcaatccccgtccccaccccactttcgggaccgctacgctggagaattgaagggggcggaccccggattaaagccgctcccttcccagcctcgccccgctttcctaatgtccgtgatgatttcgttattggcagggaagagccaggctccctgcgctcccaagacggggcgattgggagggggttctggagctcacgcctggggtcggcccggcgggggtgaccccgcgccctcgccggtgcaaggagaacaggtggttcccgccggggcagggaagcgtggacggtgtgggctcaggcgcctggcaggcacgcggggcctctaaagcttggtcgctgtcacagatcgtgtggttgtttcttccgtccccgccacgccttcctcctgggatggggattcattccctagcaggtgtcggagaactggcgcccttgcagggtaggcgccccggagcctgaggcgggaactttaaaatcagacgcttgggggccgggctgggaaaaactggcggaaaatattataactgaactctcaatgccagctgttgtagaacctcctgggacaagcggtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcgaggcgcaggagatgggctcagggttctccagagaatccccatgagctgacccgcagggcggccgggccagtaggcaccgggcccccgcggtgacctgcggccccgaagctggagcagccactgcaaatgctgcgctgaccccaaatgctgtgtcctttaaatgttttaattaagaataattaataggtccgggtgtggaggctcaagccttaatccccagcacctggcgaggccgaggagggaggatcccttgagcccagaggttcgagactagcctgggcaacacagtcagactccatccttccaaaacaaacaaacgaaaataaaacaaacagaaaacgaaattagccgggtgtggtggtgcgggcctgtggtcccagctcctcgggaggctgaggcaggaagatggcttgcgactgcaccactgcattccagccttcgcgacagagcaagaccctgtctcgaaaaatgtgtatgtctgggtaagtgtatagattttacaactattttgaaggcgacctttttaactttaaacagaccactctggaggagacgcctgacccagagcgctttacctaaagttcggtgcctaaagtgcacccttcctctggctggtgtctcccttctgccaagctatgcctcctgcagaggtaggctccgtggtgtctcccactccgccccaactggagaacggtgtaaagaactgtcagccgggtgcagtggctcacgcctgtaatctcagcactttgtgaggccgagaggggcggatcacttgaggtcagaagttcaaaaccagcctggccaacatggtgaaaccccgtctctgctacaaaaattagccaggcgtgatggtggatgcctgtaatcccagctactcaggaggctgaggcaggagaattgcttgaacccgggaggcggaggttgcagtgagcagagatggcgccactgcactccagcctgggtgacaagagcaactccg

SEQ ID NO: 65527 - DNA, 703 bp, Homo sapiens
cgcgaaccataacgcagcgtcatgcgcacagcctctgtaagtacacagtcgtttccggtagaccccgagcctaccgctctgcttgcgttctcgggggtcggtgtcggtcttgggtctggccatgcctgagcctgcaaagttcgcgccggctcccaagaagggctccaagaaagccgtcaccaaagcccagaagaaagacggcaagaagcgcaagcgcagccgcaaggagagctactccatctacgtgtacaaggtgctgaagcgggtccaccccgacaccggcatctggtgcaaggccatgggcatcatgaactccttcctcaacgacatcttcgagcgcatcgcgggagaggcgtcccgcctggcgcactacaacaagcgctccaccatcacgtcccggagatccagacggccgtgcgcctgctgctgcccggcgagctggccaagcacgccgtgtccgagggcaccaaggcggtcaccaagtacgccagctccaagtgagtccctgccgggacctggcgctcgctcgctccctccctccctccctccgcgggtcgccggctgctttgtctccaaaggctcttttcagggccatttaaccacctcagttaaagaatctttcttgtgttgtcagtcccagttgatgtttttggcttcacgtctggttaactttaggagagcacacaacaccaagcacagataa

SEQ ID NO: 65528 - DNA, 741 bp, Homo sapiens
ctgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggtaagcaggcattcccaatgctgaggccagcctgaaacccagacattcagggaaacctggaggctgtggccaacactacgtgagcccctcccttcccagtgggcaccatgtgcttgcattcatgaccatgtggtgtgtgcagggaacagcagaggtcagtgtggctggatcccaaggggaatggggggcagaggggagatgcagagaccagggcacagaggctcccctgtgtcccactcagaaagttggtttcacatttaagttatggttgctccttggaaaagacaccaaatccttgcagaagaagccacctctgaatagtcaatgagatgaactagtccggtaggaatcgggcccaccgctcaaatccagatttaagtagtcctggcggccaacttctaag

SEQ ID NO: 65529 - DNA, 1857 bp, Homo sapiens
gcgctgccctgggcgggcttgcacccccacacccaagtgagcggcctgctcactcctcagctgcaggagccagacgtgtggagtcccagcagaggccaacctgtgtctcttcatctccctgggaaaggtgcccccgaggtgaaagagatggcctggtggaaatcctggattgaacaggagggtgtcacagtgaagagcagctcccacttcaacccagaccctgatgcagagaccctctacaaagccatgaaggggatcgggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccaggactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggtgactacaagaacgccctgctgagcctggtgggcagcgacccctgaggcacagaagaacaagagcaaagaccatgaagccagagtctccaggactcctcactcaacctcggccatggacgcaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaa

SEQ ID NO: 65530 - DNA, 1474 bp, Homo sapiens
gcgctgccctgggcgggcttgcacccccacacccaagtgagcggcctgctcactcctcagctgcaggagccagacgtgtggagtcccagcagaggccaacctgtgtctcttcatctccctgggaaaggtgcccccgaggtgaaagagatggcctggtggaaatcctggattgaacaggagggtgtcacagtgaagagcagctcccacttcaacccagaccctgatgcagagaccctctacaaagccatgaaggggatcgggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccaggactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggtaagcaggcattcccaatgctgaggccagcctgaaacccagacattcagggaaacctggaggctgtggccaacactacgtgagcccctcccttcccagtgggcaccatgtgcttgcattcatgaccatgtggtgtgtgcagggaacagcagaggtcagtgtggctggatcccaaggggaatggggggcagaggggagatgcagagaccagggcacagaggctcccctgtgtcccactcagaaagttggtttcacatttaagttatggttgctccttggaaaagacaccaaatccttgcagaagaagccacctctgaaaagtcaatgagatgaactagtccggtaggaatcgggcccaccgctcaaatccagatttaagtagtcctggcggccaacttctaag

SEQ ID NO: 65531 - DNA, 1960 bp, Homo sapiens
ctggatctggcctgaacccaccaagaatgaagtctgccagcagggaatagtgaagccatgcagtgctccgtcatgctgggccttcctattcacttcaccttgaagcctcgcatcagtctcacttcccagatgagtcagggaggttgagtaatgaagccatactgcaccatcaaggcaggaagtgaacacatgcctacctcactcaaagcccatgctccttctgcagccctaagtgaaaatgccaaccttccccacccagatgccaagtctctgagcagtacccatgggagcaagcatgggcccagtctctggaccagacgcccccaggtgccttagtcctgtggggccaaactccacttgtcacatgggaattcaaaatgcagggttcctgctgataagtgtgagagagagggcactctgaggccagcagccaccatcccatggtgcttctgtggagctgagaggctggatttttggtggaggtgtctctgggttgagagcccagggcctgtcctgagtctgagctgcccttggatgggcttgagctggtgtcttcagacgagccccacagtctggtgcatttcacatcttacccttttgcctgcctgcttgggcctttggagctgtgcccagtgccccgggctaccttccctgtcccacgccacctgacacaaagcctctcacattgggaaaggcacggaacaaagaaatatgccaagccttgcacaacactgactcttaagacctaaggcaagacataaagttgtaggcagtgccacctaccagctccagacattaacacagctttcttgtttgccagtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggagtggaactgtctctgattcattttccacatcaatcctgcatgtagttggaagacaccagcggtgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcggtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaa

SEQ ID NO: 65532 - DNA, 1530 bp, Homo sapiens
ccctgaagttagttccacacccgaaacccaagccctctggccacttctgcccaggaaatgagagagggcatgcgattcccttggccatgtggccccagctgacatgagactggtcagggatgaaggtgagcaggaaggccctgcctgtgaaattcctggctgagctgattgctgccattgctctagtaggaagtcttgttcctggagcagtgagtattttgtgtctagaatctgatgtggcaaaccaaacatactgcagtttggagcacttggcatcataaaggaagagttctgggcagtgggtgagaaggaattaagggagtggacaccctaagccaccaaagcttccctcctaatgcttccctggctgaagcacaggctccttcccacatctccctccctctaaaagccccagaacccaaccacacagatccgtccatcactcagagatggacaggaaaggtgaggcaggattgttgatggctgctgtcttgcccagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggtgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcggtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaa

SEQ ID NO: 65533 - DNA, 1060 bp, Homo sapiens
tttttgagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggtgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcggtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaa

SEQ ID NO: 65534 - DNA, 1222 bp, Homo sapiens
caagagtgagacccatggctcactggaggaggccatgctcactgtggcaccaagtgcaaagccaaggagctcaaagccaccacgatcctccacacgggggagttatcttacccaaacctgtcgtggatcagaaaggttttagttctcggaggtgaaattgagtctgggaaagggacgctgcatctccagagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggtgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcggtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaa

SEQ ID NO: 65535 - DNA, 1849 bp, Homo sapiens
cgaggggacggcaggcaggtgtggcgctgccctgggcgggcttgcacccccacacccaagtgagcggcctgctcactcctcagctgcaggagccagacgtgtggagtcccagcagaggccaacctgtgtctcttcatctccctgggaaaggtgcccccgaggtgaaagagatggcctggtggaaatcctggattgaacaggagggtgtcacagtgaagagcagctcccacttcaacccagaccctgatgcagagaccctctacaaagccatgaaggggatcggtgtcgggtcccaactgctcagccaccaagcagctgccttcgccttcccctcctccgccctcaccagtgtgtcaccctgggggcagcagggtcacttgtgctgtaaccctgcagggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcagcagggatgatgtgagcagctttgtggacccaggactggccctccaagacgcacaggatctgtatgcggcaggcgagaagattcgtgggactgatgagatgaaattcatcaccatcctgtgcacgcgcagtgccactcacctgctgagagtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggtgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcggtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaa

SEQ ID NO: 65536 - DNA, 1738 bp, Homo sapiens
ccacgctccctaatctatctttggcgcaggggaggcttcttattcctgtttatggatcgggatgcttaggctccaggacatggagcagcctgtctgagaccacccagctaaggagggagagctgagacagggcttccccgtcacagcacttgccctcaatgttcatcactgaagcatgtgattttctcatcacatcctcccacttcaagtggggcagggcagtgaggtccttcctgaggctcaggcatcttgagaaaagaaggtgtggacagagcagaaggtcatggcagagcactccagcaggcagaggtttctgtccacagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccaggactggccctccaagacgcacaggatctgtatgcggcaggcgagaagattcgtgggactgatgagatgaaattcatcaccatcctgtgcacgcgcagtgccactcacctgctgagagtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggtgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcggtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaa

SEQ ID NO: 65537 - DNA, 1982 bp, Homo sapiens
gtggcgctgccctgggcgggcttgcacccccacacccaagtgagcggcctgctcactcctcagctgcaggagccagacgtgtggagtcccagcagaggccaacctgtgtctcttcatctccctgggaaaggtgcccccgaggtgaaagagatggcctggtggaaatcctggattgaacaggagggtgtcacagtgaagagcagctcccacttcaacccagaccctgatgcagagaccctctacaaagccatgaaggggatcgggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccaggactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggtgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcggtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaa

SEQ ID NO: 65538 - DNA, 1455 bp, Homo sapiens
tcctggtgtgcctcctgcaggtgtcacagcctaggctcttgggagtgccttggtttgggagtcccaacagctccaccccagggagcagcccttgaatagcgccacaagagtcaggggcagcagggatgatgtgagcagctttgtggacccaggactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggtgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcggtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaa

SEQ ID NO: 65539 - DNA, 1693 bp, Homo sapiens
gcgctgccctgggcgggcttgcacccccacacccaagtgagcggcctgctcactcctcagctgcaggagccagacgtgtggagtcccagcagaggccaacctgtgtctcttcatctccctgggaaaggtgcccccgaggtgaaagagatggcctggtggaaatcctggattgaacaggagggtgtcacagtgaagagcagctcccacttcaacccagaccctgatgcagagaccctctacaaagccatgaaggggatcgggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccaggactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggtgactacaagaacgccctgctgagcctggtgggcagcgacccctgaggcacagaagaacaagagcaaagaccatgaagccagagtctccaggactcctcactcaacctcggccatggacgcagacagatgcctcagcatgaagggcttggggacttgtggatcattccttcctccctgcaggagcttcccaagctggtcacagagtctcctgggcacagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattc

SEQ ID NO: 65540 - DNA, 1745 bp, Homo sapiens
gcgctgccctgggcgggcttgcacccccacacccaagtgagcggcctgctcactcctcagctgcaggagccagacgtgtggagtcccagcagaggccaacctgtgtctcttcatctccctgggaaaggtgcccccgaggtgaaagagatggcctggtggaaatcctggattgaacaggagggtgtcacagtgaagagcagctcccacttcaacccagaccctgatgcagagaccctctacaaagccatgaaggggatcgggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccaggactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggtgactacaagaacgccctgctgagcctggtgggcagcgacccctgaggcacagaagaacaagagcaaagaccatgaagccagagtctccaggactcctcactcaacctcggccatggacgcaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaa

SEQ ID NO: 65541 - DNA, 1865 bp, Homo sapiens
gcgctgccctgggcgggcttgcacccccacacccaagtgagcggcctgctcactcctcagctgcaggagccagacgtgtggagtcccagcagaggccaacctgtgtctcttcatctccctgggaaaggtgcccccgaggtgaaagagatggcctggtggaaatcctggattgaacaggagggtgtcacagtgaagagcagctcccacttcaacccagaccctgatgcagagaccctctacaaagccatgaaggggatcgggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccaggactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggtgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcggtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattc

SEQ ID NO: 65542 - DNA, 1699 bp, Homo sapiens
aggagcacgtttctctccgtgtaaccggtaaagatactgatgctaagagaagctaaggagctggcccaagaaacccagccagcacgtggcaaggcccacgcagaatccagcccaagcccctggacccagccaccactccgctgcctgcactcagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccaggactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggtgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcggtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaa

SEQ ID NO: 65543 - DNA, 1834 bp, Homo sapiens
ccacgctccctaatctatctttggcgcaggggaggcttcttattcctgtttatggatcgggatgcttaggctccaggacatggagcagcctgtctgagaccacccagctaaggagggagagctgagacagggcttccccgtcacagcacttgccctcaatgttcatcactgaagcatgtgattttctcatcacatcctcccacttcaagtggggcagggcagtgaggtccttcctgaggctcaggcatcttgagaaaagaaggtgtggacagagcagaaggtcatggcagagcactccagcaggcagaggtttctgtccacagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccaggactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggtgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcggtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaa

SEQ ID NO: 65544 - DNA, 1982 bp, Homo sapiens
gtggcgctgccctgggcgggcttgcacccccacacccaagtgagcggcctgctcactcctcagctgcaggagccagacgtgtggagtcccagcagaggccaacctgtgtctcttcatctccctgggaaaggtgcccccgaggtgaaagagatggcctggtggaaatcctggattgaacaggagggtgtcacagtgaagagcagctcccacttcaacccagaccctgatgcagagaccctctaccaagccatgaaggggatcgggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccaggactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggcgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcagtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaa

SEQ ID NO: 65545 - DNA, 1474 bp, Homo sapiens
gcgctgccctgggcgggcttgcacccccacacccaagtgagcggcctgctcactcctcagctgcaggagccagacgtgtggagtcccagcagaggccaacctgtgtctcttcatctccctgggaaaggtgcccccgaggtgaaagagatggcctggtggaaatcctggattgaacaggagggtgtcacagtgaagagcagctcccacttcaacccagaccctgatgcagagaccctctaccaagccatgaaggggatcgggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccaggactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggtaagcaggcattcccaatgctgaggccagcctgaaacccagacattcagggaaacctggaggctgtggccaacactacgtgagcccctcccttcccagtgggcaccatgtgcttgcattcatgaccatgtggtgtgtgcagggaacagcagaggtcagtgtggctggatcccaaggggaatggggggcagaggggagatgcagagaccagggcacagaggctcccctgtgtcccactcagaaagttggtttcacatttaagttatggttgctccttggaaaagacaccaaatccttgcagaagaagccacctctgaatagtcaatgagatgaactagtccggtaggaatcgggcccaccgctcaaatccagatttaagtagtcctggcggccaacttctaag

SEQ ID NO: 65546 - DNA, 1296 bp, Homo sapiens
ccctgaagttagttccacacccgaaacccaagccctctggccacttctgcccaggaaatgagagagggcatgcgattcccttggccatgtggccccagctgacatgagactggtcagggatgaaggtgagcaggaaggccctgcctgtgaaattcctggctgagctgattgctgccattgctctagtaggaagtcttgttcctggagcagtgagtattttgtgtctagaatctgatgtggcaaaccaaacatactgcagtttggagcacttggcatcataaaggaagagttctgggcagtgggtgagaaggaattaagggagtggacaccctaagccaccaaagcttccctcctaatgcttccctggctgaagcacaggctccttcccacatctccctccctctaaaagccccagaacccaaccacacagatccgtccatcactcagagatggacaggaaaggtgaggcaggattgttgatggctgctgtcttgcccagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggcgactacaagaacgccctgctgagcctggtgggcagcgacccctgaggcacagaagaacaagagcaaagaccatgaagccagagtctccaggactcctcactcaacctcggccatggacgcaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaa
